United States Patent 8,952,217 (PROCESS FOR DECREASING VERBASCOSE IN A PLANT BY EXPRESSION OF A CHLOROPLAST-TARGETED FIMD PROTEIN) - sequence listing, part 12

SEQ ID NO: 58622 - protein, 632 aa, Danio rerio
MLPSTRKDFVSLTLSESGSYSNSKQWRRQSCWRKWKQLSRLQRSLILLTLMLLLVCGIATSPTLIGHWRGMNGDDVKNSFVVDLKNEYRSILPEPPSERKDFDRRGAFGLEKLLQGKVNVSGVLGDQNHGLDLKNADKGSEGQKPIISWRGAVIEEEQASDTDTKDTENQGDPASLALAESRLEAVREAFRHAWKGYKDFAWGHDELKPISKSYGEWFGLGLTLIDALDTMWILGLQEEFAEAREWVAKELSFDKNVDVNLFESTIRILGGLLSTYHLTGDNLFLDKAKEIGFRLMPAFSTPSKIPYSDVNIGKGTAHPPRWTSDSTVAEVTSIQLEFRELSRLTGDPKYKLAVMEVMKQVHKLDGKQDGLVPMFINTNNGLFTHQGIYTLGARADSYYEYLLKQWIQGGRIEQELLEDYLQAVEGVKKNLLKKSTPLGLTFVGELSHGHFSPKMDHLVCFLPGTLALGVHYGLPADHMELAKQLIETCYQMYAQMETGLSPEIAHFNMHDGSTQDVDVKIADRHNLLRPETVESLFYLYRLTRDKKYQQWGWEILQNFNKYTRVPTGGYTSINNVRDPSYTSPRDKMESFFLGETLKYFYLLFSEDPTLISLDKYVFNTEAHPLPVWPQAE

SEQ ID NO: 58623 - DNA, 2304 bp, Danio rerio
  CDS (1)..(2304)
atgtccaccttcccaagccatgactggtgcgcgcaagaatccctcgtcatctcatggtcaatgtgtgtaaggaggcctgtggtgtgtgtcactgtaatgctgctgttcacagtggcccacagtaaacgctcctgtgattattcagtgatcatcagcacctacaaggcgctcatcctggtcgagctccaagccctgaatctgactggttcgtttgatatatcaaaagaaaaggaccactgtcctgagaaggtacagcctgagaaggttcgctgcctcctgcggtatatctatggcaggactcagatcttcaactgcttgagtgacagtcggatgcagcagcagtcagaccgcatgactgaggtggtgaaacaaatgcagaggctcctcacacaagactgcctcaaaccgcaaaaaatgaaaaaagcatcttgtaaaccggtgaagaagcgcagaggacggctgcggcagagactgaagctgatgaggatgatcattaacacattcgctcgcacgcacgcgcagtgtgtgcacttcctattattattattgtatagtatttgtgcacctccatgtagccgggaattattgtattatttacctctgttcacatctcgttacttcatgcttactttccttttctccgccattttctgcgccgcgtacctgtctccgatcatcagtcatgttaaaggcagagactttactgagcaggaaatgtctcattacagggacagagtaaagtccatgttttatcatgcatataacagctatctggacaatgcatatccatatgatgagctgaggccgctgacctgtgatggacaggacacctggggcagttctcccctcacactcatagatgctctggacacattgttgattctaggaaaccacacagagtttcagcgtgtggcctctctgcttcaggacactgttgacttcgacatcgacgtcaatgcgtctgtgtttgagacaaatatacgagtggtcggtgggcttctctcggctcatctgctctccaagcgtgctgggatgaaggtggaggagggctggccctgctctggaccccttctgcgcatggcagaggacgcagctcgaaaactgcttcctgctttccagacgcccacagggatgccgtatggaacagtaaacctgctgcggggagtgaaccccggcgaaacccctgtcttctgcaccgccggagtgggcaccttcatcctagagttttccaccctcagtcgactcaccggtgaccctgtgttcgagaatgttgcccgcaaagctctcagggccttatggagaacgcgctctgacatcggcctggtgggcaatcacatagatgtcataacctcgaagtgggtcgctcaggatgcaggcattggagcaggagttgattcatatttcgaatatcttgttaagggtgccatcatgcttcaagatgagaagctgttgacaatgttttatgaatttgataagtccataaagaactacactaagtttgatgattggtatctgtgggtgcagatgcacaaaggaacagtatcaatgcctgtgtttcagtctttggaggcgttctggcctggaatgcagagtttaataggtgatatttccagtgctacaaagagcttccacaactactacagcgtgtggcggcagtttggaggtctcccagaattctacagcattcctcaaggttacacagtggacaagcgagagggatatccactgcggccagagttaatagagagcgcaatgtatctgtataaggccactggagacccttcattcatccaacttggccgagatgcagtggagtccattgacagaatcagccgggtcaactgtggctttgccactgtaaaggatgtaagggaccacaagttggacaaccgcatggaatccttcttcctagccgagaccattaaatacctctacctcctcttcgatcctgacaacttccttcacaacacgggcacagagtttgagctggggggtctgcggggtgactgtattctcagcgcggggggctatgtgttcaacacagaggctcatcccctggaccccgccgcactccactgctgcagccgagagcagcaggaccgcagggagattcaggacatcctcctcagcttctcgcagccgcaaacagaggagccaccacgggaccagaacgcaggtggctctccggagagcattgcactgaagccgggagagcagaggaaagcgccggtgctctcctgccctacgcagccctttagtgccaaactggccgtcatgggtcaggtcttctctgacaactcttga

SEQ ID NO: 58624 - protein, 767 aa, Danio rerio
MSTFPSHDWCAQESLVISWSMCVRRPVVCVTVMLLFTVAHSKRSCDYSVIISTYKALILVELQALNLTGSFDISKEKDHCPEKVQPEKVRCLLRYIYGRTQIFNCLSDSRMQQQSDRMTEVVKQMQRLLTQDCLKPQKMKKASCKPVKKRRGRLRQRLKLMRMIINTFARTHAQCVHFLLLLLYSICAPPCSRELLYYLPLFTSRYFMLTFLFSAIFCAAYLSPIISHVKGRDFTEQEMSHYRDRVKSMFYHAYNSYLDNAYPYDELRPLTCDGQDTWGSSPLTLIDALDTLLILGNHTEFQRVASLLQDTVDFDIDVNASVFETNIRVVGGLLSAHLLSKRAGMKVEEGWPCSGPLLRMAEDAARKLLPAFQTPTGMPYGTVNLLRGVNPGETPVFCTAGVGTFILEFSTLSRLTGDPVFENVARKALRALWRTRSDIGLVGNHIDVITSKWVAQDAGIGAGVDSYFEYLVKGAIMLQDEKLLTMFYEFDKSIKNYTKFDDWYLWVQMHKGTVSMPVFQSLEAFWPGMQSLIGDISSATKSFHNYYSVWRQFGGLPEFYSIPQGYTVDKREGYPLRPELIESAMYLYKATGDPSFIQLGRDAVESIDRISRVNCGFATVKDVRDHKLDNRMESFFLAETIKYLYLLFDPDNFLHNTGTEFELGGLRGDCILSAGGYVFNTEAHPLDPAALHCCSREQQDRREIQDILLSFSQPQTEEPPRDQNAGGSPESIALKPGEQRKAPVLSCPTQPFSAKLAVMGQVFSDNS

SEQ ID NO: 58625 - DNA, 1848 bp, Candida albicans SC5314
  CDS (1)..(1848): transl_table=12
atgtctttttcatttggtataaataatatatcgaaaggcaataatacatataaagacaaaccagcaggaggagcattaccattattctacaaagacaaagtaccagcattccacccagcccacacttcaaaaaataaaaaacgtattctcatgctattaaaaggttttatgttgtctttagtattatatgctgtgtaccatttagcatcaaatggtgggcaatttatgtttgatttctcgggtcaatcaaaatgggaaagagctcaactggaagttcgtcaagccatgttagattcatggcatacctatgaaaagtatggttggggttatgatgtctatcatccaattaagcaagaaggggaaaatatgggtccaaaaccgttggggtggatgattgtggattcattagatactttgatgattatggattgtccagaagaagtcagtcgagccagagattggatcaagaatgatttggattacacttttgattataatgtcaacacatttgaaaccactattagaatgcttggtggtttattatcagcttatcatttcagcaatgacgatgtctatttggataaagcggtacaattggccaatgcattacacggggcctatgatagtccatcaggaataccatatctgtctgtcaatttgaaatcaggtaaaggtataaagaatcatgttgataatggtgcctcatccactgctgaagctgctactgttcaattagaaatgaaatatttatcgaaattgactggagaaattttgtggtggaacttggcagagaaagtaatgcaagtgttagaaagtaataaacctcaagatggtttggtgccaatttatgtcaacccagatactggtaaatatcaaggccatttgattagattggggtcacgtggagattcttattacgaatatttgttgaagcaatacttgcaaacaaataagcaagaacttgtctattgggatatgtatcgtgaatcggttgaaggtgtcaagaaacatcttgtgagtgattcttatccttcaggattgacgtttattggggaattggataatggtattggtggcaaattgtcaaccaagatggaccatttagtttgcttttacggtggattgttagcccttggtgctactggaggattgacattgaacgaggctcaaagtttaaaatcatggaatgaagaaagagaagctgactttaaacttggtgaagagttgacttatacttgttataagatgtaccacgatgttagtccaactggattgtcaccagaaattgttgttttcaatgaagatacttcaaaatccaaagattttattattaaacctttggatagacataacttacaacgtccagaaacagttgaatcattgttttatctttatagattaactggtgatgtcaaatatcgtgaaatgggatatgaaattttccaaaattttatcaagtacactaaagttgttaattcggaaggtgaagtttcattttcctcgctttccgatgtcacttctttcgattctaatggcttaccgaaattcaaagataacactgaatcattctggtgggcagaaactttgaaatatttgtatcttttgtttgatgacaccaataagattccattgacagattatgtctttaatactgaagcccatccattccctagatttgatactaatgattatttcaaaactggttggagaagaaaaattgatgagaatgaaaaggcacaaatgagagaatccaaagttattgataaaagtaatcttccggaagctcaaccagttgataaatcagctgatcaagaagctaaagaaattattgaagaaattgctgggtaa

SEQ ID NO: 58626 - protein, 615 aa, Candida albicans SC5314
MSFSFGINNISKGNNTYKDKPAGGALPLFYKDKVPAFHPAHTSKNKKRILMLLKGFMLSLVLYAVYHLASNGGQFMFDFSGQSKWERAQSEVRQAMLDSWHTYEKYGWGYDVYHPIKQEGENMGPKPLGWMIVDSLDTLMIMDCPEEVSRARDWIKNDLDYTFDYNVNTFETTIRMLGGLLSAYHFSNDDVYLDKAVQLANALHGAYDSPSGIPYSSVNLKSGKGIKNHVDNGASSTAEAATVQLEMKYLSKLTGEILWWNLAEKVMQVLESNKPQDGLVPIYVNPDTGKYQGHLIRLGSRGDSYYEYLLKQYLQTNKQELVYWDMYRESVEGVKKHLVSDSYPSGLTFIGELDNGIGGKLSTKMDHLVCFYGGLLALGATGGLTLNEAQSLKSWNEEREADFKLGEELTYTCYKMYHDVSPTGLSPEIVVFNEDTSKSKDFIIKPLDRHNLQRPETVESLFYLYRLTGDVKYREMGYEIFQNFIKYTKVVNSEGEVSFSSLSDVTSFDSNGLPKFKDNTESFWWAETLKYLYLLFDDTNKIPLTDYVFNTEAHPFPRFDTNDYFKTGWRRKIDENEKAQMRESKVIDKSNLPEAQPVDKSADQEAKEIIEEIAG

SEQ ID NO: 58627 - DNA, 2529 bp, Candida albicans SC5314
  CDS (1)..(2529): transl_table=12
atgtttttggggctatttcataattacatattcttggtaatactaagtctaaaaataatccccataaatgcatattctccatataattcatcattcacatctgaacatatacgatatttacaaaatgaaacacaagcattatttgatcattcatggaaatcatatatgaaatatggtttcccatttgatgaaataaccccaatcagttgtgaacctttaggacctgattttgatgactatgaaaataccgttagaaatgatgctagagggaatatatcactgatggtattagataatatcgatacattaataatatttgaacgatgggatgaattagaatatattttgaaatatcttctggataataaacaagattttttcaatcaagatactgtggtacaagtgtttgaaacttgtattcgtcatttaggtggattattatcggctcatttattattaaccgacattaccaataaaccaatcacattatcaacaaaatatcaaccattacgtgaaatttcaaacaaatataatgggtttttattggacatggctcatgatttaggattaagattaattccttcttatcaaacatcaacgacaaatatcccattaccaagaattaatttagcttatggtttgaaaaaagtcccacccaaattacaacgtgatgcatgtacttcaggggtaatgactccagttttagaattcactctattatcaagattaactggagatcgacaatttgaatattattcacaattatcattttggaaactttggtcactgaaactggcattaaatctattacctatgacaattgatcctattgctaatcaatggaaagatagtattaccggaataggtgctagtattgattcattttatgaatatgctgctaaactggcaattttatttaatgatgattatatgtggacagttttcaaaacttcatatcgagcattattgagtcatctggctcaaggtggtaaaggtacgatgattttccctaatgtggggatttatgatggggttgttttcagtccttggatagatctgttaggagcattttggtcaggattacaagttttaactgggcaattacaagacgccataaagactcatgtggtttatttaaaaatatgggactttttcgatctgattccagaaagatggatatataaccatcagcaccatcatcaaggtaataagaaagttaaacgtaataagaaaaaattcaaagcagaagattccattgatttggaatggtacccgttgagaccagaatttattgaatcaacttattatttatatcgtgccactaaagatccaatgtatttacaaataggggaaagagtattaaatttattaggtgatagatataaagcaccatgtggattaagtggattacaagatgttagaactgcagaaagacaagatcgaatggaatcatttgttgttggtgaaactttgaaatatttatatttattatttgatactaaagatgaaattttcttacacaattccactataatgcaaaataaaaattggattttctccactgaagcacatccattatggttaaataaaaaaatcgatcttattggtgattctttgacacaatcatcaaatgaaatatcatcggcaataatgggtgaaaaaccttatcataaaaatagtttaaaacccaataaagatttactcaaaataccaaattcagcgtttataagaaatattacattacctcaaccagaattggttgatattgaaggtataacggaggatgtatcccatattgccaaaaaactgccctttgcgggtcgatttgatacatgtcaattaaatccttggaataaatctgttgattcatttcttgaatcaagttattataaatggccctatttgtttaatgctgattatgcatttgaaaattcatttagaaaaccaagatatttgagtcaaactaatttagatggcagttatattgaattaacaaaagaattttacaataaatttactatgttcaatggagccaacttgatttgtcctcgtacttcaactacagcagtttatgaagtgttttggggagatatcaaacaatgcgaatacattgaagtttcagaaatttatcataccaagttttctaatgaatcgttaatggcaccgggtgatatttggataccgtctttgaacggattacgcgttgtattggaagaattggtacctgggaaagtagatacatttaataatgttgttactgaagaacagcttcttgcattacaggatagtaataataatgaagactataataacaataacgacgattacaggattagattagtaaattctggtttaagaattaaacgagtcaatggtgttgttattggtgaaggggtaactttatggacgctaccatttgaaccactggaacaatcgaatgaagaagacgggatgataggaataactgaagatgctagagtagttatacaaggtaaagtagttgaaaatttatttgtttggtatggatag

SEQ ID NO: 58628 - protein, 842 aa, Candida albicans SC5314
MFLGLFHNYIFLVILSLKIIPINAYSPYNSSFTSEHIRYLQNETQALFDHSWKSYMKYGFPFDEITPISCEPLGPDFDDYENTVRNDARGNISSMVLDNIDTLIIFERWDELEYILKYLSDNKQDFFNQDTVVQVFETCIRHLGGLLSAHLLLTDITNKPITLSTKYQPLREISNKYNGFLLDMAHDLGLRLIPSYQTSTTNIPLPRINLAYGLKKVPPKLQRDACTSGVMTPVLEFTLLSRLTGDRQFEYYSQLSFWKLWSSKSALNLLPMTIDPIANQWKDSITGIGASIDSFYEYAAKSAILFNDDYMWTVFKTSYRALLSHSAQGGKGTMIFPNVGIYDGVVFSPWIDSLGAFWSGLQVLTGQLQDAIKTHVVYLKIWDFFDSIPERWIYNHQHHHQGNKKVKRNKKKFKAEDSIDLEWYPLRPEFIESTYYLYRATKDPMYLQIGERVLNLLGDRYKAPCGLSGLQDVRTAERQDRMESFVVGETLKYLYLLFDTKDEIFLHNSTIMQNKNWIFSTEAHPLWLNKKIDLIGDSLTQSSNEISSAIMGEKPYHKNSLKPNKDLLKIPNSAFIRNITLPQPELVDIEGITEDVSHIAKKSPFAGRFDTCQLNPWNKSVDSFLESSYYKWPYLFNADYAFENSFRKPRYLSQTNLDGSYIELTKEFYNKFTMFNGANLICPRTSTTAVYEVFWGDIKQCEYIEVSEIYHTKFSNESLMAPGDIWIPSLNGLRVVLEELVPGKVDTFNNVVTEEQLLALQDSNNNEDYNNNNDDYRIRLVNSGLRIKRVNGVVIGEGVTLWTLPFEPSEQSNEEDGMIGITEDARVVIQGKVVENLFVWYG

SEQ ID NO: 58629 - DNA, 2115 bp, Aspergillus fumigatus Af293
  CDS (1)..(2115)
atgacgagctctccagcccagcgactccatagcgaaagccactggcgagcgaaccgcaatcccactgtcagccctctgggtggatatgggctatcgcaacagtcgaccggggtagggaacaaactcggcaacttcttcgacggcggtcgctcgctcccgatgtacaaagataagccgtactttgcgccgcggcgtacggcggggaggagtaggcggagaaagatcctgtatggcgggttgtgtgtgtttgtgttggtctgcctgtggtattttacgacggggtcgtctcagcggcataggcatggcttagacacgcctgaaacgcccaagggcgaggaaatgtggaagtggctgcagagtcttggggatccgacgaccgagattgaagatggccagcaccagaatatcgattggaatgcgcgaagggaaaaggtcagggatgcgttcattattagctgggatggatatgagcagcatggatggggatatgacgagtacaagccgatcacgaaagaaggaaaacagatggtcccaggagggttgggctggatcattgttgacgccctcgatacgctcatgatcatgaatctgacctcgcgggttcagcacgcgcgcaactggatccacaattcgctacaatacaaccaggaccacgacgtcaacacattcgagacgaccatccggatgttgggtggccttctgtcggcgcattatctttcgaccgcccatcccggactggccccaatcgcggacgacgatgcgggctcaccaggagaggatttgtatattgagaaggcgaccgacttggcggacagactgcttggggcttttgagtccaagtctggagtgccatatgccagcatcaatctgaatacgtcgactggtattccatctcatgcagacaatggggcttcatctacggcggaggctaccactgttcaacttgagttcaagtacttggccaagttgacgggagaagcggagtactggcgggtggtggagaaggtgatgcaagtggtcgatgaccagaagatggaagacggcctgctcccgatctatatctatccagactctggacatttcagaggagacaacatccgtctgggaagtcggggggattcttactacgagtatctcatcaagcagtatttgcaaacatctaaacaggagcccatctataaagagctctgggatgaatcgttgatgggcgtccgcaagcatctgattgcgtacaccaaaaatgctcagctaatgattttgggggagaggccgtctgggctccatgggaaactgtcgccgaagatggatcatctggtgtgcttcatgccgggaaccattgctcttggagccaccggcggcgtgccgttgagcgaagcccggaagtctcctgactggaatcaacggcgggacgaagaaattctgattgctcgggaattgatgaaaacatgctgggcgacatacctcgcgacgaagacgggtctggctccggaaatcacctacttcaccttggacgaccctccaaagatgttccacgacatgtacccggactcgacggcgagcgccggcaaccgcaagtcccagggggctgatttgccaatgaagtcacagcctctttacccgctggacgacgaaaccctcaagtggcgggaggacatccagatccaaagccaggaccgccacaatctccaacggccggagacggtcgagtcattgttttatatgtaccgcatcaccggggacgagatatatcgccagtggggatgggagatgttcaagtcctttatccgccacacggcagtggttgaacatgaccactcgcacgagaccgattcccctgccgatgccgctgccggaagccaatccgagaaagtcgcgcgtccctcgcggattacgggattcacgtcgctgagcaacgccaacaccgtgccccctgtaccccgagacaacatggagagtttctggatggcagagacgctcaagtatttctacttgttgttttccgaccgggactttatctccctggaggaccatgtgttcaacacggaagcgcatccgctgccacggtttcagcctacgggtgatttgaagacggggtggacgcggaagcctcggtag

SEQ ID NO: 58630 - protein, 704 aa, Aspergillus fumigatus Af293
MTSSPAQRLHSESHWRANRNPTVSPLGGYGLSQQSTGVGNKLGNFFDGGRSLPMYKDKPYFAPRRTAGRSRRRKILYGGLCVFVLVCLWYFTTGSSQRHRHGLDTPETPKGEEMWKWLQSLGDPTTEIEDGQHQNIDWNARREKVRDAFIISWDGYEQHGWGYDEYKPITKEGKQMVPGGLGWIIVDALDTLMIMNLTSRVQHARNWIHNSLQYNQDHDVNTFETTIRMLGGLLSAHYLSTAHPGLAPIADDDAGSPGEDLYIEKATDLADRLLGAFESKSGVPYASINLNTSTGIPSHADNGASSTAEATTVQLEFKYLAKLTGEAEYWRVVEKVMQVVDDQKMEDGLLPIYIYPDSGHFRGDNIRLGSRGDSYYEYLIKQYLQTSKQEPIYKELWDESLMGVRKHLIAYTKNAQLMILGERPSGLHGKLSPKMDHLVCFMPGTIALGATGGVPLSEARKSPDWNQRRDEEILIARELMKTCWATYLATKTGLAPEITYFTLDDPPKMFHDMYPDSTASAGNRKSQGADLPMKSQPLYPLDDETLKWREDIQIQSQDRHNLQRPETVESLFYMYRITGDEIYRQWGWEMFKSFIRHTAVVEHDHSHETDSPADAAAGSQSEKVARPSRITGFTSLSNANTVPPVPRDNMESFWMAETLKYFYLLFSDRDFISLEDHVFNTEAHPLPRFQPTGDLKTGWTRKPR

SEQ ID NO: 58631 - DNA, 1767 bp, Trypanosoma brucei
  CDS (1)..(1767)
atgccgtgggttcgtgctttactagttctcgtgacggtattttttgtccgtcttccgtccgtgatgagagaggaaaggttccaccagtacggaaatggtgaaagtagaaagttgcataatgtcagcgatatgcatcctattcaagctgagatgcttccttatgtgcgtgacatgattgaccacgcgtttggttcatacatcaaatacgcctttcccaaagatgaattgtgtcctgtgagtggtactgggaagaatacgatgggtggctatggctggacccttattgactctctcgatacactagcaattgccgggtttcacaaagaatttcgtcgccacgcgaagtgggtggaagagcacttgaccttcgatattgacgaatcagtgtcggtatttgagacgactattcgagctcttggaggtcttctggctgctcacttcatgtacgaggagggcatagtcccaattatcccttcggagcacgactacaacggcgggttcttgcggctcgctgtggatcttgcagatcgtctgatgccctgttttgacacgcccactgggataccatatggggcgattaatttacgccgtggggttagtggtggggaatcgcagctggccaacacggccggcgctgggacgttgttaatggagatgacggtactgtcgaggatcacaggcgatgaaaaatacgagcgtgcggcgcggcgtgcatctgaggctctttttgcggccagagattctcaaactgagcttatggggaatcacattcatactcatacaggaatttggagacatggtgaatcatccgttggagggaacattgatagcgtcattgaatactttatcaaatcacatagtatgagtggggacattggggactgggagcggttcgagaggactgcgagagctgtgaaccgctatgtgcggaagggtggaatgctgctagcagctagcatgtatagtggacggcggctgcagacgtcccaggaatctttgtcatcattttttcctgggaacttggttcttggcggccatctccacgaggctgtagaaagttcgtggccaattcatacgttcttcaaacattttggcgttctgccggagatattttccttggaatctggcgagccgtcgtggatgtcacatgactacgttggtcgacctgagcatatcgagtctctgtatatgctttaccgtgcaacacgagatcctacatacctcttgatgggaaaagaactggcactggccattaacttgcgtatgcgcacgccatatgggttttcttccgtaagtgatgtaaggtacccgcatcatgatggtgttcacagagactcgatggagagtttcatgatcgcggagaccctgaaatatttgtatctcttgtttgacgagtgcaacgctgttcacatgcagggacggatgggcggtcgcgcctcaccgcattgtgttatggacagcggtagcggcagtagcgtcagccacgtggggtgggttttcaacactgaagctcatctgttccctaattctgccgagtggtgggcgcctacttccttggagaccttggacaaggaggctgaggatcccgctgctgcgctcaggcgccagcgtttggaggtaattgacggtttgctcgcgagttttgaggaagtggacggtgaggttgttggggcgaatgataagggtggtgcagccctgtaccagttccactgtgccaatcacgccctgagtgatatagggaggctgtcgaagtctgtgtttcgataa

SEQ ID NO: 58632 - protein, 588 aa, Trypanosoma brucei
MPWVRALLVLVTVFFVRLPSVMREERFHQYGNGESRKLHNVSDMHPIQAEMLPYVRDMIDHAFGSYIKYAFPKDELCPVSGTGKNTMGGYGWTLIDSLDTLAIAGFHKEFRRHAKWVEEHLTFDIDESVSVFETTIRALGGLLAAHFMYEEGIVPIIPSEHDYNGGFLRLAVDLADRLMPCFDTPTGIPYGAINLRRGVSGGESQLANTAGAGTLLMEMTVLSRITGDEKYERAARRASEALFAARDSQTELMGNHIHTHTGIWRHGESSVGGNIDSVIEYFIKSHSMSGDIGDWERFERTARAVNRYVRKGGMLLAASMYSGRRLQTSQESLSSFFPGNLVLGGHLHEAVESSWPIHTFFKHFGVLPEIFSLESGEPSWMSHDYVGRPEHIESLYMLYRATRDPTYLLMGKELALAINLRMRTPYGFSSVSDVRYPHHDGVHRDSMESFMIAETLKYLYLLFDECNAVHMQGRMGGRASPHCVMDSGSGSSVSHVGWVFNTEAHLFPNSAEWWAPTSLETLDKEAEDPAAALRRQRLEVIDGLLASFEEVDGEVVGANDKGGAALYQFHCANHALSDIGRLSKSVFR

SEQ ID NO: 58633 - DNA, 1977 bp, Canis familiaris
  CDS (1)..(1977)
atgactaccccggccctgctgcccttatctggacgaaggataccacctctgaacctgggaccgccttccttcccgcaccacagggctaccttgagactttccgagaagtttatcctcctccttatcctaagtgccttcatcaccctgtgttttggagcattcttcttccttccagactcttcaaaacacaaacgctttgatctgggtttggaagatgtgttaattcctcacgtagatgccagcaaaggggctaaaaaccctggagtctttctgatccacggacccgatgaacacagacacaggtttgtttatttcagaagtttgggttttagcatttggcagagcgagaatggggaagaagaggaacgtttaagaaataaaattcgagctgatcacgagaaggccctggaggaagcaaaagaaaaattaaaaaagtcgagagaggaaattcgagcggaaattcagacagagaaaaataaggtagtccaagagatgaagacaaaagagaagaagccactgccaccagtccctataccaaatctaataggaataaatggtggagacccagaagataatgacatacgaaagaaaagggaaaaaattaaagagatgatgaaacatgcctgggataattataggatgtatggttggggacataatgaactcagacctattgcaaagaaaggacactccactaatatatttggtaattcacaaatgggtgctaccatagtagatgctttggataccctttatatcatgggacttcatgatgaatttggagatgggcaaaaatggattgaagagaaccttgatttcagtgtgaactcagaggtgtctgtgtttgaagtcaacattcgatttattggaggcctgcttgcagcttattacctttcaggagaagagatattcaagattaaagcagtccaactggctgagaaactccttccggcctttaacacacctactgggattccttgggcaatggtgaatctgaaaagtggagtagggcgaaactggggctgggcatctgcaggtagcagcattcttgctgaatttggtacactgcatatggagtttgtccacctcagctacttgacaggggacccagtttactacaaaaaggtaatgcacattcggaaactgcttcagaagatggatcgtccaaatggtctttatccaaattatttgaacccaagaacaggtcgctggggtcagtatcatacatcagttggcgggctgggagacagtttttacgaatacttactaaaagcatggttgatgtcagataaaacagaccatgaggcgagaaaaatgtatgatgatgctattgaggctatagagaaacatcttattaagaagtcccgaggaggtctcacctttattggagaatggaaaaatgggcacttggaaaagaagatggggcacttggcctgttttgctgggggaatgtttgcactgggagcagatggttccagaatggataaagctggtcattatttagagctaggggcagaaattgcacgtacatgtcatgagtcatatgacagaactgcattaaagctgggtcctgaatcattcaagtttgatggtgcagtagaggctgtggcagtccggcaggctgaaaagtattacatcctccgtccagaagtaattgaaacctattggtacctatggagattcactcatgatccaagatataggcaatggggctgggaagcagcactggctattgaaaagtattgccgagtaagtggtggattttctggggtgaaggatgtgtattcctctactcctacacatgatgatgtacagcagagcttctttcttgctgaaacattaaaatatttgtatctgctgttctccagtgatgatcttttacctttagaccactgggtattcaacacagaggctcatcctctgcctgtgttacatttagccaacaccacactttcaggaaatcctgctgttcgatga

SEQ ID NO: 58634 - protein, 658 aa, Canis familiaris
MTTPALLPLSGRRIPPLNLGPPSFPHHRATLRLSEKFILLLILSAFITLCFGAFFFLPDSSKHKRFDLGLEDVLIPHVDASKGAKNPGVFLIHGPDEHRHRFVYFRSLGFSIWQSENGEEEERLRNKIRADHEKALEEAKEKLKKSREEIRAEIQTEKNKVVQEMKTKEKKPLPPVPIPNLIGINGGDPEDNDIRKKREKIKEMMKHAWDNYRMYGWGHNELRPIAKKGHSTNIFGNSQMGATIVDALDTLYIMGLHDEFGDGQKWIEENLDFSVNSEVSVFEVNIRFIGGLLAAYYLSGEEIFKIKAVQLAEKLLPAFNTPTGIPWAMVNLKSGVGRNWGWASAGSSILAEFGTLHMEFVHLSYLTGDPVYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRMDKAGHYLELGAEIARTCHESYDRTALKLGPESFKFDGAVEAVAVRQAEKYYILRPEVIETYWYLWRFTHDPRYRQWGWEAALAIEKYCRVSGGFSGVKDVYSSTPTHDDVQQSFFLAETLKYLYLLFSSDDLLPLDHWVFNTEAHPLPVLHLANTTLSGNPAVR

SEQ ID NO: 58635 - DNA, 2013 bp, Spodoptera frugiperda
  CDS (1)..(2013)
atgacggggattttacctacctaccagcgatttgtaaatggagttcctgtaccgtccatttctcgacgttcgttccgtctacgggagaaatatttgattgtttctgtacttttgacattcgggatcgtgtggttaggagcattattctacttgccagagtttaaaagttcaaatagtgtgaacgatagtgtttacaatgtatacaaaagaatccagaaagctggcccagagctgctcatgccgcctcctctggcacaaaacgatgtcggtgactttcctgtgattgggatcgctcaccatggtgaagggggtgatgatcctcacgtaattgaggacaggaaccggctacgagctaagatagaggaggatatgggaatgaaagtgttggagaggcctcagtttgacgtagcaccttccgtgtcgtcttcgcgagggcccagcaagccgccagtcgatgcgattgaggagcccgcggtagggaacaatgcagctaacaaagacgtgtcgccgtcaggcccgaaggctgagagctcggacaagtttgtggctgtggccctggcaccaggagctgaccctgagatcaagcacaagctggagactgtcaaaaagatgatgctgcacgcgtggtacaactacaagctgtatgcttggggcaagaatgagctgaagccgatgtcgaagcgagctcacttgtccagcgtgttcggcgcgggcgaacttggcgccaccatcgtcgatggtctcgacaccctctacctcatgggactcaacgacgaattccgagagggccgcgactgggtcgctgaacatttgcatattaatgaaatcgattccgacttatctgtgttcgagacgacgatccggtttgtcggaggtctcctgtcatgttacgcgctgaccggcgacacgatgttccgagacaaggcggcggaagtaggcgacgctttgctgccagcattcgacacacccaccgggttgccatatgctctcatcaacccgtccaccaaggcaagccgtcagtaccactgggcgggtccgaacagcatcctatcggagctgggaacgctccacctcgagttcacgtacctcagtgacgtcacgggccgtgatatttacagacaaaaagtgagccgcatccgtgaggttttggatcagatcgacaaacctggcgacttgtaccccaacttcatcaacccacgcactggacaatggggacaaaggcacatgtctctgggcgctctcggcgactcgttctacgagtacttactgaaggcgtggctgatgtctggcggcgctgacgagcaggctcgcatcatgttcgacacggccatgcaggcggcgctcgacaaaatgctgcgtgtctcgccctccggcctcgcttacctcgccgagctcaagtacggacgtatcattgaagagaagatggaccacctttcgtgcttcgctggcggtatgttcgcactggcgtcgactaccctggacaactcgatgtcggagcgctacatggacgtggccaagaagctgaccaatacctgccacgagagctacgcgcgatccgagaccaaactcggccctgaagcattccgattctccaacgcggccgaggcgcgtgcacagaagagcaatgagaaggtgtacctcctgcggccggagacgttcgagagctacttcatcatgtggagactcaccaagcaacagatgtaccgcgactgggcctgggaggctgtgcaggctctggagaaacactgccgcgtggagggcggctacaccggtctcgtgaacgtctaccacgccaaccctcagggagacgacgtgcagcagagcttcttcctcgctgagacactcaagtacttatacctgatattcggtgacgattcgttcctgccgctcgacgagtgggtgttcaacacggaagcccatccattcccgatcaggggcaagaacccgctgtaccgcgctgtcgacaaaccggtcctgccagaacctgcgcatgcgcaaaacaacaggatataa

SEQ ID NO: 58636 - protein, 670 aa, Spodoptera frugiperda
MTGILPTYQRFVNGVPVPSISRRSFRLREKYLIVSVLLTFGIVWLGALFYLPEFKSSNSVNDSVYNVYKRIQKAGPELLMPPPLAQNDVGDFPVIGIAHHGEGGDDPHVIEDRNRLRAKIEEDMGMKVLERPQFDVAPSVSSSRGPSKPPVDAIEEPAVGNNAANKDVSPSGPKAESSDKFVAVALAPGADPEIKHKLETVKKMMLHAWYNYKLYAWGKNELKPMSKRAHLSSVFGAGELGATIVDGLDTLYLMGLNDEFREGRDWVAEHLHINEIDSDLSVFETTIRFVGGLLSCYALTGDTMFRDKAAEVGDALLPAFDTPTGLPYALINPSTKASRQYHWAGPNSILSELGTLHLEFTYLSDVTGRDIYRQKVSRIREVLDQIDKPGDLYPNFINPRTGQWGQRHMSLGALGDSFYEYLLKAWLMSGGADEQARIMFDTAMQAALDKMLRVSPSGLAYLAELKYGRIIEEKMDHLSCFAGGMFALASTTLDNSMSERYMDVAKKLTNTCHESYARSETKLGPEAFRFSNAAEARAQKSNEKVYLLRPETFESYFIMWRLTKQQMYRDWAWEAVQALEKHCRVEGGYTGLVNVYHANPQGDDVQQSFFLAETLKYLYLIFGDDSFLPLDEWVFNTEAHPFPIRGKNPLYRAVDKPVLPEPAHAQNNRI

SEQ ID NO: 58637 - DNA, 2988 bp, Drosophila melanogaster
  CDS (1)..(2988)
atgcagcaaaaaccccgaaacaacggctatccgggcaccctcatctgcgcggtcctcctcgtcctgctgtccaccggtgtcagcggccagaagcagtattccaaggcaagaaagttggaactgagggaggatgtgcggcgcatgttccagcacgcctacgatggttacctgcgccacgcctccaactacgatgaactgcgtccgctgacctgcgatggccacgacacctggggcagctactccttgacactgatcgacgctctggacacgctggccaccatgggcaacttcacggaattccgccgcgcggcaagactgctcgaggagaagatggattttgacagggacatcaacgtgtccgtgttcgagacaaacatccgcatcgtgggcgggctgctgtccgcgcatctgctctccaagcgtgctggcgtagagctagagccaggatggccctgcaagggacctctgctgcgactggcggaggatgtggcccgacgattattgccagccttcgtcacgaacacgggtatgccttatggcacggtgaacctgcgctatggcgtgcccaagggcgagacctctataacctgtacggcgggcgtggggacattcctcatcgaatttggtacccttagccggttgaccgggaaaaccatctacgaggatgttgctatgaaggcggtacatgctctatgggcatatcgctcgcccattggactttttggcaatcacatcgacgtgcagagcggtcgttggaccgccctcgactctggtatcggagcaggagtggattccctttttgaatacctagttaaggcatctgtcctgctcaatcgcccagaactcttggagttattccatgaggctcgcgcggccattgataagtacatgcggaaggaggactggtacgtgtgggtaggcatgaacaaaggccgcgtcacccttcccgtctttcagtccctggaggcgttttggcccggcatcctgagcattattggcgacacggagccggccttgcgcaccatatcacggtacattggggtctggaagaagtacggctttctgccagagttttataacattgctgctggagaggcatcgccgaatcgggaggtgtaccccctgcgaccggagctaatcgagtcagctatgtatctctatcgagccacaggaaacgagtatcttctggagtttggtgagcacatgctggagaccttggagttcagtgccaaaaccaaatgcggatatgcaacgattcgcaatgttgtcacccacgaaaaggagaatcgcatggagtcattcttcctggcggaaacaagcaagtacctttatctgctgtttgacgaggaaaacttcctgcacaacgatgggtccggaggcgagctgctgtcaaccgaggatgatgtatgcgtggtacaggccggtgcgtacatcttcaacacagaggctcatcccatggacatgtcagccctccactgttgccacgcccacaacgaggacatctacacctctctggatctacagcggtttagtccacgggcgatattagagaggagcaaaaagcggcaggtagctgttcaggaacagtgggtgccgcagtgtcacccagagaacaacgagttctttaataaagaggatgagagtgtgcaggcgcaggactctgaaaaagagcaggaacgcgagcaatccggcacaagcactaccatggccgtagatattgaggtgttcgacgaatttcaacagcccgccggcgatctgttagtaagcaacttcgagcagatacgcgaggagcgggagctaaacgagagcctgcacagaaacgtggtggcacgaaaccagttgacagtgagcgatttggatgaattctttgctcagcgacgggagagtttcgcaagcgcctccgaggctcttaactatgtaaagaccttcatgggcaactataccatggatgtagcctttatacggggcttgcaactgtacgatactaatatgagtagtgtattgggcacaggcgcccagaaagagtatgagtctcgaatgaggaccctttggcagctgtacgaactgcagcagcaatatgtggccaacatccgagtgattcaaggattaggtttgctaacctttccggcggacggtgaccggatacctagccatttgacagaggtgttggacagcctggataagtcggctcacttggagcatatggatctacaagatctcgaaacaagagtgtccaatacctcctcgccccagttggctcatataagagaagttattctaaaagcacgtaatgcctatgccatagccatggtcaatacttcggccatgcaggaatttgctatccgaatctacctcagtggcacttcggaggccggtgttcgcattcacccacttttggaagacgcagaactaagtgaggaagcacgtaaaaggccattgaagttggcggaggagcgagccctcttcagctacgcccgtcgaatagtggactttcggaaacgaatggcggagacagttgatcgattgcagacgctcatgcaggacattccgccacccaaaaggaaagaggccactaccgactctcaggccgcagatgcgtccacagtctacactcaaaccaaagcccagatggcggcgcctgcacagcagccggagccgagccaggaagagaagcagtcgacacaaattcaaaaaggaaagcttgccgaaaacggctccggattgggtgaagaggagtccggctgcgtgtggtcgcagttggtgcagaccatccttcggaagaccacggtgcagcgggtcaaatttgacgaggccgtgctccaggaaaatacgcgcaaggcactggagaagtacgcccgcaaggagttaccccaccatctgttcgcctgcaccggccggagtacattgagggattcgcctatcgggacttttatccggaagcgctgtaagctcgcaatcacctcaccgaccaacacgactgatctgtag

SEQ ID NO: 58638 - protein, 995 aa, Drosophila melanogaster
MQQKPRNNGYPGTLICAVLLVLLSTGVSGQKQYSKARKLELREDVRRMFQHAYDGYLRHASNYDELRPLTCDGHDTWGSYSLTLIDALDTLATMGNFTEFRRAARLLEEKMDFDRDINVSVFETNIRIVGGLLSAHLLSKRAGVELEPGWPCKGPLLRLAEDVARRLLPAFVTNTGMPYGTVNLRYGVPKGETSITCTAGVGTFLIEFGTLSRLTGKTIYEDVAMKAVHALWAYRSPIGLFGNHIDVQSGRWTALDSGIGAGVDSLFEYLVKASVLLNRPELLELFHEARAAIDKYMRKEDWYVWVGMNKGRVTLPVFQSLEAFWPGILSIIGDTEPALRTISRYIGVWKKYGFLPEFYNIAAGEASPNREVYPLRPELIESAMYLYRATGNEYLLEFGEHMLETLEFSAKTKCGYATIRNVVTHEKENRMESFFLAETSKYLYLLFDEENFLHNDGSGGELLSTEDDVCVVQAGAYIFNTEAHPMDMSALHCCHAHNEDIYTSLDLQRFSPRAILERSKKRQVAVQEQWVPQCHPENNEFFNKEDESVQAQDSEKEQEREQSGTSTTMAVDIEVFDEFQQPAGDLLVSNFEQIREERELNESLHRNVVARNQLTVSDLDEFFAQRRESFASASEALNYVKTFMGNYTMDVAFIRGLQLYDTNMSSVLGTGAQKEYESRMRTLWQLYELQQQYVANIRVIQGLGLLTFPADGDRIPSHLTEVLDSLDKSAHLEHMDLQDLETRVSNTSSPQLAHIREVILKARNAYAIAMVNTSAMQEFAIRIYLSGTSEAGVRIHPLLEDAELSEEARKRPLKLAEERALFSYARRIVDFRKRMAETVDRLQTLMQDIPPPKRKEATTDSQAADASTVYTQTKAQMAAPAQQPEPSQEEKQSTQIQKGKLAENGSGLGEEESGCVWSQLVQTILRKTTVQRVKFDEAVLQENTRKALEKYARKELPHHLFACTGRSTLRDSPIGTFIRKRCKLAITSPTNTTDL

SEQ ID NO: 58639 - DNA, 2231 bp, Mus musculus
  CDS (75)..(2033)
gggacgcgcggggaggcggtcggctggggacgcgcccggcgcttcaaaataatgcccgcggcggacgcgcgaccatgcaatggcgagcgcttgtcctggggctggtgctgctgcgcctcggcctccacgcggtgctctggttggtcttcgggctggggcccagcatgggcttctaccagcggtttccgctcagcttcggcttccagcgcttgagggaccccgacggctcggggccagttggtccgcccggaggcccggcctggcttcatcggccaaggcgcggaacggaggggcggcttgagaccccgccagagccgggaccgacgccgggaccgggcgtgtgcggcccggcgcactggggctatgccctgggcggcggtggctgcggcccggacgagtacgagcggcgctacagcggcgccttcccgccgcagctgcgtgcccagatgcgcgacctggcgcggggcatgttcgtcttcggctatgacaactacatggcgcacgcctttccgcaggacgagctcaaccccatctactgccgcggccgggggcctgaccgcggagacccttccaatctgaacatcaatgatgtcctagggaattactctctgactctggttgatgccttggatacattggcaataatgggaaattcatccgagttccagaaggcagtcaagttagtgatcaacactgtttcatttgacaaagattccacagtccaggtcttcgaagctacgataagggttctgggaagcctcctttctgctcacagaataataactgattccaaacagccctttggtgacatgacaattgaggattatgataatgaattgttgtacatggcccatgacttggctgtgcggctccttccagcctttgaaaacaccaagacagggatcccctatcctcgggtgaatctgaagacaggtgttcctcctgacagcaataatgagacctgcacagcgggggccggttctctcctggtggaatttgggattctgagccgactgctgggggattccacttttgagtgggttgccagacgagctgtgaaagccctctggaacttgcggagcaacgatacaggattattaggcaatgttgtgaacatccagacaggccattgggttggaaagcagagtggcttgggtgctgggctggattccttctatgagtacctcttgaaatcttacattctctttggagaaaaagaagatctagagatgtttaatgctgcgtatcagagcatccagagctacctgcgaagaggccgggaagcctgcaatgaaggagaaggagacccaccgctctacgtcaacgtgaacatgttcagtgggcagctcatgaacacctggattgactcgctgcaggctttcttccctggactgcaggttctgataggggatgtggaagatgccatctgcctacacgccttctactatgccatatggaagcggtacggggccctccctgagcgctataactggcaactccaggcccctgatgttctcttctaccctctgggtccagagctagtggagtccacatatctcctctaccaggcaaccaagaatcccttctacctccatgtaggaatggacattctgcagagtcttgaaaaatacacaaaagtcaaatgtggatatgctacgctgcatcacgtcatagacaagtctaaagaagaccggatggaaagcttctttctcagcgagacttgcaaatacttgtatctgctatttgatgaagagaatccagtacacaaatctggaaccagatacatgtttacaactgagggccatatcatatctgtggacaaacgtcttcgggaattgccttggaaggaattcttctctgaagatggggagcgggaccaagaggaaaagtttgtacacagacctaagtctcaggagctcagagtcattaactccagttctaattgtaatcgtgttcctgatgagaggagatactccttgcccttaaagagcatctacatgcgccagatcgaccagatggttggcttgatttgacctgctcacctcaatgtggccagaacttaaaccaaacccaagtgtaccaaaatctcctctgaggtggaagcggtggagcctgcccatctgtgatgctgtcgaagtttctgtccagctcttactcacctctggttgaatcttgcacttagtgctttttagtgtttcccttctgtttaataaaatactctattttttctg

SEQ ID NO: 58640 - protein, 652 aa, Mus musculus
MQWRALVLGLVLLRLGLHAVLWLVFGLGPSMGFYQRFPLSFGFQRLRDPDGSGPVGPPGGPAWLHRPRRGTEGRLETPPEPGPTPGPGVCGPAHWGYALGGGGCGPDEYERRYSGAFPPQLRAQMRDLARGMFVFGYDNYMAHAFPQDELNPIYCRGRGPDRGDPSNLNINDVLGNYSLTLVDALDTLAIMGNSSEFQKAVKLVINTVSFDKDSTVQVFEATIRVLGSLLSAHRIITDSKQPFGDMTIEDYDNELLYMAHDLAVRLLPAFENTKTGIPYPRVNLKTGVPPDSNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQSYLRRGREACNEGEGDPPLYVNVNMFSGQLMNTWIDSLQAFFPGLQVLIGDVEDAICLHAFYYAIWKRYGALPERYNWQLQAPDVLFYPLGPELVESTYLLYQATKNPFYLHVGMDILQSLEKYTKVKCGYATLHHVIDKSKEDRMESFFLSETCKYLYLLFDEENPVHKSGTRYMFTTEGHIISVDKRLRELPWKEFFSEDGERDQEEKFVHRPKSQELRVINSSSNCNRVPDERRYSLPLKSIYMRQIDQMVGLI

SEQ ID NO: 58641 - DNA, 1995 bp, Tetraodon nigroviridis
  CDS (1)..(1995)
atgaccacgccggcgctcctgcccctgtcgggccgaaggatacccaccctgtcgccgggcgcctcctcctttccgcaccaccgagccacgctgaggctctccgagaagttcatcctcctcctcatcctcagtgccttcatcacgctttgtttcggggcctttttcttcctcccggacagttccaagcacaagcgctttgacctgggcttggaggacgtgctcatcccccacatcgactcacccaaagaggggaaacacgcctccggacaggtggtcatacacggacagggggcccacgacgagcacagacacaggtcatttttcgggatgctggaatactctgtgggagccagagtaaatggggaggaggaggagagcttgcgggacaagatccgagcggaccacgagcgagcgctgcaggaggccaaggagaagctgagaaagtcacgcgaggagctgcaagccgagattcagacggagaagaacaaggtcgccgaggacctgaagaagaaggactcgggccccaagcctttaccgcctgtccccatgcccagggtggtgggggtcagcgacggcgagcctccagagccggacgtcaaagagaagcgtgacaagataagagagatgatgaagcacgcctgggacagctaccggcagtacggctggggccacaacgagctgaagcccctggccaagaagggacactccaccaacatctttggtaactcccaactcggcgccaccatcgtggacgcgctggacaccctctacatcatgggtctgcacgaggagttcaaggacggccaggagtggatcgagcagaacctggacttcggtgtgaatgcagaggtttccgtgttcgaagtcaacatccgcttcatcggagggctgctggccgcctactacctctctggacaagaagttttcaagatgaaggccgtccagctggccgagaagctgctccctgccttcaacacccccacaggcatcccctgggccatcgtcaacctgaagagcggcgtgggtcgtaactggggctgggcctcggctggaagcagcatcctggcggagtttgggaccctgcacatggagtttgttcacctcacctacctgaccggaaaccccgcctactaccagaaggtgatgcacatccggaagctcctagccaagatggaccgacccaacgggctctaccccaactacctgaacccacgcacgggccgctggggccagcatcacacgtccgtcggaggactcggggacagcttttacgaatacctgctgaaggcctggctgatgtcggacaagacggacacagaagcgcgcaagacttacgacgaggccatggaggctatcgagcgccacctgatccgcaagtccaacggcggcctgacgttcatcggcgagtggaagaacggacacctggagaggaagatgggccacctagcgtgtttcgccggtggcatgttcgctctgggcgcggatggttcccccgacgacaaggccgggcactatctgcagctgggggccgagatcgcgcacacgtgccacgagtcctacgacaggacggtgctgaagctgggccccgaggccttcaagttcgacagcggcctggaggcggtggcggtgcggcagaacgagaagtactacatcctgaggcccgaggtcatcgagacctactggtacatgtggaggttcacccacgaccccaaataccgccagtggggctgggaggcggcgcaggccatcgacaagtactgccgggtgagcggaggcttctcgggggtgaaggacgtctactcctccagcccgacctacgacgacgtgcagcagagcttcttcctggccgagacgctcaagtatctctacctgctgttctccagcgacgacctgatgccctttgagagttgggtcttcaacacggaggcccacccgcttcccgtcctccacctgggcaacatcacgctgcccggcagcgagccggcgcagcggtag

SEQ ID NO: 58642 - protein, 664 aa, Tetraodon nigroviridis
MTTPALLPLSGRRIPTLSPGASSFPHHRATLRLSEKFILLLILSAFITLCFGAFFFLPDSSKHKRFDLGLEDVLIPHIDSPKEGKHASGQVVIHGQGAHDEHRHRSFFGMLEYSVGARVNGEEEESLRDKIRADHERALQEAKEKLRKSREELQAEIQTEKNKVAEDLKKKDSGPKPLPPVPMPRVVGVSDGEPPEPDVKEKRDKIREMMKHAWDSYRQYGWGHNELKPLAKKGHSTNIFGNSQLGATIVDALDTLYIMGLHEEFKDGQEWIEQNLDFGVNAEVSVFEVNIRFIGGLLAAYYLSGQEVFKMKAVQLAEKLLPAFNTPTGIPWAIVNLKSGVGRNWGWASAGSSILAEFGTLHMEFVHLTYLTGNPAYYQKVMHIRKLLAKMDRPNGLYPNYLNPRTGRWGQHHTSVGGLGDSFYEYLLKAWLMSDKTDTEARKTYDEAMEAIERHLIRKSNGGLTFIGEWKNGHLERKMGHLACFAGGMFALGADGSPDDKAGHYLQLGAEIAHTCHESYDRTVLKLGPEAFKFDSGLEAVAVRQNEKYYILRPEVIETYWYMWRFTHDPKYRQWGWEAAQAIDKYCRVSGGFSGVKDVYSSSPTYDDVQQSFFLAETLKYLYLLFSSDDLMPFESWVFNTEAHPLPVLHLGNITLPGSEPAQR

SEQ ID NO: 58643 - DNA, 2823 bp, Cryptococcus neoformans var
  CDS (1)..(2823)
atgctatcatcaagaaccatatggatatggctggctccttgcctttgcctgtcgaatttattaggcgtatggggcatgaccgatgctcgaaggatacagcttcgtgacgagactgctgccctgttcagacatggatacgaagggtatataaagtatgcatatcctgcggacgaacttcgcccattgtcatgtgcaccactacgtcgatcaaagaatgcagctgattttggcatcaacgacctccacgccaatgtttccctcaccctcctcgacgtcctctcctccttaccgctcttacacccacatgctctcccctctgcgctagagcgtataacaacccaagtatcgttcgaccaagatgtgaaagtacaagtattcgaaatgaccatccgtgccctgggaggtttattgtcgatgtatcagtatctcgatgatttaccggattcaccttacgagcaagcgagagtgcttggggtggtaagagaaggaaaggaagggtggttaggcctagggctgggagctcaggaaaaagtggataaggtggatgtgaaaaagtataagccgaggatcttggaattggcggaagatttggggaggaggatgttgccggcgttcaacacgaaaactggattaccgtatgcgcgtgtgaatttgaagcatgggatcgagaagggtgagagtgcggagacgtgtacggcaggagcgggcagtcttatcctcgagttttcccttctttctagattgacaggcgacgaccgttacgaacaactagcccgaaacgcttactactcgatatggaatcgtcgctcggatcataatctactcggtaacacgataggagccacgcacggccattggctcatgcctggtttgagcggagttggagcagggatggatagcttctttgaatatggggtcaaggctggtatcatgctcggtgatgactcgttttacgacatattttacgactcttatgctgctattcaaactcatgtccgaacgactgacggttttatctatcgacctatccacactcgccttctccaaatccccagcccaacaacgatcgattccctctcggcctttctacccgccatccaagtcctcgctggtgatatcccttcggccatcagatcgcatctcgtcttctggaatctatggagaaagtttggagctctgcctgagagttggcggtggcaggagaggcggatagaatgggctggatggcctgggagaccagagtttatagagtcgacttattatctgtatcaggcaacaaaagatccgttctatttgagggttggcgaacgggttttaaaggatctggcaaggcgaaccaaaacgtcctgcggatttgctaccatcaagaacgtcttgacgagcgagctggaagacagaatggagagctttatgctttcggaaaccctcaagtatctctaccttttattctctgatacgcccttcccgaatcagaataaagttttcaccactgaaggccacccactatacataccacagcctcttctgcagcctagcacaaatgcgagaaagtcattgcataaaggcgaatggctcacatgcccggcgtatcaaagtccttttgccaccgggggtatcgactttcatgggactgacaaggttgggaaccgagtggagaaagttgggataacagtcgggattgagggcacgtcagagtatgaatatgcgagagcgctcgtctttggttggggagaggaaggattgaaggtagaagatcaaaaaagaatgtggtttgatggtggggtatgtagtatccaggaagtccccaaattcgcgttcgatatcgttttaacctctccgttcaatgagacgttccctgaggatccatctcctggatctgataaggtgtatcaaaataccacgacgggtgattatgtcatcagcaatatcgcggggatccgtctgggagtgagatggcggctggacgggcaagggtatgacgtgtcaagcatcggtccacatagggttaggaccggccagcaggtcacagtcatcgactcgtctatgcggaatcatttccctctaccttcccttgctccaggtccacctcagccgcagtatgagcctactgaagtcatcctccgcttcgtctttctctccccggtggttgtcaaggataaacatgtagaagctagtacagtttttctccacgctttaggagcgaccgcgacattcggaaaggattttggtgcttctgcaacgtcccccagaatggaagaccagcaaggatggcagctcagcggaggtgcactgccgattctcgtcctccccaacccctccgatggctgttcaccattaaccctatcaactcctgattatccgttcatcctcctcctcgataggggcaattgcacctttgcagagaaagcgcaaaacgcagagacaataggtgcaagcgggttgttaatagttggttaccctcacccacccgaaggaggtgtaacgcaaggtgatcagacggtatacgctgctccggaggaaggcttggtacggccctctgccgagccaaacgaggctgagggattggatagtatggggatagtgtatatggagcatcttgtaggagaactggtgcgcaatgcgagtcaaaaaggtgaaataggggcggcgattatgagaatcgaaggtgtaggtgaggaagcagctgggagcagtggattcccacaggctggatcgggggcgacaaagaagcattgggaaagcgattcgcggattagggaaggtaggctggcagttggagattgggaaatttgtaatcttgtggtcgtagatacttctgtataa

SEQ ID NO: 58644 - protein, 940 aa, Cryptococcus neoformans var
MLSSRTIWIWLAPCLCLSNLLGVWGMTDARRIQLRDETAALFRHGYEGYIKYAYPADELRPLSCAPLRRSKNAADFGINDLHANVSLTLLDVLSSLPLLHPHALPSALERITTQVSFDQDVKVQVFEMTIRALGGLLSMYQYLDDLPDSPYEQARVLGVVREGKEGWLGLGLGAQEKVDKVDVKKYKPRILELAEDLGRRMLPAFNTKTGLPYARVNLKHGIEKGESAETCTAGAGSLILEFSLLSRLTGDDRYEQLARNAYYSIWNRRSDHNLLGNTIGATHGHWLMPGLSGVGAGMDSFFEYGVKAGIMLGDDSFYDIFYDSYAAIQTHVRTTDGFIYRPIHTRLLQIPSPTTIDSLSAFLPAIQVLAGDIPSAIRSHLVFWNLWRKFGALPESWRWQERRIEWAGWPGRPEFIESTYYLYQATKDPFYLRVGERVLKDLARRTKTSCGFATIKNVLTSELEDRMESFMLSETLKYLYLLFSDTPFPNQNKVFTTEGHPLYIPQPLLQPSTNARKSLHKGEWLTCPAYQSPFATGGIDFHGTDKVGNRVEKVGITVGIEGTSEYEYARALVFGWGEEGLKVEDQKRMWFDGGVCSIQEVPKFAFDIVLTSPFNETFPEDPSPGSDKVYQNTTTGDYVISNIAGIRLGVRWRLDGQGYDVSSIGPHRVRTGQQVTVIDSSMRNHFPLPSLAPGPPQPQYEPTEVILRFVFLSPVVVKDKHVEASTVFLHALGATATFGKDFGASATSPRMEDQQGWQLSGGALPILVLPNPSDGCSPLTLSTPDYPFILLLDRGNCTFAEKAQNAETIGASGLLIVGYPHPPEGGVTQGDQTVYAAPEEGLVRPSAEPNEAEGLDSMGIVYMEHLVGELVRNASQKGEIGAAIMRIEGVGEEAAGSSGFPQAGSGATKKHWESDSRIREGRLAVGDWEICNLVVVDTSV

SEQ ID NO: 58645 - DNA, 1776 bp, Aspergillus fumigatus
  CDS (1)..(1776)
atgtggaagtggctgcagagtcttggggatccgacgaccgagattgaagatggccagcaccagaatatcgattggaatgcgcgaagggaaaaggtcagggatgcgttcattattagctgggatggatatgagcagcatggatggggatatgacgagtacaagccgatcacgaaagaaggaaaacagatggtcccaggagggttgggctggatcattgttgacgccctcgatacgctcatgatcatgaatctgacctcgcgggttcagcacgcgcgcaactggatccacaattcgctacaatacaaccaggaccacgacgtcaacacattcgagacgaccatccggatgttgggtggccttctgtcggcgcattatctttcgaccgcccatcccggactggccccaatcgcggacgacgatgcgggctcaccaggagaggatttgtatattgagaaggcgaccgacttggcggacagactgcttggggcttttgagtccaagtctggagtgccatatgccagcatcaatctgaatacgtcgactggtattccatctcatgcagacaatggggcttcatctacggcggaggctaccactgttcaacttgagttcaagtacttggccaagttgacgggagaagcggagtactggcgggtggtggagaaggtgatgcaagtggtcgatgaccagaagatggaagacggcctgctcccgatctatatctatccagactctggacatttcagaggagacaacatccgtctgggaagtcggggggattcttactacgagtatctcatcaagcagtatttgcaaacatctaaacaggagcccatctataaagagctctgggatgaatcgttgatgggcgtccgcaagcatctgattgcgtacaccaaaaatgctcagctaatgattttgggggagaggccgtctgggctccatgggaaactgtcgccgaagatggatcacctggtgtgcttcatgccgggaaccattgctcttggagccaccggcggcgtgccgttgagcgaagcccggaagtctcctgactggaatcaacggcgggacgaagaaattctgattgctcgggaattgatgaaaacatgctgggcgacatacctcgcgacgaagacgggtctggctccggaaatcacctacttcaccttggacgaccctccaaagatgttccacgacatgtacccggactcgacggcgagcgccggcaaccgcaagtcccagggggctgatttgccaatgaagtcacagcctctttacccgctggacgacgaaaccctcaagtggcgggaggacatccagatccaaagccaggaccgccacaatctccaacggccggagacggtcgagtcattgttttatatgtaccgcatcaccggggacgagatatatcgccagtggggatgggagatgttcaagtcctttatccgccacacggcagtggttgaacatgaccactcgcacgagaccgattcccctgccgatgccgctgccggaagccaatccgagaaagtcgcgcgtccctcgcggattacgggattcacgtcgctgagcaacgccaacaccgtgccccctgtaccccgagacaacatggagagtttctggatggcagagacgctcaagtatttctacttgttgttttccgaccgggactttatctccctggaggaccatgtgttcaacacggaagcgcatccgctgccacggtttcagcctacgggtgatttgaagacggggtggacgcggaagcctcggtag

SEQ ID NO: 58646 - protein, 591 aa, Aspergillus fumigatus
MWKWLQSLGDPTTEIEDGQHQNIDWNARREKVRDAFIISWDGYEQHGWGYDEYKPITKEGKQMVPGGLGWIIVDALDTLMIMNLTSRVQHARNWIHNSLQYNQDHDVNTFETTIRMLGGLLSAHYLSTAHPGLAPIADDDAGSPGEDLYIEKATDLADRLLGAFESKSGVPYASINLNTSTGIPSHADNGASSTAEATTVQLEFKYLAKLTGEAEYWRVVEKVMQVVDDQKMEDGLLPIYIYPDSGHFRGDNIRLGSRGDSYYEYLIKQYLQTSKQEPIYKELWDESLMGVRKHLIAYTKNAQLMILGERPSGLHGKLSPKMDHLVCFMPGTIALGATGGVPLSEARKSPDWNQRRDEEILIARELMKTCWATYLATKTGLAPEITYFTLDDPPKMFHDMYPDSTASAGNRKSQGADLPMKSQPLYPLDDETLKWREDIQIQSQDRHNLQRPETVESLFYMYRITGDEIYRQWGWEMFKSFIRHTAVVEHDHSHETDSPADAAAGSQSEKVARPSRITGFTSLSNANTVPPVPRDNMESFWMAETLKYFYLLFSDRDFISLEDHVFNTEAHPLPRFQPTGDLKTGWTRKPR

SEQ ID NO: 58647 - DNA, 2725 bp, Homo sapiens
  CDS (16)..(2115)
gttgacggcgctgcgatggctgcctgcgagggcaggagaagcggagctctcggttcctctcagtcggacttcctgacgccgccagtgggcggggccccttgggccgtcgccaccactgtagtcatgtacccaccgccgccgccgccgcctcatcgggacttcatctcggtgacgctgagctttggcgagaactatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggacgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaaaaaaaaaaaaaaaaaaa

SEQ ID NO: 58648 - protein, 699 aa, Homo sapiens
MAACEGRRSGALGSSQSDFLTPPVGGAPWAVATTVVMYPPPPPPPHRDFISVTLSFGENYDNSKSWRRRSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVPSGGYSSINNVQDPQKPEPRDKMESFFLGETLKYLFLLFSDDPNLLSLDAYVFNTEAHPLPIWTPA

SEQ ID NO: 58649 - DNA, 2031 bp, Oryza sativa
  CDS (1)..(2031)
atgcagccggcgctgcgacggcggcggcggcgccaaggcttcctcctccccttcgcctgcctctccgccgccctcatcgccgctgccctgctccccggcgccgctttcgccgatggcgtcacgccctccgaggcccgccggctccgcgacgaggtcaaagatatgttctatcatgcatttgatgggtacatgcaacatgcttttccacttgatgaattgcggcctttaagttgccaaggagaagattcacttggtggctatgcacttactcttatagactctttggataccttggctttactaggggataaggagagatttgatgctgccgtggagtgggttggtaagaatgtccgctttgatattaataaaactgtctctgtttttgaaaccaacatacgcattcttgggggtctgctatcagctcacctgattgccagtgattatgcaactggaatgagaattcaatcttatgatgatcagttgcttcatttagcggctgacttagctcaaagattgctacctgcatttgacactccaacaggtattccatttggatcagtaaatttattgtatggagtcgatgaaaatgaaagcaagataacttcaacagctggtggtggcactttgacactggaatttggtgtcctgagtcgtttgactaatgatagcgtttatgaacgagttacaaaaaactctgtgcgtggaatatgggcacgcaggtcgaaacttgaccttgttggtgcccatataaatgtatttactggtgaatggacacagaaggatgcaggaattggcacaagcattgactcattctatgagtatcttctaaaggcgtatttattatttggagatgaagaatatttgtatatatttcaggaggcttacaaggctgccatgcattatctccatcatgatccctggtatgtggaggtaaatatgaattctggtgctactgtttggccactattcaacagtctccaggcattctggccaggacttcaggtgttagctggagatgttgatcctgccattcgaactcatgctgccttcttcagtgtatggaaaaaatatggcttcaccccagaagggtttaatcttgctacatccactgttcagaatggacaaaggagctacccgctgcggcctgaattgattgaaagcacatattggctgttcaaggctactagagattataggtaccttgatgttggaagggatatattagcaagccttcaatatggtgctaaatgtccatgtggttactgccatatttcagatgtagaaacccaccagcaggatgaccacatggagagttttttccttgcagaaacagtcaaatatctctggcttctttttgatttagctgcaggccctgataatattgttgaaaatgggccatataaatacatatttagtacagaaggtcatctgttgcctgctactcctcagataaccttgttagatgagcattgcttgtatgctggagcattctgcaatggtactgcaggccatggatatggtaccggtgatagttctaataagcatcaaaatgcaaactctgttccgttcgatgatagtcgaacaccttccgatcaatctttatccaatattttgtctacgacaagagggtacatcaagggagtttgtccaggattaactcatgcccagaaacttggcatatcatactctgccgaggaggataactcaatacagcagaattctggaagtagtgagaatcttgatgaatcacacgtgatcaaatccagtgtccaagctcaatcaagttctgttatattgatatcgcatccagtcgcaagccaaactgaggagcctacgtcgggcagaagtcagtacaatgcaaacattgtggcaactgctgagtctgtagggactgatactgccggcgcctcatcccaccccgaggatcttgttaaggaaactgagagcgtctctgaacagaaagaaatcaatgacaaagagatcgcttctcagggtagtcaaccgaccgaaggaagatacctgacctaa

SEQ ID NO: 58650 - protein, 676 aa, Oryza sativa
MQPALRRRRRRQGFLLPFACLSAALIAAALLPGAAFADGVTPSEARRLRDEVKDMFYHAFDGYMQHAFPLDELRPLSCQGEDSLGGYALTLIDSLDTLALLGDKERFDAAVEWVGKNVRFDINKTVSVFETNIRILGGLLSAHLIASDYATGMRIQSYDDQLLHLAADLAQRLLPAFDTPTGIPFGSVNLLYGVDENESKITSTAGGGTLTLEFGVLSRLTNDSVYERVTKNSVRGIWARRSKLDLVGAHINVFTGEWTQKDAGIGTSIDSFYEYLLKAYLLFGDEEYLYIFQEAYKAAMHYLHHDPWYVEVNMNSGATVWPLFNSLQAFWPGLQVLAGDVDPAIRTHAAFFSVWKKYGFTPEGFNLATSTVQNGQRSYPLRPELIESTYWLFKATRDYRYLDVGRDILASLQYGAKCPCGYCHISDVETHQQDDHMESFFLAETVKYLWLLFDLAAGPDNIVENGPYKYIFSTEGHLLPATPQITLLDEHCLYAGAFCNGTAGHGYGTGDSSNKHQNANSVPFDDSRTPSDQSLSNILSTTRGYIKGVCPGLTHAQKLGISYSAEEDNSIQQNSGSSENLDESHVIKSSVQAQSSSVILISHPVASQTEEPTSGRSQYNANIVATAESVGTDTAGASSHPEDLVKETESVSEQKEINDKEIASQGSQPTEGRYLT

SEQ ID NO: 58651 - DNA, 1569 bp, Caenorhabditis briggsae
  CDS (1)..(1569)
atgttcttgatcatttgtctagtctcaatgcaactactcgtttttctattcgttttcttggccacaccatcggattctctgaatcccaaaagacagcgattcttcggaacgtcttctgaaaattgtgcgatgattagtacaacgaaacggaaaattgcggcgaataagttgaaaagagcgccgcccatttttcaaggaccttctaacgatcgccagcgagcaattgtagcagcattccagcactcgtggacgggatacaagaaatatgcatggggacatgacgagctgcttccggtgtcgaagcgattcgatgatccattccagttaggattgacgattgtggatagtttggatacagcgattattatgggattggagacagaaacccgagaaggcgtcgaatggattcggaatagtctgaatgtgtctccatcgaaaagtgtgaatgtgttcgaaactacgattcgagtgctcggcggacttttgagtggatatcatttgactggggaagaagctctcctggaaaaagccgctaaactaggcgacaatctactcaacgcattcacaaaatccaaatctcccatcccgaaaagtgacgtggatcttggcaccggcgcagcattcagcccgaatcgcggatactcttcgctcgccgaagcgacaacgttgcagctggagtttcgagatttatcagtactgaccggtgataagaaatacgaagaaacggctttcgcagcgtcagaacatgtacacaagacgaaatgtgccgaatatgatggtttatgcttttatcatatcgatgagaacggagaattcaagaaaactgcgatcactcttggcgctcgtgctgacagctactatgagtacctcatcaagcaatggctccagaccaaaaaatcgattgattggctgcgcgatgacttcctccaatcgatgaaatccatcaaaaatcacctctaccgtcaatcccaaccatcaggcctctggttcattggagaaatcgctgaaaacgatgatttctacccaaaaatggatcacttggtgtgctttttatccggatccctggctctttctcacttaaatggactagatgaaaatggggaacatattagaatggccaagaaaatcggagaaatttgccataaaatgtatcaaaatccaactggtcttggccccgaaatcattcatttcaatatcgaaaatcgaacagacgacgtatccagagaagattcttatgtcaaaagtctagatgctcattctctgctccgtccagaagccattgaagcctggttttatttgtatcgtgtcaccaaggacccaaaatatcaagaatggggatggtcagcgtttgaagccattgaaaaatacgcgaaagtggagactggaggatacagttcaatcgataatgtccttcggaagaaggttagaagacgtgacaagatggaatccttcttcccagctgagacgctgaagtatctgtatttgctgctggccgatgatcaggagattctgccgttggatcgatgggtattcaataccgaagcacacccattgcctctttataattga

SEQ ID NO: 58652 - protein, 522 aa, Caenorhabditis briggsae
MFLIICLVSMQLLVFLFVFLATPSDSLNPKRQRFFGTSSENCAMISTTKRKIAANKLKRAPPIFQGPSNDRQRAIVAAFQHSWTGYKKYAWGHDELLPVSKRFDDPFQLGLTIVDSLDTAIIMGLETETREGVEWIRNSLNVSPSKSVNVFETTIRVLGGLLSGYHLTGEEALLEKAAKLGDNLLNAFTKSKSPIPKSDVDLGTGAAFSPNRGYSSLAEATTLQLEFRDLSVLTGDKKYEETAFAASEHVHKTKCAEYDGLCFYHIDENGEFKKTAITLGARADSYYEYLIKQWLQTKKSIDWLRDDFLQSMKSIKNHLYRQSQPSGLWFIGEIAENDDFYPKMDHLVCFLSGSLALSHLNGLDENGEHIRMAKKIGEICHKMYQNPTGLGPEIIHFNIENRTDDVSREDSYVKSLDAHSLLRPEAIEAWFYLYRVTKDPKYQEWGWSAFEAIEKYAKVETGGYSSIDNVLRKKVRRRDKMESFFPAETLKYLYLLLADDQEILPLDRWVFNTEAHPLPLYN

SEQ ID NO: 58653 - DNA, 1926 bp, Xenopus laevis
  CDS (1)..(1926)
atgtactccccgcagcgccgggactttctgtccgtgactgtgagccaggccgagggctacaataacagcaagggctggaggagaaagtcctgctggaggaaatggaagcagctgtcgaggttccagcgcaacatcattctgttcctgtgcgttgtactcgctgtctgcaccgtggtctcattctccaacctgggcgagcactggagagccctaatcagccaatcagaagagcattatgagtcccaggatgggcctggggttaaagccgtgctgccggcccctaagagagaggaagactcagacctgatgttgctcaaacctcctgctcagaaacccaggagaccccacaaacgcggcccccccatcttgcagccaccccctacgccaggccagaaagtggaagacaacgagcagagaccggaccaagttgagaaccagcagccagtaatcagctggcgcggcgccgttatagacccagtccaaccctcggaacctactgtgaataaagtacaaaaggcgactgcagctgctccggttgccaatgaaaaggaaccagtccctatcagcgagcgtcaggaggcagtgaaggaggcattccgccatgcttggaagggctacacggagcacgcatgggggcacgatgaactgaagcccatctctaaatcctacagcgagtggttcgggctggggctgaccctcatcgatgccctggacaccatgtggatcatgggactgaaggaagagtttgagaaagcccgggagtgggtcggcaatcggctcaccttcgacaagaacgtagacgtcaacctgtttgagagcacaatccggatcctgggggggctgctgagcacgtatcacctgaccaaagaccccatcttcctagataaagctaaagacatcggtacccgcttgctgccagccttcaacactccgtccaaggttcctttctccgatgtgaacattgggcgtgggacggcccacccccctcgctggacctctgacagcaccgtggccgaagtgaccagcgtacaactggaattccgggagctgagccgaatcacaggggacgaccgcttccagaaatccgtcgatcaggtgacccagcacgtgcacagtctgcccgggaaacgggacggtctggtaccgatgttcatcaacacaaacagcggccagttcactcacctgggggtgttcactttgggcgccagagctgacagttactacgagtatctgctgaagcagtggattcagagcggcaagaaggagaatgggttcctagaagattacatgcaggctatcgagggagtgaagaagaaccttctgcggaaatcccaccccaaccagctgacgtttgtgggagaattatctcacgggcacttcagtcccaagatggaccacctggtgtgtttccttcccggaacgcttgccctaggagctcacaacggcatcacggcggatcacatggagatcgccacggccttgatggaaacctgttaccagatgtacaagcagatggagaccggcctgagccccgagatctcccacttcttcctgagcggggcacagaagggcagcaaggatatcgatgtgaagccggccgaccgtcacaacctcctgcgcccagagacggtggaaagtctcttctacttgtaccgcttcaccggtgataccaaataccaggactgggggtgggagatactgcagagctttaacaaatacacgcgggtttcaggtggcggtttcacttccatcaacaacgtacagagcaccgagaaccccgagccacgggacaagatggagagcttcttcctgggcgagaccctcaagtacctgtacctgctcttttccgacgacgtggaccttattaacctggacaagtttgtgttcaacacggaagcccacccgctgcccatctggaactcatag

SEQ ID NO: 58654 - protein, 641 aa, Xenopus laevis
MYSPQRRDFLSVTVSQAEGYNNSKGWRRKSCWRKWKQLSRFQRNIILFLCVVLAVCTVVSFSNLGEHWRALISQSEEHYESQDGPGVKAVLPAPKREEDSDLMLLKPPAQKPRRPHKRGPPILQPPPTPGQKVEDNEQRPDQVENQQPVISWRGAVIDPVQPSEPTVNKVQKATAAAPVANEKEPVPISERQEAVKEAFRHAWKGYTEHAWGHDELKPISKSYSEWFGLGLTLIDALDTMWIMGLKEEFEKAREWVGNRLTFDKNVDVNLFESTIRILGGLLSTYHLTKDPIFLDKAKDIGTRLLPAFNTPSKVPFSDVNIGRGTAHPPRWTSDSTVAEVTSVQLEFRELSRITGDDRFQKSVDQVTQHVHSLPGKRDGLVPMFINTNSGQFTHLGVFTLGARADSYYEYLLKQWIQSGKKENGFLEDYMQAIEGVKKNLLRKSHPNQLTFVGELSHGHFSPKMDHLVCFLPGTLALGAHNGITADHMEIATALMETCYQMYKQMETGLSPEISHFFLSGAQKGSKDIDVKPADRHNLLRPETVESLFYLYRFTGDTKYQDWGWEILQSFNKYTRVSGGGFTSINNVQSTENPEPRDKMESFFLGETLKYLYLLFSDDVDLINLDKFVFNTEAHPLPIWNS

SEQ ID NO: 58655 - DNA, 1932 bp, Xenopus laevis
  CDS (1)..(1932)
atgaccaccccagcccttctcccactcacagggcgccggatcccagccctgaacctcggaacttcatcctttccccaccatcgggccaccctgagactctccgagaaattcattctgcttctcatcctcagtgcctttatcaccctgtgtttcggggctttcttttttctccccgactcctccaagcacaaacgctttgacctgggcctggaggatgtgcttatcccccatatcgagtctgataaaggaggcaagaactctgggagtcttctcatccacggacaaggccacgacgggcaccgacacagggaggaggaggagcagctgagaaacaagatccgtgccgaccatgagcgggcgctagaggaggccaaagagaagctgaagaagtcgcgggatgagatccgagccgagattcagacggagaagagtaagctggtcgaagagctaaagaaaaaggataacccaccccttccacttgcccccgtccccaacctcccagagataaagaatggggatcccggggaccccgacatcagagagaaacgggacaaaattaaagagatgatgaaacatgcctgggacaattacaaacagtatggctggggccacaatgagctcaaacccattgccaggaagggccactccacaaacatatttggaaattctcagatgggagccacaattgtggatgccctggacaccctgtacattatggggctcctggatgagttcagggatggacaggagtgggtgcaaaataacctggactttggtgtgaatgccgaggtgtctgtgtttgaggtgaacatccgtttcattggtggtttgctggcagcgttctacctgtctgggcaagaggtttttaagaacaaggcagttctgctggcagagaagcttctccctgcgttcaacaccccaactggaattccgtgggctatggtgaacctcaaaaccggtgttggcaggaactggggctgggcatcggcagggagcagtatcctggcagagtttggcaccctacacctggagtttgtgcatcttagttacctgacggggaaccctgtttattataacaaggttatgcacattcggaaactcctgcagaagatggatcggcccaatggacttttccccaattacttgaatcccaggacggggcgctgggggcagcaccacacgtcggtgggaggtttgggtgacagtttctacgaatacctgctgaaggcttggctgctgtcagaccgcactgacctggaggcgcgccatatgtacgacagcgctattgacgccatagagagacacctgatccgcaagtctggagggggtctgacgtttatcggcgagtggaagaacgggcacctggagaggaagatgggtcacctgacgtgctttgcggggggcatgctggcgctgggtgctgacggctcccctggagaaaaggccggtcactacctacagctgggggctgagattgcccacacgtgccacgagtcttacgaccggacggtgctaaagttgggccccgaggcctttaagtttgatggtggagcagaggcggtggcagtgagacagaatgagaagtattacatcctgaggccggaggtcattgagacttattggtacatgtggcgctttacccacgacccaaaataccggcagtggggctgggaggctgctcaggccattgataagtactgcagggtgagtgggggattctctggaatcaaagacgtgtattcctcgtctccaacctacgatgatgttcagcagagtttcttcctggctgagaccctaaagtacctgtacctcctcttctccagtgacgacctcctgccattggataactgggtgttcaacacggaggcccacccattaccagtgatccatttgctgaacaccaccctgcctggtaaccatgtgatgcgatag

SEQ ID NO: 58656 - protein, 643 aa, Xenopus laevis
MTTPALLPLTGRRIPALNLGTSSFPHHRATLRLSEKFILLLILSAFITLCFGAFFFLPDSSKHKRFDLGLEDVLIPHIESDKGGKNSGSLLIHGQGHDGHRHREEEEQLRNKIRADHERALEEAKEKLKKSRDEIRAEIQTEKSKLVEELKKKDNPPLPLAPVPNLPEIKNGDPGDPDIREKRDKIKEMMKHAWDNYKQYGWGHNELKPIARKGHSTNIFGNSQMGATIVDALDTLYIMGLLDEFRDGQEWVQNNLDFGVNAEVSVFEVNIRFIGGLLAAFYLSGQEVFKNKAVLLAEKLLPAFNTPTGIPWAMVNLKTGVGRNWGWASAGSSILAEFGTLHLEFVHLSYLTGNPVYYNKVMHIRKLLQKMDRPNGLFPNYLNPRTGRWGQHHTSVGGLGDSFYEYLLKAWLLSDRTDLEARHMYDSAIDAIERHLIRKSGGGLTFIGEWKNGHLERKMGHLTCFAGGMLALGADGSPGEKAGHYLQLGAEIAHTCHESYDRTVLKLGPEAFKFDGGAEAVAVRQNEKYYILRPEVIETYWYMWRFTHDPKYRQWGWEAAQAIDKYCRVSGGFSGIKDVYSSSPTYDDVQQSFFLAETLKYLYLLFSSDDLLPLDNWVFNTEAHPLPVIHLLNTTLPGNHVMR

SEQ ID NO: 58657 - DNA, 2703 bp, Xenopus laevis
  CDS (1)..(2703)
atgtggctggtggtggccttctgtctgctgggacacggacatgctgctgtgaccaaggaggagaaggctcacttaaggagtcaagtgctggagatgttcgatcatgcatacggaaattatatgcaacacgcttacccagctgacgaacttatgcccttgacctgccgtggaagaatacgtggccaggaacccagcagaggggatgttgatgacgctttgggaaaattttcgctaacattaatcgacacactggacacacttgtggtgttaaacaaaaccaaggagtttgaagatgcagtccgaaaagtgattactgatgtcaatttagacaatgatatagtggtgtctgtctttgagacaaatatcagagtcttgggcggcctccttggtggacactcagttgccatcatgctgaaagaaaatggggatggcatgcagtggtacaatgatgaactcctgcacatggctaaagagcttggctataagcttctcccagcgttcaacactaccagtggccttccctaccccagaattaacttaaaatttggcatcagaaggccagaggctcggacggggacagagactgatacgtgtacagcttgcgcaggaacaatgatcttggaattcgctgcactgagccgctttactggaatatcagtatttgaggaacatgctcggaaagccctagatttcctctgggacaaaaggcagcgcagcagtaacctggtcggtgtgacaattaatatccatacaggggactgggtgcgcaaagacagcggagtgggagcaggaatagattcttactatgaatatttactgaaggcctacgttctcctgggggatgacagctatctggaaagattcaatacacactatgatgccattatgcgatacataagccagcctccactcctgcttgatgtacatatccacaaaccaatgctgacagcacggacatggatggattcactacttgcatttttccctggtctccaggtgttgaagggggatatcagacctgcaattgagactcacgaaatgctttaccaggtgataaaaaagcacaatttcctgccagaggccttcacaactgatttcagggttcactgggcccagcaccctttaagaccagagtttgctgaaagtacttatttcctctataaagccactggtgatccttactacctcgaagtgggaaaaactctgattgataatctgaataaatatgcacgggtgccatgtggattcgctgctgttaaagatgtgcggacaggaagccatgaagaccgaatggattcctttttcctggcagagatgtttaagtacctctatttgctgttctccgaaagggaagatcttatatttgatatagaagattatatattcactacagaagcacatctcctacctctctctctttccactgcaaatccgagcagcacaaagaaaaacacaactactcagtacactgaactagatgatagtaactttgattggtcctgcccaaacacccagatcctgttccgaaatgacccaatgtacgcacagaatattcgggaacctctgaaaaatgtcgttgataagaattgtcctcggagtccttctcgtctggatgagatttctggcagtggtaaaatgccacctctacgggctcgtgattttatggcctctaattcagagcatttagagatcctaaagaagatgggtgtgagtctgattcacctcaaggatggccgtgttcagttggtccaacatgccaaccaagctgcaagctctattgatgctgaggatggccttcgattcatgcaagaaatgattgagctctccagccagcagcagaaagagcagcaactgcctccccgtgccgtgcagattgtgtcccacccgttttatgggagagtcgtattaactgcgggacccgctcagtttggcatggacctttcgaaacatttagcaggggcacaagggctggtagctagagctgagccatacagcgggtgctctgatatcaccaacggacaggcaatacaaggcaagattgcactgatgcagagaggtcagtgtatgtttgctgagaaggctcgcaatgtgcagaaagctggggccattggagggattgttatagatgacaatgaaggcagcagcagtgacactgcccctctcttccaaatggctggagatgggaagagtacggatgacgtcaccatccccatgttgtttctcttcagtaaggaaggaaatatcattcttgatgccattcgtgaataccagcaggtggaggttctactttcagacaaagccaaagaccgagatttagaaagtgaaagtggagaacagaagccagtagaaaacgattcccagaaacaggcattggaagatctttttatgactccagaagaaattgcagaacttcttatagtgcatgaggaagaatcacctgtttctcagccagaggtgccaagttctgactctccatctggtggggacagaacttcagaaagagacattacaccagaaagtcaagaacataagaccgaagagactgaacacagcccgaaagacaatgttcagaccccaccagaaaactctgaagactccacagaggagaaaatggacaacaaagttcagccaatggagtcaatattggccgactggaaagaggacattgaggcctttgaaatgatggagaaggatgaactatga

SEQ ID NO: 58658 - protein, 900 aa, Xenopus laevis
MWLVVAFCLLGHGHAAVTKEEKAHLRSQVLEMFDHAYGNYMQHAYPADELMPLTCRGRIRGQEPSRGDVDDALGKFSLTLIDTLDTLVVLNKTKEFEDAVRKVITDVNLDNDIVVSVFETNIRVLGGLLGGHSVAIMLKENGDGMQWYNDELLHMAKELGYKLLPAFNTTSGLPYPRINLKFGIRRPEARTGTETDTCTACAGTMILEFAALSRFTGISVFEEHARKALDFLWDKRQRSSNLVGVTINIHTGDWVRKDSGVGAGIDSYYEYLLKAYVLLGDDSYLERFNTHYDAIMRYISQPPLLLDVHIHKPMLTARTWMDSLLAFFPGLQVLKGDIRPAIETHEMLYQVIKKHNFLPEAFTTDFRVHWAQHPLRPEFAESTYFLYKATGDPYYLEVGKTLIDNLNKYARVPCGFAAVKDVRTGSHEDRMDSFFLAEMFKYLYLLFSEREDLIFDIEDYIFTTEAHLLPLSLSTANPSSTKKNTTTQYTELDDSNFDWSCPNTQILFRNDPMYAQNIREPLKNVVDKNCPRSPSRLDEISGSGKMPPLRARDFMASNSEHLEILKKMGVSLIHLKDGRVQLVQHANQAASSIDAEDGLRFMQEMIELSSQQQKEQQLPPRAVQIVSHPFYGRVVLTAGPAQFGMDLSKHLAGAQGLVARAEPYSGCSDITNGQAIQGKIALMQRGQCMFAEKARNVQKAGAIGGIVIDDNEGSSSDTAPLFQMAGDGKSTDDVTIPMLFLFSKEGNIILDAIREYQQVEVLLSDKAKDRDLESESGEQKPVENDSQKQALEDLFMTPEEIAELLIVHEEESPVSQPEVPSSDSPSGGDRTSERDITPESQEHKTEETEHSPKDNVQTPPENSEDSTEEKMDNKVQPMESILADWKEDIEAFEMMEKDEL

SEQ ID NO: 58659 - DNA, 1737 bp, Homo sapiens
  CDS (1)..(1737)
atgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacacggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataa

SEQ ID NO: 58660 - protein, 578 aa, Homo sapiens [sequence omitted]

SEQ ID NO: 58661 - DNA, 2028 bp, Mus musculus
  CDS (1)..(2028)
atgcggggaggcggtcggctggggacgcgcccggcgcttcaaaataatgcccgcggcggacgcgcgaccatgcaatggcgagcgcttgtcctggggctggtgctgctgcgcctcggcctccacgcggtgctctggttggtcttcgggctggggcccagcatgggcttctaccagcggtttccgctcagcttcggcttccagcgcttgagggaccccgacggctcggggccagttggtccgcccggaggcccggcctggcttcatcggccaaggcgcggaacggaggggcggcttgagaccccgccagagccgggaccgacgccgggaccgggcgtgtgcggcccggcgcactggggctatgccctgggcggcggtggctgcggcccggacgagtacgagcggcgctacagcggcgccttcccgccgcagctgcgtgcccagatgcgcgacctggcgcggggcatgttcgtcttcggctatgacaactacatggcgcacgcctttccgcaggacgagctcaaccccatctactgccgcggccgggggcctgaccgcggagacccttccaatctgaacatcaatgatgtcctagggaattactctctgactctggttgatgccttggatacattggcaataatgggaaattcatccgagttccagaaggcagtcaagttagtgatcaacactgtttcatttgacaaagattccacagtccaggtcttcgaagctacgataagggttctgggaagcctcctttctgctcacagaataataactgattccaaacagccctttggtgacatgacaattgaggattatgataatgaattgttgtacatggcccatgacttggctgtgcggctccttccagcctttgaaaacaccaagacagggatcccctatcctcgggtgaatctgaagacaggtgttcctcctgacagcaataatgagacctgcacagcgggggccggttctctcctggtggaatttgggattctgagccgcctgctgggggattccacttttgagtgggttgccagacgagctgtgaaagccctctggaacttgcggagcaacgatacaggattattaggcaatgttgtgaacatccagacaggccattgggttggaaagcagagtggcttgggtgctgggctggattccttctatgagtacctcttgaaatcttacattctttttggagaaaaagaagatctagagatgtttaatgctgcgtatcagagcatccagagctacctgcgaagaggccgggaagcctgcaatgaaggagaaggagacccaccgctctacgtcaacgtgaacatgttcagtgggcagctcatgaacacctggattgactcactgcaggctttcttccctggactgcaggttctgataggggatgtggaagatgccatctgcctacacgccttctactatgccatatggaagcggtacggggccctccctgagcgctataactggcaactccaggcccctgatgttctcttctaccctctgagaccagagctagtggagtccacatatctcctctaccaggcaaccaagaatcccttctacctccatgtaggaatggacattctgcagagtcttgaaaaatacacaaaagtcaaatgtggatatgctacgctgcatcacgtcatagacaagtctaaagaagaccggatggaaagcttctttctcagcgagacttgcaaatacttgtatctgctatttgatgaagagaatccagtacacaaatctggaaccagatacatgtttacaactgagggccatatcatatctgtggacaaacgtcttcgggaattgccttggaaggaattcttctctgaagatggggagcgggaccaagaggaaaagtttgtacacagacctaagtctcaggagctcagagtcattaactccagttctaattgtaatcgtgttcctgatgagaggagatactccttgcccttaaagagcatctacatgcgccagatcgaccagatggttggcttgatttga

SEQ ID NO: 58662 - protein, 675 aa, Mus musculus
MRGGGRLGTRPALQNNARGGRATMQWRALVLGLVLLRLGLHAVLWLVFGLGPSMGFYQRFPLSFGFQRLRDPDGSGPVGPPGGPAWLHRPRRGTEGRLETPPEPGPTPGPGVCGPAHWGYALGGGGCGPDEYERRYSGAFPPQLRAQMRDLARGMFVFGYDNYMAHAFPQDELNPIYCRGRGPDRGDPSNLNINDVLGNYSLTLVDALDTLAIMGNSSEFQKAVKLVINTVSFDKDSTVQVFEATIRVLGSLLSAHRIITDSKQPFGDMTIEDYDNELLYMAHDLAVRLLPAFENTKTGIPYPRVNLKTGVPPDSNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQSYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSKEDRMESFFLSETCKYLYLLFDEENPVHKSGTRYMFTTEGHIISVDKRLRELPWKEFFSEDGERDQEEKFVHRPKSQELRVINSSSNCNRVPDERRYSLPLKSIYMRQIDQMVGLI

SEQ ID NO: 58663 - DNA, 1722 bp, Brachydanio rerio
  CDS (1)..(1722)
atgttgtattatttacctctgttcacatctcgttacttcatgcttactttccttttctccgccattttctgcgccgcgtacctgtctccgatcatcagtcatgttaaaggcagagactttactgagcaggaaatgtctcattacagggacagagtaaagtccatgttttatcatgcatataacagctatctggacaatgcgtatccatatgatgagctgaggccgctgacctgtgatggacaggacacctggggcagtttctccctcacactcatagatgctctggacacattgctgattctaggaaaccacacagagtttcagcgtgtggccactctgcttcaggacactgttgacttcgacatcgacgtcaatgcgtctgtgtttgagacaaatatacgagtggtcggtgggcttctctcggctcatctgctctccaagcgtgctgggatgaaggtggaggagggctggccctgctctggaccccttctgcgcatggcagaggacgccgctcgaaaactgcttcctgctttccagacgcccacagggatgccgtatggaacagtaaacctgctgcggggagtgaaccccggcgaaacccctgtcacctgcaccgccggagtgggcaccttcatcctagagttttccaccctcagtcgactcaccggtgaccctgtgttcgagaatgtggcccgcaaagctctcagggccttatggagaacgcgctctgacatcggcctggtgggcaatcacatagatgtcataacctcgaagtgggtcgctcaggacgcagggattggagcaggagttgattcatatttcgaatatcttgtaaggggtgccatcatgcttcaagatgaggagctgttgacaatgttctatgaatttgataagtccataaagaactacactaagtttgatgattggtatctgtgggtgcagatgcataaaggaacagtatcaatgcctgtgtttcagtctctggaggcgttctggcctggaatgcagagtttaataggtgatatttccagtgctacaaagagcttccacaactactacagcgtgtggcggcagtttggaggtcttccagaattctacagcattcctcaaggttacacagtggacaagcgagagggatatccactgcggccagagttaatagagagcgcaatgtatctgtataaggccactggggacccttcattcatccagcttggccgagatgcagtggagtccattgacagaatcagccgggtcaactgtggttttgccactgtgaaggatgtaagggaccacaagttggacaaccgcatggaatccttcttcctagccgagaccattaaatacctctacctcctcttcgatcctgacaacttccttcacaacacgggcacagagtttgagctggggggtctgcggggtgactgtattctcagcgcggggggctatgtgttcaacacagaggctcatccgctggaccccgccgcactccactgctgcagccgagagcagcaggaccgcagggagattcaggacatcctcctcagcttctcgcagccgcatacagaggagccatcacgggaccagagcgcaggtggctctccggagagcattgcactgaagccgggagagcagaggaaagcgccggtgctctcctgccctacgcagcccttcagtgccaaactggccgtcatgggtcaggtcttctctgacaactcttga

SEQ ID NO: 58664 - protein, 573 aa, Brachydanio rerio
MLYYLPLFTSRYFMLTFLFSAIFCAAYLSPIISHVKGRDFTEQEMSHYRDRVKSMFYHAYNSYLDNAYPYDELRPLTCDGQDTWGSFSLTLIDALDTLLILGNHTEFQRVATLLQDTVDFDIDVNASVFETNIRVVGGLLSAHLLSKRAGMKVEEGWPCSGPLLRMAEDAARKLLPAFQTPTGMPYGTVNLLRGVNPGETPVTCTAGVGTFILEFSTLSRLTGDPVFENVARKALRALWRTRSDIGLVGNHIDVITSKWVAQDAGIGAGVDSYFEYLVRGAIMLQDEELLTMFYEFDKSIKNYTKFDDWYLWVQMHKGTVSMPVFQSLEAFWPGMQSLIGDISSATKSFHNYYSVWRQFGGLPEFYSIPQGYTVDKREGYPLRPELIESAMYLYKATGDPSFIQLGRDAVESIDRISRVNCGFATVKDVRDHKLDNRMESFFLAETIKYLYLLFDPDNFLHNTGTEFELGGLRGDCILSAGGYVFNTEAHPLDPAALHCCSREQQDRREIQDILLSFSQPHTEEPSRDQSAGGSPESIALKPGEQRKAPVLSCPTQPFSAKLAVMGQVFSDNS

SEQ ID NO: 58665 - DNA, 1803 bp, Brachydanio rerio
  CDS (1)..(1803)
atggcattcgctcgcacgcacgcgcagtgtgtgcacttcctattattattattgtatagtatttgtgcacctccatgtagccgggaattattgtattatttacctctgttcacatctcgttacttcatgcttactttccttttctccgccattttctgcgccgcgtacctgtctccgatcatcagtcatgttaaaggcagagactttactgagcaggaaatgtctcattacagggacagagtaaagtccatgttttatcatgcatataacagctatccggacaatgcatatccatatgatgagctgaggccgctgacctgtgatggacaggacacctggggcagtttctccctcacactcatagatgctctggacacattgctgattctaggaaaccacacagagtttcagcgtgtggccactctgcttcaggacactgttgacttcgacatcgacgtcaatgcgtctgtgtttgagacaaatatacgagtggtcggtgggcttctctcggctcatctgctctccaagcgtgctgggatgaaggtggaggagggctggccctgctctggaccccttctgcgcatggcagaggacgccgctcgaaaactgcttcctgctttccagacgcccacagggatgccgtatggaacagtaaacctgctgcggggagtgaaccccggcgaaacccctgtcacctgcaccgccggagtgggcaccttcatcctagagttttccaccctcagtcgactcaccggtgaccctgtgttcgagaatgttgcccgcaaagctctcagggccttatggagaacgcgctctgacatcggcctggtgggcaatcacatagatgtcataacctcgaagtgggtcgctcaggatgcaggcattggagcaggagttgattcatatttcgaatatcttgttaagggtgccatcatgcttcaagatgagaagctgttgacaatgttttatgaatttgataagtccataaagaactacactaagtttgatgattggtatctgtgggtgcagatgcataaaggaacagtatcaatgcctgtgtttcagtctttggaggcgttctggcctggaatgcagagtttaataggtgatatttccagtgctacaaagagcttccacaactactacagcgtgtggcggcagtttggaggtctcccagaattctacagcattcctcaaggttacacagtggacaagcgagagggatatccactgcggccagagttaatagagagcgcaatgtatctgtataaggccactggagacccttcaatcatccaacttggccgagatgcagtggagtccattgacagaatcagccgggtcaactgtggctttgccactgatgtaagggaccacaagttggacaaccgcatggaatccttcttcctagccgagaccattaaatacctctacctcctcttcgatcctgacaacttccttcacaacacgggcacagagtttgagctggggggtctgcggggtgactgtattctcagcgcggggggctatgtgttcaacacagaggctcatccgctggaccccgccgcactccactgctgcagccgagagcagcaggaccgcagggagattcaggacatcctcctcagcttctcgcagccgcaaacagaggagccaccacgggaccagaacgcaggtggctctccggagagcattgcactgaagccgggagagcagaggaaagcgccggtgctctcctgccctacgcagccctttagtgccaaactggccgtcatgggtcaggtcttctctgacaactcttga

SEQ ID NO: 58666 - protein, 600 aa, Brachydanio rerio
MAFARTHAQCVHFLLLLLYSICAPPCSRELLYYLPLFTSRYFMLTFLFSAIFCAAYLSPIISHVKGRDFTEQEMSHYRDRVKSMFYHAYNSYPDNAYPYDELRPLTCDGQDTWGSFSLTLIDALDTLLILGNHTEFQRVATLLQDTVDFDIDVNASVFETNIRVVGGLLSAHLLSKRAGMKVEEGWPCSGPLLRMAEDAARKLLPAFQTPTGMPYGTVNLLRGVNPGETPVTCTAGVGTFILEFSTLSRLTGDPVFENVARKALRALWRTRSDIGLVGNHIDVITSKWVAQDAGIGAGVDSYFEYLVKGAIMLQDEKLLTMFYEFDKSIKNYTKFDDWYLWVQMHKGTVSMPVFQSLEAFWPGMQSLIGDISSATKSFHNYYSVWRQFGGLPEFYSIPQGYTVDKREGYPLRPELIESAMYLYKATGDPSIIQLGRDAVESIDRISRVNCGFATDVRDHKLDNRMESFFLAETIKYLYLLFDPDNFLHNTGTEFELGGLRGDCILSAGGYVFNTEAHPLDPAALHCCSREQQDRREIQDILLSFSQPQTEEPPRDQNAGGSPESIALKPGEQRKAPVLSCPTQPFSAKLAVMGQVFSDNS

SEQ ID NO: 58667 - DNA, 3132 bp, Dictyostelium discoideum
  CDS (1)..(3132)
atgataaggaatttaactttattatcaaaaagttcattagatccaaaatgtttaatcttaaaacattcaaacaaaaacctcaataattatttcaaacaaataacatttcgttattatagtaaaaccaacccaatcattaaacaacaaaatcataataatattaataactataataatacaacaccagaaactcaagaaagaattaatgaattattaaaattattccctccaataaagtatggatttgcatatggttcaggtgtaatttcacaaaaaggttacaatagaaatggtgatggatcaacctcaactgaaaatccatcaaaaaaagaagaacaatcaccaatgattgatttaatatttgctgttgaaaactcaactaaatggcattctctcaatcttgtaaataatcaatcacattattcttttcttggtttgatgggtgctcatatagttgcaaaagttcaatatatgaatgctaaaatttattttaatacattattagaacataatggaattaaatttaaatatggtgttattgaatataaagatttaatagatgatttaaagaattggaaaacattatatttatcaggtagaatgcaaaaaccaattttcaatttaccaacatcaagtacagaaggattgaaagagattcaagagattaatagtgaatataatttaaaaaatgctgtaatcacatcattattaatgttacctgaaacatttacagagtatgatctttatcatacaatctcaaaactatcctatagtggtgatataagaatgaaaggtgctgaaaatccaatgaaaactcataatatcacaacaacaacagcagcaccaaaaatggttacattcaaatcaaaacaagatccaatgaattatttaaatttattaatgatgctaccaggaagtattaaatcaacaatgttaaaagaagttagaaataatatgaaattgatgaaatctgatgaaaaaattgatccaacaatacttcacaatttaatatttatgattgtttcaaaaagtagtttcgctcaaacagtaaaaggtcaaatggataatagatcaccaaatggaataacaaaaaatattactctattggtgcctatactattattgtctttaatgccaatagtagtatcatcaacatctgattttaataattcacaacatttttatatcccgaccccaattttaaaagaaagattaaaatcagatgttaaaagaatgttttatcatggatatgataattatattaaatatagttttccaaaggatgaattaaatccaataagttgtagtggtaccaatacatttggagattatgcattaacgtttatagatagtttagatgcattagtagttttaggagatttaaaagaatttgaaagagcaattaaatgggtatcagagaatattagatttgataagaatttaacggtatcagtatttgaaacgaatattcgtgttttaggtggactattatcagcacatttattagcagaggaacatttacaaccaaatagttatgatggttcattattaccattagcaaaggatttaggtgatagattattgaaagcatttgaaacaccaactggtataccgtatggtgctgtcaatctaaagtatggtgtgcccagtggtgaaattgcaattacaagtacagcttcagcaaccacattctcattagagtttggaatattatcgcgacttacaaatgacaggaaatatgatgatgccgcaagaaaggctgttaggtcaatttggaagtataggtcggatttggagttggtgggtaatcatatcaatatcatcaatggtgagtggacgattaaggaagcgggcattggtacaggtgtggactcattctatgagtacctctacaaatcggcaatctatttcgatgatgatgaatatttaagtttattcgagaagaattacaagttaatcaataaatacattaaaaaggacccatggtatgtcgatgtttcaattgatcgtgcatccatagtttggccaatctacaatagtttacaatcgttttggcccggtattcaatcgatgtatggtgattatgagaatgctttctctacaattaaatcatttcatatcgtgtggcgtcgttatggtttcatacctgagggttataatctattgtctggcaatgttcaacctggtcaaaaggggtacccactcagacctgaattggctgaatctttatatcacatgtatcaaactaacaaggatccaatattcattagaatggcaaaagatttggtttggacaatctccaatgtaaccacaaccaaatgtggtcatgccaatatactcgatgttgaatctcatcaattggatgatcgtatggaatctttctttctttcagaaacttgtaaataccttttcttactattcaatagtatagataactataatggaactgatattcatagtgattcaacaacctattcaaatcctaatccaatcgatattgaaaattcaatattcaataccgaaggtcatatatttccaatgcaatcaagattttttaaaaaatttacaaccactactaatgatatttccgatataaatttaattaaaaaagaaaataataataataatagtaataaagaaaaagatattattaaaaataataataataataataataataataataataataacaataatcaaaaaaataaaaataataaaaataataatgaagaagataattttagtgttaataaaataaacgataatgtaaatgataatgaaaaaaaagaagttgtaaaagtaaataataataataataataataataataataataataataataataataataataataataataataataataataataataataataataataataataataataataataataataataataataataaaaaaaataataataataataataatttactattaagttacgatagtactttagaaaaagcaaattggacttgcgaaccattaccatttttaagaagaatatcatctggtactttccaatttattgggggtcctcaagatattgaatggtttgaagataaaaagatcagagatgcgatgtttgatcttacaacttaa

SEQ ID NO: 58668 - protein, 1043 aa, Dictyostelium discoideum
MIRNLTLLSKSSLDPKCLILKHSNKNLNNYFKQITFRYYSKTNPIIKQQNHNNINNYNNTTPETQERINELLKLFPPIKYGFAYGSGVISQKGYNRNGDGSTSTENPSKKEEQSPMIDLIFAVENSTKWHSLNLVNNQSHYSFLGLMGAHIVAKVQYMNAKIYFNTLLEHNGIKFKYGVIEYKDLIDDLKNWKTLYLSGRMQKPIFNLPTSSTEGLKEIQEINSEYNLKNAVITSLLMLPETFTEYDLYHTISKLSYSGDIRMKGAENPMKTHNITTTTAAPKMVTFKSKQDPMNYLNLLMMLPGSIKSTMLKEVRNNMKLMKSDEKIDPTILHNLIFMIVSKSSFAQTVKGQMDNRSPNGITKNITLLVPILLLSLMPIVVSSTSDFNNSQHFYIPTPILKERLKSDVKRMFYHGYDNYIKYSFPKDELNPISCSGTNTFGDYALTFIDSLDALVVLGDLKEFERAIKWVSENIRFDKNLTVSVFETNIRVLGGLLSAHLLAEEHLQPNSYDGSLLPLAKDLGDRLLKAFETPTGIPYGAVNLKYGVPSGEIAITSTASATTFSLEFGILSRLTNDRKYDDAARKAVRSIWKYRSDLELVGNHINIINGEWTIKEAGIGTGVDSFYEYLYKSAIYFDDDEYLSLFEKNYKLINKYIKKDPWYVDVSIDRASIVWPIYNSLQSFWPGIQSMYGDYENAFSTIKSFHIVWRRYGFIPEGYNLLSGNVQPGQKGYPLRPELAESLYHMYQTNKDPIFIRMAKDLVWTISNVTTTKCGHANILDVESHQLDDRMESFFLSETCKYLFLLFNSIDNYNGTDIHSDSTTYSNPNPIDIENSIFNTEGHIFPMQSRFFKKFTTTTNDISDINLIKKENNNNNSNKEKDIIKNNNNNNNNNNNNNNNQKNKNNKNNNEEDNFSVNKINDNVNDNEKKEVVKVNNNNNNNNNNNNNNNNNNNNNNNNNNNNNNNNNNNNNNNNNNNKKNNNNNNNLLLSYDSTLEKANWTCEPLPFLRRISSGTFQFIGGPQDIEWFEDKKIRDAMFDLTT

SEQ ID NO: 58669 - DNA, 1894 bp, Mus musculus
  CDS (84)..(1817)
gggaagaaccagccgcggctcggaggatgagctggtggcggtggctgcagctgctgcggcggcactgacaggacacgagctctatgcctttccggctactcatcccgctcggcctcgtgtgcgtgctgctacccctgcaccatggtgcgccaggccccgacggcaccgcgcccgaccccgcccactacagggagcgagtcaaggccatgttctaccacgcctacgacagttacctggaaaatgcctttccctacgatgagctgagacctctcacctgtgatgggcacgacacctggggcagtttttctctgacgctaattgatgccctggacaccttgctgattttggggaatacctctgaattccaaagagtagtggaggttcttcaggacaatgtggactttgatatcgacgtgaacgcctctgtgttcgaaaccaacatccgagtggtaggaggactcctttctgctcatctcttgtcaaagaaggccggtgtggaggtggaagccgggtggccttgttctgggcctctcctcaggatggcggaggaagcagcccggaaactcctcccagcatttcagacccccacgggcatgccctatggaactgtgaacctgcttcatggcgtgaaccctggagagacccctgttacctgtacagcagggattgggaccttcattgtggaatttgctaccctgagcagcctcaccggtgaccctgtgtttgaagatgtggccagagtggccctgatgcgtctctgggagagccggtcagatatcgggctggttggcaatcacatcgatgtgctcactggcaagtgggtggcccaggatgcaggcatcggggctggtgtggattcctattttgagtacctggtaaaaggagccatccttcttcaggataagaaactcatggccatgttcctagagtacaacaaagccatccggaattacacgcacttcgatgactggtacctctgggtgcagatgtacaaggggaccgtgtcaatgcctgtcttccagtccttggaggcctactggcctggccttcagagccttattggagacattgacaatgccatgaggacctttctcaactactacactgtatggaagcagtttggggggctgccagaattctacaacattcctcagggatacacagtggagaagcgagaaggctacccactccgaccggagctcatcgagagcgcaatgtacctctaccgcgccactggggatcccactctcttagaacttgggagagacgctgtggaatccattgagaaaatcagcaaggtggagtgtggatttgccacgatcaaggacctccgggaccacaagcttgacaaccgcatggagtctttcttcctggctgaaactgtgaaatacctctatcttctgttccacccaaacaacttcatccacaacaatggctccacctttgactctgtgatgactccccatggggagtgcatcctaggagccgggggctacatcttcaacacggaggctcaccccattgaccctgctgccttgcactgctgccggaggctcaaggaggagcagtgggaagtggaggacttgataaaggagttgtactccctcaaacagagcaggccaaagagagctcagaggaagacagtgaggtcggggccctgggagccccagtcagggccagccacgctctcctcacctgcaaaccagcccagggagaagcagcctgcccagcagcgaaccccgcttctcagctgccccagccagcccttcacctctaagctggcattgctaggccaggttttcctagactcctcatagccactggataattttctaatttttatttttttgagactaagctctaataataaatctgcttttggctatcaggtttt

SEQ ID NO: 58670 - protein, 577 aa, Mus musculus
MPFRLLIPLGLVCVLLPLHHGAPGPDGTAPDPAHYRERVKAMFYHAYDSYLENAFPYDELRPLTCDGHDTWGSFSLTLIDALDTLLILGNTSEFQRVVEVLQDNVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTHFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFHPNNFIHNNGSTFDSVMTPHGECILGAGGYIFNTEAHPIDPAALHCCRRLKEEQWEVEDLIKELYSLKQSRPKRAQRKTVRSGPWEPQSGPATLSSPANQPREKQPAQQRTPLLSCPSQPFTSKLALLGQVFLDSS

SEQ ID NO: 58671 - DNA, 1915 bp, Mus musculus
  CDS (75)..(1808)
gagccgcggctcggaggatgagctggtggcggtggctgcagctgctgcggcggcactgacaggacacgagctctatgcctttccggctactcatcccgctcggcctcgtgtgcgtgctgctacccctgcaccatggtgcgccaggccccgacggcaccgcgcccgaccccgcccactacagggagcgagtcaaggccatgttctaccacgcctacgacagttacctggaaaatgcctttccctacgatgagctgagacctctcacctgtgatgggcacgacacctggggcagtttttctctgacgctaattgatgccctggacaccttgctgattttggggaatacctctgaattccaaagagtagtggaggttcttcaggacaatgtggactttgatatcgacgtgaacgcctctgtgttcgaaaccaacatccgagtggtaggaggactcctttctgctcatctcttgtcaaagaaggccggtgtggaggtggaagccgggtggccttgttctgggcctctcctcaggatggcggaggaagcagcccggaaactcctcccagcatttcagacccccacgggcatgccctatggaactgtgaacctgcttcatggcgtgaaccctggagagacccctgttacctgtacagcagggattgggaccttcattgtggaatttgctaccctgagcagcctcaccggtgaccctgtgtttgaagatgtggccagagtggccctgatgcgtctctgggagagccggtcagatatcgggctggttggcaatcacatcgatgtgctcactggcaagtgggtggcccaggatgcaggcatcggggctggtgtggattcctattttgagtacctggtaaaaggagccatccttcttcaggataagaaactcatggccatgttcctagagtacaacaaagccatccggaattacacgcacttcgatgactggtacctctgggtgcagatgtacaaggggaccgtgtcaatgcctgtcttccagtccttggaggcctactggcctggccttcagagccttattggagacattgacaatgccatgaggacctttctcaactactacactgtatggaagcagtttggggggctgccagaattctacaacattcctcagggatacacagtggagaagcgagaaggctacccactccgaccggagctcatcgagagcgcaatgtacctctaccgcgccactggggatcccactctcttagaacttgggagagacgctgtggaatccattgagaaaatcagcaaggtggagtgtggatttgccacgatcaaggacctccgggaccacaagcttgacaaccgcatggagtctttcttcctggctgaaactgtgaaatacctctatcttctgttccacccaaacaacttcatccacaacaatggctccacctttgactctgtgatgactccccatggggagtgcatcctaggagccgggggctacatcttcaacacggaggctcaccccattgaccctgctgccttgcactgctgccggaggctcaaggaggagcagtgggaagtggaggacttgataaaggagttctactccctcaaacagagcaggccaaagagagctcagaggaagacagtgaggtcggggccctgggagccccagtcagggccagccacgctctcctcacctgcaaaccagcccagggagaagcagcctgcccagcagcgaaccccgcttctcagctgccccagccagcccttcacctctaagctggcattgctaggccaggttttcctagactcctcatagccactggataattttctaatttttatttttttgagactaagctctaataataaatctgcttttggctatcaggttttacatgctggattcttgataaaatttcactt

SEQ ID NO: 58672 - protein, 577 aa, Mus musculus
MPFRLLIPLGLVCVLLPLHHGAPGPDGTAPDPAHYRERVKAMFYHAYDSYLENAFPYDELRPLTCDGHDTWGSFSLTLIDALDTLLILGNTSEFQRVVEVLQDNVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTHFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFHPNNFIHNNGSTFDSVMTPHGECILGAGGYIFNTEAHPIDPAALHCCRRLKEEQWEVEDLIKEFYSLKQSRPKRAQRKTVRSGPWEPQSGPATLSSPANQPREKQPAQQRTPLLSCPSQPFTSKLALLGQVFLDSS

SEQ ID NO: 58673 - DNA, 1856 bp, Mus musculus
  CDS (53)..(1786)
gggatggcggtggctgcagctgctgcggcggcactgacaggacacgagctctatgcctttccggctactcatcccgctcggcctcgtgtgcgtgctgctacccctgcaccatggtgcgccaggccccgacggcaccgcgcccgaccccgcccactacagggagcgagtcaaggccatgttctaccacgcctacgacagttacctggaaaatgcctttccctacgatgagctgagacctctcacctgtgatgggcacgacacctggggcagtttttctctgacgctaattgatgccctggacaccttgctgattttggggaatacctctgaattccaaagagtagtggaggttcttcaggacaatgtggactttgatatcgacgtgaacgcctctgtgttcgaaaccaacatccgagtggtaggaggactcctttctgctcatctcttgtcaaagaaggccggtgtggaggtggaagccgggtggccttgttctgggcctctcctcaggatggcggaggaagcagcccggaaactcctcccagcatttcagacccccacgggcatgccctatggaactgtgaacctgcttcatggcgtgaaccctggagagacccctgttacctgtacagcagggattgggaccttcattgtggaatttgctaccctgagcagcctcaccggtgaccctgtgtttgaagatgtggccagagtggccctgatgcgtctctgggagagccggtcagatatcgggctggttggcaatcacatcgatgtgctcactggcaagtgggtggcccaggatgcaggcatcggggctggtgtggattcctattttgagtacctggtaaaaggagccatccttcttcaggataagaaactcatggccatgttcctagagtacaacaaagccatccggaattacacgcacttcgatgactggtacctctgggtgcagatgtacaaggggaccgtgtcaatgcctgtcttccagtccttggaggcctactggcctggccttcagagccttattggagacattgacaatgccatgaggacctttctcaactactacactgtatggaagcagtttggggggctgccagaattctacaacattcctcagggatacacagtggagaagcgagaaggctacccactccgaccggagctcatcgagagcgcaatgtacctctaccgcgccactggggatcccactctcttagaacttgggagagacgctgtggaatccattgagaaaatcagcaaggtggagtgtggatttgccacgatcaaggacctccgggaccacaagcttgacaaccgcatggagtctttcttcctggctgaaactgtgaaatacctctatcttctgttccacccaaacaacttcatccacaacaatggctccacctttgactctgtgatgactccccatggggagtgcatcctaggagccgggggctacatcttcaacacggaggctcaccccattgaccctgctgccttgcactgctgccggaggctcaaggaggagcagtgggaagtggaggacttgataaaggagttctactccctcaaacagagcaggccaaagagagctcagaggaagacagtgaggtcggggccctgggagccccagtcagggccagccacgctctcctcacctgcaaaccagcccagggagaagcagcctgcccagcagcgaacccccgttctcagctgccccagccagcccttcacctctaagctggcattgctaggccaggttttcctagactcctcatagccactggataattttctaatttttatttttttgagactaagctctaataataaatctgcttttggctatc

SEQ ID NO: 58674 - protein, 577 aa, Mus musculus
MPFRLLIPLGLVCVLLPLHHGAPGPDGTAPDPAHYRERVKAMFYHAYDSYLENAFPYDELRPLTCDGHDTWGSFSLTLIDALDTLLILGNTSEFQRVVEVLQDNVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTHFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFHPNNFIHNNGSTFDSVMTPHGECILGAGGYIFNTEAHPIDPAALHCCRRLKEEQWEVEDLIKEFYSLKQSRPKRAQRKTVRSGPWEPQSGPATLSSPANQPREKQPAQQRTPVLSCPSQPFTSKLALLGQVFLDSS

SEQ ID NO: 58675 - DNA, 1869 bp, Mus musculus
  CDS (1)..(1869)
atgggcttctaccagcggtttccgctcagcttcggcttccagcgcttgagggaccccgacggctcggggccagttggtccgcccggaggcccggcctggcttcatcggccaaggcgcggaacggaggggcggcttgagaccccgccagagccgggaccgacgccgggaccgggcgtgtgcggcccggcgcactggggctatgccctgggcggcggtggctgcggcccggacgagtacgagcggcgctacagcggcgccttcccgccgcagctgcgtgcccagatgcgcgacctggcgcggggcatgttcgtcttcggctatgacaactacatggcgcacgcctttccgcaggacgagctcaaccccatctactgccgcggccgggggcctgaccgcggagacccttccaatctgaacatcaatgatgtcctagggaattactctctgactctggttgatgccttggatacattggcaataatgggaaattcatccgagttccagaaggcagtcaagttagtgatcaacactgtttcatttgacaaagattccacagtccaggtcttcgaagctacgataagggttctgggaagcctcctttctgctcacagaataataactgattccaaacagccctttggtgacatgacaattgaggattatgataatgaattgttgtacatggcccatgacttggctgtgcggctccttccagcctttgaaaacaccaagacagggatcccctatcctcgggtgaatctgaagacaggtgttcctcctgacagcaataatgagacctgcacagcgggggccggttctctcctggtggaatttgggattctgagccgcctgctgggggattccacttttgagtgggttgccagacgagctgtgaaagccctctggaacttgcggagcaacgatacaggattattaggcaatgttgtgaacatccagacaggccattgggttggaaagcagagtggcttgggtgctgggctggattccttctatgagtacctcttgaaatcttacattctttttggagaaaaagaagatctagagatgtttaatgctgcgtatcagagcatccagagctacctgcgaagaggccgggaagcctgcaatgaaggagaaggagacccaccgctctacgtcaacgtgaacatgttcagtgggcagctcatgaacacctggattgactcactgcaggctttcttccctggactgcaggttctgataggggatgtggaagatgccatctgcctacacgccttctactatgccatatggaagcggtacggggccctccctgagcgctataactggcaactccaggcccctgatgttctcttctaccctctgagaccagagctagtggagtccacatatctcctctaccaggcaaccaagaatcccttctacctccatgtaggaatggacattctgcagagtcttgaaaaatacacaaaagtcaaatgtggatatgctacgctgcatcacgtcatagacaagtctaaagaagaccggatggaaagcttctttctcagcgagacttgcaaatacttgtatctgctatttgatgaagagaatccagtacacaaatctggaaccagatacatgtttacaactgagggccatatcatatctgtggacaaacgtcttcgggaattgccttggaaggaattcttctctgaagatggggagcgggaccaagaggaaaagtttgtacacagacctaagtctcaggagctcagagtcattaactccagttctaattgtaatcgtgttcctgatgagaggagatactccttgcccttaaagagcatctacatgcgccagatcgaccagatggttggcttgatttga

SEQ ID NO: 58676 - protein, 622 aa, Mus musculus
MGFYQRFPLSFGFQRLRDPDGSGPVGPPGGPAWLHRPRRGTEGRLETPPEPGPTPGPGVCGPAHWGYALGGGGCGPDEYERRYSGAFPPQLRAQMRDLARGMFVFGYDNYMAHAFPQDELNPIYCRGRGPDRGDPSNLNINDVLGNYSLTLVDALDTLAIMGNSSEFQKAVKLVINTVSFDKDSTVQVFEATIRVLGSLLSAHRIITDSKQPFGDMTIEDYDNELLYMAHDLAVRLLPAFENTKTGIPYPRVNLKTGVPPDSNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQSYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSKEDRMESFFLSETCKYLYLLFDEENPVHKSGTRYMFTTEGHIISVDKRLRELPWKEFFSEDGERDQEEKFVHRPKSQELRVINSSSNCNRVPDERRYSLPLKSIYMRQIDQMVGLI

SEQ ID NO: 58677 - DNA, 2406 bp, Drosophila melanogaster
  CDS (1)..(2406)
atgtctaccacatcctccgaatcctttgtccgcggccagcggcttatgctcatcttcctggtggccatgtgcatcgtagttgcctgcgtccttagcaccgaaaccaccatgcccacgcagaacatgtccaataaggagcgggcggaactccgggaagaggctcgcgatatgttctatcatgcatacaacgcctacatgcagaacgcctatccagctgatgagcttatgccgctctcctgcaaaggacggtaccgaggagtgacgccatcacgtggcgacatggacgacatccttggaaatttctccatgactctggtggatactctggacactctggtgctcctgggcgatttcacagagtttgatcacgcggtgaagctagttatccgcgaagttcaattcgacagcgacattattgtgtcggtgtttgagacgaacattcgaatggtcggtggcttgctgtcggcgcacatcctggcggagtatctgcaaaagcatgcggacacgatgcattggtacaagggcgaactgctggagatgtctcgcgagctgggctaccgtttgctaccggcgttcaacacatccacgggcattccgcatgcgcgggttaatctccgcctgggcatgaaggacccgatgctcaagaagtcccgtgaaacgtgtacggcgtgtgctggtaccatccttctggaatttgctgctctgtcgcgtctcaccggcgatcccattttcgaggtgcgagctcacgccgccatggatgcactgtggaagctaaggcaccgtggctccgatctcatgggcacggtacttaatgtccattcgggcgattgggtgcgtcgcgattctggagtcggagctggcatcgacagttactatgagtacctgttcaagtcgtacgtcctactgggtgacgacaagtacctggcacgctttaatcgccactacaacgcagtgatgaagtacgtcagcgaaggacccatgctactcgacgtgctcatgcacaggccacatgctaagtccaaaaacttcatggactcgcttctggcattttggccgggcttgcaggtgctatcgggcgatctgaaaccagctgtgcagacacacgagatgctctatcaggtcatgcagatgcacaccttcattccagaagcatttaccgtcgacttccagatccattggggacagcatcccctgcgaccagaatttatagagtccacttacttcctgtaccgcgccactggcgatcatcattatctgcaggttggcaagaaggctctgaaaacactccagcagcatgctaaggtatcttgcggctatgcggccgtcaatgatgtacggactggcaagcatgaggatcgcatggactcgtttgtgctctccgagacgatcaagtacctcttcctactgttctccgatccccaggatctgatcataaacgtcgatgagttcgtcttcacgaccgaggctcatctgctaccgctctctattgcccaactagggaatgccacgtttagctttcgccagacggacgaacacaacgtactcgacttcatgcgcacctgccccagttcaaataggctttttcctgaaaaagtacgcaaaccactgcgcaacttcattacgggctcgtgccctcgcaccacagcgggaaagcgactcagcgccctggattttcaggcaagcaatgcagatcatcttcgagctgtttacgacatgggcattaccatggtttcggtaggcgaccgcagccaaggcaaggtgcgactgtttcatagtttctataatgccaaaagtcacgaggagggcgaaatgggactgcaatttatgcaggagatgcttgagctgaccaagatgcaaagcataaatcagctagcgcaactgcaggccgttgcctacgccactgacgagaactcacaggattggatcgcactgatggccgggccgtcgcactttagcccagagttaactggcgatcagttcgtcgaaggggacgtgattctggccaagccgctacgagcatgcgatgagagcctagagaacgccgaggaggcgaaaggaaaggtcctggtggccgagcgcggcgattgcacgttcgttagcaaagcgcgactggcccagaaggtgggggcggcggcgctgattgtctgtgataatgttccgggctcttccggtgagacgcagccgatgttcgcaatgtctggcgacggcaaggacgacgtgctcattccagtcgtattcatgtacagcatggagttcggcaaactgtcggcggtcatgcagcgacggaaacaacctctgcgtgttcgcgtcatgcagatggtggagtttaagcggtggcaactggccaaggagcagcgccagaaccaaacagcgtcggtagcacagaaaccggaaaaagaattgtag

SEQ ID NO: 58678 - protein, 801 aa, Drosophila melanogaster
MSTTSSESFVRGQRLMLIFLVAMCIVVACVLSTETTMPTQNMSNKERAELREEARDMFYHAYNAYMQNAYPADELMPLSCKGRYRGVTPSRGDMDDILGNFSMTLVDTLDTLVLLGDFTEFDHAVKLVIREVQFDSDIIVSVFETNIRMVGGLLSAHILAEYLQKHADTMHWYKGELLEMSRELGYRLLPAFNTSTGIPHARVNLRLGMKDPMLKKSRETCTACAGTILLEFAALSRLTGDPIFEVRAHAAMDALWKLRHRGSDLMGTVLNVHSGDWVRRDSGVGAGIDSYYEYLFKSYVLLGDDKYLARFNRHYNAVMKYVSEGPMLLDVLMHRPHAKSKNFMDSLLAFWPGLQVLSGDLKPAVQTHEMLYQVMQMHTFIPEAFTVDFQIHWGQHPLRPEFIESTYFLYRATGDHHYLQVGKKALKTLQQHAKVSCGYAAVNDVRTGKHEDRMDSFVLSETIKYLFLLFSDPQDLIINVDEFVFTTEAHLLPLSIAQLGNATFSFRQTDEHNVLDFMRTCPSSNRLFPEKVRKPLRNFITGSCPRTTAGKRLSALDFQASNADHLRAVYDMGITMVSVGDRSQGKVRLFHSFYNAKSHEEGEMGLQFMQEMLELTKMQSINQLAQLQAVAYATDENSQDWIALMAGPSHFSPELTGDQFVEGDVILAKPLRACDESLENAEEAKGKVLVAERGDCTFVSKARLAQKVGAAALIVCDNVPGSSGETQPMFAMSGDGKDDVLIPVVFMYSMEFGKLSAVMQRRKQPLRVRVMQMVEFKRWQLAKEQRQNQTASVAQKPEKEL

SEQ ID NO: 58679 - DNA, 1713 bp, Mus musculus
  CDS (1)..(1713)
atggaagtcctgcctgtcttaccagcgcctcagaaggaaagtgctgaacaagaagggtttgcagacatactctctcagaagcggcaaaggcattttcggcggggccctccccatctgcagattagaccccccaacacagtctccaaggatgggatgcaggatgatgctaaggagagagaagcagccctggggaaggctcagcaggaagaaaacacacagagaaccgtcatcagctggcggggagccgtgattgagcctgaacaggccactgaacttccttacaaaagagctgaagcctccatcaaacctctggttttggcatccaagatatggaaagagccagcccccccgaatgagcgccagaagggagtgattgaggcctttctccatgcttggaagggttaccaaaagtttgcttggggccatgatgaactaaaacctgtgtccaaaaccttcagtgagtggtttggcctgggcctcaccctgatcgatgccttggataccatgtggattttgggtctgaagcaagaatttaagcaagccaggaaatgggtatcagagaacttagactttcagaagaatgttgatgtcaacctgtttgagagcaccattcgcatcttagggggcctgctgagtacctaccacctgtcgggggacagcctcttcctgaccaaagctgaagattttggaaaacggctgatgcctgccttcactacgccctccaagatcccatactctgatgtgaacattggcactggatttgcccactcaccccagtggacttcagacagcacggtggcagaagtgacgagcattcagttggagttccgggagctctctcgtcttactggaataaagaaattccaggaggccgtggaggaagtgacaaagcacatccactccctgtctgggaagaaagacgggctggtgcctatgttcatcaacacgaacagcggcctcttcacccacccaggagtgttcaccttgggggccagggctgacagctactacgaatacctgctgaaacagtggatccagggtggcaagaaggagacacagttgctggaagactatgttaaagccattgaggggataaaagcccatctgctccggcagtctcagcccagaaagctcaccttcgtgggagaacttgcccacggccgcttcagtgccaagatggaccacttagtgtgcttcctgccggggacgctggctttgggtgtccaccatggcctgccagctgaccacatggatctagctcgggccctcatggagacctgctaccagatgaaccaacagatggagacaggtctgagccctgagattgcacatttcaacatgtaccctcgggcagatcataaagatgtggaggtcaagccagctgacaggcacaacctgctgcggccagagacggtggaaagcctattctatctgtaccgtgtcacaagggaccgcaagtaccaggactggggctgggaaatcctgcagagcttcaataagtacacacgggtcccctcaggtggctattcttctatcaacaacgtccagaattcccacaagcctgagcccagggacaagatggagagcttctttgtgggggaaaccctgaagtacttgtacctgctcttttctgatgacctggagctgctcagtctggacagctgtgtgttcaacacagaagcccatcccctccccatctgggctcctgcgtag

SEQ ID NO: 58680 - protein, 570 aa, Mus musculus
MEVLPVLPAPQKESAEQEGFADILSQKRQRHFRRGPPHLQIRPPNTVSKDGMQDDAKEREAALGKAQQEENTQRTVISWRGAVIEPEQATELPYKRAEASIKPLVLASKIWKEPAPPNERQKGVIEAFLHAWKGYQKFAWGHDELKPVSKTFSEWFGLGLTLIDALDTMWILGLKQEFKQARKWVSENLDFQKNVDVNLFESTIRILGGLLSTYHLSGDSLFLTKAEDFGKRLMPAFTTPSKIPYSDVNIGTGFAHSPQWTSDSTVAEVTSIQLEFRELSRLTGIKKFQEAVEEVTKHIHSLSGKKDGLVPMFINTNSGLFTHPGVFTLGARADSYYEYLLKQWIQGGKKETQLLEDYVKAIEGIKAHLLRQSQPRKLTFVGELAHGRFSAKMDHLVCFLPGTLALGVHHGLPADHMDLARALMETCYQMNQQMETGLSPEIAHFNMYPRADHKDVEVKPADRHNLLRPETVESLFYLYRVTRDRKYQDWGWEILQSFNKYTRVPSGGYSSINNVQNSHKPEPRDKMESFFVGETLKYLYLLFSDDLELLSLDSCVFNTEAHPLPIWAPA

SEQ ID NO: 58681 - DNA, 1719 bp, Arabidopsis thaliana
  CDS (1)..(1719)
atggcgaggaataaacttgtaagtggtagtcatgggatatggaaatatttcaacccagcgttttatctccgaagaccaagacgtcttgctttgctcatcatcctcttcgtctctgtttcaatggttgtttgggatcgtcaatctctttcccgagactaccagtttgaagtttccaagttaaatgaagaagttttgcggttgcagcagatgttggaagagataaagagcgtcactgaggatgtgtctgtcaatagtttgaaggatgttcaggaagatccagttgatgctcagcgaatgcagagagttaaagaggcaatggttcatgcttggagttcacatgaaaagtatgcctggggacaagatgagcttcagccccagacaaaggatggtgttgacagctttggtggcctgggtgcaactatgatagatgcattagacacactatatataatgggtctagatgagcagtttcagaaagccagagagtgggtagcaagctcattagatttcgacaaggattatgctgccagtatgtttgagacaaccataagagtggtaggagggcttctcagtgcgtatgatctttctggggataaaattttccttgaaaaggctatggatattgcagacagattattgcctgcatgggacactcaatcgggtataccatataatattatcaacttgaagcatggaaatgctcacaatcctacatgggcggggggagacagtattcttgcagattctggtactgagcagcttgaatttattgccctttcccagaggacaggggacccaaaatatcagcaaaaggtagaaaaggttatttcagtgctaaataagaacttccctgctgatggtttacttccgatatatataaatcccgatacagctaatccatcgcagtctacaataacatttggtgccatgggagacagcttttacgaatatttgctcaaagtttgggtgtttgggaacaaaacttcagcagtgaaacactatagagatatgtgggagaagtcaatgaatggtctgctaagcttggttaagaaatcaacacctttgtcgtttacatatatctgtgagaagagtggaaattctttgatcgataagatggatgaattggcatgctttgctcctggaatgttggctttaggagcatctgggtatagtgatcctgctgaaggaaagaagtttctcacactcgctgaagagcttgcgtggacatgttataacttttaccaatcaactccaacaaaactggctggggagaattatttcttcaactctgggagtgacatgagtgttggaacgtcgtggaacatcttgagaccagaaactgtcgaatcactgttttacctctggcggttaactggaaacaagacatatcaagagtggggatggaatatatttgaagcatttgagaagaactcgcgcatagagtctggatatgttggtttgaaggatgttaatacaggcgttaaggacaacaagatgcaaagtttcttccttgcagagacactcaagtatctctatctactcttctcgccgacaacagtcattcctttagacgagtgggtattcaacaccgaagctcatccacttaagattaagtctcgaaacgatcaggtaaatctcaaacaatccaacaaagtactgctacgaaaaccggcatttagaatacgccagaggcattatggtcggataacaaagaagtaa

SEQ ID NO: 58682 - protein, 572 aa, Arabidopsis thaliana
MARNKLVSGSHGIWKYFNPAFYLRRPRRLALLIILFVSVSMVVWDRQSLSRDYQFEVSKLNEEVLRLQQMLEEIKSVTEDVSVNSLKDVQEDPVDAQRMQRVKEAMVHAWSSHEKYAWGQDELQPQTKDGVDSFGGLGATMIDALDTLYIMGLDEQFQKAREWVASSLDFDKDYAASMFETTIRVVGGLLSAYDLSGDKIFLEKAMDIADRLLPAWDTQSGIPYNIINLKHGNAHNPTWAGGDSILADSGTEQLEFIALSQRTGDPKYQQKVEKVISVLNKNFPADGLLPIYINPDTANPSQSTITFGAMGDSFYEYLLKVWVFGNKTSAVKHYRDMWEKSMNGLLSLVKKSTPLSFTYICEKSGNSLIDKMDELACFAPGMLALGASGYSDPAEGKKFLTLAEELAWTCYNFYQSTPTKLAGENYFFNSGSDMSVGTSWNILRPETVESLFYLWRLTGNKTYQEWGWNIFEAFEKNSRIESGYVGLKDVNTGVKDNKMQSFFLAETLKYLYLLFSPTTVIPLDEWVFNTEAHPLKIKSRNDQVNLKQSNKVLLRKPAFRIRQRHYGRITKK

SEQ ID NO: 58683 - DNA, 1518 bp, Emericella nidulans
  CDS (1)..(1518)
atgcgtacgcttctcgctctcgcggccttcgcgggctttgccgctgctagggtgcccgcctacgccatcacgcgcccggtgatgcgcagtgattctcgcgccgacgctgtcaaggaggccttttcgcatgcctgggacggttactacaactacgcttttcctcatgacgagcttcacccgatttcgaacggttacggagactcgcgaaaccactggggcgcgtcggccgtcgacgctctatcgacggccatcatgatgcgcaacgcgaccatcgtcaaccagatccttgaccatattgctgctgtggactactccaagaccaacgccatggtaagtttgttcgagacgaccatccggtacctcgcgggcatgatttctggatacgacctgctcaaaggccctgcggcggggttggtggacgacagcagggtcgacgtgcttctagagcagtcgcagaacctcgccgaggtgctgaaattcgcgttcgacactccttctggtgtgccgtacaacatgattaacattacttcgggcggcaacgacggcgccacgaccaacgggctggccgtgaccggtaccttggtgctggagtggacgcgtctgtcggacttgactgggaacgacgagtatgcccgcttgagccagagagctgaagactaccttctccacccggagccagcgcagtacgaaccgttccctggattgattggaagcgcagtcaatattgccgacggcaagctcgccaatggtcacatcagctggaatggtggcgcagactcgtactacgagtacctgatcaagatgtacgtctacgatcccgaacgctttggcctctaccgggaccgctgggtcgcagctgccgagtcgagcatcaaccatctggcttcgcacccgtccacccgcccagacgtgactttcttggccacttacaacgaggagcatcagctgggcctgaccagccaacacctgacctgcttcgacggtggaagctttctgcttggtgggacattgctggaccgccaggactttgtcgacttcggccttgaccttgtcgccggctgccacgagacgtacaactcgactctgacgggcatcggccctgagcaattcagctgggaccctaacggtgtgcccgacagccagaaggagctgttcgagcgcgcaggcttctacatcaacagcggccaatacattcttcgtcccgaagtcatcgagagcttctactatgcatggcgcgtcacaggtgatggaacgtacctcgaatgggtgtggaacgccttcaccaacatcaacaagtactgccgcactgcgaccggtttcgcggggctggagaacgtcaatgcagcgaacggcggaggccggatcgacaaccaggagagtttcatgttcgcagaggtgctgaagtattcgtttttgacttttgctcctgaggacgactggcaggtgcagaagggcagtggaaatacgtttgtttataacaccgaggcgcacccgtttaaggtgtatacgcctcagtag

SEQ ID NO: 58684 - protein, 505 aa, Emericella nidulans
MRTLLALAAFAGFAAARVPAYAITRPVMRSDSRADAVKEAFSHAWDGYYNYAFPHDELHPISNGYGDSRNHWGASAVDALSTAIMMRNATIVNQILDHIAAVDYSKTNAMVSLFETTIRYLAGMISGYDLLKGPAAGLVDDSRVDVLLEQSQNLAEVLKFAFDTPSGVPYNMINITSGGNDGATTNGLAVTGTLVLEWTRLSDLTGNDEYARLSQRAEDYLLHPEPAQYEPFPGLIGSAVNIADGKLANGHISWNGGADSYYEYLIKMYVYDPERFGLYRDRWVAAAESSINHLASHPSTRPDVTFLATYNEEHQLGLTSQHLTCFDGGSFLLGGTLLDRQDFVDFGLDLVAGCHETYNSTLTGIGPEQFSWDPNGVPDSQKELFERAGFYINSGQYILRPEVIESFYYAWRVTGDGTYLEWVWNAFTNINKYCRTATGFAGLENVNAANGGGRIDNQESFMFAEVLKYSFLTFAPEDDWQVQKGSGNTFVYNTEAHPFKVYTPQ

SEQ ID NO: 58685 - DNA, 1737 bp, Glycine max
  CDS (1)..(1737)
atggcgagagggagcagatcagtgggtagcagcagcagcaaatggaggtactgcaacccttcctattacttgaagcgcccaaagcgtcttgctctgctcttcatcgttttcgtttgtgtctctttcgttttctgggaccgtcaaactctcgtcagagagcaccaggttgaaatttctgagctgcagaaagaagtgactgatttgaaaaatttggtggatgatttaaataacaaacaaggtggtacctctgggaagactgacttggggagaaaagctaccaagtccagtaaagacgtcctagatgatcccattgatatcgagaggagggaaaaagtaaaagaagcaatgcttcatgcttggggatcttatgagaagtatgcatggggacaagatgaacttcagccacaatcaaagaatggtgtcaatagctttggaggtcttggagcaactttaatagattctcttgatacactatatattatgggtctcaacgaacagtttcagaaagcacgagaatgggttgcaaactctttggattttaacaaggattatgaagcaagtgtttttgagacaaccataagagtagtaggtggccttcttagtgcatatgatctttcaggggacaaagtattcctcgacaaagcaatagaaattgcagacagattactgcctgcatggaatacacctacaggaattccttacaacatcattaatttatcacatggacgagcacacaaccctagttggactgggggtgagagtatcttggcagattctggcactgaacaactggaattcattgttctatcccaaaggactggagacctcaagtatcagcagaaggtggaaaatgtaatagcccagctaaataaaacatttcctgatgatggattacttcccatctacattaatcctcatagtggggcagcaggctactctcccatcacattcggtgccatgggtgatagtttttacgagtacttgctcaaagtttggatacaagggaataagacttcatccataaaacattatagagatatgtgggagaaatcaatgaaaggcctgtcaagtttgattaggagatcaacaccatcttcttttacttatatatgtgagaagaatggaggatctctcacagacaaaatggatgaactagcatgctttgctccagggatgattgctttgggatcatttggttacagtgctgctgatgattcacagaagtttctgtcacttgcagaagagcttgcttggacatgttataacttctaccaatcaactccaacaaaattggctggagagaactatttctttcattctgggcaggacatgagtgtgggtacatcatggaacatactgaggccagagacagttgagtccctcttttacctttggcgtctaactggcaacaaaacataccaagaatggggttggaatatatttcaagcttttgagaagaactcccgcatagagtcaggctatgttggactgaaggatgttaatagtggagtcaaagacaacatgatgcaaagcttctttcttgcggagaccctgaagtatttttatcttctcttctcaccttcttcagtcatctcattagacgaatgggtattcaacacagaagcccaccctctgaggattgtgaccagacacgaagagggacttgttaagaatttaaatgagaagcaaaaacctttttctagaataggtggcagaaaggaaggaaggtcaggttag

SEQ ID NO: 58686 - protein, 578 aa, Glycine max
MARGSRSVGSSSSKWRYCNPSYYLKRPKRLALLFIVFVCVSFVFWDRQTLVREHQVEISELQKEVTDLKNLVDDLNNKQGGTSGKTDLGRKATKSSKDVLDDPIDIERREKVKEAMLHAWGSYEKYAWGQDELQPQSKNGVNSFGGLGATLIDSLDTLYIMGLNEQFQKAREWVANSLDFNKDYEASVFETTIRVVGGLLSAYDLSGDKVFLDKAIEIADRLLPAWNTPTGIPYNIINLSHGRAHNPSWTGGESILADSGTEQLEFIVLSQRTGDLKYQQKVENVIAQLNKTFPDDGLLPIYINPHSGAAGYSPITFGAMGDSFYEYLLKVWIQGNKTSSIKHYRDMWEKSMKGLSSLIRRSTPSSFTYICEKNGGSLTDKMDELACFAPGMIALGSFGYSAADDSQKFLSLAEELAWTCYNFYQSTPTKLAGENYFFHSGQDMSVGTSWNILRPETVESLFYLWRLTGNKTYQEWGWNIFQAFEKNSRIESGYVGLKDVNSGVKDNMMQSFFLAETLKYFYLLFSPSSVISLDEWVFNTEAHPLRIVTRHEEGLVKNLNEKQKPFSRIGGRKEGRSG

SEQ ID NO: 58687 - DNA, 2670 bp, Homo sapiens
  CDS (1)..(2670)
atgagtagggaggagaaacagaagcttgggaatcaagtactggaaatgtttgatcatgcttatggtaactatatggaacatgcttaccctgctgatgaactcatgcctttaacctgtagaggtcgagttagaggccaagagccaagtcgcggtgacgttgatgatgccttgggaaaattttctctgacactgattgattctttggacactcttgtggttttaaataaaactaaagaatttgaagatgcagtgagaaaagttttaagagatgttaatttagataacgatgtagtcgtatcagtctttgaaacaaacatcagagttcttgggggtcttttgggtgggcactccctggcaatcatgctgaaagaaaaaggtgaatatatgcagtggtacaatgatgaacttctccaaatggcaaagcagttaggttacaaacttttaccggctttcaacactaccagtggccttccttatccaagaattaatttaaagtttggcatcagaaaaccagaagctcggacaggaactgagacagatacctgtacagcttgtgcaggtaccttgatccttgaatttgctgctttaagtcgattcacaggagcaacaatatttgaggaatatgccagaaaagctcttgattttctctgggaaaaaagacagcgaagtagtaatttagtgggcgtgactataaatattcatactggagattgggtacgaaaagatagtggagttggagcagggattgattcatattatgaatatctgttgaaagcctatgtcttgcttggagatgacagttttctggaaagatttaacacacactatgatgccataatgaggtatattagccagccacctcttctacttgatgtgcatatccacaaaccaatgctgaatgctcggacttggatggatgctttgcttgccttcttcccaggcttgcaggtgttaaagggggatattagacctgctattgaaactcatgaaatgttatatcaggtgattaaaaaacacaattttctaccagaggcatttaccacagatttcagagtacactgggctcaacatcctttaaggccagaatttgcagaaagtacctacttcttatataaagctacaggagatccttactaccttgaagtagggaagacacttattgaaaatttaaataaatatgctagagtgccttgcggatttgctgccatgaaggatgttcgtactggaagtcatgaggacagaatggattctttcttcttggctgaaatgtttaaatatctttacctgttatttgctgataaagaagacattatttttgacatagaagattacatctttacaacagaagctcatctgttacctctttggctctctactacaaatcaaagcatctctaaaaagaacacaacctcggaatatacagaactggatgacagtaacttcgattggacttgtccaaatactcagatcctctttcctaatgacccattgtatgctcaaagtattcgtgagcccttgaaaaatgtggtggataagagctgtcctagaggcatcatcagagtagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaagctgctagttcaatcgacgctgaagatgggttgaggttcatgcaggagatgattgaattgtcaagtcagcaacaaaaagaacagcagctgcctccacgagctgtacaaattgtttcccacccattttttggcagggtagtattgactgctggaccagctcagtttgggctggatctgtctaaacataaagagacaagaggatttgttgcaagcagtaaaccatccaatggttgttcagagcttactaacccagaggcagtgatgggaaaaatcgcactgatacaaagaggacagtgcatgtttgcagaaaaggcacgcaacatccagaatgctggagccattggtggcattgttattgatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgagatcctgaaatggaaaatgaagaacaaccatcctctgaaaatgattctcagaatcagagtggtgaacagatttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatga

SEQ ID NO: 58688 - protein, 889 aa, Homo sapiens
MSREEKQKLGNQVLEMFDHAYGNYMEHAYPADELMPLTCRGRVRGQEPSRGDVDDALGKFSLTLIDSLDTLVVLNKTKEFEDAVRKVLRDVNLDNDVVVSVFETNIRVLGGLLGGHSLAIMLKEKGEYMQWYNDELLQMAKQLGYKLLPAFNTTSGLPYPRINLKFGIRKPEARTGTETDTCTACAGTLILEFAALSRFTGATIFEEYARKALDFLWEKRQRSSNLVGVTINIHTGDWVRKDSGVGAGIDSYYEYLLKAYVLLGDDSFLERFNTHYDAIMRYISQPPLLLDVHIHKPMLNARTWMDALLAFFPGLQVLKGDIRPAIETHEMLYQVIKKHNFLPEAFTTDFRVHWAQHPLRPEFAESTYFLYKATGDPYYLEVGKTLIENLNKYARVPCGFAAMKDVRTGSHEDRMDSFFLAEMFKYLYLLFADKEDIIFDIEDYIFTTEAHLLPLWLSTTNQSISKKNTTSEYTELDDSNFDWTCPNTQILFPNDPLYAQSIREPLKNVVDKSCPRGIIRVEESFRSGAKPPLRARDFMATNPEHLEILKKMGVSLIHLKDGRVQLVQHAIQAASSIDAEDGLRFMQEMIELSSQQQKEQQLPPRAVQIVSHPFFGRVVLTAGPAQFGLDLSKHKETRGFVASSKPSNGCSELTNPEAVMGKIALIQRGQCMFAEKARNIQNAGAIGGIVIDDNEGSSSDTAPLFQMAGDGKDTDDIKIPMLFLFSKEGSIILDAIREYEEVEVLLSDKAKDRDPEMENEEQPSSENDSQNQSGEQISSSSQEVDLVDQESSEENSLNSHPESLSLADMDNAASISPSEQTSNPTENHETTNLNGECTDLDNQLQEQSETEEDSNPNVSWGKKVQPIDSILADWNEDIEAFEMMEKDEL

SEQ ID NO: 58689 - DNA, 1737 bp, Homo sapiens
  CDS (1)..(1737)
atgcctttccggctgctcatcccgctcggcctcctgtgcgcgctgctgcctcagcaccatggtgcgccaggtcccgacggctccgcgccagatcccgcccactacagggagcgagtcaaggccatgttctaccacgcctacgacagctacctggagaatgcctttcccttcgatgagctgcgacctctcacctgtgacgggcacgacacctggggcagtttttctctgactctaattgatgcactggacaccttgctgattttggggaatgtctcagaattccaaagagtggttgaagtgctccaggacagcgtggactttgatattgatgtgaacgcctctgtgtttgaaacaaacattcgagtggtaggaggactcctgtctgctcatctgctctccaagaaggctggggtggaagtagaggctggatggccctgttccgggcctctcctgagaatggctgaggaggcggcccgaaaactcctcccagcctttcagacccccactggcatgccatatggaacagtgaacttacttcatggcgtgaacccaggagagacccctgtcacctgtacggcagggattgggaccttcattgttgaatttgccaccctgagcagcctcactggtgacccggtgttcgaagatgtggccagagtggctttgatgcgcctctgggagagccggtcagatatcgggctggtcggcaaccacattgatgtgctcactggcaagtgggtggcccaggacgcaggcatcggggctggcgtggactcctactttgagtacttggtgaaaggagccatcctgcttcaggataagaagctcatggccatgttcctagagtataacaaagccatccggaactacacccgcttcgatgactggtacctgtgggttcagatgtacaaggggactgtgtccatgccagtcttccagtccttggaggcctactggcctggtcttcagagcctcattggagacattgacaatgccatgaggaccttcctcaactactacactgtatggaagcagtttggggggctcccggaattctacaacattcctcagggatacacagtggagaagcgagagggctacccacttcggccagaacttattgaaagcgcaatgtacctctaccgtgccacgggggatcccaccctcctagaactcggaagagatgctgtggaatccattgaaaaaatcagcaaggtggagtgcggatttgcaacaatcaaagatctgcgagaccacaagctggacaaccgcatggagtcgttcttcctggccgagactgtgaaatacctctacctcctgtttgacccaaccaacttcatccacaacaatgggtccaccttcgacgcggtgatcaccccctatggggagtgcatcctgggggctggggggtacatcttcaacacagaagctcaccccatcgaccctgccgccctgcactgctgccagaggctgaaggaagagcagtgggaggtggaggacttgatgagggaattctactctctcaaacggagcaggtcgaaatttcagaaaaacactgttagttcggggccatgggaacctccagcaaggccaggaacactcttctcaccagaaaaccatgaccaggcaagggagaggaagcctgccaaacagaaggtcccacttctcagctgccccagtcagcccttcacctccaagttggcattactgggacaggttttcctagactcctcataa

SEQ ID NO: 58690 - protein, 578 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 58691 - DNA, 1974 bp, Homo sapiens
  CDS (1)..(1974)
atgcaatggcgagcgctcgtcctggggctggtgctcctccggcttggcctccatggagtattgtggctcgtcttcgggctggggcccagcatgggcttctaccagcgctttccgctcagcttcggcttccagcgtctgaggagccccgacggccccgcgtcgcccacctcggggcccgtgggccggcctgggggggtatccgggccgtcgtggctgcagccgccggggaccggggcagcgcagagcccgcgcaaggctccgcggcgtcctgggccggggatgtgcggcccagccaactggggctacgtgctgggcggccggggccgcggcccggacgagtacgagaagcgctacagcggcgccttccctccgcagctgcgtgcccagatgcgcgacctggcacggggcatgttcgtctttggctacgacaactacatggctcacgccttcccccaggacgagctcaaccccatccactgccgcggccgtgggcccgaccgcggggacccttcaaatctgaacatcaatgatgtactagggaactactcattgactcttgttgatgcattggatacacttgcaataatgggaaattcatccgagttccagaaagcagtcaagttagtgatcaacacagtttcatttgacaaagattccaccgtccaagtctttgaggccacgataagggtcctgggaagcctcctttctgctcacagaataataactgactccaagcagccctttggtgacatgacaattaaggactatgataatgagttgttatacatggcccatgacctggcggtgcggctcctccctgcttttgaaaacaccaagacagggattccatatcctcgggtgaatctaaagacaggagttcctcctgacaccaataatgagacatgcacagcgggagccggttccctcctggtggaatttgggattctgagtcgactcctgggggactccacatttgagtgggtggccagacgagcagtgaaagccctttggaacctccggagcaatgatacaggattactaggcaatgtcgtgaacattcagacgggccactgggttggaaagcagagtggcctgggtgccgggctggactccttctatgaatacctcttgaaatcttacattctctttggagaaaaagaagacctagaaatgtttaatgctgcatatcagagtattcagaactacttaagaagagggcgggaagcctgcaatgaaggagaaggagaccctccactctatgtcaacgtgaacatgttcagtgggcagctgatgaacacctggattgactctctgcaggcctttttccctggactgcaggtgctgataggagatgtggaagatgccatctgccttcatgccttctactatgccatatggaaacgatatggtgccctccctgagagatataactggcagctgcaggcccctgacgttctcttctacccactgagaccagagttagtggaatccacatatctcctctaccaggcaaccaagaatcccttctacctccatgtaggaatggatattctgcagagtctggaaaagtacacaaaagtcaagtgtgggtacgccacgctgcatcacgtcattgacaagtccacagaagaccggatggagagcttctttctcagtgagacctgtaaatatttgtatctgctgtttgatgaagacaatccagtacacaagtctggaaccagatacatgttcacaacagagggacacattgtatctgtggatgagcatcttcgggaattgccatggaaggaattcttctctgaagagggagggcaggaccaagggggaaagtctgtgcacaggccgaaacctcatgagttaaaagtcatcaactccagctccaactgcaatcgtgtacctgatgagaggaggtactccctgcccttaaagagcatctacatgcgacagattgaccagatggttggtttgatttga

SEQ ID NO: 58692 - protein, 657 aa, Homo sapiens
MQWRALVLGLVLLRLGLHGVLWLVFGLGPSMGFYQRFPLSFGFQRLRSPDGPASPTSGPVGRPGGVSGPSWLQPPGTGAAQSPRKAPRRPGPGMCGPANWGYVLGGRGRGPDEYEKRYSGAFPPQLRAQMRDLARGMFVFGYDNYMAHAFPQDELNPIHCRGRGPDRGDPSNLNINDVLGNYSLTLVDALDTLAIMGNSSEFQKAVKLVINTVSFDKDSTVQVFEATIRVLGSLLSAHRIITDSKQPFGDMTIKDYDNELLYMAHDLAVRLLPAFENTKTGIPYPRVNLKTGVPPDTNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQNYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSTEDRMESFFLSETCKYLYLLFDEDNPVHKSGTRYMFTTEGHIVSVDEHLRELPWKEFFSEEGGQDQGGKSVHRPKPHELKVINSSSNCNRVPDERRYSLPLKSIYMRQIDQMVGLI

SEQ ID NO: 58693 - DNA, 1959 bp, Mus musculus
  CDS (1)..(1959)
atgcaatggcgagcgcttgtcctggggctggtgctgctgcgcctcggcctccacgcggtgctctggttggtcttcgggctggggcccagcatgggcttctaccagcggtttccgctcagcttcggcttccagcgcttgagggaccccgacggctcggggccagttggtccgcccggaggcccggcctggcttcatcggccaaggcgcggaacggaggggcggcttgagaccccgccagagccgggaccgacgccgggaccgggcgtgtgcggcccggcgcactggggctatgccctgggcggcggtggctgcggcccggacgagtacgagcggcgctacagcggcgccttcccgccgcagctgcgtgcccagatgcgcgacctggcgcggggcatgttcgtcttcggctatgacaactacatggcgcacgcctttccgcaggacgagctcaaccccatctactgccgcggccgggggcctgaccgcggagacccttccaatctgaacatcaatgatgtcctagggaattactctctgactctggttgatgccttggatacattggcaataatgggaaattcatccgagttccagaaggcagtcaagttagtgatcaacactgtttcatttgacaaagattccacagtccaggtcttcgaagctacgataagggttctgggaagcctcctttctgctcacagaataataactgattccaaacagccctttggtgacatgacaattgaggattatgataatgaattgttgtacatggcccatgacttggctgtgcggctccttccagcctttgaaaacaccaagacagggatcccctatcctcgggtgaatctgaagacaggtgttcctcctgacagcaataatgagacctgcacagcgggggccggttctctcctggtggaatttgggattctgagccgactgctgggggattccacttttgagtgggttgccagacgagctgtgaaagccctctggaacttgcggagcaacgatacaggattattaggcaatgttgtgaacatccagacaggccattgggttggaaagcagagtggcttgggtgctgggctggattccttctatgagtacctcttgaaatcttacattctttttggagaaaaagaagatctagagatgtttaatgctgcgtatcagagcatccagagctacctgcgaagaggccgggaagcctgcaatgaaggagaaggagacccaccgctctacgtcaacgtgaacatgttcagtgggcagctcatgaacacctggattgactcgctgcaggctttcttccctggactgcaggttctgataggggatgtggaagatgccatctgcctacacgccttctactatgccatatggaagcggtacggggccctccctgagcgctataactggcaactccaggcccctgatgttctcttctaccctctgagaccagagctagtggagtccacatatctcctctaccaggcaaccaagaatcccttctacctccatgtaggaatggacattctgcagagtcttgaaaaatacacaaaagtcaaatgtggatatgctacgctgcatcacgtcatagacaagtctaaagaagaccggatggaaagcttctttctcagcgagacttgcaaatacttgtatctgctatttgatgaagagaatccagtacacaaatctggaaccagatacatgtttacaactgagggccatatcatatctgtggacaaacgtcttcgggaattgccttggaaggaattcttctctgaagatggggagcgggaccaagaggaaaagtttgtacacagacctaagtctcaggagctcagagtcattaactccagttctaattgtaatcgtgttcctgatgagaggagatactccttgcccttaaagagcatctacatgcgccagatcgaccagatggttggcttgatttga

SEQ ID NO: 58694 - protein, 652 aa, Mus musculus
MQWRALVLGLVLLRLGLHAVLWLVFGLGPSMGFYQRFPLSFGFQRLRDPDGSGPVGPPGGPAWLHRPRRGTEGRLETPPEPGPTPGPGVCGPAHWGYALGGGGCGPDEYERRYSGAFPPQLRAQMRDLARGMFVFGYDNYMAHAFPQDELNPIYCRGRGPDRGDPSNLNINDVLGNYSLTLVDALDTLAIMGNSSEFQKAVKLVINTVSFDKDSTVQVFEATIRVLGSLLSAHRIITDSKQPFGDMTIEDYDNELLYMAHDLAVRLLPAFENTKTGIPYPRVNLKTGVPPDSNNETCTAGAGSLLVEFGILSRLLGDSTFEWVARRAVKALWNLRSNDTGLLGNVVNIQTGHWVGKQSGLGAGLDSFYEYLLKSYILFGEKEDLEMFNAAYQSIQSYLRRGREACNEGEGDPPLYVNVNMFSGQLMNTWIDSLQAFFPGLQVLIGDVEDAICLHAFYYAIWKRYGALPERYNWQLQAPDVLFYPLRPELVESTYLLYQATKNPFYLHVGMDILQSLEKYTKVKCGYATLHHVIDKSKEDRMESFFLSETCKYLYLLFDEENPVHKSGTRYMFTTEGHIISVDKRLRELPWKEFFSEDGERDQEEKFVHRPKSQELRVINSSSNCNRVPDERRYSLPLKSIYMRQIDQMVGLI

SEQ ID NO: 58695 - DNA, 2004 bp, Drosophila melanogaster
  CDS (1)..(2004)
atgtatcgcatcagtccaattggacgcaaatcgaacttccactcgcgcgaaaaatgtctgattggactcgtcctggtaacgttgtgcttcctctgcttcggcggcatcttccttctgccggacaatttcggcagcgatcgtgtcctgcgcgtctacaagcacttccgaaaggccggaccggagatctttatcccagccccgcccctcgccgcacacgccccccatcgcagcgaggatccacatttcattggcgatcgccaacgtttggagcaaaagattcgcgccgaattgggcgatatgctcgatgagccaccggctgcgggtggaggcgaacctggacaattccaggtgctcgcccaacaggctcaggctccagcacccgtcgccgctctggcggatcagccgctggatcaggacgagggacacgccgccattcccgttctggccgccccagttcagggggacaatgccgccagccaggcctcgtcccatccacaaagttccgcccagcagcacaaccagcagcaaccacaactgccattgggtggcggtggcaatgatcaggcgccggacacactggacgccacactggaagaacggcgtcagaaggtcaaagagatgatggaacatgcgtggcacaattacaaattgtatgcgtggggcaaaaacgagctgcgtccgctttcgcagcgaccccattcggccagtatttttggatcatacgatctgggtgctacaatcgtcgacggtctggataccctgtacattatgggactggagaaggaatatcgcgagggtcgcgattggatcgagcgaaaattctcactggacaatatcagcgcagagttgagtgttttcgaaacgaacattcgttttgttggcggcatgctgacgctgtacgcctttacgggcgatccactgtacaaggagaaggcccagcacgttgccgacaagctgctgcccgccttccaaacaccaacgggtattccctacgcgctggtcaacaccaagaccggtgtggccaagaactacggctgggcatccggcggcagttctatcctatccgaatttggcacactgcatctggaatttgcctatctgagcgacattaccgggaatccactgtatcgggaacgagtccagaccattcgccaagtgctcaaggagatcgagaaaccaaagggcctctatcccaacttccttaatcccaagacaggcaaatgggggcaacttcacatgtcattgggcgctctgggcgacagctactacgagtacttgctgaaggcctggctgcaatccggccaaacggatgaggaagcccgcgagatgttcgacgaggcaatgctggccattctggataagatggtccgcacaagtcccggcggactgacatacgtctctgatctcaagttcgacaggctggagcataagatggaccatttggcttgcttctcgggtggcctcttcgctttgggagcggctacacgtcaaaatgactatacggacaagtacatggaggtgggcaagggcattacgaatacctgccacgagagctacatcagagcacccactcagctgggacccgaggcctttagattcagcgaagctgtggaggcgcgagcgctgagatcgcaggagaagtactacattctacggccagagactttcgagagctactttgtgctgtggcgactcacgcacgaccagaaataccgcgactggggctgggaggcggtcctcgccctggagaagcactgccgcacggcgcacggatattgtggcctgcgcaacgtctaccagcaggagccgcaaaaggacgacgttcagcaaagcttcttcctcgccgaaacgcttaagtacctgtacttgctgttctcggacgattcggtgctgccgctggacgaatgggtgttcaacacggaggcccatccgctgccgatcaagggtgcgaatgcgtactatagacaggcgcccgtaacgcttccggtttcgaacgcatcgtaa

SEQ ID NO: 58696 - protein, 667 aa, Drosophila melanogaster
MYRISPIGRKSNFHSREKCLIGLVLVTLCFLCFGGIFLLPDNFGSDRVLRVYKHFRKAGPEIFIPAPPLAAHAPHRSEDPHFIGDRQRLEQKIRAELGDMLDEPPAAGGGEPGQFQVLAQQAQAPAPVAALADQPLDQDEGHAAIPVLAAPVQGDNAASQASSHPQSSAQQHNQQQPQLPLGGGGNDQAPDTLDATLEERRQKVKEMMEHAWHNYKLYAWGKNELRPLSQRPHSASIFGSYDLGATIVDGLDTLYIMGLEKEYREGRDWIERKFSLDNISAELSVFETNIRFVGGMLTLYAFTGDPLYKEKAQHVADKLLPAFQTPTGIPYALVNTKTGVAKNYGWASGGSSILSEFGTLHLEFAYLSDITGNPLYRERVQTIRQVLKEIEKPKGLYPNFLNPKTGKWGQLHMSLGALGDSYYEYLLKAWLQSGQTDEEAREMFDEAMLAILDKMVRTSPGGLTYVSDLKFDRLEHKMDHLACFSGGLFALGAATRQNDYTDKYMEVGKGITNTCHESYIRAPTQLGPEAFRFSEAVEARALRSQEKYYILRPETFESYFVLWRLTHDQKYRDWGWEAVLALEKHCRTAHGYCGLRNVYQQEPQKDDVQQSFFLAETLKYLYLLFSDDSVLPLDEWVFNTEAHPLPIKGANAYYRQAPVTLPVSNAS

SEQ ID NO: 58697 - DNA, 1932 bp, Drosophila melanogaster
  CDS (1)..(1932)
atgtgtccgaaaacgtcgaaaaccacgccgctcctgctgattggcggaatttgctttgtgatcgttctggtcgggattaccggcataacgctgatcaacaacatcaatttgtcgaacatcattcgactgaacgagaaggtagccagcgatagtgttagcaacaatgagaatcagatcaaagagttgaactatgtgaacaatcatccgcgaaatgtgtatctcaagttgaatgccagcagcagggatgacgaggatgatgagcaaatgcaaaaagagcaggagcagttggagctacccaagatatctgctgttattggtggcagtaagccaaaagtcgaggataatcaagtgaaggagtcgtcggaagtcatttccccatctacatcaactttctccatgcgctcgtctgccggagaattaacctcaacctctgcacccttgtcctcaattgtatccgtgaccgctccacctatgcccttcggcggggtcaagtacaaccaatccagcggtttgattgattacgaaaaacgtaaccaagtcgtcaagatgatggaacatgcgtggcacaattacaaattgtatgcgtggggcaaaaacgagctgcgtccgctttcgcagcgaccccattcggccagtatttttggatcatacgatctgggtgctacaatcgtcgacggtctggataccctgtacattatgggactggagaaggaatatcgcgagggtcgcgattggatcgagcgaaaattctcactggacaatatcagcgcagagttgagtgttttcgaaacgaacattcgttttgttggcggcatgctgacgctgtacgcctttacgggcgatccactgtacaaggagaaggcccagcacgttgccgacaagctgctgcccgccttccaaacaccaacgggtattccctacgcgctggtcaacaccaagaccggtgtggccaagaactacggctgggcatccggcggcagttctatcctatccgaatttggcacactgcatctggaatttgcctatctgagcgacattaccgggaatccactgtatcgggaacgagtccagaccattcgccaagtgctcaaggagatcgagaaaccaaagggcctctatcccaacttccttaatcccaagacaggcaaatgggggcaacttcacatgtcattgggcgctctgggcgacagctactacgagtacttgctgaaggcctggctgcaatccggccaaacggatgaggaagcccgcgagatgttcgacgaggcaatgctggccattctggataagatggtccgcacaagtcccggcggactgacatacgtctctgatctcaagttcgacaggctggagcataagatggaccatttggcttgcttctcgggtggcctcttcgctttgggagcggctacacgtcaaaatgactatacggacaagtacatggaggtgggcaagggcattacgaatacctgccacgagagctacatcagagcacccactcagctgggacccgaggcctttagattcagcgaagctgtggaggcgcgagcactgagatcgcaggagaagtactacattctacggccagagactttcgagagctactttgtgctgtggcgactcacgcacgaccagaaataccgcgactggggctgggaggcggtcctcgccctggagaagcactgccgcacggcgcacggatattgtggcctgcgcaacgtctaccagcaggagccgcaaaaggacgacgttcagcaaagcttcttcctcgccgaaacgcttaagtacctgtacttgctgttctcggacgattcggtgctgccgctggacgaatgggtgttcaacacggaggcccatccgctgccgatcaagggtgcgaatgcgtactatagacaggcgcccgtaacgcttccggtttcgaacgcatcgtaa

SEQ ID NO: 58698 - protein, 643 aa, Drosophila melanogaster
MCPKTSKTTPLLLIGGICFVIVLVGITGITLINNINLSNIIRLNEKVASDSVSNNENQIKELNYVNNHPRNVYLKLNASSRDDEDDEQMQKEQEQLELPKISAVIGGSKPKVEDNQVKESSEVISPSTSTFSMRSSAGELTSTSAPLSSIVSVTAPPMPFGGVKYNQSSGLIDYEKRNQVVKMMEHAWHNYKLYAWGKNELRPLSQRPHSASIFGSYDLGATIVDGLDTLYIMGLEKEYREGRDWIERKFSLDNISAELSVFETNIRFVGGMLTLYAFTGDPLYKEKAQHVADKLLPAFQTPTGIPYALVNTKTGVAKNYGWASGGSSILSEFGTLHLEFAYLSDITGNPLYRERVQTIRQVLKEIEKPKGLYPNFLNPKTGKWGQLHMSLGALGDSYYEYLLKAWLQSGQTDEEAREMFDEAMLAILDKMVRTSPGGLTYVSDLKFDRLEHKMDHLACFSGGLFALGAATRQNDYTDKYMEVGKGITNTCHESYIRAPTQLGPEAFRFSEAVEARALRSQEKYYILRPETFESYFVLWRLTHDQKYRDWGWEAVLALEKHCRTAHGYCGLRNVYQQEPQKDDVQQSFFLAETLKYLYLLFSDDSVLPLDEWVFNTEAHPLPIKGANAYYRQAPVTLPVSNAS

SEQ ID NO: 58699 - DNA, 1962 bp, Homo sapiens
  CDS (1)..(1962)
atgcccgtggggggcctgttgccgctcttcagcagccccgcgggcggcgtcctgggcggggggctcggcggcggcggtggcaggaaggggtcgggccccgccgccctccgcctgacggagaagttcgtgctgctgctggtattcagcgccttcatcacgctctgcttcggggcgatcttcttcctgccagactcctccaagctgctcagcggggtcctgttccactccagccccgccttgcagccggccgccgaccacaagcccgggcccggggcgcgcgccgaggacgcggccgaggggcgagcccggcgccgcgaggagggggcacccggggacccggaggccgccctggaggacaacttggccaggatccgcgaaaaccacgagcgggctctcagggaagccaaggagaccctgcagaagctgcccgaggagatccaaagagacatcctactggagaagaagaaggtggcccaggaccagctgcgtgacaaggcgccgttcagaggcctgcccccggtggacttcgtgcccccaatcggggtggagagccgggagcccgccgacgccgccatccgcgagaaaagggcaaagatcaaagagatgatgaaacatgcttggaataattataaaggttatgcctggggattaaatgaactcaaacctatatcaaaaggaggccattcaagcagtttgtttggtaacatcaaaggagcaactatagtagatgccctggatacactttttattatggaaatgaaacatgaatttgaagaagcaaaatcatgggttgaagaaaatttagattttaatgtgaatgctgaaatttctgtctttgaagtaaatatacgctttgttggtggactactctcagcctactatctgtctggagaagagatttttcgaaagaaagcagtggaacttggggtaaaattgctacctgcatttcatactccctctggaataccttgggcattgctgaatatgaaaagtggtattggaaggaactggccctgggcctctggaggcagcagtattctggcagaatttggaaccctgcatttggagtttatgcacttgagccacttatcaggaaaccccatctttgctgaaaaggtaatgaatattcgaacagtactgaacaaactggaaaaaccacaaggcctttatcctaactatctgaatcccagtagtggacagtggggtcaacatcatgtatcagttggaggacttggagacagcttctatgagtatttgctgaaggcctggttaatgtctgacaagacagatctggaagctaagaagatgtattttgatgctgttcaggctatcgagactcatttgatccgcaagtctagcagcggactaacttatatcgcagagtggaaagggggcctcctggagcacaagatgggccacctgacctgcttcgcggggggcatgttcgcactcggggctgatgcagctcccgaaggcatggcccaacactaccttgaactcggggctgaaattgcccgtacttgtcatgaatcatataatcgaacatttatgaaactgggaccagaagctttcagatttgatggtggtgttgaagccatcgctacaagacaaaatgaaaaatactacatcttacggccagaagttatggagacttacatgtatatgtggagactgactcatgatccaaagtacaggaaatgggcctgggaagccgtagaggccttggaaaaccattgcagagtgaatggaggctattcaggcctaagggatgtttaccttcttcatgagagttatgatgatgtgcagcagagtttcttcctggcagagacattgaaatatttgtacctaatattttctgacgacgatcttcttccactggagcattggatcttcaatagcgaggcacatcttctccctatcctccctaaagataaaaaggaagttgaaatcagagaggaataa

SEQ ID NO: 58700 - protein, 653 aa, Homo sapiens
MPVGGLLPLFSSPAGGVLGGGLGGGGGRKGSGPAALRLTEKFVLLLVFSAFITLCFGAIFFLPDSSKLLSGVLFHSSPALQPAADHKPGPGARAEDAAEGRARRREEGAPGDPEAALEDNLARIRENHERALREAKETLQKLPEEIQRDILLEKKKVAQDQLRDKAPFRGLPPVDFVPPIGVESREPADAAIREKRAKIKEMMKHAWNNYKGYAWGLNELKPISKGGHSSSLFGNIKGATIVDALDTLFIMEMKHEFEEAKSWVEENLDFNVNAEISVFEVNIRFVGGLLSAYYLSGEEIFRKKAVELGVKLLPAFHTPSGIPWALLNMKSGIGRNWPWASGGSSILAEFGTLHLEFMHLSHLSGNPIFAEKVMNIRTVLNKLEKPQGLYPNYLNPSSGQWGQHHVSVGGLGDSFYEYLLKAWLMSDKTDLEAKKMYFDAVQAIETHLIRKSSSGLTYIAEWKGGLLEHKMGHLTCFAGGMFALGADAAPEGMAQHYLELGAEIARTCHESYNRTFMKLGPEAFRFDGGVEAIATRQNEKYYILRPEVMETYMYMWRLTHDPKYRKWAWEAVEALENHCRVNGGYSGLRDVYLLHESYDDVQQSFFLAETLKYLYLIFSDDDLLPLEHWIFNSEAHLLPILPKDKKEVEIREE

SEQ ID NO: 58701 - DNA, 1968 bp, Mus musculus
  CDS (1)..(1968)
atgcccgtggggggcctgttgccgctcttcagtagccctgggggcggcggcctgggcagtggcctgggcggggggcttggcggcgggaggaaggggtctggccccgctgccttccgcctcaccgagaagttcgtgctgctgctggtgttcagcgccttcatcacgctctgcttcggggcaatcttcttcctgcctgactcctccaagctgctcagcggggtcctgttccactccaaccctgccttgcagccgccggcggagcacaagcccgggctcggggcgcgtgcggaggatgccgccgaggggagagtccggcaccgcgaggaaggcgcgcctggggaccctggagctggactggaagacaacttagccaggatccgcgaaaaccacgagcgggctctcagggaagccaaggagaccctgcagaagctgccggaggagatccaaagagacattctgctggagaaggaaaaggtggcccaggaccagctgcgtgacaaggatctgtttaggggcttgcccaaggtggacttcctgccccccgtcggggtagagaaccgggagcccgctgacgccaccatccgtgagaagagggcaaagatcaaagagatgatgacccatgcttggaataattataaacgctatgcgtggggcttgaacgaactgaaacctatatcaaaagaaggccattcaagcagtttgtttggcaacatcaaaggagctacaatagtagatgccctggatacccttttcattatgggcatgaagactgaatttcaagaagctaaatcgtggattaaaaaatatttagattttaatgtgaatgctgaagtttctgtttttgaagtcaacatacgcttcgtcggtggactgctgtcagcctactatttgtccggagaggagatatttcgaaagaaagcagtggaacttggggtaaaattgctacctgcatttcatactccctctggaataccttgggcattgctgaatatgaaaagtgggatcgggcggaactggccctgggcctctggaggcagcagtatcctggccgaatttggaactctgcatttagagtttatgcacttgtcccacttatcaggagacccagtctttgccgaaaaggttatgaaaattcgaacagtgttgaacaaactggacaaaccagaaggcctttatcctaactatctgaaccccagtagtggacagtggggtcaacatcatgtgtcggttggaggacttggagacagcttttatgaatatttgcttaaggcgtggttaatgtctgacaagacagatctcgaagccaagaagatgtattttgatgctgttcaggccatcgagactcacttgatccgcaagtcaagtgggggactaacgtacatcgcagagtggaaggggggcctcctggaacacaagatgggccacctgacgtgctttgcaggaggcatgtttgcacttggggcagatggagctccggaagcccgggcccaacactaccttgaactcggagctgaaattgcccgcacttgtcatgaatcttataatcgtacatatgtgaagttgggaccggaagcgtttcgatttgatggcggtgtggaagctattgccacgaggcaaaatgaaaagtattacatcttacggcccgaggtcatcgagacatacatgtacatgtggcgactgactcacgaccccaagtacaggacctgggcctgggaagccgtggaggctctagaaagtcactgcagagtgaacggaggctactcaggcttacgggatgtttacattgcccgtgagagttatgacgatgtccagcaaagtttcttcctggcagagacactgaagtatttgtacttgatattttccgatgatgaccttcttccactagaacactggatcttcaacaccgaggctcatcctttccctatactccgtgaacagaagaaggaaattgatggcaaagagaaatga

SEQ ID NO: 58702 - protein, 655 aa, Mus musculus
MPVGGLLPLFSSPGGGGLGSGLGGGLGGGRKGSGPAAFRLTEKFVLLLVFSAFITLCFGAIFFLPDSSKLLSGVLFHSNPALQPPAEHKPGLGARAEDAAEGRVRHREEGAPGDPGAGLEDNLARIRENHERALREAKETLQKLPEEIQRDILLEKEKVAQDQLRDKDLFRGLPKVDFLPPVGVENREPADATIREKRAKIKEMMTHAWNNYKRYAWGLNELKPISKEGHSSSLFGNIKGATIVDALDTLFIMGMKTEFQEAKSWIKKYLDFNVNAEVSVFEVNIRFVGGLLSAYYLSGEEIFRKKAVELGVKLLPAFHTPSGIPWALLNMKSGIGRNWPWASGGSSILAEFGTLHLEFMHLSHLSGDPVFAEKVMKIRTVLNKLDKPEGLYPNYLNPSSGQWGQHHVSVGGLGDSFYEYLLKAWLMSDKTDLEAKKMYFDAVQAIETHLIRKSSGGLTYIAEWKGGLLEHKMGHLTCFAGGMFALGADGAPEARAQHYLELGAEIARTCHESYNRTYVKLGPEAFRFDGGVEAIATRQNEKYYILRPEVIETYMYMWRLTHDPKYRTWAWEAVEALESHCRVNGGYSGLRDVYIARESYDDVQQSFFLAETLKYLYLIFSDDDLLPLEHWIFNTEAHPFPILREQKKEIDGKEK

SEQ ID NO: 58703 - DNA, 1980 bp, Sus scrofa
  CDS (1)..(1980)
atgccggtggggggcctgttgccactcttcagcagcccggcgggcggcggcctgggcggcggcctgggtggggggctcggcggcggcggcggcggcggcggcagaaaggggtcgggcccctccgccttccgcctgacggagaagttcgtgctgctgttggtgttcagcgccttcatcacgctctgcttcggagcgatcttcttcctgcccgactcttccaagctgctcagcggggtcctgttccactccagccccgccctgcagccagccgctgaccacaagccggggcccggggcgcgcgccgaggacgcggcagatgggcgagcccggcccggagaagagggcgctcccggggaccccgcggccgccctagaggacaacttggccaggatccgcgaaaaccacgagcgagctttgatggaagccaaggagactctgcagaagctgcccgaggagatccaaagagatatcctgatggagaaggagaaggtggcccaggaccagatgagtaacaggatggggttcaggctgcccccagtgtacttagtacccctcatcggggcgattgaccgggagccggccgacgccgctgtccgcgagaaaagggcaaagatcaaagagatgatgaaacatgcctggaataattataaactttatgcctggggaaaaaatgaactgaagcctgtatcaaaaggaggccattcaagcagtttgtttggtaatatcaaaggagcaacaatagtagatgccctggatacactttttattatgaaaatgaaaaacgaatttgaagaggcaaaagcatgggttgaagaacatctaaactttaatgtgaatgctgaagtttctgtttttgaagtaaatatacgctttattggtggactaatctcagcttactatctgtctggagaagagatatttcgaaagaaagcagtggaacttggggtaaaattgctacctgcattttatactccctctggaataccttgggcattgctgaatataaaaagtgggattggaaggaattggccatgggcctctggaggcagcagtattttggcagaatttggaactctgcatttggaatttatacacttgagctacttatcaggaaaccccttctttgctgaaaaggtaatgaatattcgaaaagtgctaaacaacctggaaaaaccacaaggcctttatcctaactatctgaatcctaatagtggacagtggggtcaatatcatgtatcagtaggaggacttggagacagcttttatgaatatttgctaaaggcatggttaatgtctgacaagacagatctagaagctaagaagatgtattttgatgctattaaggcaattgagacacacttgatccggaagtcacgtaacggactgacttacatcgcagagtggaaagggggcctcctggaacacaagatgggccacctgacctgctttgctgggggtatgtttgcacttggagcagacgatgcacctgatggcctgacccaacactaccttcagctcggggctgagattgcccgtacctgtcatgaatcatatagtcgcacatttgtgaaactgggaccagaagctttcagatttgatggtggtgtggaagccattgctacaaggcaaaatgaaaaatactacattctacggccagaagttgttgagacttacctgtacatgtggcgactgactcatgatccaaagtacaggaagtgggcctgggaagccgtggaggccctggaaaaacactgcagggtgaatggaggctattctggcctcagggacgtttatgtgagtgcacagacctacgacgacgtgcagcagagcttcttcctggcagagacacttaaatatttgtacttaatattttctgatgatgatctgcttccactggaacattggatcttcaataccgaggcacatcctctccccgtgctctctaggaatataaagaaagttgaagacaatgagaaataa

SEQ ID NO: 58704 - protein, 659 aa, Sus scrofa
MPVGGLLPLFSSPAGGGLGGGLGGGLGGGGGGGGRKGSGPSAFRLTEKFVLLLVFSAFITLCFGAIFFLPDSSKLLSGVLFHSSPALQPAADHKPGPGARAEDAADGRARPGEEGAPGDPAAALEDNLARIRENHERALMEAKETLQKLPEEIQRDILMEKEKVAQDQMSNRMGFRLPPVYLVPLIGAIDREPADAAVREKRAKIKEMMKHAWNNYKLYAWGKNELKPVSKGGHSSSLFGNIKGATIVDALDTLFIMKMKNEFEEAKAWVEEHLNFNVNAEVSVFEVNIRFIGGLISAYYLSGEEIFRKKAVELGVKLLPAFYTPSGIPWALLNIKSGIGRNWPWASGGSSILAEFGTLHLEFIHLSYLSGNPFFAEKVMNIRKVLNNLEKPQGLYPNYLNPNSGQWGQYHVSVGGLGDSFYEYLLKAWLMSDKTDLEAKKMYFDAIKAIETHLIRKSRNGLTYIAEWKGGLLEHKMGHLTCFAGGMFALGADDAPDGLTQHYLQLGAEIARTCHESYSRTFVKLGPEAFRFDGGVEAIATRQNEKYYILRPEVVETYLYMWRLTHDPKYRKWAWEAVEALEKHCRVNGGYSGLRDVYVSAQTYDDVQQSFFLAETLKYLYLIFSDDDLLPLEHWIFNTEAHPLPVLSRNIKKVEDNEK

SEQ ID NO: 58705 - DNA, 2100 bp, Homo sapiens
  CDS (1)..(2100)
atggctgcctgcgagggcaggagaagcggagctctcggttcctctcagtcggacttcctgacgccgccagtgggcggggccccttgggccgtcgccaccactgtagtcatgtacccaccgccgccgccgccgcctcatcgggacttcatctcggtgacgctgagctttggcgagagctatgacaacagcaagagttggcggcggcgctcgtgctggaggaaatggaagcaactgtcgagattgcagcggaatatgattctcttcctccttgcctttctgcttttctgtggactcctcttctacatcaacttggctgaccattggaaagctctggctttcaggctagaggaagagcagaagatgaggccagaaattgctgggttaaaaccagcaaatccacccgtcttaccagctcctcagaaggcggacaccgaccctgagaacttacctgagatttcgtcacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcagctggaggggagcggtgatcgagcctgagcagggcaccgagctcccttcaagaagagcagaagtgcccaccaagcctcccctgccaccggccaggacacagggcacaccagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagctgctggaagactacgtggaagccatcgagggtgtcagaacgcacctgctgcggcactccgagcccagtaagctcacctttgtgggggagcttgcccacggccgcttcagtgccaagatggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaagccagcagacaggcacaacctgctgcggccagagaccgtggagagcctgttctacctgtaccgcgtcacaggggaccgcaaataccaggactggggctgggagattctgcagagcttcagccgattcacacgggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggatgcctacgtgttcaacaccgaagcccaccctctgcctatctggacccctgcctag

SEQ ID NO: 58706 - protein, 699 aa, Homo sapiens
MAACEGRRSGALGSSQSDFLTPPVGGAPWAVATTVVMYPPPPPPPHRDFISVTLSFGESYDNSKSWRRRSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVPSGGYSSINNVQDPQKPEPRDKMESFFLGETLKYLFLLFSDDPNLLSLDAYVFNTEAHPLPIWTPA

SEQ ID NO: 58707 - DNA, 1893 bp, Homo sapiens
  CDS (1)..(1893)
atgctcatgaggaaagtgcccggcttcgtcccggcctccccgtgggggctgcggctgccgcagaagttcctcttcctcctcttcctctcgggcctggtcaccctgtgcttcggggccctcttcctgctgccccactcctctcgcctcaagcgcctcttcctggccccccggacccagcagcctggtctggaagtggtggctgaaatcgccggccatgccccggcccgcgagcaggagccgcctcccaacccggcccccgccgcgccggccccgggcgaggatgaccccagcagctgggccagtccccgccgcaggaaaggggggctgcggcgcacccgccccactggaccccgcgaggaggccacggcggcccggggcaatagcatcccggcctccaggcccggggacgagggcgtccctttccgctttgacttcaacgcattccggagccgtctccgccacccggtcctgggaacgagggccgatgagagtcaggagccccagagccaagtgcgagcccagcgggagaaaatcaaggagatgatgcagtttgcttggcagagctataagcgttatgcaatggggaaaaacgaactccgtccactaacaaaagatggctacgagggtaacatgttcggaggcctcagcggggcaacagtcattgactccctcgataccctctacctcatggagctgaaggaggagttccaggaggccaaggcctgggtgggagagagcttccacctgaacgtgagcggagaagcatccttgtttgaggtgaacatccgctacatcgggggactcctctcagccttctacctgacaggagaagaggtgttccgaataaaggccatcaggctgggagagaagctcctgccggcgttcaacacccccacgggaatcccaaagggcgtggtgagcttcaaaagtgggaactggggctgggccacagccggcagcagcagcatcttggcggagtttggatccctgcacttggaattcttacacctcactgaactctctggcaaccaggtcttcgctgaaaaggtcaggaacatccgcaaggtcctcaggaagatcgaaaagccctttggcctctaccccaacttcctcagcccagtgagtgggaactgggtgcaacaccatgtctcagttggaggactcggggacagtttttatgaatatttgatcaaatcctggttgatgtcgggcaagacagatatggaggctaaaaatatgtactacgaagccttggaggcgatagagacctacttgctgaatgtctctcccggggggctgacctacattgccgagtggcgaggggggattctggaccacaagatggggcacctggcctgtttctccgggggcatgatcgcccttggcgccgaggatgccaaggaagaaaagagggcccactaccgagagctcgcagcccagatcaccaagacgtgtcacgagtcatacgcccgctcagacaccaaacttgggcctgaggccttctggtttaactccggcagagaggccgtggccacccagctgagcgagagctactacatcctccggccagaggtggtggagagctacatgtacctgtggcgacagacccacaaccccatctacagggagtggggctgggaggtggtgctggccttggagaaatactgtcggacagaagccggtttctctgggatccaagacgtgtacagtagcacccccaaccacgacaacaagcagcagagcttctttctagcggagacactaaagtatctctatcttctgttctctgaagatgacttgctctccctggaagactgggtgttcaacaccgaggcccacccactcccggtgaaccactcagacagctccggcagagcctggggcagacactga

SEQ ID NO: 58708 - protein, 630 aa, Homo sapiens
MLMRKVPGFVPASPWGLRLPQKFLFLLFLSGLVTLCFGALFLLPHSSRLKRLFLAPRTQQPGLEVVAEIAGHAPAREQEPPPNPAPAAPAPGEDDPSSWASPRRRKGGLRRTRPTGPREEATAARGNSIPASRPGDEGVPFRFDFNAFRSRLRHPVLGTRADESQEPQSQVRAQREKIKEMMQFAWQSYKRYAMGKNELRPLTKDGYEGNMFGGLSGATVIDSLDTLYLMELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 58709 - DNA, 1698 bp, Candida albicans
  CDS (1)..(1698): transl_table=12
atgctattaaaaggttttatgttgtctttagtattatatgctgtgtaccatttagcatcaaatggtgggcaatttatgtttgatttctcgggtcaatcaaaatgggaaagagctcaactggaagttcgtcaagccatattagattcatggcatacctatgaaaagtatggttggggttatgatgtctatcatccaattaagcaagaaggggaaaatatgggtccaaaaccgttgggatggatgattgtggattcattagatactttgatgattatggattgtccagaagaagtcagtcgagccagagattggatcaagaatgatttggattacacttttgattataatgtcaacacatttgaaaccactattagaatgcttggtggtttattatcagcttatcatttcagcaatgacgatgtctatttggataaagcggtacaattggccaatgcattacacggggcctatgatagtccatcaggaataccatatctgtctgtcaatttgaaatcaggtaaaggtataaagaatcatgttgataatggtgcctcatccactgctgaagctgctactgttcaattagaaatgaaatatttatcgaaattgactggagaaattttgtggtggaacttggcagagaaagtaatgcaagtgttagaaagtaataaacctcaagatggtttggtgccaatttatgtcaacccagatactggtaaatatcaaggccatttgattagattggggtcacgtggagattcttattacgaatatttgttgaagcaatacttgcaaacaaataagcaagaacttgtctattgggatatgtatcgtgaatcggttgaaggtgtcaagaaacatcttgtgagtgattcttatccttcaggattgacgtttattggggaattggataatggtattggtggcaaattgtcaaccaagatggaccatttagtttgcttttacggtggattgttagcccttggtgctactggaggattgacattgaacgaggctcaaagtttaaaatcatggaatgaagaaagagaagctgactttaaacttggtgaagagttgacttatacttgttataagatgtaccacgatgttagtccaactggattgtcaccagaaattgttgttttcaatgaagatacttcaaaatccaaagattttattattaaacctttggatagacataacttacaacgtccagaaacagttgaatcattgttttatctttatagattaactggtgatgtcaaatatcgtgaaatgggatatgaaattttccaaaattttatcaagtacactaaagttgttaattcggaaggtgaagtttcattttcctcgctttccgatgtcacttctttcgattctaatggcttaccgaaattcaaagataacactgaatcattctggtgggcagaaactttgaaatatttgtatcttttgtttgatgacaccaataagattccattgacagattatgtctttaatactgaagcccatccattccctagatttgatactaatgattatttcaaaactggttggagaagaaaaattgatgagaatgaaaaggcacaaatgagagaatccaaagttattgataaaagtaatcttccggaagctcaaccagttgataaatcagctgatcaagaagctaaagaaattattgaagaaattgctgggtaa

SEQ ID NO: 58710 - protein, 565 aa, Candida albicans
MLLKGFMLSLVLYAVYHLASNGGQFMFDFSGQSKWERAQSEVRQAILDSWHTYEKYGWGYDVYHPIKQEGENMGPKPLGWMIVDSLDTLMIMDCPEEVSRARDWIKNDLDYTFDYNVNTFETTIRMLGGLLSAYHFSNDDVYLDKAVQLANALHGAYDSPSGIPYSSVNLKSGKGIKNHVDNGASSTAEAATVQLEMKYLSKLTGEILWWNLAEKVMQVLESNKPQDGLVPIYVNPDTGKYQGHLIRLGSRGDSYYEYLLKQYLQTNKQELVYWDMYRESVEGVKKHLVSDSYPSGLTFIGELDNGIGGKLSTKMDHLVCFYGGLLALGATGGLTLNEAQSLKSWNEEREADFKLGEELTYTCYKMYHDVSPTGLSPEIVVFNEDTSKSKDFIIKPLDRHNLQRPETVESLFYLYRLTGDVKYREMGYEIFQNFIKYTKVVNSEGEVSFSSLSDVTSFDSNGLPKFKDNTESFWWAETLKYLYLLFDDTNKIPLTDYVFNTEAHPFPRFDTNDYFKTGWRRKIDENEKAQMRESKVIDKSNLPEAQPVDKSADQEAKEIIEEIAG

SEQ ID NO: 58711 - DNA, 1650 bp, Saccharomyces cerevisiae
  CDS (1)..(1650)
atgaagaactctgtcggtatttcaattgcaaccattgttgctatcatagcagctatatactatgtgccatggtacgaacactttgagagaaagtcaccgggggccggagaaatgagagatcggattgaaagcatgttcttggaatcgtggagagactattccaagcatggctggggatacgatgtgtatggacctattgagcacacttcccataatatgcctcgtggcaaccagccgttaggctggattatcgtagattcagtggataccttgatgttaatgtataactcctccacactatacaaaagtgagttcgaggcagaaattcagagatcggagcattggataaacgatgttttggattttgatattgatgccgaagtgaatgtttttgaaactactattagaatgctaggtggtttattatccgcatatcatctatctgatgttttagaagtaggtaataagactgtctacttgaacaaagcaatagatttgggggataggcttgctttggcgttcttatccactcagaccggaattccatactcaagtataaaccttcatagtggccaagcggttaagaaccatgcagatgggggggcatcttctaccgcagaattcactacgctacaaatggaattcaaatatctggcgtatttgacaggaaatcgtacttattgggagctggtggagcgtgtttacgagccattatacaaaaataacgatcttctaaatacctacgatggattggttccaatttatacatttccagatactgggaagtttggtgcttcgactatccggttcggatcaagaggtgattctttttatgagtatttactaaaacaatatttattgacgcacgaaacactttattatgatctgtacagaaaatccatggaaggtatgaaaaagcatttattagcacaatccaaaccctcttctctgtggtacattggggaaagagaacaaggtctacatggacaactttctcctaagatggaccacctcgtgtgctttatggggggattgttagcatcaggctctactgagggcctttctattcatgaagcccgaagacgtccgtttttctctctttcccttgaaagaaaaagtgactgggatttggctaaagggataactgacacatgttatcaaatgtacaagcagtcttcctcggggcttgcgcctgaaatcgttgtcttcaatgatggaaacataaaacaggatggttggtggcggtcgtctgtgggtgatttttttgttaaaccactcgataggcacaacctacaaagaccagaaacggtggaatcgattatgttcatgtatcatttatctcatgatcacaaatatcgtgaatggggggcggaaatcgcaactagcttctttgaaaatacctgtgttgattgtaatgacccaaaattaaggcggttcaccagtttaagtgattgtatcacgttacctacaaagaaatctaacaatatggaaagtttctggttggcagagactttaaagtatttatatatattgtttttagacgagtttgatttgaccaaagttgttttcaacacagaagctcatccttttccagtattagacgaagaaatattaaaatcgcagtctctgaccacaggttggtcgttgtag

SEQ ID NO: 58712 - protein, 549 aa, Saccharomyces cerevisiae
MKNSVGISIATIVAIIAAIYYVPWYEHFERKSPGAGEMRDRIESMFLESWRDYSKHGWGYDVYGPIEHTSHNMPRGNQPLGWIIVDSVDTLMLMYNSSTLYKSEFEAEIQRSEHWINDVLDFDIDAEVNVFETTIRMLGGLLSAYHLSDVLEVGNKTVYLNKAIDLGDRLALAFLSTQTGIPYSSINLHSGQAVKNHADGGASSTAEFTTLQMEFKYLAYLTGNRTYWELVERVYEPLYKNNDLLNTYDGLVPIYTFPDTGKFGASTIRFGSRGDSFYEYLLKQYLLTHETLYYDLYRKSMEGMKKHLLAQSKPSSLWYIGEREQGLHGQLSPKMDHLVCFMGGLLASGSTEGLSIHEARRRPFFSLSLERKSDWDLAKGITDTCYQMYKQSSSGLAPEIVVFNDGNIKQDGWWRSSVGDFFVKPLDRHNLQRPETVESIMFMYHLSHDHKYREWGAEIATSFFENTCVDCNDPKLRRFTSLSDCITLPTKKSNNMESFWLAETLKYLYILFLDEFDLTKVVFNTEAHPFPVLDEEILKSQSLTTGWSL

SEQ ID NO: 58713 - DNA, 1566 bp, Schizosaccharomyces pombe
  CDS (1)..(1566)
atggttaaacgaaggactgtcaaatactttcttcgtcgaattttggcactctttgtattatgcgttccaatatattatttatacacgactgtccaacgacctcctggttataccaaacttaaaggctccacgagaagaaaagcgctgattaagaaaacattcatagaaagctggacagactatgaaacttatggctggggtaaagatgaatactatcctattattaaacgtggacggaattaccttaggaagggcatgggctggatgattattgattcccttgatacaatgatgattatgggccttgatgaacaagttttacgtgctcgtgaatgggttaataattctcttacttggaaccaagatgacgaagaagttagtgtttttgaaactactattcgtatattgggaggactcctttcttcttatcacttgtctcaagacaaactatacctagaccgcgcagtggacctagctgatcgtttgctagctgcttataatacctccacgggcttacctagatcaaatgtaaacctaggaactcgtaaatctagaaaaagaactagagagtatttcgtaagcactgctgaatccggaactgttcagatggagctacgttatttatcctatcttactggcgatcctaaatattggataacggctgacaagacaatggaggtgttgctaggagatgctacttggtctcatactggcttggttcctattacggtaaatttgattacaggcgcctacgttggtcgaaatattcgactgggttctcacggtgattcctactatgagtatttactgaaacaagatcttcaattattttcaagtggtacagtatataggaaagcgttcgatttgagtgttgatggaattattgaatatctccttaattatactactcctaatcactttgcctacatagcggaacttcccggtggattagaacacgctcaacttccaaaaatggatcacttagtatgttttttacctggcacacttatgtggggagcaaccaacggtacttcattagaagcagcacgtacttccaaaaattggggtacacgtcaagaacgtgatgtaaagctggctcaagaacttatgcgaacttgttatgaaatgtacaacatgacagctactggtttagcacctgaaattgtgttttttgatgttgaccagactaaaaatgaaatttatagcaagcgtcgtgaccaacataatttgatgaggccagagacggtagagagtctgtttattctttacagaataacgagagatgaaatatatagagaatggggatggaacatatttgtttcatttttgagatattctcgattgcctggccgagatgcatttacatgtttggatagtgtagagtcgaagaaggttaaagaccaaagggacaaaaccgaatcattttggtttgcggagacgctcaagtatctgtaccttctatttgaagacgattttagtattttgcctttaacaaactacaccttcaatacggaagctcatccatttccaaatattgaaaacaatatggacctgtacacggtgtaa

SEQ ID NO: 58714 - protein, 521 aa, Schizosaccharomyces pombe
MVKRRTVKYFLRRILALFVLCVPIYYLYTTVQRPPGYTKLKGSTRRKALIKKTFIESWTDYETYGWGKDEYYPIIKRGRNYLRKGMGWMIIDSLDTMMIMGLDEQVLRAREWVNNSLTWNQDDEEVSVFETTIRILGGLLSSYHLSQDKLYLDRAVDLADRLLAAYNTSTGLPRSNVNLGTRKSRKRTREYFVSTAESGTVQMELRYLSYLTGDPKYWITADKTMEVLLGDATWSHTGLVPITVNLITGAYVGRNIRLGSHGDSYYEYLLKQDLQLFSSGTVYRKAFDLSVDGIIEYLLNYTTPNHFAYIAELPGGLEHAQLPKMDHLVCFLPGTLMWGATNGTSLEAARTSKNWGTRQERDVKLAQELMRTCYEMYNMTATGLAPEIVFFDVDQTKNEIYSKRRDQHNLMRPETVESLFILYRITRDEIYREWGWNIFVSFLRYSRLPGRDAFTCLDSVESKKVKDQRDKTESFWFAETLKYLYLLFEDDFSILPLTNYTFNTEAHPFPNIENNMDLYTV

SEQ ID NO: 58715 - DNA, 24 bp, Artificial sequence
  (1)..(24): primer
atggtttgctgcttatgggtgctt

SEQ ID NO: 58716 - DNA, 27 bp, Artificial sequence
  (1)..(27): primer
tcatacaataaataagttgatgatggg

SEQ ID NO: 58717 - protein, 709 aa, Artificial sequence
  Variant (3)..(4): xaa in position 3 to 4 is any amino acid
  Variant (6)..(8): xaa in position 6 to 8 is any amino acid
  Variant (11)..(12): xaa in position 11 to 12 is any amino acid
  Variant (16)..(16): xaa in position 16 is any amino acid
  Variant (19)..(30): xaa in position 19 to 30 is any amino acid
  Variant (31)..(46): xaa in position 31 to 46 is any or no amino acid
  Variant (56)..(56): xaa in position 56 is any amino acid
  Variant (59)..(62): xaa in position 59 to 62 is any amino acid
  Variant (63)..(63): xaa in position 63 is any or no amino acid
  Variant (65)..(66): xaa in position 65 to 66 is any amino acid
  Variant (68)..(70): xaa in position 68 to 70 is any amino acid
  Variant (72)..(74): xaa in position 72 to 74 is any amino acid
  Variant (76)..(76): xaa in position 76 is any amino acid
  Variant (77)..(111): xaa in position 77 to 111 is any or no amino acid
  Variant (115)..(116): xaa in position 115 to 116 is any amino acid
  Variant (119)..(119): xaa in position 119 is any amino acid
  Variant (128)..(128): xaa in position 128 is any or no amino acid
  Variant (130)..(134): xaa in position 130 to 134 is any amino acid
  Variant (135)..(177): xaa in position 135 to 177 is any or no amino acid
  Variant (179)..(180): xaa in position 179 to 180 is any amino acid
  Variant (182)..(183): xaa in position 182 to 183 is any amino acid
  Variant (186)..(186): xaa in position 186 is any amino acid
  Variant (190)..(190): xaa in position 190 is any amino acid
  Variant (193)..(193): xaa in position 193 is any amino acid
  Variant (194)..(194): xaa in position 194 is any or no amino acid
  Variant (196)..(196): xaa in position 196 is any amino acid
  Variant (201)..(203): xaa in position 201 to 203 is any amino acid
  Variant (207)..(208): xaa in position 207 to 208 is any amino acid
  Variant (210)..(212): xaa in position 210 to 212 is any amino acid
  Variant (213)..(239): xaa in position 213 to 239 is any or no amino acid
  Variant (241)..(242): xaa in position 241 to 242 is any or no amino acid
  Variant (244)..(246): xaa in position 244 to 246 is any or no amino acid
  Variant (248)..(249): xaa in position 248 to 249 is any or no amino acid
  Variant (253)..(254): xaa in position 253 to 254 is any amino acid
  Variant (257)..(257): xaa in position 257 is any amino acid
  Variant (261)..(263): xaa in position 261 to 263 is any amino acid
  Variant (265)..(274): xaa in position 265 to 274 is any amino acid
  Variant (276)..(283): xaa in position 276 to 283 is any amino acid
  Variant (284)..(288): xaa in position 284 to 288 is any or no amino acid
  Variant (290)..(293): xaa in position 290 to 293 is any amino acid
  Variant (295)..(297): xaa in position 295 to 297 is any amino acid
  Variant (300)..(300): xaa in position 300 is any amino acid
  Variant (302)..(307): xaa in position 302 to 307 is any amino acid
  Variant (308)..(308): xaa in position 308 is any or no amino acid
  Variant (312)..(313): xaa in position 312 to 313 is any amino acid
  Variant (323)..(324): xaa in position 323 to 324 is any or no amino acid
  Variant (326)..(377): xaa in position 326 to 377 is any or no amino acid
  Variant (379)..(384): xaa in position 379 to 384 is any or no amino acid
  Variant (386)..(387): xaa in position 386 to 387 is any or no amino acid
  Variant (389)..(429): xaa in position 389 to 429 is any or no amino acid
  Variant (431)..(432): xaa in position 431 to 432 is any or no amino acid
  Variant (434)..(435): xaa in position 434 to 435 is any or no amino acid
  Variant (437)..(437): xaa in position 437 is any amino acid
  Variant (438)..(439): xaa in position 438 to 439 is any or no amino acid
  Variant (441)..(441): xaa in position 441 is any amino acid
  Variant (443)..(456): xaa in position 443 to 456 is any amino acid
  Variant (457)..(472): xaa in position 457 to 472 is any or no amino acid
  Variant (474)..(496): xaa in position 474 to 496 is any amino acid
  Variant (497)..(561): xaa in position 497 to 561 is any or no amino acid
  Variant (566)..(566): xaa in position 566 is any amino acid
  Variant (570)..(572): xaa in position 570 to 572 is any amino acid
  Variant (576)..(576): xaa in position 576 is any amino acid
  Variant (578)..(581): xaa in position 578 to 581 is any amino acid
  Variant (583)..(585): xaa in position 583 to 585 is any amino acid
  Variant (587)..(597): xaa in position 587 to 597 is any amino acid
  Variant (599)..(601): xaa in position 599 to 601 is any amino acid
  Variant (603)..(617): xaa in position 603 to 617 is any amino acid
  Variant (618)..(650): xaa in position 618 to 650 is any or no amino acid
  Variant (658)..(658): xaa in position 658 is any amino acid
  Variant (666)..(670): xaa in position 666 to 670 is any amino acid
  Variant (672)..(675): xaa in position 672 to 675 is any amino acid
  Variant (676)..(699): xaa in position 676 to 699 is any or no amino acid
  Variant (703)..(703): xaa in position 703 is any amino acid
  Variant (708)..(708): xaa in position 708 is any amino acid
AWXXYXXXAWXXDELXPIXXXXXXXXXXXXXXXXXXXXXXXXXXXXTLIDALDTLXIMXXXXXFXXAXXXVXXXLXXXXXXXXXXXXXXXXXXXXXXXXXXXXXXXXXXXXVFEXXIRXLGGLLSAHXLXXXXXXXXXXXXXXXXXXXXXXXXXXXXXXXXXXXXXXXXXXXXXXXXLXXAXXLAXRLLXAFXXTXTGIPXXXVNLXXGXXXXXXXXXXXXXXXXXXXXXXXXXXXXXXSXXAXXXTXXLEFXXLSXLTGXXXFXXXXXXXXXXLXXXXXXXXXXXXXLXXXXIXXXTGXWXXXXXXXLGAXXDSYYEYLLKXXIXXXXXXXXXXXXXXXXXXXXXXXXXXXXXXXXXXXXXXXXXXXXXXXXXXXXFXXXXXXIXXHXXXXXXXXXXXXXXXXXXXXXXXXXXXXXXXXXXXXXXXXXLXXFXXGXXXLXGXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRPEXVESXXXLYRXTXXXXYXXXGXXXXXXXXXXXKXXXGXXXXXXXXXXXXXXXXXXXXXXXXXXXXXXXXXXXXXXXXXXXXXXXXSFFLAETXKYLYLLFXXXXXLXXXXXXXXXXXXXXXXXXXXXXXXXXXXYVFXTEAHXL

SEQ ID NO: 58718 - protein, 13 aa, Artificial sequence
  Variant (2)..(4): xaa in position 2 to 4 is any or no amino acid
  Variant (6)..(6): xaa in position 6 is any amino acid
  Variant (7)..(7): xaa in position 7 is Gly, Asn or Pro
  Variant (8)..(8): xaa in position 8 is any amino acid
  Variant (9)..(9): xaa in position 9 is Asp or Asn
  Variant (10)..(12): xaa in position 10 to 12 is any amino acid
YXXXAXXXXXXXP

SEQ ID NO: 58719 - protein, 6 aa, Artificial sequence
  Variant (2)..(2): xaa in position 2 is Asn, Ser or Thr
  Variant (5)..(5): xaa in position 5 is Ala or Gly
FXTEXH

SEQ ID NO: 58720 - protein, 8 aa, Artificial sequence
  Variant (2)..(2): xaa in position 2 is Ile, Leu, Met or Val
  Variant (3)..(3): xaa in position 3 is Ile, Leu or Val
  Variant (5)..(5): xaa in position 5 is Ala, Gly, Asn, Ser, Thr or Val
  Variant (7)..(7): xaa in position 7 is Asp, Gly, Ser or Thr
  Variant (8)..(8): xaa in position 8 is Ser or Thr
TXXDXLXX

SEQ ID NO: 58721 - protein, 13 aa, Artificial sequence
  Variant (3)..(3): xaa in position 3 is Ala, Cys, Ser, Thr or Val
  Variant (4)..(4): xaa in position 4 is any amino acid
  Variant (7)..(8): xaa in position 7 to 8 is any amino acid
  Variant (10)..(10): xaa in position 10 is Gly or Ser
  Variant (12)..(12): xaa in position 12 is Ile or Leu
FEXXIRXXGXLXS

SEQ ID NO: 58722 - protein, 17 aa, Artificial sequence
  Variant (2)..(2): xaa in position 2 is any amino acid
  Variant (3)..(3): xaa in position 3 is Ala, Gly or Pro
  Variant (4)..(6): xaa in position 4 to 6 is any amino acid
  Variant (7)..(7): xaa in position 7 is Ser or Thr
  Variant (8)..(8): xaa in position 8 is any amino acid
  Variant (9)..(9): xaa in position 9 is Ser or Thr
  Variant (10)..(10): xaa in position 10 is any amino acid
  Variant (11)..(11): xaa in position 11 is Ile, Leu, Met or Val
  Variant (13)..(13): xaa in position 13 is any amino acid
  Variant (14)..(14): xaa in position 14 is Ala, Gly, Asn, Pro, Ser or Thr
  Variant (15)..(16): xaa in position 15 to 16 is any amino acid
LXXXXXXXXXXPXXXXN

SEQ ID NO: 58723 - protein, 17 aa, Artificial sequence
  Variant (2)..(3): xaa in position 2 to 3 is any amino acid
  Variant (4)..(4): xaa in position 4 is Ala, Gly, Ser or Thr
  Variant (5)..(5): xaa in position 5 is Cys, Ser or Thr
  Variant (6)..(7): xaa in position 6 to 7 is any amino acid
  Variant (8)..(8): xaa in position 8 is Phe, Ile, Leu, Met or Val
  Variant (11)..(12): xaa in position 11 to 12 is any amino acid
  Variant (13)..(15): xaa in position 13 to 15 is any or no amino acid
  Variant (17)..(17): xaa in position 17 is Ser or Thr
AXXXXXXXEFXXXXXLX

SEQ ID NO: 58724 - protein, 14 aa, Artificial sequence
  Variant (2)..(2): xaa in position 2 is Ala, Gly, Ser or Thr
  Variant (3)..(3): xaa in position 3 is any amino acid
  Variant (4)..(4): xaa in position 4 is Ala, Gly, Ile, Leu or Val
  Variant (7)..(7): xaa in position 7 is any or no amino acid
  Variant (9)..(9): xaa in position 9 is any or no amino acid
  Variant (13)..(13): xaa in position 13 is any amino acid
GXXXDSXYXEYLXK

SEQ ID NO: 58725 - protein, 11 aa, Artificial sequence
  Variant (2)..(2): xaa in position 2 is any amino acid
  Variant (3)..(3): xaa in position 3 is Ala or Cys
  Variant (5)..(5): xaa in position 5 is any amino acid
  Variant (6)..(6): xaa in position 6 is Gly, Pro or Ser
  Variant (8)..(8): xaa in position 8 is any amino acid
  Variant (9)..(10): xaa in position 9 to 10 is any or no amino acid
LXXFXXGXXXL

SEQ ID NO: 58726 - protein, 32 aa, Artificial sequence
  Variant (5)..(5): xaa in position 5 is any amino acid
  Variant (6)..(6): xaa in position 6 is Phe, Ile, Met or Val
  Variant (8)..(8): xaa in position 8 is Ala, Ser or Thr
  Variant (9)..(12): xaa in position 9 to 12 is any amino acid
  Variant (13)..(13): xaa in position 13 is Phe, Trp or Tyr
  Variant (14)..(15): xaa in position 14 to 15 is any amino acid
  Variant (17)..(17): xaa in position 17 is any amino acid
  Variant (18)..(18): xaa in position 18 is Asp or Asn
  Variant (19)..(24): xaa in position 19 to 24 is any amino acid
  Variant (25)..(25): xaa in position 25 is Ala, Gly or Val
  Variant (26)..(31): xaa in position 26 to 31 is any amino acid
  Variant (32)..(32): xaa in position 32 is Phe, Ile, Leu or Val
LRPEXXEXXXXXXXXTXXXXXXXXXXXXXXXX

SEQ ID NO: 58727 - protein, 16 aa, Artificial sequence
  Variant (2)..(2): xaa in position 2 is any or no amino acid
  Variant (4)..(5): xaa in position 4 to 5 is any amino acid
  Variant (6)..(6): xaa in position 6 is any or no amino acid
  Variant (9)..(9): xaa in position 9 is any amino acid
  Variant (12)..(12): xaa in position 12 is Phe or Leu
  Variant (13)..(13): xaa in position 13 is Phe, Trp or Tyr
  Variant (15)..(15): xaa in position 15 is Ile or Leu
SXFXXXETXKYXXLXF

SEQ ID NO: 58728 - DNA, 243 bp, Saccharomyces cerevisiae
  CDS (1)..(243)
atgccacattccgagaaactgaaaggcaaaaaagaaaaagccttttttttcctgccgcgaaagtttaatttgcctaccggcgttcctattggagtcaggaaaagatcactaggaattacagctgtgagaacatactctggggctggcgtaggcacacaatccggtattcctaaagttttgtggtacaaaactccatacctaaaacataaaacaaatctcacccgtggatccttttattcataa

SEQ ID NO: 58729 - protein, 80 aa, Saccharomyces cerevisiae
MPHSEKLKGKKEKAFFFLPRKFNLPTGVPIGVRKRSLGITAVRTYSGAGVGTQSGIPKVLWYKTPYLKHKTNLTRGSFYS

SEQ ID NO: 58730 - DNA, 25 bp, Artificial sequence
  (1)..(25): primer
atgccacattccgagaaactgaaag

SEQ ID NO: 58731 - DNA, 26 bp, Artificial sequence
  (1)..(26): primer
ttatgaataaaaggatccacgggtga

SEQ ID NO: 58732 - DNA, 1877 bp, Saccharomyces cerevisiae; identical to SEQ ID NO: 45527
  CDS (505)..(1791)

SEQ ID NO: 58733 - protein, 428 aa, Saccharomyces cerevisiae; identical to SEQ ID NO: 45528

SEQ ID NO: 58734 - DNA, 969 bp, Encephalitozoon cuniculi; identical to SEQ ID NO: 45529
  CDS (1)..(969): transl_table=11

SEQ ID NO: 58735 - protein, 322 aa, Encephalitozoon cuniculi; identical to SEQ ID NO: 45530

SEQ ID NO: 58736 - DNA, 1137 bp, Schizosaccharomyces pombe; identical to SEQ ID NO: 45531
  CDS (1)..(1137)

SEQ ID NO: 58737 - protein, 378 aa, Schizosaccharomyces pombe; identical to SEQ ID NO: 45532

SEQ ID NO: 58738 - DNA, 897 bp, Schizosaccharomyces pombe; identical to SEQ ID NO: 45533
  CDS (1)..(897)

SEQ ID NO: 58739 - protein, 298 aa, Schizosaccharomyces pombe; identical to SEQ ID NO: 45534

SEQ ID NO: 58740 - DNA, 1176 bp, Schizosaccharomyces pombe; identical to SEQ ID NO: 45535
  CDS (1)..(1176)

SEQ ID NO: 58741 - protein, 391 aa, Schizosaccharomyces pombe; identical to SEQ ID NO: 45536

SEQ ID NO: 58742 - DNA, 1317 bp, Schizosaccharomyces pombe; identical to SEQ ID NO: 45537
  CDS (1)..(1317)

SEQ ID NO: 58743 - protein, 438 aa, Schizosaccharomyces pombe; identical to SEQ ID NO: 45538

SEQ ID NO: 58744 - DNA, 1119 bp, Schizosaccharomyces pombe; identical to SEQ ID NO: 45539
  CDS (1)..(1119)

SEQ ID NO: 58745 - protein, 372 aa, Schizosaccharomyces pombe; identical to SEQ ID NO: 45540

SEQ ID NO: 58746 - DNA, 1173 bp, Schizosaccharomyces pombe; identical to SEQ ID NO: 45541
  CDS (1)..(1173)

SEQ ID NO: 58747 - protein, 390 aa, Schizosaccharomyces pombe; identical to SEQ ID NO: 45542

SEQ ID NO: 58748 - DNA, 1239 bp, Eremothecium gossypii; identical to SEQ ID NO: 45543
  CDS (1)..(1239)

SEQ ID NO: 58749 - protein, 412 aa, Eremothecium gossypii; identical to SEQ ID NO: 45544

SEQ ID NO: 58750 - DNA, 1263 bp, Eremothecium gossypii; identical to SEQ ID NO: 45545
  CDS (1)..(1263)

SEQ ID NO: 58751 - protein, 420 aa, Eremothecium gossypii; identical to SEQ ID NO: 45546

SEQ ID NO: 58752 - DNA, 1362 bp, Eremothecium gossypii; identical to SEQ ID NO: 45547
  CDS (1)..(1362)

SEQ ID NO: 58753 - protein, 453 aa, Eremothecium gossypii; identical to SEQ ID NO: 45548

SEQ ID NO: 58754 - DNA, 1284 bp, Eremothecium gossypii; identical to SEQ ID NO: 45549
  CDS (1)..(1284)

SEQ ID NO: 58755 - protein, 427 aa, Eremothecium gossypii; identical to SEQ ID NO: 45550

SEQ ID NO: 58756 - DNA, 1305 bp, Neurospora crassa; identical to SEQ ID NO: 45551
  CDS (1)..(1305)

SEQ ID NO: 58757 - protein, 434 aa, Neurospora crassa; identical to SEQ ID NO: 45552

SEQ ID NO: 58758 - DNA, 1512 bp, Neurospora crassa; identical to SEQ ID NO: 45553
  CDS (1)..(1512)

SEQ ID NO: 58759 - protein, 503 aa, Neurospora crassa; identical to SEQ ID NO: 45554

SEQ ID NO: 58760 - DNA, 1446 bp, Neurospora crassa; identical to SEQ ID NO: 45555
  CDS (1)..(1446)

SEQ ID NO: 58761 - protein, 481 aa, Neurospora crassa; identical to SEQ ID NO: 45556

SEQ ID NO: 58762 - DNA, 1311 bp, Neurospora crassa; identical to SEQ ID NO: 45557
  CDS (1)..(1311)

SEQ ID NO: 58763 - protein, 436 aa, Neurospora crassa; identical to SEQ ID NO: 45558

SEQ ID NO: 58764 - DNA, 1182 bp, Neurospora crassa; identical to SEQ ID NO: 45559
  CDS (1)..(1182)

SEQ ID NO: 58765 - protein, 393 aa, Neurospora crassa; identical to SEQ ID NO: 45560

SEQ ID NO: 58766 - DNA, 1185 bp, Magnaporthe grisea 70-15; identical to SEQ ID NO: 45561
  CDS (1)..(1185)

SEQ ID NO: 58767 - protein, 394 aa, Magnaporthe grisea 70-15; identical to SEQ ID NO: 45562

SEQ ID NO: 58768 - DNA, 1176 bp, Magnaporthe grisea 70-15; identical to SEQ ID NO: 45563
  CDS (1)..(1176)

SEQ ID NO: 58769 - protein, 391 aa, Magnaporthe grisea 70-15; identical to SEQ ID NO: 45564

SEQ ID NO: 58770 - DNA, 1317 bp, Magnaporthe grisea 70-15; identical to SEQ ID NO: 45565
  CDS (1)..(1317)

SEQ ID NO: 58771 - protein, 438 aa, Magnaporthe grisea 70-15; identical to SEQ ID NO: 45566

SEQ ID NO: 58772 - DNA, 1551 bp, Magnaporthe grisea 70-15; identical to SEQ ID NO: 45567
  CDS (1)..(1551)

SEQ ID NO: 58773 - protein, 516 aa, Magnaporthe grisea 70-15; identical to SEQ ID NO: 45568

SEQ ID NO: 58774 - DNA, 1527 bp, Gibberella zeae PH-1; identical to SEQ ID NO: 45569
  CDS (1)..(1527)

SEQ ID NO: 58775 - protein, 508 aa, Gibberella zeae PH-1; identical to SEQ ID NO: 45570

SEQ ID NO: 58776 - DNA, 1434 bp, Gibberella zeae PH-1; identical to SEQ ID NO: 45571
  CDS (1)..(1434)

SEQ ID NO: 58777 - protein, 477 aa, Gibberella zeae PH-1; identical to SEQ ID NO: 45572

SEQ ID NO: 58778 - DNA, 1185 bp, Gibberella zeae PH-1; identical to SEQ ID NO: 45573
  CDS (1)..(1185)

SEQ ID NO: 58779 - protein, 394 aa, Gibberella zeae PH-1; identical to SEQ ID NO: 45574

SEQ ID NO: 58780 - DNA, 1311 bp, Ustilago maydis 521; identical to SEQ ID NO: 45575
  CDS (1)..(1311)

SEQ ID NO: 58781 - protein, 436 aa, Ustilago maydis 521; identical to SEQ ID NO: 45576

SEQ ID NO: 58782 - DNA, 1188 bp, Ustilago maydis 521; identical to SEQ ID NO: 45577
  CDS (1)..(1188)

SEQ ID NO: 58783 - protein, 395 aa, Ustilago maydis 521; identical to SEQ ID NO: 45578

SEQ ID NO: 58784 - DNA, 1497 bp, Aspergillus nidulans FGSC A4; identical to SEQ ID NO: 45579
  CDS (1)..(1497)

SEQ ID NO: 58785 - protein, 498 aa, Aspergillus nidulans FGSC A4; identical to SEQ ID NO: 45580

SEQ ID NO: 58786 - DNA, 1350 bp, Aspergillus nidulans FGSC A4; identical to SEQ ID NO: 45581
  CDS (1)..(1350)

SEQ ID NO: 58787 - protein, 449 aa, Aspergillus nidulans FGSC A4; identical to SEQ ID NO: 45582

SEQ ID NO: 58788 - DNA, 1188 bp, Aspergillus nidulans FGSC A4; identical to SEQ ID NO: 45583
  CDS (1)..(1188)

SEQ ID NO: 58789 - protein, 395 aa, Aspergillus nidulans FGSC A4; identical to SEQ ID NO: 45584

SEQ ID NO: 58790 - DNA, 1206 bp, Candida glabrata CBS138; identical to SEQ ID NO: 45585
  CDS (1)..(1206)

SEQ ID NO: 58791 - protein, 401 aa, Candida glabrata CBS138; identical to SEQ ID NO: 45586

SEQ ID NO: 58792 - DNA, 1392 bp, Candida glabrata CBS138; identical to SEQ ID NO: 45587
  CDS (1)..(1392)

SEQ ID NO: 58793 - protein, 463 aa, Candida glabrata CBS138; identical to SEQ ID NO: 45588

SEQ ID NO: 58794 - DNA, 1275 bp, Candida glabrata CBS138; identical to SEQ ID NO: 45589
  CDS (1)..(1275)

SEQ ID NO: 58795 - protein, 424 aa, Candida glabrata CBS138; identical to SEQ ID NO: 45590

SEQ ID NO: 58796 - DNA, 1281 bp, Candida glabrata CBS138; identical to SEQ ID NO: 45591
  CDS (1)..(1281)

SEQ ID NO: 58797 - protein, 426 aa, Candida glabrata CBS138; identical to SEQ ID NO: 45592

SEQ ID NO: 58798 - DNA, 1236 bp, Candida glabrata CBS138; identical to SEQ ID NO: 45593
  CDS (1)..(1236)

SEQ ID NO: 58799 - protein, 411 aa, Candida glabrata CBS138; identical to SEQ ID NO: 45594

SEQ ID NO: 58800 - DNA, 1599 bp, Candida glabrata CBS138; identical to SEQ ID NO: 45595
  CDS (1)..(1599)

SEQ ID NO: 58801 - protein, 532 aa, Candida glabrata CBS138; identical to SEQ ID NO: 45596

SEQ ID NO: 58802 - DNA, 1434 bp, Candida glabrata CBS138; identical to SEQ ID NO: 45597
  CDS (1)..(1434)

SEQ ID NO: 58803 - protein, 477 aa, Candida glabrata CBS138; identical to SEQ ID NO: 45598

SEQ ID NO: 58804 - DNA, 1335 bp, Kluyveromyces lactis NRRL Y-1140; identical to SEQ ID NO: 45599
  CDS (1)..(1335)

SEQ ID NO: 58805 - protein, 444 aa, Kluyveromyces lactis NRRL Y-1140; identical to SEQ ID NO: 45600

SEQ ID NO: 58806 - DNA, 1284 bp, Kluyveromyces lactis NRRL Y-1140; identical to SEQ ID NO: 45601
  CDS (1)..(1284)

SEQ ID NO: 58807 - protein, 427 aa, Kluyveromyces lactis NRRL Y-1140; identical to SEQ ID NO: 45602

SEQ ID NO: 58808 - DNA, 1221 bp, Kluyveromyces lactis NRRL Y-1140; identical to SEQ ID NO: 45603
  CDS (1)..(1221)

SEQ ID NO: 58809 - protein, 406 aa, Kluyveromyces lactis NRRL Y-1140; identical to SEQ ID NO: 45604

SEQ ID NO: 58810 - DNA, 1569 bp, Kluyveromyces lactis NRRL Y-1140; identical to SEQ ID NO: 45605
  CDS (1)..(1569)

SEQ ID NO: 58811 - protein, 522 aa, Kluyveromyces lactis NRRL Y-1140; identical to SEQ ID NO: 45606

SEQ ID NO: 58812 - DNA, 1251 bp, Kluyveromyces lactis NRRL Y-1140; identical to SEQ ID NO: 45607
  CDS (1)..(1251)

SEQ ID NO: 58813 - protein, 416 aa, Kluyveromyces lactis NRRL Y-1140; identical to SEQ ID NO: 45608

SEQ ID NO: 58814 - DNA, 1233 bp, Kluyveromyces lactis NRRL Y-1140; identical to SEQ ID NO: 45609
  CDS (1)..(1233)

SEQ ID NO: 58815 - protein, 410 aa, Kluyveromyces lactis NRRL Y-1140; identical to SEQ ID NO: 45610

SEQ ID NO: 58816 - DNA, 1773 bp, Debaryomyces hansenii CBS767; identical to SEQ ID NO: 45611
  CDS (1)..(1773)

SEQ ID NO: 58817 - protein, 590 aa, Debaryomyces hansenii CBS767; identical to SEQ ID NO: 45612

SEQ ID NO: 58818 - DNA, 1515 bp, Debaryomyces hansenii CBS767; identical to SEQ ID NO: 45613
  CDS (1)..(1515)

SEQ ID NO: 58819 - protein, 504 aa, Debaryomyces hansenii CBS767; identical to SEQ ID NO: 45614

SEQ ID NO: 58820 - DNA, 1257 bp, Debaryomyces hansenii CBS767; identical to SEQ ID NO: 45615
  CDS (1)..(1257)

SEQ ID NO: 58821 - protein, 418 aa, Debaryomyces hansenii CBS767; identical to SEQ ID NO: 45616

SEQ ID NO: 58822 - DNA, 1320 bp, Debaryomyces hansenii CBS767; identical to SEQ ID NO: 45617
  CDS (1)..(1320)

SEQ ID NO: 58823 - protein, 439 aa, Debaryomyces hansenii CBS767; identical to SEQ ID NO: 45618

SEQ ID NO: 58824 - DNA, 1419 bp, Debaryomyces hansenii CBS767; identical to SEQ ID NO: 45619
  CDS (1)..(1419)

SEQ ID NO: 58825 - protein, 472 aa, Debaryomyces hansenii CBS767; identical to SEQ ID NO: 45620

SEQ ID NO: 58826 - DNA, 1341 bp, Debaryomyces hansenii CBS767; identical to SEQ ID NO: 45621
  CDS (1)..(1341)

SEQ ID NO: 58827 - protein, 446 aa, Debaryomyces hansenii CBS767; identical to SEQ ID NO: 45622

SEQ ID NO: 58828 - DNA, 1251 bp, Debaryomyces hansenii CBS767; identical to SEQ ID NO: 45623
  CDS (1)..(1251)

SEQ ID NO: 58829 - protein, 416 aa, Debaryomyces hansenii CBS767; identical to SEQ ID NO: 45624

SEQ ID NO: 58830 - DNA, 1302 bp, Debaryomyces hansenii CBS767; identical to SEQ ID NO: 45625
  CDS (1)..(1302)

SEQ ID NO: 58831 - protein, 433 aa, Debaryomyces hansenii CBS767; identical to SEQ ID NO: 45626

SEQ ID NO: 58832 - DNA, 1341 bp, Yarrowia lipolytica CLIB99; identical to SEQ ID NO: 45627
  CDS (1)..(1341)

SEQ ID NO: 58833 - protein, 446 aa, Yarrowia lipolytica CLIB99; identical to SEQ ID NO: 45628

SEQ ID NO: 58834 - DNA, 1290 bp, Yarrowia lipolytica CLIB99; identical to SEQ ID NO: 45629
  CDS (1)..(1290)

SEQ ID NO: 58835 - protein, 429 aa, Yarrowia lipolytica CLIB99; identical to SEQ ID NO: 45630

SEQ ID NO: 58836 - DNA, 1242 bp, Yarrowia lipolytica CLIB99; identical to SEQ ID NO: 45631
  CDS (1)..(1242)

SEQ ID NO: 58837 - protein, 413 aa, Yarrowia lipolytica CLIB99; identical to SEQ ID NO: 45632

SEQ ID NO: 58838 - DNA, 1527 bp, Yarrowia lipolytica CLIB99; identical to SEQ ID NO: 45633
  CDS (1)..(1527)

SEQ ID NO: 58839 - protein, 508 aa, Yarrowia lipolytica CLIB99; identical to SEQ ID NO: 45634

SEQ ID NO: 58840 - DNA, 1299 bp, Schizosaccharomyces pombe; identical to SEQ ID NO: 45635
  CDS (1)..(1299)

SEQ ID NO: 58841 - protein, 432 aa, Schizosaccharomyces pombe; identical to SEQ ID NO: 45636

SEQ ID NO: 58842 - DNA, 1215 bp, Saccharomyces cerevisiae; identical to SEQ ID NO: 45637
  CDS (1)..(1215)

SEQ ID NO: 58843 - protein, 404 aa, Saccharomyces cerevisiae; identical to SEQ ID NO: 45638

SEQ ID NO: 58844 - DNA, 1233 bp, Candida albicans; identical to SEQ ID NO: 45639
  CDS (1)..(1233): transl_table=12

SEQ ID NO: 58845 - protein, 410 aa, Candida albicans; identical to SEQ ID NO: 45640

SEQ ID NO: 58846 - DNA, 1443 bp, Candida albicans; identical to SEQ ID NO: 45641
  CDS (1)..(1443): transl_table=12

SEQ ID NO: 58847 - protein, 480 aa, Candida albicans; identical to SEQ ID NO: 45642

SEQ ID NO: 58848 - DNA, 1296 bp, Candida albicans; identical to SEQ ID NO: 45643
  CDS (1)..(1296): transl_table=12

SEQ ID NO: 58849 - protein, 431 aa, Candida albicans; identical to SEQ ID NO: 45644

SEQ ID NO: 58850 - DNA, 1329 bp, Saccharomyces cerevisiae; identical to SEQ ID NO: 45645
  CDS (1)..(1329)

SEQ ID NO: 58851 - protein, 442 aa, Saccharomyces cerevisiae; identical to SEQ ID NO: 45646

SEQ ID NO: 58852 - DNA, 1182 bp, Saccharomyces cerevisiae; identical to SEQ ID NO: 45647
  CDS (1)..(1182)

SEQ ID NO: 58853 - protein, 393 aa, Saccharomyces cerevisiae; identical to SEQ ID NO: 45648

SEQ ID NO: 58854 - DNA, 1278 bp, Saccharomyces cerevisiae; identical to SEQ ID NO: 45649
  CDS (1)..(1278)

SEQ ID NO: 58855 - protein, 425 aa, Saccharomyces cerevisiae; identical to SEQ ID NO: 45650

SEQ ID NO: 58856 - DNA, 1215 bp, Saccharomyces cerevisiae; identical to SEQ ID NO: 45651
  CDS (1)..(1215)

SEQ ID NO: 58857 - protein, 404 aa, Saccharomyces cerevisiae; identical to SEQ ID NO: 45652

SEQ ID NO: 58858 - DNA, 1395 bp, Saccharomyces cerevisiae; identical to SEQ ID NO: 45653
  CDS (1)..(1395)

SEQ ID NO: 58859 - protein, 464 aa, Saccharomyces cerevisiae; identical to SEQ ID NO: 45654

SEQ ID NO: 58860 - DNA, 1569 bp, Saccharomyces cerevisiae; identical to SEQ ID NO: 45655
  CDS (1)..(1569)

SEQ ID NO: 58861 - protein, 522 aa, Saccharomyces cerevisiae; identical to SEQ ID NO: 45656

SEQ ID NO: 58862 - DNA, 1341 bp, Saccharomyces cerevisiae; identical to SEQ ID NO: 45657
  CDS (1)..(1341)

SEQ ID NO: 58863 - protein, 446 aa, Saccharomyces cerevisiae; identical to SEQ ID NO: 45658

SEQ ID NO: 58864 - DNA, 1554 bp, Saccharomyces cerevisiae; identical to SEQ ID NO: 45659
  CDS (1)..(1554)

SEQ ID NO: 58865 - protein, 517 aa, Saccharomyces cerevisiae; identical to SEQ ID NO: 45660

SEQ ID NO: 58866 - DNA, 1386 bp, Candida albicans; identical to SEQ ID NO: 45661
  CDS (1)..(1386): transl_table=12

SEQ ID NO: 58867 - protein, 461 aa, Candida albicans; identical to SEQ ID NO: 45662

SEQ ID NO: 58868 - DNA, 1137 bp, Candida albicans; identical to SEQ ID NO: 45663
  CDS (1)..(1137): transl_table=12

SEQ ID NO: 58869 - protein, 378 aa, Candida albicans; identical to SEQ ID NO: 45664

SEQ ID NO: 58870 - DNA, 23 bp, Artificial sequence
  (1)..(23): primer
atggcaaaaggaggctcgctata

SEQ ID NO: 58871 - DNA, 26 bp, Artificial sequence
  (1)..(26): primer
ttaaatctcgtcttgctcttctttta

SEQ ID NO: 58872 - protein, 464 aa, Artificial sequence; identical to SEQ ID NO: 45667
  Variant (2)..(3): xaa in position 2 to 3 is any amino acid
  Variant (5)..(6): xaa in position 5 to 6 is any amino acid
  Variant (8)..(8): xaa in position 8 is any amino acid
  Variant (10)..(10): xaa in position 10 is any amino acid
  Variant (13)..(13): xaa in position 13 is any amino acid
  Variant (16)..(17): xaa in position 16 to 17 is any amino acid
  Variant (19)..(20): xaa in position 19 to 20 is any amino acid
  Variant (23)..(24): xaa in position 23 to 24 is any amino acid
  Variant (27)..(28): xaa in position 27 to 28 is any amino acid
  Variant (31)..(32): xaa in position 31 to 32 is any amino acid
  Variant (33)..(34): xaa in position 33 to 34 is any or no amino acid
  Variant (36)..(36): xaa in position 36 is any amino acid
  Variant (38)..(38): xaa in position 38 is any amino acid
  Variant (40)..(40): xaa in position 40 is any amino acid
  Variant (45)..(46): xaa in position 45 to 46 is any amino acid
  Variant (48)..(50): xaa in position 48 to 50 is any amino acid
  Variant (52)..(63): xaa in position 52 to 63 is any amino acid
  Variant (64)..(74): xaa in position 64 to 74 is any or no amino acid
  Variant (76)..(77): xaa in position 76 to 77 is any amino acid
  Variant (79)..(82): xaa in position 79 to 82 is any amino acid
  Variant (84)..(85): xaa in position 84 to 85 is any amino acid
  Variant (87)..(88): xaa in position 87 to 88 is any amino acid
  Variant (90)..(103): xaa in position 90 to 103 is any amino acid
  Variant (104)..(108): xaa in position 104 to 108 is any or no amino acid
  Variant (110)..(110): xaa in position 110 is any or no amino acid
  Variant (113)..(114): xaa in position 113 to 114 is any amino acid
  Variant (115)..(115): xaa in position 115 is any or no amino acid
  Variant (118)..(119): xaa in position 118 to 119 is any or no amino acid
  Variant (124)..(124): xaa in position 124 is any or no amino acid
  Variant (127)..(127): xaa in position 127 is any or no amino acid
  Variant (130)..(134): xaa in position 130 to 134 is any or no amino acid
  Variant (136)..(141): xaa in position 136 to 141 is any or no amino acid
  Variant (143)..(143): xaa in position 143 is any or no amino acid
  Variant (151)..(151): xaa in position 151 is any amino acid
  Variant (153)..(155): xaa in position 153 to 155 is any amino acid
  Variant (159)..(159): xaa in position 159 is any amino acid
  Variant (160)..(160): xaa in position 160 is any or no amino acid
  Variant (163)..(163): xaa in position 163 is any amino acid
  Variant (165)..(166): xaa in position 165 to 166 is any amino acid
  Variant (168)..(171): xaa in position 168 to 171 is any amino acid
  Variant (173)..(173): xaa in position 173 is any amino acid
  Variant (177)..(177): xaa in position 177 is any amino acid
  Variant (179)..(179): xaa in position 179 is any amino acid
  Variant (181)..(181): xaa in position 181 is any or no amino acid
  Variant (183)..(185): xaa in position 183 to 185 is any amino acid
  Variant (188)..(189): xaa in position 188 to 189 is any amino acid
  Variant (192)..(196): xaa in position 192 to 196 is any amino acid
  Variant (198)..(214): xaa in position 198 to 214 is any amino acid
  Variant (215)..(296): xaa in position 215 to 296 is any or no amino acid
  Variant (298)..(299): xaa in position 298 to 299 is any amino acid
  Variant (310)..(310): xaa in position 310 is any amino acid
  Variant (312)..(313): xaa in position 312 to 313 is any amino acid
  Variant (316)..(318): xaa in position 316 to 318 is any amino acid
  Variant (320)..(321): xaa in position 320 to 321 is any amino acid
  Variant (322)..(323): xaa in position 322 to 323 is any or no amino acid
  Variant (326)..(327): xaa in position 326 to 327 is any amino acid
  Variant (330)..(331): xaa in position 330 to 331 is any amino acid
  Variant (336)..(336): xaa in position 336 is any amino acid
  Variant (349)..(350): xaa in position 349 to 350 is any amino acid
  Variant (352)..(357): xaa in position 352 to 357 is any amino acid
  Variant (360)..(360): xaa in position 360 is any amino acid
  Variant (362)..(362): xaa in position 362 is any amino acid
  Variant (367)..(367): xaa in position 367 is any amino acid
  Variant (369)..(372): xaa in position 369 to 372 is any amino acid
  Variant (373)..(375): xaa in position 373 to 375 is any or no amino acid
  Variant (378)..(381): xaa in position 378 to 381 is any amino acid
  Variant (382)..(430): xaa in position 382 to 430 is any or no amino acid
  Variant (432)..(443): xaa in position 432 to 443 is any amino acid
  Variant (444)..(459): xaa in position 444 to 459 is any or no amino acid
  Variant (461)..(463): xaa in position 461 to 463 is any amino acid

SEQ ID NO: 58873 - protein, 48 aa, Artificial sequence; identical to SEQ ID NO: 45668
  Variant (2)..(3): xaa in position 2 to 3 is any amino acid
  Variant (4)..(5): xaa in position 4 to 5 is any or no amino acid
  Variant (7)..(7): xaa in position 7 is any amino acid
  Variant (8)..(9): xaa in position 8 to 9 is any or no amino acid
  Variant (12)..(12): xaa in position 12 is any amino acid
  Variant (13)..(13): xaa in position 13 is Asp or Glu
  Variant (14)..(19): xaa in position 14 to 19 is any amino acid
  Variant (20)..(20): xaa in position 20 is Ala, Pro, Ser or Thr
  Variant (21)..(21): xaa in position 21 is Ile, Met or Val
  Variant (22)..(24): xaa in position 22 to 24 is any amino acid
  Variant (25)..(25): xaa in position 25 is Glu or Gln
  Variant (26)..(28): xaa in position 26 to 28 is any amino acid
  Variant (30)..(31): xaa in position 30 to 31 is any amino acid
  Variant (32)..(32): xaa in position 32 is Phe, His or Tyr
  Variant (33)..(33): xaa in position 33 is any amino acid
  Variant (35)..(35): xaa in position 35 is Asp, Gly or Pro
  Variant (36)..(37): xaa in position 36 to 37 is any amino acid
  Variant (39)..(39): xaa in position 39 is any amino acid
  Variant (41)..(41): xaa in position 41 is Asp or Asn
  Variant (42)..(43): xaa in position 42 to 43 is any amino acid
  Variant (44)..(44): xaa in position 44 is Phe or Trp
  Variant (45)..(47): xaa in position 45 to 47 is any amino acid

SEQ ID NO: 58874 - protein, 18 aa, Artificial sequence
  Variant (2)..(2): xaa in position 2 is Ala or Gly
  Variant (3)..(5): xaa in position 3 to 5 is any amino acid
  Variant (6)..(6): xaa in position 6 is Pro or Ser
  Variant (8)..(8): xaa in position 8 is His or Arg
  Variant (9)..(9): xaa in position 9 is any amino acid
  Variant (13)..(13): xaa in position 13 is Phe, Trp or Tyr
  Variant (14)..(14): xaa in position 14 is any amino acid
  Variant (16)..(16): xaa in position 16 is any amino acid
  Variant (17)..(17): xaa in position 17 is any or no amino acid
YXXXXXYXXMCRXXSXXF

SEQ ID NO: 58875 - protein, 48 aa, Artificial sequence; identical to SEQ ID NO: 45670
  Variant (2)..(15): xaa in position 2 to 15 is any amino acid
  Variant (16)..(18): xaa in position 16 to 18 is any or no amino acid
  Variant (21)..(21): xaa in position 21 is Ile, Leu, Pro or Val
  Variant (23)..(24): xaa in position 23 to 24 is any amino acid
  Variant (25)..(25): xaa in position 25 is Leu or Met
  Variant (26)..(29): xaa in position 26 to 29 is any amino acid
  Variant (31)..(31): xaa in position 31 is any amino acid
  Variant (33)..(33): xaa in position 33 is Ala, Gly or Ser
  Variant (34)..(34): xaa in position 34 is Phe or Tyr
  Variant (35)..(35): xaa in position 35 is any amino acid
  Variant (36)..(36): xaa in position 36 is Ile, Leu, Met or Val
  Variant (37)..(37): xaa in position 37 is any amino acid
  Variant (38)..(38): xaa in position 38 is Ile, Leu, Met or Val
  Variant (39)..(39): xaa in position 39 is any amino acid
  Variant (40)..(40): xaa in position 40 is Asp or Glu
  Variant (41)..(43): xaa in position 41 to 43 is any amino acid
  Variant (44)..(44): xaa in position 44 is Ser or Thr
  Variant (45)..(46): xaa in position 45 to 46 is any amino acid
  Variant (47)..(47): xaa in position 47 is Gly, Asn, Ser or Thr
  Variant (48)..(48): xaa in position 48 is Ile or Leu

SEQ ID NO: 58876 - protein, 75 aa, Artificial sequence; identical to SEQ ID NO: 45671
  Variant (2)..(2): xaa in position 2 is any amino acid
  Variant (3)..(4): xaa in position 3 to 4 is any or no amino acid
  Variant (6)..(6): xaa in position 6 is Ser or Thr
  Variant (8)..(8): xaa in position 8 is Phe or Leu
  Variant (10)..(10): xaa in position 10 is Ile or Val
  Variant (11)..(11): xaa in position 11 is Ala or Gly
  Variant (12)..(16): xaa in position 12 to 16 is any amino acid
  Variant (17)..(17): xaa in position 17 is Asp, Glu, Asn or Arg
  Variant (18)..(18): xaa in position 18 is Gly, Asn or Ser
  Variant (19)..(20): xaa in position 19 to 20 is any amino acid
  Variant (22)..(24): xaa in position 22 to 24 is any amino acid
  Variant (26)..(27): xaa in position 26 to 27 is any amino acid
  Variant (28)..(28): xaa in position 28 is Leu or Met
  Variant (29)..(29): xaa in position 29 is Asp or Glu
  Variant (30)..(32): xaa in position 30 to 32 is any amino acid
  Variant (33)..(33): xaa in position 33 is Gly or Asn
  Variant (35)..(35): xaa in position 35 is Phe, Trp or Tyr
  Variant (36)..(36): xaa in position 36 is any amino acid
  Variant (43)..(43): xaa in position 43 is Ala or Pro
  Variant (44)..(44): xaa in position 44 is Phe, Ile or Val
  Variant (46)..(46): xaa in position 46 is Ser or Thr
  Variant (47)..(47): xaa in position 47 is Ile, Leu, Met or Val
  Variant (48)..(48): xaa in position 48 is any amino acid
  Variant (49)..(49): xaa in position 49 is Ala, Ile, Leu or Val
  Variant (50)..(60): xaa in position 50 to 60 is any amino acid
  Variant (61)..(61): xaa in position 61 is Phe or Trp
  Variant (62)..(62): xaa in position 62 is any amino acid
  Variant (63)..(63): xaa in position 63 is Asp, Glu, Gly or Asn
  Variant (64)..(64): xaa in position 64 is Phe, Ile, Leu or Val
  Variant (65)..(65): xaa in position 65 is Ala, Gly or Ser
  Variant (66)..(66): xaa in position 66 is Phe or Tyr
  Variant (67)..(67): xaa in position 67 is any amino acid
  Variant (69)..(73): xaa in position 69 to 73 is any amino acid
  Variant (75)..(75): xaa in position 75 is Gly or Pro

SEQ ID NO: 58877 - DNA, 1390 bp, Saccharomyces cerevisiae; identical to SEQ ID NO: 531
  CDS (303)..(1118)

SEQ ID NO: 58878 - protein, 271 aa, Saccharomyces cerevisiae; identical to SEQ ID NO: 532

SEQ ID NO: 58879 - DNA, 714 bp, Deinococcus radiodurans; identical to SEQ ID NO: 533
  CDS (1)..(714)

SEQ ID NO: 58880 - protein, 237 aa, Deinococcus radiodurans; identical to SEQ ID NO: 534

SEQ ID NO: 58881 - DNA, 1350 bp, Nostoc sp. PCC 7120; identical to SEQ ID NO: 535
  CDS (1)..(1350)

SEQ ID NO: 58882 - protein, 449 aa, Nostoc sp. PCC 7120; identical to SEQ ID NO: 536

SEQ ID NO: 58883 - DNA, 636 bp, Listeria monocytogenes; identical to SEQ ID NO: 537
  CDS (1)..(636)

SEQ ID NO: 58884 - protein, 211 aa, Listeria monocytogenes; identical to SEQ ID NO: 538

SEQ ID NO: 58885 - DNA, 636 bp, Listeria innocua; identical to SEQ ID NO: 539
  CDS (1)..(636)

SEQ ID NO: 58886 - protein, 211 aa, Listeria innocua; identical to SEQ ID NO: 540

SEQ ID NO: 58887 - DNA, 654 bp, Brucella melitensis; identical to SEQ ID NO: 541
  CDS (1)..(654)

SEQ ID NO: 58888 - protein, 217 aa, Brucella melitensis; identical to SEQ ID NO: 542

SEQ ID NO: 58889 - DNA, 813 bp, Nostoc sp. PCC 7120; identical to SEQ ID NO: 543
  CDS (1)..(813)

SEQ ID NO: 58890 - protein, 270 aa, Nostoc sp. PCC 7120; identical to SEQ ID NO: 544

SEQ ID NO: 58891 - DNA, 615 bp, Deinococcus radiodurans; identical to SEQ ID NO: 545
  CDS (1)..(615)

SEQ ID NO: 58892 - protein, 204 aa, Deinococcus radiodurans; identical to SEQ ID NO: 546

SEQ ID NO: 58893 - DNA, 714 bp, Caulobacter crescentus; identical to SEQ ID NO: 547
  CDS (1)..(714)

SEQ ID NO: 58894 - protein, 237 aa, Caulobacter crescentus; identical to SEQ ID NO: 548

SEQ ID NO: 58895 - DNA, 756 bp, Treponema pallidum subsp. pallidum (syphilis spirochete); identical to SEQ ID NO: 549
  CDS (1)..(756)

SEQ ID NO: 58896 - protein, 251 aa, Treponema pallidum subsp. pallidum (syphilis spirochete); identical to SEQ ID NO: 550

SEQ ID NO: 58897 - DNA, 645 bp, Xylella fastidiosa; identical to SEQ ID NO: 551
  CDS (1)..(645)

SEQ ID NO: 58898 - protein, 214 aa, Xylella fastidiosa; identical to SEQ ID NO: 552

SEQ ID NO: 58899 - DNA, 2034 bp, Arabidopsis thaliana (mouse-ear cress); identical to SEQ ID NO: 553
  CDS (1)..(2034)

SEQ ID NO: 58900 - protein, 677 aa, Arabidopsis thaliana (mouse-ear cress); identical to SEQ ID NO: 554

SEQ ID NO: 58901 - DNA, 582 bp, Bacillus subtilis; identical to SEQ ID NO: 555
  CDS (1)..(582)

SEQ ID NO: 58902 - protein, 193 aa, Bacillus subtilis; identical to SEQ ID NO: 556

SEQ ID NO: 58903 - DNA, 606 bp, Thermotoga maritima; identical to SEQ ID NO: 557
  CDS (1)..(606)

SEQ ID NO: 58904 - protein, 201 aa, Thermotoga maritima; identical to SEQ ID NO: 558

SEQ ID NO: 58905 - DNA, 660 bp, Clostridium acetobutylicum; identical to SEQ ID NO: 559
  CDS (1)..(660)

SEQ ID NO: 58906 - protein, 219 aa, Clostridium acetobutylicum; identical to SEQ ID NO: 560

SEQ ID NO: 58907 - DNA, 744 bp, Saccharomyces cerevisiae; identical to SEQ ID NO: 561
  CDS (1)..(744)

SEQ ID NO: 58908 - protein, 247 aa, Saccharomyces cerevisiae; identical to SEQ ID NO: 562

SEQ ID NO: 58909 - DNA, 1050 bp, Synechocystis sp; identical to SEQ ID NO: 563
  CDS (1)..(1050)

SEQ ID NO: 58910 - protein, 349 aa, Synechocystis sp; identical to SEQ ID NO: 564

SEQ ID NO: 58911 - DNA, 875 bp, Arabidopsis thaliana (mouse-ear cress); identical to SEQ ID NO: 565
  CDS (30)..(722)

SEQ ID NO: 58912 - protein, 230 aa, Arabidopsis thaliana (mouse-ear cress); identical to SEQ ID NO: 566

SEQ ID NO: 58913 - DNA, 741 bp, Debaryomyces hansenii; identical to SEQ ID NO: 567
  CDS (1)..(741)

SEQ ID NO: 58914 - protein, 246 aa, Debaryomyces hansenii; identical to SEQ ID NO: 568

SEQ ID NO: 58915 - DNA, 741 bp, Yarrowia lipolytica; identical to SEQ ID NO: 569
  CDS (1)..(741)

SEQ ID NO: 58916 - protein, 246 aa, Yarrowia lipolytica; identical to SEQ ID NO: 570

SEQ ID NO: 58917 - DNA, 816 bp, Kluyveromyces lactis; identical to SEQ ID NO: 571
  CDS (1)..(816)

SEQ ID NO: 58918 - protein, 271 aa, Kluyveromyces lactis; identical to SEQ ID NO: 572

SEQ ID NO: 58919 - DNA, 687 bp, Kluyveromyces lactis; identical to SEQ ID NO: 573
  CDS (1)..(687)

SEQ ID NO: 58920 - protein, 228 aa, Kluyveromyces lactis; identical to SEQ ID NO: 574

SEQ ID NO: 58921 - DNA, 651 bp, Erwinia carotovora subsp; identical to SEQ ID NO: 575
  CDS (1)..(651)

SEQ ID NO: 58922 - protein, 216 aa, Erwinia carotovora subsp; identical to SEQ ID NO: 576

SEQ ID NO: 58923 - DNA, 840 bp, Candida glabrata; identical to SEQ ID NO: 577
  CDS (1)..(840)

SEQ ID NO: 58924 - protein, 279 aa, Candida glabrata; identical to SEQ ID NO: 578

SEQ ID NO: 58925 - DNA, 744 bp, Candida glabrata; identical to SEQ ID NO: 579
  CDS (1)..(744)

SEQ ID NO: 58926 - protein, 247 aa, Candida glabrata; identical to SEQ ID NO: 580

SEQ ID NO: 58927 - DNA, 621 bp, Bartonella quintana; identical to SEQ ID NO: 581
  CDS (1)..(621)

SEQ ID NO: 58928 - protein, 206 aa, Bartonella quintana; identical to SEQ ID NO: 582

SEQ ID NO: 58929 - DNA, 648 bp, Parachlamydia sp; identical to SEQ ID NO: 583
  CDS (1)..(648)

SEQ ID NO: 58930 - protein, 215 aa, Parachlamydia sp; identical to SEQ ID NO: 584

SEQ ID NO: 58931 - DNA, 636 bp, Listeria monocytogenes; identical to SEQ ID NO: 585
  CDS (1)..(636)

SEQ ID NO: 58932 - protein, 211 aa, Listeria monocytogenes; identical to SEQ ID NO: 586

SEQ ID NO: 58933 - DNA, 633 bp, Thermus thermophilus; identical to SEQ ID NO: 587
  CDS (1)..(633)

SEQ ID NO: 58934 - protein, 210 aa, Thermus thermophilus; identical to SEQ ID NO: 588

SEQ ID NO: 58935 - DNA, 654 bp, Mycobacterium paratuberculosis; identical to SEQ ID NO: 589
  CDS (1)..(654)

SEQ ID NO: 58936 - protein, 217 aa, Mycobacterium paratuberculosis; identical to SEQ ID NO: 590

SEQ ID NO: 58937 - DNA, 1134 bp, Mycobacterium paratuberculosis; identical to SEQ ID NO: 591
  CDS (1)..(1134)

SEQ ID NO: 58938 - protein, 377 aa, Mycobacterium paratuberculosis; identical to SEQ ID NO: 592

SEQ ID NO: 58939 - DNA, 627 bp, Lactobacillus johnsonii; identical to SEQ ID NO: 593
  CDS (1)..(627)

SEQ ID NO: 58940 - protein, 208 aa, Lactobacillus johnsonii; identical to SEQ ID NO: 594

SEQ ID NO: 58941 - DNA, 807 bp, Ashbya gossypii; identical to SEQ ID NO: 595
  CDS (1)..(807)

SEQ ID NO: 58942 - protein, 268 aa, Ashbya gossypii; identical to SEQ ID NO: 596

SEQ ID NO: 58943 - DNA, 687 bp, Mycobacterium tuberculosis; identical to SEQ ID NO: 597
  CDS (1)..(687)

SEQ ID NO: 58944 - protein, 228 aa, Mycobacterium tuberculosis; identical to SEQ ID NO: 598

SEQ ID NO: 58945 - DNA, 618 bp, Photorhabdus luminescens; identical to SEQ ID NO: 599
  CDS (1)..(618)

SEQ ID NO: 58946 - protein, 205 aa, Photorhabdus luminescens; identical to SEQ ID NO: 600

SEQ ID NO: 58947 - DNA, 588 bp, Anopheles gambiae str; identical to SEQ ID NO: 601
  CDS (1)..(588)

SEQ ID NO: 58948 - protein, 195 aa, Anopheles gambiae str; identical to SEQ ID NO: 602

SEQ ID NO: 58949 - DNA, 3762 bp, Neurospora crassa; identical to SEQ ID NO: 603
  CDS (1)..(3762)

SEQ ID NO: 58950 - protein, 1253 aa, Neurospora crassa; identical to SEQ ID NO: 604

SEQ ID NO: 58951 - DNA, 567 bp, Synechococcus sp; identical to SEQ ID NO: 605
  CDS (1)..(567)

SEQ ID NO: 58952 - protein, 188 aa, Synechococcus sp; identical to SEQ ID NO: 606

SEQ ID NO: 58953 - DNA, 612 bp, Rhodopirellula baltica; identical to SEQ ID NO: 607
  CDS (1)..(612)

SEQ ID NO: 58954 - protein, 203 aa, Rhodopirellula baltica; identical to SEQ ID NO: 608

SEQ ID NO: 58955 - DNA, 1329 bp, Prochlorococcus marinus subsp; identical to SEQ ID NO: 609
  CDS (1)..(1329)

SEQ ID NO: 58956 - protein, 442 aa, Prochlorococcus marinus subsp; identical to SEQ ID NO: 610

SEQ ID NO: 58957 - DNA, 1332 bp, Prochlorococcus marinus; identical to SEQ ID NO: 611
  CDS (1)..(1332)

SEQ ID NO: 58958 - protein, 443 aa, Prochlorococcus marinus; identical to SEQ ID NO: 612

SEQ ID NO: 58959 - DNA, 591 bp, Prochlorococcus marinus; identical to SEQ ID NO: 613
  CDS (1)..(591)

SEQ ID NO: 58960 - protein, 196 aa, Prochlorococcus marinus; identical to SEQ ID NO: 614

SEQ ID NO: 58961 - DNA, 618 bp, Streptomyces avermitilis; identical to SEQ ID NO: 615
  CDS (1)..(618)

SEQ ID NO: 58962 - protein, 205 aa, Streptomyces avermitilis; identical to SEQ ID NO: 616

SEQ ID NO: 58963 - DNA, 600 bp, Streptomyces avermitilis; identical to SEQ ID NO: 617
  CDS (1)..(600)

SEQ ID NO: 58964 - protein, 199 aa, Streptomyces avermitilis; identical to SEQ ID NO: 618

SEQ ID NO: 58965 - DNA, 612 bp, Streptomyces avermitilis; identical to SEQ ID NO: 619
  CDS (1)..(612)

SEQ ID NO: 58966 - protein, 203 aa, Streptomyces avermitilis; identical to SEQ ID NO: 620

SEQ ID NO: 58967 - DNA, 645 bp, Enterococcus faecalis; identical to SEQ ID NO: 621
  CDS (1)..(645)

SEQ ID NO: 58968 - protein, 214 aa, Enterococcus faecalis; identical to SEQ ID NO: 622

SEQ ID NO: 58969 - DNA, 666 bp, Lactobacillus plantarum; identical to SEQ ID NO: 623
  CDS (1)..(666)

SEQ ID NO: 58970 - protein, 221 aa, Lactobacillus plantarum; identical to SEQ ID NO: 624

SEQ ID NO: 58971 - DNA, 642 bp, Clostridium tetani; identical to SEQ ID NO: 625
  CDS (1)..(642)

SEQ ID NO: 58972 - protein, 213 aa, Clostridium tetani; identical to SEQ ID NO: 626

SEQ ID NO: 58973 - DNA, 600 bp, Bradyrhizobium japonicum; identical to SEQ ID NO: 627
  CDS (1)..(600)

SEQ ID NO: 58974 - protein, 199 aa, Bradyrhizobium japonicum; identical to SEQ ID NO: 628

SEQ ID NO: 58975 - DNA, 1407 bp, Synechococcus elongatus; identical to SEQ ID NO: 629
  CDS (1)..(1407)

SEQ ID NO: 58976 - protein, 468 aa, Synechococcus elongatus; identical to SEQ ID NO: 630

SEQ ID NO: 58977 - DNA, 582 bp, Oceanobacillus iheyensis; identical to SEQ ID NO: 631
  CDS (1)..(582)

SEQ ID NO: 58978 - protein, 193 aa, Oceanobacillus iheyensis; identical to SEQ ID NO: 632

SEQ ID NO: 58979 - DNA, 648 bp, Bifidobacterium longum; identical to SEQ ID NO: 633
  CDS (1)..(648)

SEQ ID NO: 58980 - protein, 215 aa, Bifidobacterium longum; identical to SEQ ID NO: 634

SEQ ID NO: 58981 - DNA, 1005 bp, Arabidopsis thaliana; identical to SEQ ID NO: 635
  CDS (1)..(1005)

SEQ ID NO: 58982 - protein, 334 aa, Arabidopsis thaliana; identical to SEQ ID NO: 636

SEQ ID NO: 58983 - DNA, 645 bp, Xanthomonas campestris; identical to SEQ ID NO: 637
  CDS (1)..(645)

SEQ ID NO: 58984 - protein, 214 aa, Xanthomonas campestris; identical to SEQ ID NO: 638

SEQ ID NO: 58985 - DNA, 645 bp, Xanthomonas axonopodis; identical to SEQ ID NO: 639
  CDS (1)..(645)

SEQ ID NO: 58986 - protein, 214 aa, Xanthomonas axonopodis; identical to SEQ ID NO: 640

SEQ ID NO: 58987 - DNA, 621 bp, Thermoanaerobacter tengcongensis; identical to SEQ ID NO: 641
  CDS (1)..(621)

SEQ ID NO: 58988 - protein, 206 aa, Thermoanaerobacter tengcongensis; identical to SEQ ID NO: 642

SEQ ID NO: 58989 - DNA, 582 bp, Rhizobium loti; identical to SEQ ID NO: 643
  CDS (1)..(582)

SEQ ID NO: 58990 - protein, 193 aa, Rhizobium loti; identical to SEQ ID NO: 644

SEQ ID NO: 58991 - DNA, 651 bp, Pasteurella multocida; identical to SEQ ID NO: 645
  CDS (1)..(651)

SEQ ID NO: 58992 - protein, 216 aa, Pasteurella multocida; identical to SEQ ID NO: 646

SEQ ID NO: 58993 - DNA, 597 bp, Streptomyces coelicolor; identical to SEQ ID NO: 647
  CDS (1)..(597)

SEQ ID NO: 58994 - protein, 198 aa, Streptomyces coelicolor; identical to SEQ ID NO: 648

SEQ ID NO: 58995 - DNA, 600 bp, Streptomyces coelicolor; identical to SEQ ID NO: 649
  CDS (1)..(600)

SEQ ID NO: 58996 - protein, 199 aa, Streptomyces coelicolor; identical to SEQ ID NO: 650

SEQ ID NO: 58997 - DNA, 660 bp, Gloeobacter violaceus; identical to SEQ ID NO: 651
  CDS (1)..(660)

SEQ ID NO: 58998 - protein, 219 aa, Gloeobacter violaceus; identical to SEQ ID NO: 652

SEQ ID NO: 58999 - DNA, 621 bp, Bartonella henselae; identical to SEQ ID NO: 653
  CDS (1)..(621)

SEQ ID NO: 59000 - protein, 206 aa, Bartonella henselae; identical to SEQ ID NO: 654

SEQ ID NO: 59001 - DNA, 681 bp, Parachlamydia sp; identical to SEQ ID NO: 655
  CDS (1)..(681)

SEQ ID NO: 59002 - protein, 226 aa, Parachlamydia sp; identical to SEQ ID NO: 656

SEQ ID NO: 59003 - DNA, 636 bp, Rhizobium meliloti; identical to SEQ ID NO: 657
  CDS (1)..(636)

SEQ ID NO: 59004 - protein, 211 aa, Rhizobium meliloti; identical to SEQ ID NO: 658

SEQ ID NO: 59005 - DNA, 648 bp, Escherichia coli O6; identical to SEQ ID NO: 659
  CDS (1)..(648)

SEQ ID NO: 59006 - protein, 215 aa, Escherichia coli O6; identical to SEQ ID NO: 660

SEQ ID NO: 59007 - DNA, 648 bp, Photorhabdus luminescens; identical to SEQ ID NO: 661
  CDS (1)..(648)

SEQ ID NO: 59008 - protein, 215 aa, Photorhabdus luminescens; identical to SEQ ID NO: 662

SEQ ID NO: 59009 - DNA, 648 bp, Salmonella typhimurium; identical to SEQ ID NO: 663
  CDS (1)..(648)

SEQ ID NO: 59010 - protein, 215 aa, Salmonella typhimurium; identical to SEQ ID NO: 664

SEQ ID NO: 59011 - DNA, 22 bp, Artificial sequence
  (1)..(22): primer
atgccttcgctaacccccagat

SEQ ID NO: 59012 - DNA, 23 bp, Artificial sequence
  (1)..(23): primer
ttacacatcgccatgctgggatt

SEQ ID NO: 59013 - protein, 289 aa, Artificial sequence; identical to SEQ ID NO: 34983
  Variant (2)..(2): xaa in position 2 is any amino acid
  Variant (8)..(8): xaa in position 8 is any amino acid
  Variant (10)..(10): xaa in position 10 is any amino acid
  Variant (12)..(18): xaa in position 12 to 18 is any amino acid
  Variant (20)..(21): xaa in position 20 to 21 is any amino acid
  Variant (22)..(22): xaa in position 22 is any or no amino acid
  Variant (24)..(25): xaa in position 24 to 25 is any amino acid
  Variant (27)..(29): xaa in position 27 to 29 is any amino acid
  Variant (31)..(33): xaa in position 31 to 33 is any amino acid
  Variant (35)..(37): xaa in position 35 to 37 is any amino acid
  Variant (39)..(40): xaa in position 39 to 40 is any amino acid
  Variant (42)..(49): xaa in position 42 to 49 is any amino acid
  Variant (50)..(60): xaa in position 50 to 60 is any or no amino acid
  Variant (62)..(64): xaa in position 62 to 64 is any amino acid
  Variant (66)..(68): xaa in position 66 to 68 is any amino acid
  Variant (70)..(83): xaa in position 70 to 83 is any amino acid
  Variant (84)..(116): xaa in position 84 to 116 is any or no amino acid
  Variant (118)..(118): xaa in position 118 is any amino acid
  Variant (120)..(122): xaa in position 120 to 122 is any amino acid
  Variant (124)..(126): xaa in position 124 to 126 is any amino acid
  Variant (128)..(153): xaa in position 128 to 153 is any amino acid
  Variant (154)..(193): xaa in position 154 to 193 is any or no amino acid
  Variant (195)..(206): xaa in position 195 to 206 is any amino acid
  Variant (207)..(217): xaa in position 207 to 217 is any or no amino acid
  Variant (221)..(221): xaa in position 221 is any amino acid
  Variant (225)..(226): xaa in position 225 to 226 is any amino acid
  Variant (228)..(229): xaa in position 228 to 229 is any amino acid
  Variant (231)..(249): xaa in position 231 to 249 is any amino acid
  Variant (250)..(285): xaa in position 250 to 285 is any or no amino acid
  Variant (287)..(288): xaa in position 287 to 288 is any amino acid

SEQ ID NO: 59014 - protein, 65 aa, Artificial sequence; identical to SEQ ID NO: 1307
  Variant (4)..(4): xaa in position 4 is Glu, Gln, Lys or Ala
  Variant (5)..(5): xaa in position 5 is Thr or Ser
  Variant (6)..(6): xaa in position 6 is any amino acid
  Variant (7)..(7): xaa in position 7 is Trp, Phe or Tyr
  Variant (8)..(8): xaa in position 8 is Asn, Ser or Ala
  Variant (9)..(13): xaa in position 9 to 13 is any amino acid
  Variant (14)..(14): xaa in position 14 is Gln or Thr
  Variant (15)..(15): xaa in position 15 is Gly or Ser
  Variant (16)..(16): xaa in position 16 is any amino acid
  Variant (17)..(18): xaa in position 17 to 18 is any or no amino acid
  Variant (19)..(19): xaa in position 19 is Asp, Asn or Glu
  Variant (20)..(21): xaa in position 20 to 21 is any amino acid
  Variant (23)..(25): xaa in position 23 to 25 is any amino acid
  Variant (26)..(26): xaa in position 26 is Gly or Ser
  Variant (27)..(29): xaa in position 27 to 29 is any amino acid
  Variant (30)..(30): xaa in position 30 is Ala, Met, Val or Ile
  Variant (31)..(36): xaa in position 31 to 36 is any amino acid
  Variant (37)..(37): xaa in position 37 is Leu, Ile, Val, Ala or Phe
  Variant (38)..(44): xaa in position 38 to 44 is any amino acid
  Variant (45)..(55): xaa in position 45 to 55 is any or no amino acid
  Variant (56)..(56): xaa in position 56 is Thr, Ser, Ala or Val
  Variant (58)..(60): xaa in position 58 to 60 is any amino acid
  Variant (62)..(62): xaa in position 62 is Ala, Thr or Pro
  Variant (63)..(64): xaa in position 63 to 64 is any amino acid

SEQ ID NO: 59015 - DNA, 1123 bp, Saccharomyces cerevisiae
  CDS (263)..(955)
tattccagccttcccaccacgtagctattatcggccctaatgatcttttattctaactgactcgcagattaattcacacatcggttgttaatcattgtttgaatttccaaaatatgcgatgagctgaatgaaaaattttggaacctgtcactatcgacgaacatcgaagtttgccatgacaaccatatatgaagaaagcttatgagactagctcgagtatatcatacgtatgcatgttaatcgcagttaagcggataacacaatgcgtaagccttctattacgataacaacagcaaaagctattataactccagactatactcttattaaatcgcattctaaataccaacttccttcacgttttcaaaagctagatgcagactcacctgagagaagtacagttgttaagctattttaccgccgatttatgaggcttaagcctttcatatcgaatgtgaaaatggttaaagatacttacagggattatgttcgatataagtttatgaaagaaaactacgaactcaaacgatacttggtattcaatcctgatggcttgaggtcgaaaatcaatcttgagcttctcagcaacacgaaatgttgtgaaaggatactccccgtgactgagatgcaaagaaccttggaatttgttctgaagagctgttcatacttgcccgaaacaaaagttcaaaagtgggatattgcaagggacaacacatattgcaggcaaattttaaagaaccttttaacaatgcaatatgaaaagtacagatcgattttgcatagaggaataggccatgatgagcttgacgtcaaattctctcatttgaaaactacttctagtccgctaactaagctaaataaaaccgaaaagaaaaagattccgcttttcaaagtatttagtgatttcgatacaacattgatatatctcaatgagacattaggtacaaggttataaagatcattatcgtaaaagaggagcggagcggagctttttagtatgtatggtaaaatatcaatcaaatactgtaatagatgcggatatgcgcaatgacatattttgtggtgtgcatatccattgaaaaggtgcgtagaacgttacaatactactgaacttttttccttc

SEQ ID NO: 59016 - protein, 230 aa, Saccharomyces cerevisiae
MRKPSITITTAKAIITPDYTLIKSHSKYQLPSRFQKLDADSPERSTVVKLFYRRFMRLKPFISNVKMVKDTYRDYVRYKFMKENYELKRYLVFNPDGLRSKINLELLSNTKCCERILPVTEMQRTLEFVLKSCSYLPETKVQKWDIARDNTYCRQILKNLLTMQYEKYRSILHRGIGHDELDVKFSHLKTTSSPLTKLNKTEKKKIPLFKVFSDFDTTLIYLNETLGTRL

SEQ ID NO: 59017 - DNA, 642 bp, Eremothecium gossypii
  CDS (1)..(642)
atgttaccgctcgcgatacctccgaataatatagtgcgagcaatgtcgtctcccaatgctaccggtccactcatgcggacctctaaggcaattataaccagtaactacactctgctaactgataagactccttacctgcttcccgtatgttttaatgagagttgcagggccgaacaagtgagaatgctctatcgtcgcttcttccggcttcgacctttggtagcccagcgtgcaatgataaaagagagctatacgaattatattagggtgaagtttagtgaggattatgcattaaaacgccggcaagcgttgccgcagaatacgtgcccggtactagatgccatagaggctggccgtcggtcgctgacctttatcctgaaggctgtatctgagatagaggatgcagacagcaatccggaacttgcatacgacaactatatatgtcggaagattctgaagaacgtacttactctggaataccagcgggagcgccttgagttcaaaaatcccaaaaggaagcagatactacgccaaaactacgaatacttagacgccaagtatcatgatcctaaatatacatcattaaggaatgctgacgtatccattatacattttaatgagacattgggaactaggctataa

SEQ ID NO: 59018 - protein, 213 aa, Eremothecium gossypii
MLPLAIPPNNIVRAMSSPNATGPLMRTSKAIITSNYTLLTDKTPYLLPVCFNESCRAEQVRMLYRRFFRLRPLVAQRAMIKESYTNYIRVKFSEDYALKRRQALPQNTCPVLDAIEAGRRSLTFILKAVSEIEDADSNPELAYDNYICRKILKNVLTLEYQRERLEFKNPKRKQILRQNYEYLDAKYHDPKYTSLRNADVSIIHFNETLGTRL

SEQ ID NO: 59019 - DNA, 636 bp, Candida glabrata CBS138
  CDS (1)..(636)
atggttaggaggggagtgggcacaattgagactgttaatgctttggtcaatgataattacgcgttgatacgcaacgttgcgaaatatatgctaaatgacaagggcctaaccaatgcggagttcctcagggcaagctatagacggttcatcaggcttcgaccatttgtatccaatagaagtatggtgaaggacacatatactgactatatcaggtataagtatcgatatgaagattatcctaagcgaatggctatgataggtgtgcaatgtgataatcaattgaatcgaagccaggttaagaacagtctatcttttgtagcaaaagcttgctcgtttatagatgagtctaaggggactaaatttgaagtggcgagagataatacgatgtgccgccagattctcaagaatttgttgactattcactacgagaaaacttcgcataccaacgagaaacgaaccccactgaggcatatattccaatattcatttgaacatatgaaggacataaacaaaagtacaaattctcaatcttatagcaagccagctagtcccaaatcatcacttatacttgatttgtacggtgaatttgacagagacatattactattgaacaaccttcttaacatgcgtttataa

SEQ ID NO: 59020 - protein, 211 aa, Candida glabrata CBS138
MVRRGVGTIETVNALVNDNYALIRNVAKYMLNDKGLTNAEFLRASYRRFIRLRPFVSNRSMVKDTYTDYIRYKYRYEDYPKRMAMIGVQCDNQLNRSQVKNSLSFVAKACSFIDESKGTKFEVARDNTMCRQILKNLLTIHYEKTSHTNEKRTPLRHIFQYSFEHMKDINKSTNSQSYSKPASPKSSLILDLYGEFDRDILLLNNLLNMRL

SEQ ID NO: 59021 - DNA, 567 bp, Kluyveromyces lactis NRRL Y-1140
  CDS (1)..(567)
atggtgctcatcaaatctaggaaatccattgtcactgccacgaatgtgtgcatcaattcatcttccaaattttaccttacagaagaacaggttcagtcacttggagacaaagagttcttgactgcatcttatagaagattccttcgaatgagacaattcatttccaaaaggcaaatggtgaaggagtcatatacgacataccttaggtacaagttcaagattgaggattttgaattaaagagaagtaaattactatctgtttctgggatgagtgctatggattttcgaagctcggtccagaaatccctctgttttcttatcaaggcgttctcgattagtgatgcctactctaaagacatgattgatgactctcataaatgtaaaaagattataaaaaatttgttgactgttgactatcatcggaatagaattatcaatcgatcaagcaatatgtatcaatattatagaaaggatttcacatttttcactgatggtcaaaatattgggttgaagcaattcgaagagaatctaatgcgacttaatgagtgcttaggaacaagattataa

SEQ ID NO: 59022 - protein, 188 aa, Kluyveromyces lactis NRRL Y-1140
MVLIKSRKSIVTATNVCINSSSKFYLTEEQVQSLGDKEFLTASYRRFLRMRQFISKRQMVKESYTTYLRYKFKIEDFELKRSKLLSVSGMSAMDFRSSVQKSLCFLIKAFSISDAYSKDMIDDSHKCKKIIKNLLTVDYHRNRIINRSSNMYQYYRKDFTFFTDGQNIGLKQFEENLMRLNECLGTRL

SEQ ID NO: 59023 - DNA, 642 bp, Debaryomyces hansenii CBS767
  CDS (1)..(642)
atgaataagacgaaacaggttgttactataggaaatgacctaatagtgaagtatcaggtttcgttgttggcaggtcttgaggggctaaatgaactttcctcgaagaaatctaagttcttatcgctttacaaaaaattctataagcttcgtaatatgatcgattccaaaccatataataaagaaacataccagaacataatacgacggaaattcaccatggaggattttaaccttaaacgaaacatactattggaaggatctgacaaattatcagaattacagctatttgaacgtatgataaacacattagcatttgtccataattcaacggtatatttaccgtcagaaggaaaagaaaagccggcattcttctttcaagacttgaaaattcctcaaagaatggaaaagctgataatattgaccttgctcaagatggatcaacagaagcccaatacgattaaatacgatcgaaaatacgaatggataccgcagatatacaacaaattgagccagttgcctgatgaccccgatgcgaaggagtataagtccattttcaaggatatcgatgctaatcttatagggtttcgggactacgagttgaacttgatgaggctaaacgaatgttatagactatgtttatag

SEQ ID NO: 59024 - protein, 213 aa, Debaryomyces hansenii CBS767
MNKTKQVVTIGNDLIVKYQVSLLAGLEGLNELSSKKSKFLSLYKKFYKLRNMIDSKPYNKETYQNIIRRKFTMEDFNLKRNILLEGSDKLSELQLFERMINTLAFVHNSTVYLPSEGKEKPAFFFQDLKIPQRMEKLIILTLLKMDQQKPNTIKYDRKYEWIPQIYNKLSQLPDDPDAKEYKSIFKDIDANLIGFRDYELNLMRLNECYRLCL

SEQ ID NO: 59025 - DNA, 25 bp, Artificial sequence
  (1)..(25): primer
atgcgtaagccttctattacgataa

SEQ ID NO: 59026 - DNA, 26 bp, Artificial sequence
  (1)..(26): primer
ttataaccttgtacctaatgtctcat

SEQ ID NO: 59027 - protein, 232 aa, Artificial sequence
  Variant (2)..(2): xaa in position 2 is any amino acid
  Variant (4)..(4): xaa in position 4 is any amino acid
  Variant (10)..(13): xaa in position 10 to 13 is any amino acid
  Variant (16)..(20): xaa in position 16 to 20 is any amino acid
  Variant (22)..(22): xaa in position 22 is any amino acid
  Variant (24)..(33): xaa in position 24 to 33 is any amino acid
  Variant (34)..(40): xaa in position 34 to 40 is any or no amino acid
  Variant (42)..(44): xaa in position 42 to 44 is any amino acid
  Variant (49)..(49): xaa in position 49 is any amino acid
  Variant (53)..(54): xaa in position 53 to 54 is any amino acid
  Variant (57)..(57): xaa in position 57 is any amino acid
  Variant (59)..(59): xaa in position 59 is any amino acid
  Variant (66)..(67): xaa in position 66 to 67 is any amino acid
  Variant (71)..(71): xaa in position 71 is any amino acid
  Variant (74)..(75): xaa in position 74 to 75 is any amino acid
  Variant (77)..(77): xaa in position 77 is any amino acid
  Variant (79)..(80): xaa in position 79 to 80 is any amino acid
  Variant (83)..(84): xaa in position 83 to 84 is any amino acid
  Variant (86)..(91): xaa in position 86 to 91 is any amino acid
  Variant (92)..(108): xaa in position 92 to 108 is any or no amino acid
  Variant (110)..(114): xaa in position 110 to 114 is any amino acid
  Variant (116)..(117): xaa in position 116 to 117 is any amino acid
  Variant (120)..(120): xaa in position 120 is any amino acid
  Variant (123)..(123): xaa in position 123 is any amino acid
  Variant (126)..(126): xaa in position 126 is any amino acid
  Variant (128)..(128): xaa in position 128 is any or no amino acid
  Variant (130)..(136): xaa in position 130 to 136 is any amino acid
  Variant (137)..(142): xaa in position 137 to 142 is any or no amino acid
  Variant (145)..(146): xaa in position 145 to 146 is any amino acid
  Variant (149)..(150): xaa in position 149 to 150 is any amino acid
  Variant (153)..(153): xaa in position 153 is any amino acid
  Variant (162)..(162): xaa in position 162 is any amino acid
  Variant (164)..(164): xaa in position 164 is any amino acid
  Variant (166)..(196): xaa in position 166 to 196 is any amino acid
  Variant (197)..(216): xaa in position 197 to 216 is any or no amino acid
  Variant (219)..(220): xaa in position 219 to 220 is any amino acid
  Variant (223)..(223): xaa in position 223 is any amino acid
  Variant (227)..(227): xaa in position 227 is any amino acid
  Variant (229)..(230): xaa in position 229 to 230 is any amino acid
IXTXKAIVTXXXXLIXXXXXYXLXXXXXXXXXXXXXXXXXLXXXYRRFXRLRXXISXRXMVKETYXXYIRXKFXXEXFXXKRXXLXXXXXXXXXXXXXXXXXXXXXXXLXXXXXMXXSLXFVXKAXSXIXXXXXXXXXXXXXDLXXDNXXCRXILKNLLTMXYXKXXXXXXXXXXXXXXXXXXXXXXXXXXXXXXXXXXXXXXXXXXXXXXXXXXXFDXXLIXLNEXLXXRL

SEQ ID NO: 59028 - protein, 29 aa, Artificial sequence
  Variant (5)..(5): xaa in position 5 is Phe, Ile, Leu or Met
  Variant (7)..(7): xaa in position 7 is Leu or Met
  Variant (8)..(8): xaa in position 8 is Lys or Arg
  Variant (9)..(9): xaa in position 9 is Pro or Gln
  Variant (10)..(10): xaa in position 10 is Phe or Leu
  Variant (11)..(11): xaa in position 11 is Ile or Val
  Variant (12)..(12): xaa in position 12 is Ala or Ser
  Variant (13)..(15): xaa in position 13 to 15 is any amino acid
  Variant (17)..(17): xaa in position 17 is Ile or Val
  Variant (19)..(19): xaa in position 19 is Asp or Glu
  Variant (20)..(20): xaa in position 20 is Ser or Thr
  Variant (22)..(22): xaa in position 22 is any amino acid
  Variant (23)..(23): xaa in position 23 is Asp, Asn or Thr
  Variant (25)..(25): xaa in position 25 is Ile, Leu or Val
  Variant (27)..(27): xaa in position 27 is any amino acid
  Variant (29)..(29): xaa in position 29 is Phe or Tyr
YRRFXRXXXXXXXXXMXKXXYXXYXRXKX

SEQ ID NO: 59029 - protein, 9 aa, Artificial sequence
  Variant (2)..(2): xaa in position 2 is any amino acid
  Variant (4)..(4): xaa in position 4 is Ile, Leu or Val
  Variant (5)..(5): xaa in position 5 is Ala, Ile or Leu
  Variant (7)..(7): xaa in position 7 is Ala or Ser
  Variant (8)..(8): xaa in position 8 is any amino acid
LXFXXKXXS

SEQ ID NO: 59030 - protein, 17 aa, Artificial sequence
  Variant (2)..(2): xaa in position 2 is Asn or Ser
  Variant (3)..(4): xaa in position 3 to 4 is any amino acid
  Variant (6)..(6): xaa in position 6 is Lys or Arg
  Variant (7)..(7): xaa in position 7 is any amino acid
  Variant (9)..(9): xaa in position 9 is Ile or Leu
  Variant (12)..(12): xaa in position 12 is Leu or Val
  Variant (15)..(15): xaa in position 15 is Ile, Leu, Met or Val
  Variant (16)..(16): xaa in position 16 is any amino acid
DXXXCXXIXKNXLTXXY

SEQ ID NO: 59031 - protein, 8 aa, Artificial sequence
  Variant (2)..(2): xaa in position 2 is Glu or Asn
  Variant (3)..(3): xaa in position 3 is any amino acid
  Variant (5)..(5): xaa in position 5 is Gly or Asn
  Variant (6)..(6): xaa in position 6 is any amino acid
NXXLXXRL

SEQ ID NO: 59032 - DNA, 3844 bp, Saccharomyces cerevisiae; identical to SEQ ID NO: 667
  CDS (1218)..(3269)

SEQ ID NO: 59033 - protein, 683 aa, Saccharomyces cerevisiae; identical to SEQ ID NO: 668

SEQ ID NO: 59034 - DNA, 1713 bp, Glycine max; identical to SEQ ID NO: 669
  CDS (1)..(1713)

SEQ ID NO: 59035 - protein, 570 aa, Glycine max; identical to SEQ ID NO: 670

SEQ ID NO: 59036 - DNA, 1644 bp, Glycine max; identical to SEQ ID NO: 671
  CDS (1)..(1644)

SEQ ID NO: 59037 - protein, 547 aa, Glycine max; identical to SEQ ID NO: 672

SEQ ID NO: 59038 - DNA, 1641 bp, Glycine max; identical to SEQ ID NO: 673
  CDS (1)..(1641)

SEQ ID NO: 59039 - protein, 546 aa, Glycine max; identical to SEQ ID NO: 674

SEQ ID NO: 59040 - DNA, 1668 bp, Zea mays; identical to SEQ ID NO: 675
  CDS (1)..(1668): n means a or g or c or t/u, s means g or c

SEQ ID NO: 59041 - protein, 555 aa, Zea mays; identical to SEQ ID NO: 676

SEQ ID NO: 59042 - DNA, 1659 bp, Brassica napus; identical to SEQ ID NO: 677
  CDS (1)..(1659)

SEQ ID NO: 59043 - protein, 552 aa, Brassica napus; identical to SEQ ID NO: 678

SEQ ID NO: 59044 - DNA, 1689 bp, Glycine max; identical to SEQ ID NO: 679
  CDS (1)..(1689)

SEQ ID NO: 59045 - protein, 562 aa, Glycine max; identical to SEQ ID NO: 680

SEQ ID NO: 59046 - DNA, 3359 bp, Methanothrix soehngenii; identical to SEQ ID NO: 681
  CDS (310)..(2328)

SEQ ID NO: 59047 - protein, 672 aa, Methanothrix soehngenii [sequence omitted]

SEQ ID NO: 59048 - DNA, 3802 bp, Alcaligenes eutrophus; identical to SEQ ID NO: 683
  CDS (722)..(2704)

SEQ ID NO: 59049 - protein, 660 aa, Alcaligenes eutrophus [sequence omitted]

SEQ ID NO: 59050 - DNA, 1845 bp, Phanerochaete chrysosporium; identical to SEQ ID NO: 685
  CDS (1)..(1845)

SEQ ID NO: 59051 - protein, 614 aa, Phanerochaete chrysosporium; identical to SEQ ID NO: 686

SEQ ID NO: 59052 - DNA, 1938 bp, Pseudomonas aeruginosa; identical to SEQ ID NO: 687
  CDS (1)..(1938)

SEQ ID NO: 59053 - protein, 645 aa, Pseudomonas aeruginosa [sequence omitted]

SEQ ID NO: 59054 - DNA, 1668 bp, Pseudomonas aeruginosa; identical to SEQ ID NO: 689
  CDS (1)..(1668)

SEQ ID NO: 59055 - protein, 555 aa, Pseudomonas aeruginosa; identical to SEQ ID NO: 690

SEQ ID NO: 59056 - DNA, 1947 bp, Bacillus halodurans; identical to SEQ ID NO: 691
  CDS (1)..(1947)

SEQ ID NO: 59057 - protein, 648 aa, Bacillus halodurans; identical to SEQ ID NO: 692

SEQ ID NO: 59058 - DNA, 1707 bp, Staphylococcus aureus; identical to SEQ ID NO: 693
  CDS (1)..(1707)

SEQ ID NO: 59059 - protein, 568 aa, Staphylococcus aureus; identical to SEQ ID NO: 694

SEQ ID NO: 59060 - DNA, 1887 bp, Salmonella enterica subsp. enterica serovar Typhi; identical to SEQ ID NO: 695
  CDS (1)..(1887)

SEQ ID NO: 59061 - protein, 628 aa, Salmonella enterica subsp. enterica serovar Typhi; identical to SEQ ID NO: 696

SEQ ID NO: 59062 - DNA, 1575 bp, Nostoc sp. PCC 7120; identical to SEQ ID NO: 697
  CDS (1)..(1575)

SEQ ID NO: 59063 - protein, 524 aa, Nostoc sp. PCC 7120; identical to SEQ ID NO: 698

SEQ ID NO: 59064 - DNA, 1992 bp, Brucella melitensis; identical to SEQ ID NO: 699
  CDS (1)..(1992)

SEQ ID NO: 59065 - protein, 663 aa, Brucella melitensis; identical to SEQ ID NO: 700

SEQ ID NO: 59066 - DNA, 1707 bp, Brucella melitensis; identical to SEQ ID NO: 701
  CDS (1)..(1707)

SEQ ID NO: 59067 - protein, 568 aa, Brucella melitensis; identical to SEQ ID NO: 702

SEQ ID NO: 59068 - DNA, 1959 bp, Yersinia pestis; identical to SEQ ID NO: 703
  CDS (1)..(1959)

SEQ ID NO: 59069 - protein, 652 aa, Yersinia pestis; identical to SEQ ID NO: 704

SEQ ID NO: 59070 - DNA, 1716 bp, Bacillus halodurans; identical to SEQ ID NO: 705
  CDS (1)..(1716)

SEQ ID NO: 59071 - protein, 571 aa, Bacillus halodurans; identical to SEQ ID NO: 706

SEQ ID NO: 59072 - DNA, 2004 bp, Halobacterium sp. NRC-1; identical to SEQ ID NO: 707
  CDS (1)..(2004)

SEQ ID NO: 59073 - protein, 667 aa, Halobacterium sp. NRC-1; identical to SEQ ID NO: 708

SEQ ID NO: 59074 - DNA, 1944 bp, Caulobacter crescentus; identical to SEQ ID NO: 709
  CDS (1)..(1944)

SEQ ID NO: 59075 - protein, 647 aa, Caulobacter crescentus [sequence omitted]

SEQ ID NO: 59076 - DNA, 1716 bp, Sulfolobus solfataricus; identical to SEQ ID NO: 711
  CDS (1)..(1716)

SEQ ID NO: 59077 - protein, 571 aa, Sulfolobus solfataricus; identical to SEQ ID NO: 712

SEQ ID NO: 59078 - DNA, 2001 bp, Sulfolobus solfataricus; identical to SEQ ID NO: 713
  CDS (1)..(2001)

SEQ ID NO: 59079 - protein, 666 aa, Sulfolobus solfataricus; identical to SEQ ID NO: 714

SEQ ID NO: 59080 - DNA, 1959 bp, Escherichia coli; identical to SEQ ID NO: 715
  CDS (1)..(1959)

SEQ ID NO: 59081 - protein, 652 aa, Escherichia coli; identical to SEQ ID NO: 716

SEQ ID NO: 59082 - DNA, 1533 bp, Aquifex aeolicus; identical to SEQ ID NO: 717
  CDS (1)..(1533)

SEQ ID NO: 59083 - protein, 510 aa, Aquifex aeolicus; identical to SEQ ID NO: 718

SEQ ID NO: 59084 - DNA, 1950 bp, Deinococcus radiodurans; identical to SEQ ID NO: 719
  CDS (1)..(1950)

SEQ ID NO: 59085 - protein, 649 aa, Deinococcus radiodurans [sequence omitted]

SEQ ID NO: 59086 - DNA, 1929 bp, Deinococcus radiodurans; identical to SEQ ID NO: 721
  CDS (1)..(1929)

SEQ ID NO: 59087 - protein, 642 aa, Deinococcus radiodurans; identical to SEQ ID NO: 722

SEQ ID NO: 59088 - DNA, 1899 bp, Vibrio cholerae; identical to SEQ ID NO: 723
  CDS (1)..(1899)

SEQ ID NO: 59089 - protein, 632 aa, Vibrio cholerae; identical to SEQ ID NO: 724

SEQ ID NO: 59090 - DNA, 1956 bp, Pseudomonas aeruginosa; identical to SEQ ID NO: 725
  CDS (1)..(1956)

SEQ ID NO: 59091 - protein, 651 aa, Pseudomonas aeruginosa [sequence omitted]

SEQ ID NO: 59092 - DNA, 1497 bp, Sulfolobus solfataricus; identical to SEQ ID NO: 727
  CDS (1)..(1497)

SEQ ID NO: 59093 - protein, 498 aa, Sulfolobus solfataricus; identical to SEQ ID NO: 728

SEQ ID NO: 59094 - DNA, 1869 bp, Sulfolobus solfataricus; identical to SEQ ID NO: 729
  CDS (1)..(1869)

SEQ ID NO: 59095 - protein, 622 aa, Sulfolobus solfataricus; identical to SEQ ID NO: 730

SEQ ID NO: 59096 - DNA, 1989 bp, Helicobacter pylori; identical to SEQ ID NO: 731
  CDS (1)..(1989)

SEQ ID NO: 59097 - protein, 662 aa, Helicobacter pylori [sequence omitted]

SEQ ID NO: 59098 - DNA, 1989 bp, Archaeoglobus fulgidus; identical to SEQ ID NO: 733
  CDS (1)..(1989)

SEQ ID NO: 59099 - protein, 662 aa, Archaeoglobus fulgidus; identical to SEQ ID NO: 734

SEQ ID NO: 59100 - DNA, 1932 bp, Archaeoglobus fulgidus; identical to SEQ ID NO: 735
  CDS (1)..(1932)

SEQ ID NO: 59101 - protein, 643 aa, Archaeoglobus fulgidus; identical to SEQ ID NO: 736

SEQ ID NO: 59102 - DNA, 1542 bp, Aeropyrum pernix; identical to SEQ ID NO: 737
  CDS (1)..(1542)

SEQ ID NO: 59103 - protein, 513 aa, Aeropyrum pernix; identical to SEQ ID NO: 738

SEQ ID NO: 59104 - DNA, 1944 bp, Xylella fastidiosa; identical to SEQ ID NO: 739
  CDS (1)..(1944)

SEQ ID NO: 59105 - protein, 647 aa, Xylella fastidiosa [sequence omitted]

SEQ ID NO: 59106 - DNA, 1827 bp, Sulfolobus solfataricus; identical to SEQ ID NO: 741
  CDS (1)..(1827)

SEQ ID NO: 59107 - protein, 608 aa, Sulfolobus solfataricus; identical to SEQ ID NO: 742

SEQ ID NO: 59108 - DNA, 1959 bp, Sulfolobus solfataricus; identical to SEQ ID NO: 743
  CDS (1)..(1959)

SEQ ID NO: 59109 - protein, 652 aa, Sulfolobus solfataricus; identical to SEQ ID NO: 744

SEQ ID NO: 59110 - DNA, 2046 bp, Archaeoglobus fulgidus; identical to SEQ ID NO: 745
  CDS (1)..(2046)

SEQ ID NO: 59111 - protein, 681 aa, Archaeoglobus fulgidus; identical to SEQ ID NO: 746

SEQ ID NO: 59112 - DNA, 1761 bp, Archaeoglobus fulgidus; identical to SEQ ID NO: 747
  CDS (1)..(1761)

SEQ ID NO: 59113 - protein, 586 aa, Archaeoglobus fulgidus; identical to SEQ ID NO: 748

SEQ ID NO: 59114 - DNA, 1983 bp, Aeropyrum pernix; identical to SEQ ID NO: 749
  CDS (1)..(1983)

SEQ ID NO: 59115 - protein, 660 aa, Aeropyrum pernix; identical to SEQ ID NO: 750

SEQ ID NO: 59116 - DNA, 1677 bp, Methanobacterium thermoautotrophicum; identical to SEQ ID NO: 751
  CDS (1)..(1677)

SEQ ID NO: 59117 - protein, 558 aa, Methanobacterium thermoautotrophicum; identical to SEQ ID NO: 752

SEQ ID NO: 59118 - DNA, 1929 bp, Archaeoglobus fulgidus; identical to SEQ ID NO: 753
  CDS (1)..(1929)

SEQ ID NO: 59119 - protein, 642 aa, Archaeoglobus fulgidus; identical to SEQ ID NO: 754

SEQ ID NO: 59120 - DNA, 1974 bp, Campylobacter jejuni; identical to SEQ ID NO: 755
  CDS (1)..(1974)

SEQ ID NO: 59121 - protein, 657 aa, Campylobacter jejuni [sequence omitted]

SEQ ID NO: 59122 - DNA, 1956 bp, Pseudomonas aeruginosa; identical to SEQ ID NO: 757
  CDS (1)..(1956)

SEQ ID NO: 59123 - protein, 651 aa, Pseudomonas aeruginosa; identical to SEQ ID NO: 758

SEQ ID NO: 59124 - DNA, 1887 bp, Pseudomonas aeruginosa; identical to SEQ ID NO: 759
  CDS (1)..(1887)

SEQ ID NO: 59125 - protein, 628 aa, Pseudomonas aeruginosa [sequence omitted]

SEQ ID NO: 59126 - DNA, 1971 bp, Halobacterium sp. NRC-1; identical to SEQ ID NO: 761
  CDS (1)..(1971)

SEQ ID NO: 59127 - protein, 656 aa, Halobacterium sp. NRC-1; identical to SEQ ID NO: 762

SEQ ID NO: 59128 - DNA, 1719 bp, Bacillus subtilis; identical to SEQ ID NO: 763
  CDS (1)..(1719)

SEQ ID NO: 59129 - protein, 572 aa, Bacillus subtilis; identical to SEQ ID NO: 764

SEQ ID NO: 59130 - DNA, 2019 bp, Phycomyces blakesleeanus; identical to SEQ ID NO: 765
  CDS (1)..(2019)

SEQ ID NO: 59131 - protein, 672 aa, Phycomyces blakesleeanus [sequence omitted]

SEQ ID NO: 59132 - DNA, 2674 bp, Drosophila melanogaster; identical to SEQ ID NO: 767
  CDS (419)..(2164)

SEQ ID NO: 59133 - protein, 581 aa, Drosophila melanogaster; identical to SEQ ID NO: 768

SEQ ID NO: 59134 - DNA, 1962 bp, Synechocystis sp; identical to SEQ ID NO: 769
  CDS (1)..(1962)

SEQ ID NO: 59135 - protein, 653 aa, Synechocystis sp [sequence omitted]

SEQ ID NO: 59136 - DNA, 2013 bp, Emericella nidulans, Aspergillus nidulans; identical to SEQ ID NO: 771
  CDS (1)..(2013)

SEQ ID NO: 59137 - protein, 670 aa, Emericella nidulans, Aspergillus nidulans [sequence omitted]

SEQ ID NO: 59138 - DNA, 1881 bp, Neurospora crassa; identical to SEQ ID NO: 773
  CDS (1)..(1881)

SEQ ID NO: 59139 - protein, 626 aa, Neurospora crassa [sequence omitted]

SEQ ID NO: 59140 - DNA, 1971 bp, Rhodobacter capsulatus; identical to SEQ ID NO: 775
  CDS (1)..(1971)

SEQ ID NO: 59141 - protein, 656 aa, Rhodobacter capsulatus [sequence omitted]

SEQ ID NO: 59142 - DNA, 2043 bp, Caenorhabditis elegans; identical to SEQ ID NO: 777
  CDS (1)..(2043)

SEQ ID NO: 59143 - protein, 680 aa, Caenorhabditis elegans; identical to SEQ ID NO: 778

SEQ ID NO: 59144 - DNA, 1956 bp, Streptomyces coelicolor; identical to SEQ ID NO: 779
  CDS (1)..(1956)

SEQ ID NO: 59145 - protein, 651 aa, Streptomyces coelicolor; identical to SEQ ID NO: 780

SEQ ID NO: 59146 - DNA, 1989 bp, Schizosaccharomyces pombe; identical to SEQ ID NO: 781
  CDS (1)..(1989)

SEQ ID NO: 59147 - protein, 662 aa, Schizosaccharomyces pombe [sequence omitted]

SEQ ID NO: 59148 - DNA, 2013 bp, Pyrobaculum aerophilum; identical to SEQ ID NO: 783
  CDS (1)..(2013)

SEQ ID NO: 59149 - protein, 670 aa, Pyrobaculum aerophilum [sequence omitted]

SEQ ID NO: 59150 - DNA, 2010 bp, Penicillium chrysogenum; identical to SEQ ID NO: 785
  CDS (1)..(2010)

SEQ ID NO: 59151 - protein, 669 aa, Penicillium chrysogenum; identical to SEQ ID NO: 786

SEQ ID NO: 59152 - DNA, 2323 bp, Homo sapiens; identical to SEQ ID NO: 787
  CDS (92)..(2152)

SEQ ID NO: 59153 - protein, 686 aa, Homo sapiens; identical to SEQ ID NO: 788

SEQ ID NO: 59154 - DNA, 1950 bp, Pseudomonas putida; identical to SEQ ID NO: 789
  CDS (1)..(1950)

SEQ ID NO: 59155 - protein, 649 aa, Pseudomonas putida; identical to SEQ ID NO: 790

SEQ ID NO: 59156 - DNA, 2444 bp, Lysobacter; identical to SEQ ID NO: 791
  CDS (337)..(2232)

SEQ ID NO: 59157 - protein, 631 aa, Lysobacter; identical to SEQ ID NO: 792

SEQ ID NO: 59158 - DNA, 2016 bp, Debaryomyces hansenii; identical to SEQ ID NO: 793
  CDS (1)..(2016)

SEQ ID NO: 59159 - protein, 671 aa, Debaryomyces hansenii; identical to SEQ ID NO: 794

SEQ ID NO: 59160 - DNA, 2040 bp, Debaryomyces hansenii; identical to SEQ ID NO: 795
  CDS (1)..(2040)

SEQ ID NO: 59161 - protein, 679 aa, Debaryomyces hansenii; identical to SEQ ID NO: 796

SEQ ID NO: 59162 - DNA, 1974 bp, Yarrowia lipolytica; identical to SEQ ID NO: 797
  CDS (1)..(1974)

SEQ ID NO: 59163 - protein, 657 aa, Yarrowia lipolytica; identical to SEQ ID NO: 798

SEQ ID NO: 59164 - DNA, 2124 bp, Kluyveromyces lactis; identical to SEQ ID NO: 799
  CDS (1)..(2124)

SEQ ID NO: 59165 - protein, 707 aa, Kluyveromyces lactis; identical to SEQ ID NO: 800

SEQ ID NO: 59166 - DNA, 1962 bp, Pseudomonas putida; identical to SEQ ID NO: 801
  CDS (1)..(1962)

SEQ ID NO: 59167 - protein, 653 aa, Pseudomonas putida; identical to SEQ ID NO: 802

SEQ ID NO: 59168 - DNA, 1644 bp, Acinetobacter sp; identical to SEQ ID NO: 803
  CDS (1)..(1644)

SEQ ID NO: 59169 - protein, 547 aa, Acinetobacter sp; identical to SEQ ID NO: 804

SEQ ID NO: 59170 - DNA, 1644 bp, Acinetobacter sp; identical to SEQ ID NO: 805
  CDS (1)..(1644)

SEQ ID NO: 59171 - protein, 547 aa, Acinetobacter sp; identical to SEQ ID NO: 806

SEQ ID NO: 59172 - DNA, 2115 bp, Candida glabrata; identical to SEQ ID NO: 807
  CDS (1)..(2115)

SEQ ID NO: 59173 - protein, 704 aa, Candida glabrata; identical to SEQ ID NO: 808

SEQ ID NO: 59174 - DNA, 2052 bp, Candida glabrata; identical to SEQ ID NO: 809
  CDS (1)..(2052)

SEQ ID NO: 59175 - protein, 683 aa, Candida glabrata; identical to SEQ ID NO: 810

SEQ ID NO: 59176 - DNA, 1959 bp, Bartonella quintana; identical to SEQ ID NO: 811
  CDS (1)..(1959)

SEQ ID NO: 59177 - protein, 652 aa, Bartonella quintana; identical to SEQ ID NO: 812

SEQ ID NO: 59178 - DNA, 1959 bp, Bartonella henselae; identical to SEQ ID NO: 813
  CDS (1)..(1959)

SEQ ID NO: 59179 - protein, 652 aa, Bartonella henselae; identical to SEQ ID NO: 814

SEQ ID NO: 59180 - DNA, 2763 bp, Oryza sativa; identical to SEQ ID NO: 815
  CDS (355)..(2472)

SEQ ID NO: 59181 - protein, 705 aa, Oryza sativa; identical to SEQ ID NO: 816

SEQ ID NO: 59182 - DNA, 1941 bp, Bacillus thuringiensis serovar konkukian str; identical to SEQ ID NO: 817
  CDS (1)..(1941)

SEQ ID NO: 59183 - protein, 646 aa, Bacillus thuringiensis serovar konkukian str; identical to SEQ ID NO: 818

SEQ ID NO: 59184 - DNA, 1953 bp, Picrophilus torridus; identical to SEQ ID NO: 819
  CDS (1)..(1953)

SEQ ID NO: 59185 - protein, 650 aa, Picrophilus torridus; identical to SEQ ID NO: 820

SEQ ID NO: 59186 - DNA, 2994 bp, Plasmodium falciparum; identical to SEQ ID NO: 821
  CDS (1)..(2994)

SEQ ID NO: 59187 - protein, 997 aa, Plasmodium falciparum; identical to SEQ ID NO: 822

SEQ ID NO: 59188 - DNA, 2007 bp, Photobacterium profundum; identical to SEQ ID NO: 823
  CDS (1)..(2007)

SEQ ID NO: 59189 - protein, 668 aa, Photobacterium profundum; identical to SEQ ID NO: 824

SEQ ID NO: 59190 - DNA, 1899 bp, Photobacterium profundum; identical to SEQ ID NO: 825
  CDS (1)..(1899)

SEQ ID NO: 59191 - protein, 632 aa, Photobacterium profundum; identical to SEQ ID NO: 826

SEQ ID NO: 59192 - DNA, 1950 bp, Photobacterium profundum; identical to SEQ ID NO: 827
  CDS (1)..(1950)

SEQ ID NO: 59193 - protein, 649 aa, Photobacterium profundum; identical to SEQ ID NO: 828

SEQ ID NO: 59194 - DNA, 1674 bp, Methanococcus maripaludis; identical to SEQ ID NO: 829
  CDS (1)..(1674)

SEQ ID NO: 59195 - protein, 557 aa, Methanococcus maripaludis; identical to SEQ ID NO: 830

SEQ ID NO: 59196 - DNA, 1911 bp, Methanococcus maripaludis; identical to SEQ ID NO: 831
  CDS (1)..(1911)

SEQ ID NO: 59197 - protein, 636 aa, Methanococcus maripaludis; identical to SEQ ID NO: 832

SEQ ID NO: 59198 - DNA, 1938 bp, Bdellovibrio bacteriovorus; identical to SEQ ID NO: 833
  CDS (1)..(1938)

SEQ ID NO: 59199 - protein, 645 aa, Bdellovibrio bacteriovorus; identical to SEQ ID NO: 834

SEQ ID NO: 59200 - DNA, 1911 bp, Rhodopseudomonas palustris; identical to SEQ ID NO: 835
  CDS (1)..(1911)

SEQ ID NO: 59201 - protein, 636 aa, Rhodopseudomonas palustris; identical to SEQ ID NO: 836

SEQ ID NO: 59202 - DNA, 1692 bp, Rhodopseudomonas palustris; identical to SEQ ID NO: 837
  CDS (1)..(1692)

SEQ ID NO: 59203 - protein, 563 aa, Rhodopseudomonas palustris; identical to SEQ ID NO: 838

SEQ ID NO: 59204 - DNA, 1953 bp, Rhodopseudomonas palustris; identical to SEQ ID NO: 839
  CDS (1)..(1953)

SEQ ID NO: 59205 - protein, 650 aa, Rhodopseudomonas palustris; identical to SEQ ID NO: 840

SEQ ID NO: 59206 - DNA, 1959 bp, uncultured bacterium 314; identical to SEQ ID NO: 841
  CDS (1)..(1959)

SEQ ID NO: 59207 - protein, 652 aa, uncultured bacterium 314; identical to SEQ ID NO: 842

SEQ ID NO: 59208 - DNA, 1938 bp, uncultured bacterium 311; identical to SEQ ID NO: 843
  CDS (1)..(1938)

SEQ ID NO: 59209 - protein, 645 aa, uncultured bacterium 311; identical to SEQ ID NO: 844

SEQ ID NO: 59210 - DNA, 1743 bp, Rattus norvegicus; identical to SEQ ID NO: 845
  CDS (1)..(1743)

SEQ ID NO: 59211 - protein, 580 aa, Rattus norvegicus; identical to SEQ ID NO: 846

SEQ ID NO: 59212 - DNA, 1740 bp, Klebsiella pneumoniae; identical to SEQ ID NO: 847
  CDS (1)..(1740)

SEQ ID NO: 59213 - protein, 579 aa, Klebsiella pneumoniae; identical to SEQ ID NO: 848

SEQ ID NO: 59214 - DNA, 1821 bp, Homo sapiens; identical to SEQ ID NO: 849
  CDS (1)..(1821)

SEQ ID NO: 59215 - protein, 606 aa, Homo sapiens; identical to SEQ ID NO: 850

SEQ ID NO: 59216 - DNA, 1716 bp, Thermoproteus tenax; identical to SEQ ID NO: 851
  CDS (1)..(1716)

SEQ ID NO: 59217 - protein, 571 aa, Thermoproteus tenax; identical to SEQ ID NO: 852

SEQ ID NO: 59218 - DNA, 2118 bp, Agrobacterium vitis; identical to SEQ ID NO: 853
  CDS (1)..(2118)

SEQ ID NO: 59219 - protein, 705 aa, Agrobacterium vitis; identical to SEQ ID NO: 854

SEQ ID NO: 59220 - DNA, 1578 bp, Listeria monocytogenes; identical to SEQ ID NO: 855
  CDS (1)..(1578)

SEQ ID NO: 59221 - protein, 525 aa, Listeria monocytogenes; identical to SEQ ID NO: 856

SEQ ID NO: 59222 - DNA, 1986 bp, Desulfovibrio vulgaris; identical to SEQ ID NO: 857
  CDS (1)..(1986)

SEQ ID NO: 59223 - protein, 661 aa, Desulfovibrio vulgaris; identical to SEQ ID NO: 858

SEQ ID NO: 59224 - DNA, 1656 bp, Desulfovibrio vulgaris; identical to SEQ ID NO: 859
  CDS (1)..(1656)

SEQ ID NO: 59225 - protein, 551 aa, Desulfovibrio vulgaris; identical to SEQ ID NO: 860

SEQ ID NO: 59226 - DNA, 1947 bp, Desulfovibrio vulgaris; identical to SEQ ID NO: 861
  CDS (1)..(1947)

SEQ ID NO: 59227 - protein, 648 aa, Desulfovibrio vulgaris; identical to SEQ ID NO: 862

SEQ ID NO: 59228 - DNA, 1890 bp, Thermus thermophilus; identical to SEQ ID NO: 863
  CDS (1)..(1890)

SEQ ID NO: 59229 - protein, 629 aa, Thermus thermophilus; identical to SEQ ID NO: 864

SEQ ID NO: 59230 - DNA, 1884 bp, Thermus thermophilus; identical to SEQ ID NO: 865
  CDS (1)..(1884)

SEQ ID NO: 59231 - protein, 627 aa, Thermus thermophilus; identical to SEQ ID NO: 866

SEQ ID NO: 59232 - DNA, 2538 bp, Thermus thermophilus; identical to SEQ ID NO: 867
  CDS (1)..(2538)

SEQ ID NO: 59233 - protein, 845 aa, Thermus thermophilus; identical to SEQ ID NO: 868

SEQ ID NO: 59234 - DNA, 1947 bp, Thermus thermophilus; identical to SEQ ID NO: 869
  CDS (1)..(1947)

SEQ ID NO: 59235 - protein, 648 aa, Thermus thermophilus; identical to SEQ ID NO: 870

SEQ ID NO: 59236 - DNA, 1719 bp, Bacillus cereus; identical to SEQ ID NO: 871
  CDS (1)..(1719)

SEQ ID NO: 59237 - protein, 572 aa, Bacillus cereus; identical to SEQ ID NO: 872

SEQ ID NO: 59238 - DNA, 1653 bp, Treponema denticola; identical to SEQ ID NO: 873
  CDS (1)..(1653)

SEQ ID NO: 59239 - protein, 550 aa, Treponema denticola; identical to SEQ ID NO: 874

SEQ ID NO: 59240 - DNA, 1953 bp, Mycobacterium paratuberculosis; identical to SEQ ID NO: 875
  CDS (1)..(1953)

SEQ ID NO: 59241 - protein, 650 aa, Mycobacterium paratuberculosis; identical to SEQ ID NO: 876

SEQ ID NO: 59242 - DNA, 2064 bp, Ashbya gossypii; identical to SEQ ID NO: 877
  CDS (1)..(2064)

SEQ ID NO: 59243 - protein, 687 aa, Ashbya gossypii; identical to SEQ ID NO: 878

SEQ ID NO: 59244 - DNA, 2085 bp, Ashbya gossypii; identical to SEQ ID NO: 879
  CDS (1)..(2085)

SEQ ID NO: 59245 - protein, 694 aa, Ashbya gossypii; identical to SEQ ID NO: 880

SEQ ID NO: 59246 - DNA, 1977 bp, Dictyostelium discoideum; identical to SEQ ID NO: 881
  CDS (1)..(1977)

SEQ ID NO: 59247 - protein, 658 aa, Dictyostelium discoideum; identical to SEQ ID NO: 882

SEQ ID NO: 59248 - DNA, 2046 bp, Dictyostelium discoideum; identical to SEQ ID NO: 883
  CDS (1)..(2046)

SEQ ID NO: 59249 - protein, 681 aa, Dictyostelium discoideum; identical to SEQ ID NO: 884

SEQ ID NO: 59250 - DNA, 2316 bp, Oryza sativa; identical to SEQ ID NO: 885
  CDS (1)..(2316)

SEQ ID NO: 59251 - protein, 771 aa, Oryza sativa; identical to SEQ ID NO: 886

SEQ ID NO: 59252 - DNA, 1965 bp, Wolinella succinogenes; identical to SEQ ID NO: 887
  CDS (1)..(1965)

SEQ ID NO: 59253 - protein, 654 aa, Wolinella succinogenes; identical to SEQ ID NO: 888

SEQ ID NO: 59254 - DNA, 1956 bp, Photorhabdus luminescens; identical to SEQ ID NO: 889
  CDS (1)..(1956)

SEQ ID NO: 59255 - protein, 651 aa, Photorhabdus luminescens; identical to SEQ ID NO: 890

SEQ ID NO: 59256 - DNA, 2043 bp, Vibrio vulnificus; identical to SEQ ID NO: 891
  CDS (1)..(2043)

SEQ ID NO: 59257 - protein, 680 aa, Vibrio vulnificus; identical to SEQ ID NO: 892

SEQ ID NO: 59258 - DNA, 2013 bp, Vibrio vulnificus; identical to SEQ ID NO: 893
  CDS (1)..(2013)

SEQ ID NO: 59259 - protein, 670 aa, Vibrio vulnificus; identical to SEQ ID NO: 894

SEQ ID NO: 59260 - DNA, 1887 bp, Photorhabdus luminescens; identical to SEQ ID NO: 895
  CDS (1)..(1887)

SEQ ID NO: 59261 - protein, 628 aa, Photorhabdus luminescens; identical to SEQ ID NO: 896

SEQ ID NO: 59262 - DNA, 1944 bp, Gloeobacter violaceus; identical to SEQ ID NO: 897
  CDS (1)..(1944)

SEQ ID NO: 59263 - protein, 647 aa, Gloeobacter violaceus; identical to SEQ ID NO: 898

SEQ ID NO: 59264 - DNA, 1965 bp, Chromobacterium violaceum; identical to SEQ ID NO: 899
  CDS (1)..(1965)

SEQ ID NO: 59265 - protein, 654 aa, Chromobacterium violaceum; identical to SEQ ID NO: 900

SEQ ID NO: 59266 - DNA, 1962 bp, Chromobacterium violaceum; identical to SEQ ID NO: 901
  CDS (1)..(1962)

SEQ ID NO: 59267 - protein, 653 aa, Chromobacterium violaceum; identical to SEQ ID NO: 902

SEQ ID NO: 59268 - DNA, 1713 bp, Anopheles gambiae str; identical to SEQ ID NO: 903
  CDS (1)..(1713)

SEQ ID NO: 59269 - protein, 570 aa, Anopheles gambiae str; identical to SEQ ID NO: 904

SEQ ID NO: 59270 - DNA, 2856 bp, Plasmodium yoelii yoelii; identical to SEQ ID NO: 905
  CDS (1)..(2856)

SEQ ID NO: 59271 - protein, 951 aa, Plasmodium yoelii yoelii; identical to SEQ ID NO: 906

SEQ ID NO: 59272 - DNA, 2130 bp, Neurospora crassa; identical to SEQ ID NO: 907
  CDS (1)..(2130)

SEQ ID NO: 59273 - protein, 709 aa, Neurospora crassa; identical to SEQ ID NO: 908

SEQ ID NO: 59274 - DNA, 2070 bp, Synechococcus sp; identical to SEQ ID NO: 909
  CDS (1)..(2070)

SEQ ID NO: 59275 - protein, 689 aa, Synechococcus sp; identical to SEQ ID NO: 910

SEQ ID NO: 59276 - DNA, 1983 bp, Prochlorococcus marinus subsp; identical to SEQ ID NO: 911
  CDS (1)..(1983)

SEQ ID NO: 59277 - protein, 660 aa, Prochlorococcus marinus subsp; identical to SEQ ID NO: 912

SEQ ID NO: 59278 - DNA, 1977 bp, Prochlorococcus marinus; identical to SEQ ID NO: 913
  CDS (1)..(1977)

SEQ ID NO: 59279 - protein, 658 aa, Prochlorococcus marinus; identical to SEQ ID NO: 914

SEQ ID NO: 59280 - DNA, 1977 bp, Prochlorococcus marinus; identical to SEQ ID NO: 915
  CDS (1)..(1977)

SEQ ID NO: 59281 - protein, 658 aa, Prochlorococcus marinus; identical to SEQ ID NO: 916

SEQ ID NO: 59282 - DNA, 1902 bp, Helicobacter hepaticus; identical to SEQ ID NO: 917
  CDS (1)..(1902)

SEQ ID NO: 59283 - protein, 633 aa, Helicobacter hepaticus; identical to SEQ ID NO: 918

SEQ ID NO: 59284 - DNA, 1890 bp, Bordetella parapertussis; identical to SEQ ID NO: 919
  CDS (1)..(1890)

SEQ ID NO: 59285 - protein, 629 aa, Bordetella parapertussis; identical to SEQ ID NO: 920

SEQ ID NO: 59286 - DNA, 2046 bp, Bordetella parapertussis; identical to SEQ ID NO: 921
  CDS (1)..(2046)

SEQ ID NO: 59287 - protein, 681 aa, Bordetella parapertussis; identical to SEQ ID NO: 922

SEQ ID NO: 59288 - DNA, 1950 bp, Bordetella bronchiseptica; identical to SEQ ID NO: 923
  CDS (1)..(1950)

SEQ ID NO: 59289 - protein, 649 aa, Bordetella bronchiseptica; identical to SEQ ID NO: 924

SEQ ID NO: 59290 - DNA, 3626 bp, Homo sapiens; identical to SEQ ID NO: 925
  CDS (6)..(2069)

SEQ ID NO: 59291 - protein, 687 aa, Homo sapiens [sequence omitted]

SEQ ID NO: 59292 - DNA, 1941 bp, Bacillus cereus; identical to SEQ ID NO: 927
  CDS (1)..(1941)

SEQ ID NO: 59293 - protein, 646 aa, Bacillus cereus; identical to SEQ ID NO: 928

SEQ ID NO: 59294 - DNA, 1968 bp, Streptomyces avermitilis; identical to SEQ ID NO: 929
  CDS (1)..(1968)

SEQ ID NO: 59295 - protein, 655 aa, Streptomyces avermitilis; identical to SEQ ID NO: 930

SEQ ID NO: 59296 - DNA, 2019 bp, Streptomyces avermitilis; identical to SEQ ID NO: 931
  CDS (1)..(2019)

SEQ ID NO: 59297 - protein, 672 aa, Streptomyces avermitilis; identical to SEQ ID NO: 932

SEQ ID NO: 59298 - DNA, 1953 bp, Coxiella burnetii; identical to SEQ ID NO: 933
  CDS (1)..(1953)

SEQ ID NO: 59299 - protein, 650 aa, Coxiella burnetii; identical to SEQ ID NO: 934

SEQ ID NO: 59300 - DNA, 1968 bp, Dictyostelium discoideum; identical to SEQ ID NO: 935
  CDS (1)..(1968)

SEQ ID NO: 59301 - protein, 655 aa, Dictyostelium discoideum; identical to SEQ ID NO: 936

SEQ ID NO: 59302 - DNA, 1956 bp, Dictyostelium discoideum; identical to SEQ ID NO: 937
  CDS (1)..(1956)

SEQ ID NO: 59303 - protein, 651 aa, Dictyostelium discoideum; identical to SEQ ID NO: 938

SEQ ID NO: 59304 - DNA, 1968 bp, Dictyostelium discoideum; identical to SEQ ID NO: 939
  CDS (1)..(1968)

SEQ ID NO: 59305 - protein, 655 aa, Dictyostelium discoideum; identical to SEQ ID NO: 940

SEQ ID NO: 59306 - DNA, 1944 bp, Dictyostelium discoideum; identical to SEQ ID NO: 941
  CDS (1)..(1944)

SEQ ID NO: 59307 - protein, 647 aa, Dictyostelium discoideum; identical to SEQ ID NO: 942

SEQ ID NO: 59308 - DNA, 1941 bp, Dictyostelium discoideum; identical to SEQ ID NO: 943
  CDS (1)..(1941)

SEQ ID NO: 59309 - protein, 646 aa, Dictyostelium discoideum; identical to SEQ ID NO: 944

SEQ ID NO: 59310 - DNA, 2085 bp, Neurospora crassa; identical to SEQ ID NO: 945
  CDS (1)..(2085)

SEQ ID NO: 59311 - protein, 694 aa, Neurospora crassa; identical to SEQ ID NO: 946

SEQ ID NO: 59312 - DNA, 2034 bp, Vibrio parahaemolyticus; identical to SEQ ID NO: 947
  CDS (1)..(2034)

SEQ ID NO: 59313 - protein, 677 aa, Vibrio parahaemolyticus; identical to SEQ ID NO: 948

SEQ ID NO: 59314 - DNA, 1971 bp, Vibrio parahaemolyticus; identical to SEQ ID NO: 949
  CDS (1)..(1971)

SEQ ID NO: 59315 - protein, 656 aa, Vibrio parahaemolyticus; identical to SEQ ID NO: 950

SEQ ID NO: 59316 - DNA, 1905 bp, Vibrio parahaemolyticus; identical to SEQ ID NO: 951
  CDS (1)..(1905)

SEQ ID NO: 59317 - protein, 634 aa, Vibrio parahaemolyticus; identical to SEQ ID NO: 952

SEQ ID NO: 59318 - DNA, 1953 bp, Pseudomonas putida; identical to SEQ ID NO: 953
  CDS (1)..(1953)

SEQ ID NO: 59319 - protein, 650 aa, Pseudomonas putida; identical to SEQ ID NO: 954

SEQ ID NO: 59320 - DNA, 1890 bp, Pseudomonas putida; identical to SEQ ID NO: 955
  CDS (1)..(1890)

SEQ ID NO: 59321 - protein, 629 aa, Pseudomonas putida; identical to SEQ ID NO: 956

SEQ ID NO: 59322 - DNA, 1686 bp, Pseudomonas putida; identical to SEQ ID NO: 957
  CDS (1)..(1686)

SEQ ID NO: 59323 - protein, 561 aa, Pseudomonas putida; identical to SEQ ID NO: 958

SEQ ID NO: 59324 - DNA, 1689 bp, Bradyrhizobium japonicum; identical to SEQ ID NO: 959
  CDS (1)..(1689)

SEQ ID NO: 59325 - protein, 562 aa, Bradyrhizobium japonicum; identical to SEQ ID NO: 960

SEQ ID NO: 59326 - DNA, 2049 bp, Bradyrhizobium japonicum; identical to SEQ ID NO: 961
  CDS (1)..(2049)

SEQ ID NO: 59327 - protein, 682 aa, Bradyrhizobium japonicum; identical to SEQ ID NO: 962

SEQ ID NO: 59328 - DNA, 1911 bp, Bradyrhizobium japonicum; identical to SEQ ID NO: 963
  CDS (1)..(1911)

SEQ ID NO: 59329 - protein, 636 aa, Bradyrhizobium japonicum; identical to SEQ ID NO: 964

SEQ ID NO: 59330 - DNA, 1656 bp, Bacteroides thetaiotaomicron; identical to SEQ ID NO: 965
  CDS (1)..(1656)

SEQ ID NO: 59331 - protein, 551 aa, Bacteroides thetaiotaomicron; identical to SEQ ID NO: 966

SEQ ID NO: 59332 - DNA, 2495 bp, Mus musculus; identical to SEQ ID NO: 967
  CDS (87)..(1580)

SEQ ID NO: 59333 - protein, 497 aa, Mus musculus; identical to SEQ ID NO: 968

SEQ ID NO: 59334 - DNA, 1881 bp, Vibrio vulnificus; identical to SEQ ID NO: 969
  CDS (1)..(1881)

SEQ ID NO: 59335 - protein, 626 aa, Vibrio vulnificus; identical to SEQ ID NO: 970

SEQ ID NO: 59336 - DNA, 1986 bp, Oceanobacillus iheyensis; identical to SEQ ID NO: 971
  CDS (1)..(1986)

SEQ ID NO: 59337 - protein, 661 aa, Oceanobacillus iheyensis; identical to SEQ ID NO: 972

SEQ ID NO: 59338 - DNA, 1716 bp, Oceanobacillus iheyensis; identical to SEQ ID NO: 973
  CDS (1)..(1716)

SEQ ID NO: 59339 - protein, 571 aa, Oceanobacillus iheyensis; identical to SEQ ID NO: 974

SEQ ID NO: 59340 - DNA, 1887 bp, Escherichia coli O6; identical to SEQ ID NO: 975
  CDS (1)..(1887)

SEQ ID NO: 59341 - protein, 628 aa, Escherichia coli O6; identical to SEQ ID NO: 976

SEQ ID NO: 59342 - DNA, 1671 bp, Brucella suis; identical to SEQ ID NO: 977
  CDS (1)..(1671)

SEQ ID NO: 59343 - protein, 556 aa, Brucella suis; identical to SEQ ID NO: 978

SEQ ID NO: 59344 - DNA, 1989 bp, Brucella suis; identical to SEQ ID NO: 979
  CDS (1)..(1989)

SEQ ID NO: 59345 - protein, 662 aa, Brucella suis; identical to SEQ ID NO: 980

SEQ ID NO: 59346 - DNA, 2924 bp, Homo sapiens; identical to SEQ ID NO: 981
  CDS (34)..(2178)

SEQ ID NO: 59347 - protein, 714 aa, Homo sapiens [sequence omitted]

SEQ ID NO: 59348 - DNA, 1899 bp, Encephalitozoon cuniculi; identical to SEQ ID NO: 983
  CDS (1)..(1899)

SEQ ID NO: 59349 - protein, 632 aa, Encephalitozoon cuniculi; identical to SEQ ID NO: 984

SEQ ID NO: 59350 - DNA, 2004 bp, Neurospora crassa; identical to SEQ ID NO: 985
  CDS (1)..(2004)

SEQ ID NO: 59351 - protein, 667 aa, Neurospora crassa; identical to SEQ ID NO: 986

SEQ ID NO: 59352 - DNA, 1899 bp, Ralstonia solanacearum; identical to SEQ ID NO: 987
  CDS (1)..(1899)

SEQ ID NO: 59353 - protein, 632 aa, Ralstonia solanacearum; identical to SEQ ID NO: 988

SEQ ID NO: 59354 - DNA, 1956 bp, Pyrobaculum aerophilum; identical to SEQ ID NO: 989
  CDS (1)..(1956)

SEQ ID NO: 59355 - protein, 651 aa, Pyrobaculum aerophilum; identical to SEQ ID NO: 990

SEQ ID NO: 59356 - DNA, 1881 bp, Pyrobaculum aerophilum; identical to SEQ ID NO: 991
  CDS (1)..(1881)

SEQ ID NO: 59357 - protein, 626 aa, Pyrobaculum aerophilum; identical to SEQ ID NO: 992

SEQ ID NO: 59358 - DNA, 1848 bp, Pyrobaculum aerophilum; identical to SEQ ID NO: 993
  CDS (1)..(1848)

SEQ ID NO: 59359 - protein, 615 aa, Pyrobaculum aerophilum; identical to SEQ ID NO: 994

SEQ ID NO: 59360 - DNA, 1908 bp, Rhizobium meliloti; identical to SEQ ID NO: 995
  CDS (1)..(1908)

SEQ ID NO: 59361 - protein, 635 aa, Rhizobium meliloti; identical to SEQ ID NO: 996

SEQ ID NO: 59362 - DNA, 1647 bp, Rhizobium meliloti; identical to SEQ ID NO: 997
  CDS (1)..(1647)

SEQ ID NO: 59363 - protein, 548 aa, Rhizobium meliloti; identical to SEQ ID NO: 998

SEQ ID NO: 59364 - DNA, 2028 bp, Zygosaccharomyces bailii; identical to SEQ ID NO: 999
  CDS (1)..(2028)

SEQ ID NO: 59365 - protein, 675 aa, Zygosaccharomyces bailii; identical to SEQ ID NO: 1000

SEQ ID NO: 59366 - DNA, 1635 bp, Sulfolobus tokodaii; identical to SEQ ID NO: 1001
  CDS (1)..(1635)

SEQ ID NO: 59367 - protein, 544 aa, Sulfolobus tokodaii; identical to SEQ ID NO: 1002

SEQ ID NO: 59368 - DNA, 1731 bp, Sulfolobus tokodaii; identical to SEQ ID NO: 1003
  CDS (1)..(1731)

SEQ ID NO: 59369 - protein, 576 aa, Sulfolobus tokodaii; identical to SEQ ID NO: 1004

SEQ ID NO: 59370 - DNA, 1986 bp, Sulfolobus tokodaii; identical to SEQ ID NO: 1005
  CDS (1)..(1986)

SEQ ID NO: 59371 - protein, 661 aa, Sulfolobus tokodaii; identical to SEQ ID NO: 1006

SEQ ID NO: 59372 - DNA, 1866 bp, Sulfolobus tokodaii; identical to SEQ ID NO: 1007
  CDS (1)..(1866)

SEQ ID NO: 59373 - protein, 621 aa, Sulfolobus tokodaii; identical to SEQ ID NO: 1008

SEQ ID NO: 59374 - DNA, 1494 bp, Sulfolobus tokodaii; identical to SEQ ID NO: 1009
  CDS (1)..(1494)

SEQ ID NO: 59375 - protein, 497 aa, Sulfolobus tokodaii; identical to SEQ ID NO: 1010

SEQ ID NO: 59376 - DNA, 1980 bp, Sulfolobus tokodaii; identical to SEQ ID NO: 1011
  CDS (1)..(1980)

SEQ ID NO: 59377 - protein, 659 aa, Sulfolobus tokodaii; identical to SEQ ID NO: 1012

SEQ ID NO: 59378 - DNA, 1989 bp, Sulfolobus tokodaii; identical to SEQ ID NO: 1013
  CDS (1)..(1989)

SEQ ID NO: 59379 - protein, 662 aa, Sulfolobus tokodaii; identical to SEQ ID NO: 1014

SEQ ID NO: 59380 - DNA, 1689 bp, Sulfolobus tokodaii; identical to SEQ ID NO: 1015
  CDS (1)..(1689)

SEQ ID NO: 59381 - protein, 562 aa, Sulfolobus tokodaii; identical to SEQ ID NO: 1016

SEQ ID NO: 59382 - DNA, 1860 bp, Thermoplasma volcanium; identical to SEQ ID NO: 1017
  CDS (1)..(1860)

SEQ ID NO: 59383 - protein, 619 aa, Thermoplasma volcanium; identical to SEQ ID NO: 1018

SEQ ID NO: 59384 - DNA, 1926 bp, Thermoplasma volcanium; identical to SEQ ID NO: 1019
  CDS (1)..(1926)

SEQ ID NO: 59385 - protein, 641 aa, Thermoplasma volcanium; identical to SEQ ID NO: 1020

SEQ ID NO: 59386 - DNA, 1953 bp, Thermoplasma volcanium; identical to SEQ ID NO: 1021
  CDS (1)..(1953)

SEQ ID NO: 59387 - protein, 650 aa, Thermoplasma volcanium; identical to SEQ ID NO: 1022

SEQ ID NO: 59388 - DNA, 1959 bp, Rhizobium loti; identical to SEQ ID NO: 1023
  CDS (1)..(1959)

SEQ ID NO: 59389 - protein, 652 aa, Rhizobium loti; identical to SEQ ID NO: 1024

SEQ ID NO: 59390 - DNA, 1689 bp, Rhizobium loti; identical to SEQ ID NO: 1025
  CDS (1)..(1689)

SEQ ID NO: 59391 - protein, 562 aa, Rhizobium loti; identical to SEQ ID NO: 1026

SEQ ID NO: 59392 - DNA, 1929 bp, Rhizobium loti; identical to SEQ ID NO: 1027
  CDS (1)..(1929)

SEQ ID NO: 59393 - protein, 642 aa, Rhizobium loti; identical to SEQ ID NO: 1028

SEQ ID NO: 59394 - DNA, 1680 bp, Rhizobium loti; identical to SEQ ID NO: 1029
  CDS (1)..(1680)

SEQ ID NO: 59395 - protein, 559 aa, Rhizobium loti; identical to SEQ ID NO: 1030

SEQ ID NO: 59396 - DNA, 1686 bp, Pseudomonas putida; identical to SEQ ID NO: 1031
  CDS (1)..(1686)

SEQ ID NO: 59397 - protein, 561 aa, Pseudomonas putida; identical to SEQ ID NO: 1032

SEQ ID NO: 59398 - DNA, 2582 bp, Bos taurus; identical to SEQ ID NO: 1033
  CDS (1)..(2028)

SEQ ID NO: 59399 - protein, 675 aa, Bos taurus; identical to SEQ ID NO: 1034

SEQ ID NO: 59400 - DNA, 1800 bp, Thermoplasma acidophilum; identical to SEQ ID NO: 1035
  CDS (1)..(1800)

SEQ ID NO: 59401 - protein, 599 aa, Thermoplasma acidophilum; identical to SEQ ID NO: 1036

SEQ ID NO: 59402 - DNA, 1944 bp, Thermoplasma acidophilum; identical to SEQ ID NO: 1037
  CDS (1)..(1944)

SEQ ID NO: 59403 - protein, 647 aa, Thermoplasma acidophilum; identical to SEQ ID NO: 1038

SEQ ID NO: 59404 - DNA, 1860 bp, Thermoplasma acidophilum; identical to SEQ ID NO: 1039
  CDS (1)..(1860)

SEQ ID NO: 59405 - protein, 619 aa, Thermoplasma acidophilum; identical to SEQ ID NO: 1040

SEQ ID NO: 59406 - DNA, 1977 bp, Streptomyces coelicolor; identical to SEQ ID NO: 1041
  CDS (1)..(1977)

SEQ ID NO: 59407 - protein, 658 aa, Streptomyces coelicolor; identical to SEQ ID NO: 1042

SEQ ID NO: 59408 - DNA, 2113 bp, Arabidopsis thaliana; identical to SEQ ID NO: 1043
  CDS (1)..(2082)

SEQ ID NO: 59409 - protein, 693 aa, Arabidopsis thaliana; identical to SEQ ID NO: 1044

SEQ ID NO: 59410 - DNA, 2088 bp, Leishmania major; identical to SEQ ID NO: 1045
  CDS (1)..(2088)

SEQ ID NO: 59411 - protein, 695 aa, Leishmania major; identical to SEQ ID NO: 1046

SEQ ID NO: 59412 - DNA, 1956 bp, Tetrahymena pyriformis; identical to SEQ ID NO: 1047
  CDS (1)..(978)

SEQ ID NO: 59413 - protein, 325 aa, Tetrahymena pyriformis; identical to SEQ ID NO: 1048

SEQ ID NO: 59414 - DNA, 2267 bp, Drosophila melanogaster; identical to SEQ ID NO: 1049
  CDS (113)..(2137)

SEQ ID NO: 59415 - protein, 674 aa, Drosophila melanogaster; identical to SEQ ID NO: 1050

SEQ ID NO: 59416 - DNA, 2383 bp, Solanum tuberosum; identical to SEQ ID NO: 1051
  CDS (271)..(2166)

SEQ ID NO: 59417 - protein, 631 aa, Solanum tuberosum; identical to SEQ ID NO: 1052

SEQ ID NO: 59418 - DNA, 3584 bp, Mus musculus; identical to SEQ ID NO: 1053
  CDS (33)..(2081)

SEQ ID NO: 59419 - protein, 682 aa, Mus musculus; identical to SEQ ID NO: 1054

SEQ ID NO: 59420 - DNA, 2052 bp, Kluyveromyces lactis; identical to SEQ ID NO: 1055
  CDS (1)..(2052)

SEQ ID NO: 59421 - protein, 683 aa, Kluyveromyces lactis [sequence omitted]

SEQ ID NO: 59422 - DNA, 2492 bp, Saccharomyces cerevisiae; identical to SEQ ID NO: 1057
  CDS (162)..(2303)

SEQ ID NO: 59423 - protein, 713 aa, Saccharomyces cerevisiae [sequence omitted]

SEQ ID NO: 59424 - DNA, 3543 bp, Kluyveromyces lactis; identical to SEQ ID NO: 1059
  CDS (817)..(2871)

SEQ ID NO: 59425 - protein, 684 aa, Kluyveromyces lactis; identical to SEQ ID NO: 1060

SEQ ID NO: 59426 - DNA, 1935 bp, Pseudomonas putida; identical to SEQ ID NO: 1061
  CDS (1)..(1935)

SEQ ID NO: 59427 - protein, 644 aa, Pseudomonas putida [sequence omitted]

SEQ ID NO: 59428 - DNA, 1950 bp, Rhizobium meliloti; identical to SEQ ID NO: 1063
  CDS (1)..(1950)

SEQ ID NO: 59429 - protein, 649 aa, Rhizobium meliloti [sequence omitted]

SEQ ID NO: 59430 - DNA, 1959 bp, Agrobacterium rhizogenes; identical to SEQ ID NO: 1065
  CDS (1)..(1959)

SEQ ID NO: 59431 - protein, 652 aa, Agrobacterium rhizogenes; identical to SEQ ID NO: 1066

SEQ ID NO: 59432 - DNA, 1956 bp, Agrobacterium tumefaciens; identical to SEQ ID NO: 1067
  CDS (1)..(1956)

SEQ ID NO: 59433 - protein, 651 aa, Agrobacterium tumefaciens; identical to SEQ ID NO: 1068

SEQ ID NO: 59434 - DNA, 1947 bp, Bradyrhizobium japonicum; identical to SEQ ID NO: 1069
  CDS (1)..(1947)

SEQ ID NO: 59435 - protein, 648 aa, Bradyrhizobium japonicum [sequence omitted]

SEQ ID NO: 59436 - DNA, 1956 bp, Brucella suis; identical to SEQ ID NO: 1071
  CDS (1)..(1956)

SEQ ID NO: 59437 - protein, 651 aa, Brucella suis; identical to SEQ ID NO: 1072

SEQ ID NO: 59438 - DNA, 2028 bp, Candida albicans; identical to SEQ ID NO: 1073
  CDS (1)..(2028)

SEQ ID NO: 59439 - protein, 675 aa, Candida albicans [sequence omitted]

SEQ ID NO: 59440 - DNA, 1980 bp, Chlorobium tepidum; identical to SEQ ID NO: 1075
  CDS (1)..(1980)

SEQ ID NO: 59441 - protein, 659 aa, Chlorobium tepidum [sequence omitted]

SEQ ID NO: 59442 - DNA, 2041 bp, Coprinus cinereus; identical to SEQ ID NO: 1077
  CDS (20)..(2005)

SEQ ID NO: 59443 - protein, 661 aa, Coprinus cinereus [sequence omitted]

SEQ ID NO: 59444 - DNA, 2222 bp, Cryptosporidium parvum; identical to SEQ ID NO: 1079
  CDS (70)..(2154)

SEQ ID NO: 59445 - protein, 694 aa, Cryptosporidium parvum [sequence omitted]

SEQ ID NO: 59446 - DNA, 2874 bp, Drosophila melanogaster; identical to SEQ ID NO: 1081
  CDS (451)..(2463)

SEQ ID NO: 59447 - protein, 670 aa, Drosophila melanogaster [sequence omitted]

SEQ ID NO: 59448 - DNA, 1986 bp, Leptospira interrogans; identical to SEQ ID NO: 1083
  CDS (1)..(1986)

SEQ ID NO: 59449 - protein, 661 aa, Leptospira interrogans [sequence omitted]

SEQ ID NO: 59450 - DNA, 2535 bp, Mus musculus; identical to SEQ ID NO: 1085
  CDS (15)..(2120)

SEQ ID NO: 59451 - protein, 701 aa, Mus musculus; identical to SEQ ID NO: 1086

SEQ ID NO: 59452 - DNA, 1956 bp, Mycobacterium bovis; identical to SEQ ID NO: 1087
  CDS (1)..(1956)

SEQ ID NO: 59453 - protein, 651 aa, Mycobacterium bovis [sequence omitted]

SEQ ID NO: 59454 - DNA, 1968 bp, Nitrosomonas europaea; identical to SEQ ID NO: 1089
  CDS (1)..(1968)

SEQ ID NO: 59455 - protein, 655 aa, Nitrosomonas europaea [sequence omitted]

SEQ ID NO: 59456 - DNA, 1962 bp, Pasteurella multocida; identical to SEQ ID NO: 1091
  CDS (1)..(1962)

SEQ ID NO: 59457 - protein, 653 aa, Pasteurella multocida [sequence omitted]

SEQ ID NO: 59458 - DNA, 1926 bp, Gamma; identical to SEQ ID NO: 1093
  CDS (1)..(1926)

SEQ ID NO: 59459 - protein, 641 aa, Gamma [sequence omitted]

SEQ ID NO: 59460 - DNA, 1983 bp, Ralstonia solanacearum; identical to SEQ ID NO: 1095
  CDS (1)..(1983)

SEQ ID NO: 59461 - protein, 660 aa, Ralstonia solanacearum; identical to SEQ ID NO: 1096

SEQ ID NO: 59462 - DNA, 1956 bp, Rhizobium loti; identical to SEQ ID NO: 1097
  CDS (1)..(1956)

SEQ ID NO: 59463 - protein, 651 aa, Rhizobium loti; identical to SEQ ID NO: 1098

SEQ ID NO: 59464 - DNA, 2016 bp, Rhodopirellula baltica; identical to SEQ ID NO: 1099
  CDS (1)..(2016)

SEQ ID NO: 59465 - protein, 671 aa, Rhodopirellula baltica [sequence omitted]

SEQ ID NO: 59466 - DNA, 1959 bp, Salmonella typhimurium; identical to SEQ ID NO: 1101
  CDS (1)..(1959)

SEQ ID NO: 59467 - protein, 652 aa, Salmonella typhimurium; identical to SEQ ID NO: 1102

SEQ ID NO: 59468 - DNA, 1953 bp, Shewanella oneidensis; identical to SEQ ID NO: 1103
  CDS (1)..(1953)

SEQ ID NO: 59469 - protein, 650 aa, Shewanella oneidensis [sequence omitted]

SEQ ID NO: 59470 - DNA, 1959 bp, Streptomyces avermitilis; identical to SEQ ID NO: 1105
  CDS (1)..(1959)

SEQ ID NO: 59471 - protein, 652 aa, Streptomyces avermitilis [sequence omitted]

SEQ ID NO: 59472 - DNA, 1971 bp, Synechococcus elongatus; identical to SEQ ID NO: 1107
  CDS (1)..(1971)

SEQ ID NO: 59473 - protein, 656 aa, Synechococcus elongatus [sequence omitted]

SEQ ID NO: 59474 - DNA, 1950 bp, Vibrio cholerae; identical to SEQ ID NO: 1109
  CDS (1)..(1950)

SEQ ID NO: 59475 - protein, 649 aa, Vibrio cholerae [sequence omitted]

SEQ ID NO: 59476 - DNA, 1953 bp, Vibrio parahaemolyticus; identical to SEQ ID NO: 1111
  CDS (1)..(1953)

SEQ ID NO: 59477 - protein, 650 aa, Vibrio parahaemolyticus; identical to SEQ ID NO: 1112

SEQ ID NO: 59478 - DNA, 1944 bp, Xanthomonas axonopodis; identical to SEQ ID NO: 1113
  CDS (1)..(1944)

SEQ ID NO: 59479 - protein, 647 aa, Xanthomonas axonopodis [sequence omitted]

SEQ ID NO: 59480 - DNA, 1944 bp, Xanthomonas campestris; identical to SEQ ID NO: 1115
  CDS (1)..(1944)

SEQ ID NO: 59481 - protein, 647 aa, Xanthomonas campestris; identical to SEQ ID NO: 1116

SEQ ID NO: 59482 - DNA, 1944 bp, Xylella fastidiosa; identical to SEQ ID NO: 1117
  CDS (1)..(1944)

SEQ ID NO: 59483 - protein, 647 aa, Xylella fastidiosa; identical to SEQ ID NO: 1118

SEQ ID NO: 59484 - DNA, 26 bp, Artificial sequence
  (1)..(26): primer
atgacaatcaaggaacataaagtagt

SEQ ID NO: 59485 - DNA, 28 bp, Artificial sequence
  (1)..(28): primer
ttatttctttttttgagagaaaaattgg

SEQ ID NO: 59486 - protein, 695 aa, Artificial sequence
  Variant (2)..(7): xaa in position 2 to 7 is any amino acid
  Variant (9)..(29): xaa in position 9 to 29 is any amino acid
  Variant (31)..(54): xaa in position 31 to 54 is any amino acid
  Variant (56)..(65): xaa in position 56 to 65 is any amino acid
  Variant (67)..(74): xaa in position 67 to 74 is any amino acid
  Variant (76)..(78): xaa in position 76 to 78 is any amino acid
  Variant (81)..(81): xaa in position 81 is any amino acid
  Variant (83)..(86): xaa in position 83 to 86 is any amino acid
  Variant (88)..(96): xaa in position 88 to 96 is any amino acid
  Variant (99)..(102): xaa in position 99 to 102 is any amino acid
  Variant (105)..(109): xaa in position 105 to 109 is any amino acid
  Variant (111)..(112): xaa in position 111 to 112 is any amino acid
  Variant (114)..(120): xaa in position 114 to 120 is any amino acid
  Variant (122)..(255): xaa in position 122 to 255 is any amino acid
  Variant (260)..(260): xaa in position 260 is any amino acid
  Variant (263)..(263): xaa in position 263 is any amino acid
  Variant (267)..(306): xaa in position 267 to 306 is any amino acid
  Variant (308)..(308): xaa in position 308 is any amino acid
  Variant (311)..(321): xaa in position 311 to 321 is any amino acid
  Variant (323)..(324): xaa in position 323 to 324 is any amino acid
  Variant (326)..(332): xaa in position 326 to 332 is any amino acid
  Variant (334)..(362): xaa in position 334 to 362 is any amino acid
  Variant (365)..(366): xaa in position 365 to 366 is any amino acid
  Variant (368)..(390): xaa in position 368 to 390 is any amino acid
  Variant (392)..(397): xaa in position 392 to 397 is any amino acid
  Variant (400)..(407): xaa in position 400 to 407 is any amino acid
  Variant (409)..(431): xaa in position 409 to 431 is any amino acid
  Variant (434)..(468): xaa in position 434 to 468 is any amino acid
  Variant (470)..(478): xaa in position 470 to 478 is any amino acid
  Variant (480)..(506): xaa in position 480 to 506 is any amino acid
  Variant (508)..(517): xaa in position 508 to 517 is any amino acid
  Variant (519)..(558): xaa in position 519 to 558 is any amino acid
  Variant (561)..(564): xaa in position 561 to 564 is any amino acid
  Variant (566)..(568): xaa in position 566 to 568 is any amino acid
  Variant (570)..(574): xaa in position 570 to 574 is any amino acid
  Variant (577)..(577): xaa in position 577 is any amino acid
  Variant (580)..(584): xaa in position 580 to 584 is any amino acid
  Variant (586)..(586): xaa in position 586 is any amino acid
  Variant (588)..(591): xaa in position 588 to 591 is any amino acid
  Variant (593)..(593): xaa in position 593 is any amino acid
  Variant (595)..(604): xaa in position 595 to 604 is any amino acid
  Variant (606)..(606): xaa in position 606 is any amino acid
  Variant (608)..(609): xaa in position 608 to 609 is any amino acid
  Variant (611)..(616): xaa in position 611 to 616 is any amino acid
  Variant (618)..(625): xaa in position 618 to 625 is any amino acid
  Variant (627)..(684): xaa in position 627 to 684 is any amino acid
  Variant (689)..(689): xaa in position 689 is any amino acid
  Variant (694)..(694): xaa in position 694 is any amino acid
WXXXXXXNXXXXXXXXXXXXXXXXXXXXXAXXXXXXXXXXXXXXXXXXXXXXXXLXXXXXXXXXXLXXXXXXXXGXXXGDXVXXXXPXXXXXXXXXLAXXXXGAXXXXXFXXFXXXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYTSGXTGXPKGXXXXXXXXXXXXXXXXXXXXXXXXXXXXXXXXXXXXXXXXDXGWXXXXXXXXXXXLXXGXXXXXXXGXXXXXXXXXXXXXXXXXXXXXXXXXXXXXPTXXRXXXXXXXXXXXXXXXXXXXXXXXLXXXXXXGEXXXXXXXXWXXXXXXXXXXXXXXXXXXXXXXXTEXXXXXXXXXXXXXXXXXXXXXXXXXXXXXXXXXXXGXXXXXXXXXGXXXXXXXXXXXXXXXXXXXXXXXXXXXGXXXXXXXXXXPXXXXXXXXXXXXXXXXXXXXXXXXXXXXXXXXXXXXXXXXGDXXXXDXXXGXXXXXGRXDDXXXXXGXRXXXXEXEXXXXXXXXXXEXAXXGXXXXXXGXXXXXXXXLXXXXXXXXXXXXXXXXXXXXXXXXXXXXXXXXXXXXXXXXXXXXXXXXXXXXXXXXXXLPKTXSGKIXR

SEQ ID NO: 59487 - protein, 43 aa, Artificial sequence; identical to SEQ ID NO: 1308
  Variant (1)..(1): xaa in position 1 is Gly, Asn or Asp
  Variant (2)..(2): xaa in position 2 is Asp, Glu or Gln
  Variant (3)..(3): xaa in position 3 is any amino acid
  Variant (4)..(4): xaa in position 4 is Val or Ile
  Variant (5)..(7): xaa in position 5 to 7 is any amino acid
  Variant (8)..(8): xaa in position 8 is Met, Leu, Ile or Ala
  Variant (9)..(18): xaa in position 9 to 18 is any amino acid
  Variant (19)..(19): xaa in position 19 is Leu, Met, Gln, Phe or Tyr
  Variant (20)..(20): xaa in position 20 is Ala, Gly or Ser
  Variant (21)..(23): xaa in position 21 to 23 is any amino acid
  Variant (24)..(24): xaa in position 24 is Ile, Leu, Val or Ala
  Variant (26)..(26): xaa in position 26 is Ala, Gly, Val or no amino acid
  Variant (27)..(34): xaa in position 27 to 34 is any amino acid
  Variant (35)..(35): xaa in position 35 is Phe, Tyr or Leu
  Variant (36)..(39): xaa in position 36 to 39 is any amino acid
  Variant (40)..(40): xaa in position 40 is Leu, Ile or Val
  Variant (41)..(42): xaa in position 41 to 42 is any amino acid
  Variant (43)..(43): xaa in position 43 is Arg or Gln

SEQ ID NO: 59488 - protein, 14 aa, Artificial sequence
  Variant (1)..(1): xaa in position 1 is Ile, Leu, Met or Val
  Variant (2)..(2): xaa in position 2 is any amino acid
  Variant (3)..(3): xaa in position 3 is Tyr, Phe or Ser
  Variant (4)..(4): xaa in position 4 is Thr or Ser
  Variant (7)..(7): xaa in position 7 is Thr or Ser
  Variant (10)..(10): xaa in position 10 is any amino acid
  Variant (11)..(11): xaa in position 11 is Pro, Ala or Ser
  Variant (13)..(13): xaa in position 13 is any amino acid
  Variant (14)..(14): xaa in position 14 is Val, Ile, Leu, Ala or Thr
XXXXSGXTGXXKXX

SEQ ID NO: 59489 - protein, 55 aa, Artificial sequence; identical to SEQ ID NO: 1310
  Variant (1)..(1): xaa in position 1 is Tyr, Trp, Phe, Leu or His
  Variant (2)..(3): xaa in position 2 to 3 is any amino acid
  Variant (4)..(4): xaa in position 4 is Gly, Ala or Phe
  Variant (6)..(12): xaa in position 6 to 12 is any amino acid
  Variant (13)..(13): xaa in position 13 is any or no amino acid
  Variant (14)..(14): xaa in position 14 is Gly, Asp or no amino acid
  Variant (15)..(19): xaa in position 15 to 19 is any amino acid
  Variant (20)..(20): xaa in position 20 is Gly, Ser, Ala or Asp
  Variant (22)..(22): xaa in position 22 is any amino acid
  Variant (23)..(23): xaa in position 23 is Asp or Lys
  Variant (24)..(24): xaa in position 24 is Asp, Glu, Ser, Ala or Thr
  Variant (25)..(25): xaa in position 25 is any amino acid
  Variant (26)..(26): xaa in position 26 is Ile, Leu, Met or Val
  Variant (27)..(29): xaa in position 27 to 29 is any amino acid
  Variant (31)..(31): xaa in position 31 is any amino acid
  Variant (32)..(32): xaa in position 32 is Arg, Lys, Gln or Leu
  Variant (33)..(33): xaa in position 33 is Leu, Ile, Val or Met
  Variant (34)..(36): xaa in position 34 to 36 is any amino acid
  Variant (37)..(37): xaa in position 37 is Glu, Asp, Thr or Ala
  Variant (38)..(38): xaa in position 38 is Ile, Val, Met or Leu
  Variant (39)..(39): xaa in position 39 is Glu, Tyr or Asp
  Variant (40)..(41): xaa in position 40 to 41 is any amino acid
  Variant (42)..(42): xaa in position 42 is Leu, Ile, Val or Met
  Variant (43)..(47): xaa in position 43 to 47 is any amino acid
  Variant (48)..(48): xaa in position 48 is Val or Ile
  Variant (49)..(49): xaa in position 49 is any amino acid
  Variant (50)..(50): xaa in position 50 is Glu or Asp
  Variant (51)..(51): xaa in position 51 is Ala, Cys, Ser, Val or Thr
  Variant (52)..(53): xaa in position 52 to 53 is any amino acid
  Variant (54)..(54): xaa in position 54 is Val, Ile, Leu, Thr or Phe
  Variant (55)..(55): xaa in position 55 is Gly, Ala, Ser or Pro

SEQ ID NO: 59490 - protein, 14 aa, Artificial sequence
  Variant (1)..(1): xaa in position 1 is Leu, Ile or Met
  Variant (3)..(3): xaa in position 3 is Lys, Arg, Met or His
  Variant (4)..(4): xaa in position 4 is Thr or Ser
  Variant (5)..(5): xaa in position 5 is any amino acid
  Variant (6)..(6): xaa in position 6 is Ser, Thr, Asn or Val
  Variant (7)..(7): xaa in position 7 is Gly, Ala or Ser
  Variant (9)..(9): xaa in position 9 is Ile, Val, Leu, Met, Lys or Arg
  Variant (10)..(10): xaa in position 10 is any amino acid
  Variant (11)..(11): xaa in position 11 is Arg or Glu
  Variant (12)..(13): xaa in position 12 to 13 is any amino acid
  Variant (14)..(14): xaa in position 14 is Leu, Ile, Val or Met
XPXXXXXKXXXXXX

SEQ ID NO: 59491 - DNA, 1239 bp, Saccharomyces cerevisiae; identical to SEQ ID NO: 5653
  CDS (1)..(1239)

SEQ ID NO: 59492 - protein, 412 aa, Saccharomyces cerevisiae; identical to SEQ ID NO: 5654

SEQ ID NO: 59493 - DNA, 1719 bp, Rattus norvegicus (Norway rat); identical to SEQ ID NO: 5655
  CDS (30)..(1274)

SEQ ID NO: 59494 - protein, 414 aa, Rattus norvegicus (Norway rat); identical to SEQ ID NO: 5656

SEQ ID NO: 59495 - DNA, 1212 bp, Caulobacter crescentus; identical to SEQ ID NO: 5657
  CDS (1)..(1212)

SEQ ID NO: 59496 - protein, 403 aa, Caulobacter crescentus; identical to SEQ ID NO: 5658

SEQ ID NO: 59497 - DNA, 1551 bp, Arabidopsis thaliana (mouse-ear cress); identical to SEQ ID NO: 5659
  CDS (21)..(1271)

SEQ ID NO: 59498 - protein, 416 aa, Arabidopsis thaliana (mouse-ear cress); identical to SEQ ID NO: 5660

SEQ ID NO: 59499 - DNA, 1368 bp, Agrobacterium tumefaciens; identical to SEQ ID NO: 5661
  CDS (1)..(1368)

SEQ ID NO: 59500 - protein, 455 aa, Agrobacterium tumefaciens; identical to SEQ ID NO: 5662

SEQ ID NO: 59501 - DNA, 1230 bp, Mycobacterium tuberculosis; identical to SEQ ID NO: 5663
  CDS (1)..(1230)

SEQ ID NO: 59502 - protein, 409 aa, Mycobacterium tuberculosis; identical to SEQ ID NO: 5664

SEQ ID NO: 59503 - DNA, 1608 bp, Saccharomyces cerevisiae; identical to SEQ ID NO: 5665
  CDS (111)..(1397)

SEQ ID NO: 59504 - protein, 428 aa, Saccharomyces cerevisiae; identical to SEQ ID NO: 5666

SEQ ID NO: 59505 - DNA, 1242 bp, Sulfolobus solfataricus; identical to SEQ ID NO: 5667
  CDS (1)..(1242)

SEQ ID NO: 59506 - protein, 413 aa, Sulfolobus solfataricus; identical to SEQ ID NO: 5668

SEQ ID NO: 59507 - DNA, 1200 bp, Thermotoga maritima; identical to SEQ ID NO: 5669
  CDS (1)..(1200)

SEQ ID NO: 59508 - protein, 399 aa, Thermotoga maritima; identical to SEQ ID NO: 5670

SEQ ID NO: 59509 - DNA, 1221 bp, Sphingomonas yanoikuyae; identical to SEQ ID NO: 5671
  CDS (1)..(1221)

SEQ ID NO: 59510 - protein, 406 aa, Sphingomonas yanoikuyae; identical to SEQ ID NO: 5672

SEQ ID NO: 59511 - DNA, 1740 bp, Bos primigenius taurus (cattle); identical to SEQ ID NO: 5673
  CDS (67)..(1425)

SEQ ID NO: 59512 - protein, 452 aa, Bos primigenius taurus (cattle); identical to SEQ ID NO: 5674

SEQ ID NO: 59513 - DNA, 1569 bp, Solanum tuberosum (potato); identical to SEQ ID NO: 5675
  CDS (69)..(1319)

SEQ ID NO: 59514 - protein, 416 aa, Solanum tuberosum (potato); identical to SEQ ID NO: 5676

SEQ ID NO: 59515 - DNA, 1850 bp, Saccharomyces cerevisiae; identical to SEQ ID NO: 5677
  CDS (461)..(1723)

SEQ ID NO: 59516 - protein, 420 aa, Saccharomyces cerevisiae; identical to SEQ ID NO: 5678

SEQ ID NO: 59517 - DNA, 1584 bp, Nicotiana tabacum (common tobacco); identical to SEQ ID NO: 5679
  CDS (85)..(1332)

SEQ ID NO: 59518 - protein, 415 aa, Nicotiana tabacum (common tobacco); identical to SEQ ID NO: 5680

SEQ ID NO: 59519 - DNA, 1722 bp, Nicotiana tabacum (common tobacco); identical to SEQ ID NO: 5681
  CDS (76)..(1524)

SEQ ID NO: 59520 - protein, 482 aa, Nicotiana tabacum (common tobacco); identical to SEQ ID NO: 5682

SEQ ID NO: 59521 - DNA, 1308 bp, Caenorhabditis elegans; identical to SEQ ID NO: 5683
  CDS (1)..(1308)

SEQ ID NO: 59522 - protein, 435 aa, Caenorhabditis elegans; identical to SEQ ID NO: 5684

SEQ ID NO: 59523 - DNA, 1239 bp, Caenorhabditis elegans; identical to SEQ ID NO: 5685
  CDS (1)..(1239)

SEQ ID NO: 59524 - protein, 412 aa, Caenorhabditis elegans; identical to SEQ ID NO: 5686

SEQ ID NO: 59525 - DNA, 1257 bp, Schizosaccharomyces pombe; identical to SEQ ID NO: 5687
  CDS (1)..(1257)

SEQ ID NO: 59526 - protein, 418 aa, Schizosaccharomyces pombe; identical to SEQ ID NO: 5688

SEQ ID NO: 59527 - DNA, 1827 bp, Glycine max; identical to SEQ ID NO: 5689
  CDS (289)..(1539)

SEQ ID NO: 59528 - protein, 416 aa, Glycine max; identical to SEQ ID NO: 5690

SEQ ID NO: 59529 - DNA, 1645 bp, Eucalyptus globulus; identical to SEQ ID NO: 5691
  CDS (161)..(1411)

SEQ ID NO: 59530 - protein, 416 aa, Eucalyptus globulus; identical to SEQ ID NO: 5692

SEQ ID NO: 59531 - DNA, 1596 bp, Homo sapiens; identical to SEQ ID NO: 5693
  CDS (44)..(1303)

SEQ ID NO: 59532 - protein, 419 aa, Homo sapiens [sequence omitted]

SEQ ID NO: 59533 - DNA, 1233 bp, Debaryomyces hansenii; identical to SEQ ID NO: 5695
  CDS (1)..(1233)

SEQ ID NO: 59534 - protein, 410 aa, Debaryomyces hansenii; identical to SEQ ID NO: 5696

SEQ ID NO: 59535 - DNA, 1296 bp, Debaryomyces hansenii; identical to SEQ ID NO: 5697
  CDS (1)..(1296)

SEQ ID NO: 59536 - protein, 431 aa, Debaryomyces hansenii; identical to SEQ ID NO: 5698

SEQ ID NO: 59537 - DNA, 1326 bp, Yarrowia lipolytica; identical to SEQ ID NO: 5699
  CDS (1)..(1326)

SEQ ID NO: 59538 - protein, 441 aa, Yarrowia lipolytica; identical to SEQ ID NO: 5700

SEQ ID NO: 59539 - DNA, 1248 bp, Kluyveromyces lactis; identical to SEQ ID NO: 5701
  CDS (1)..(1248)

SEQ ID NO: 59540 - protein, 415 aa, Kluyveromyces lactis; identical to SEQ ID NO: 5702

SEQ ID NO: 59541 - DNA, 1290 bp, Kluyveromyces lactis; identical to SEQ ID NO: 5703
  CDS (1)..(1290)

SEQ ID NO: 59542 - protein, 429 aa, Kluyveromyces lactis; identical to SEQ ID NO: 5704

SEQ ID NO: 59543 - DNA, 1257 bp, Candida glabrata; identical to SEQ ID NO: 5705
  CDS (1)..(1257)

SEQ ID NO: 59544 - protein, 418 aa, Candida glabrata; identical to SEQ ID NO: 5706

SEQ ID NO: 59545 - DNA, 1272 bp, Candida glabrata; identical to SEQ ID NO: 5707
  CDS (1)..(1272)

SEQ ID NO: 59546 - protein, 423 aa, Candida glabrata; identical to SEQ ID NO: 5708

SEQ ID NO: 59547 - DNA, 1236 bp, Candida glabrata; identical to SEQ ID NO: 5709
  CDS (1)..(1236)

SEQ ID NO: 59548 - protein, 411 aa, Candida glabrata; identical to SEQ ID NO: 5710

SEQ ID NO: 59549 - DNA, 1215 bp, Bartonella quintana; identical to SEQ ID NO: 5711
  CDS (1)..(1215)

SEQ ID NO: 59550 - protein, 404 aa, Bartonella quintana; identical to SEQ ID NO: 5712

SEQ ID NO: 59551 - DNA, 1215 bp, Bartonella henselae; identical to SEQ ID NO: 5713
  CDS (1)..(1215)

SEQ ID NO: 59552 - protein, 404 aa, Bartonella henselae; identical to SEQ ID NO: 5714

SEQ ID NO: 59553 - DNA, 1212 bp, Rhizobium leguminosarum; identical to SEQ ID NO: 5715
  CDS (1)..(1212)

SEQ ID NO: 59554 - protein, 403 aa, Rhizobium leguminosarum; identical to SEQ ID NO: 5716

SEQ ID NO: 59555 - DNA, 1230 bp, Bdellovibrio bacteriovorus; identical to SEQ ID NO: 5717
  CDS (1)..(1230)

SEQ ID NO: 59556 - protein, 409 aa, Bdellovibrio bacteriovorus; identical to SEQ ID NO: 5718

SEQ ID NO: 59557 - DNA, 1227 bp, Rhodopseudomonas palustris; identical to SEQ ID NO: 5719
  CDS (1)..(1227)

SEQ ID NO: 59558 - protein, 408 aa, Rhodopseudomonas palustris; identical to SEQ ID NO: 5720

SEQ ID NO: 59559 - DNA, 1564 bp, Pisum sativum; identical to SEQ ID NO: 5721
  CDS (79)..(1317)

SEQ ID NO: 59560 - protein, 412 aa, Pisum sativum; identical to SEQ ID NO: 5722

SEQ ID NO: 59561 - DNA, 2254 bp, Ovis aries; identical to SEQ ID NO: 5723
  CDS (167)..(1411)

SEQ ID NO: 59562 - protein, 414 aa, Ovis aries; identical to SEQ ID NO: 5724

SEQ ID NO: 59563 - DNA, 1197 bp, Leptospira interrogans; identical to SEQ ID NO: 5725
  CDS (1)..(1197)

SEQ ID NO: 59564 - protein, 398 aa, Leptospira interrogans; identical to SEQ ID NO: 5726

SEQ ID NO: 59565 - DNA, 1239 bp, Mycobacterium paratuberculosis; identical to SEQ ID NO: 5727
  CDS (1)..(1239)

SEQ ID NO: 59566 - protein, 412 aa, Mycobacterium paratuberculosis; identical to SEQ ID NO: 5728

SEQ ID NO: 59567 - DNA, 1278 bp, Ashbya gossypii; identical to SEQ ID NO: 5729
  CDS (1)..(1278)

SEQ ID NO: 59568 - protein, 425 aa, Ashbya gossypii; identical to SEQ ID NO: 5730

SEQ ID NO: 59569 - DNA, 1248 bp, Ashbya gossypii; identical to SEQ ID NO: 5731
  CDS (1)..(1248)

SEQ ID NO: 59570 - protein, 415 aa, Ashbya gossypii; identical to SEQ ID NO: 5732

SEQ ID NO: 59571 - DNA, 1287 bp, Dictyostelium discoideum; identical to SEQ ID NO: 5733
  CDS (1)..(1287)

SEQ ID NO: 59572 - protein, 428 aa, Dictyostelium discoideum; identical to SEQ ID NO: 5734

SEQ ID NO: 59573 - DNA, 1594 bp, Oryza sativa; identical to SEQ ID NO: 5735
  CDS (66)..(1304)

SEQ ID NO: 59574 - protein, 412 aa, Oryza sativa; identical to SEQ ID NO: 5736

SEQ ID NO: 59575 - DNA, 1230 bp, Gloeobacter violaceus; identical to SEQ ID NO: 5737
  CDS (1)..(1230)

SEQ ID NO: 59576 - protein, 409 aa, Gloeobacter violaceus; identical to SEQ ID NO: 5738

SEQ ID NO: 59577 - DNA, 1410 bp, Plasmodium yoelii yoelii; identical to SEQ ID NO: 5739
  CDS (1)..(1410)

SEQ ID NO: 59578 - protein, 469 aa, Plasmodium yoelii yoelii; identical to SEQ ID NO: 5740

SEQ ID NO: 59579 - DNA, 1389 bp, Neurospora crassa; identical to SEQ ID NO: 5741
  CDS (1)..(1389)

SEQ ID NO: 59580 - protein, 462 aa, Neurospora crassa; identical to SEQ ID NO: 5742

SEQ ID NO: 59581 - DNA, 1765 bp, Oryza sativa; identical to SEQ ID NO: 5743
  CDS (83)..(1489)

SEQ ID NO: 59582 - protein, 468 aa, Oryza sativa; identical to SEQ ID NO: 5744

SEQ ID NO: 59583 - DNA, 1794 bp, Lupinus albus; identical to SEQ ID NO: 5745
  CDS (58)..(1515)

SEQ ID NO: 59584 - protein, 485 aa, Lupinus albus; identical to SEQ ID NO: 5746

SEQ ID NO: 59585 - DNA, 1583 bp, Lupinus albus; identical to SEQ ID NO: 5747
  CDS (43)..(1281)

SEQ ID NO: 59586 - protein, 412 aa, Lupinus albus; identical to SEQ ID NO: 5748

SEQ ID NO: 59587 - DNA, 1627 bp, Lupinus albus; identical to SEQ ID NO: 5749
  CDS (79)..(1317)

SEQ ID NO: 59588 - protein, 412 aa, Lupinus albus; identical to SEQ ID NO: 5750

SEQ ID NO: 59589 - DNA, 2305 bp, Homo sapiens; identical to SEQ ID NO: 5751
  CDS (196)..(1440)

SEQ ID NO: 59590 - protein, 414 aa, Homo sapiens [sequence omitted]

SEQ ID NO: 59591 - DNA, 1215 bp, Bradyrhizobium japonicum; identical to SEQ ID NO: 5753
  CDS (1)..(1215)

SEQ ID NO: 59592 - protein, 404 aa, Bradyrhizobium japonicum; identical to SEQ ID NO: 5754

SEQ ID NO: 59593 - DNA, 1215 bp, Brucella suis; identical to SEQ ID NO: 5755
  CDS (1)..(1215)

SEQ ID NO: 59594 - protein, 404 aa, Brucella suis; identical to SEQ ID NO: 5756

SEQ ID NO: 59595 - DNA, 1221 bp, Bifidobacterium longum; identical to SEQ ID NO: 5757
  CDS (1)..(1221)

SEQ ID NO: 59596 - protein, 406 aa, Bifidobacterium longum; identical to SEQ ID NO: 5758

SEQ ID NO: 59597 - DNA, 1407 bp, Plasmodium falciparum; identical to SEQ ID NO: 5759
  CDS (1)..(1407)

SEQ ID NO: 59598 - protein, 468 aa, Plasmodium falciparum; identical to SEQ ID NO: 5760

SEQ ID NO: 59599 - DNA, 1514 bp, Arabidopsis thaliana; identical to SEQ ID NO: 5761
  CDS (1)..(1458)

SEQ ID NO: 59600 - protein, 485 aa, Arabidopsis thaliana; identical to SEQ ID NO: 5762

SEQ ID NO: 59601 - DNA, 1212 bp, Thermoanaerobacter tengcongensis; identical to SEQ ID NO: 5763
  CDS (1)..(1212)

SEQ ID NO: 59602 - protein, 403 aa, Thermoanaerobacter tengcongensis; identical to SEQ ID NO: 5764

SEQ ID NO: 59603 - DNA, 1551 bp, Cucumis sativus; identical to SEQ ID NO: 5765
  CDS (62)..(1294)

SEQ ID NO: 59604 - protein, 410 aa, Cucumis sativus; identical to SEQ ID NO: 5766

SEQ ID NO: 59605 - DNA, 1610 bp, Arabidopsis thaliana; identical to SEQ ID NO: 5767
  CDS (165)..(1397)

SEQ ID NO: 59606 - protein, 410 aa, Arabidopsis thaliana; identical to SEQ ID NO: 5768

SEQ ID NO: 59607 - DNA, 1215 bp, Rhizobium meliloti; identical to SEQ ID NO: 5769
  CDS (1)..(1215)

SEQ ID NO: 59608 - protein, 404 aa, Rhizobium meliloti; identical to SEQ ID NO: 5770

SEQ ID NO: 59609 - DNA, 1561 bp, Prunus persica; identical to SEQ ID NO: 5771
  CDS (1)..(1245)

SEQ ID NO: 59610 - protein, 414 aa, Prunus persica; identical to SEQ ID NO: 5772

SEQ ID NO: 59611 - DNA, 1242 bp, Emericella nidulans; identical to SEQ ID NO: 5773
  CDS (1)..(1242)

SEQ ID NO: 59612 - protein, 413 aa, Emericella nidulans; identical to SEQ ID NO: 5774

SEQ ID NO: 59613 - DNA, 1212 bp, Rhizobium loti; identical to SEQ ID NO: 5775
  CDS (1)..(1212)

SEQ ID NO: 59614 - protein, 403 aa, Rhizobium loti; identical to SEQ ID NO: 5776

SEQ ID NO: 59615 - DNA, 1679 bp, Mus musculus; identical to SEQ ID NO: 5777
  CDS (46)..(1404)

SEQ ID NO: 59616 - protein, 452 aa, Mus musculus; identical to SEQ ID NO: 5778

SEQ ID NO: 59617 - DNA, 1227 bp, Oryza sativa; identical to SEQ ID NO: 5779
  CDS (1)..(1227)

SEQ ID NO: 59618 - protein, 408 aa, Oryza sativa; identical to SEQ ID NO: 5780

SEQ ID NO: 59619 - DNA, 1554 bp, Solanum tuberosum; identical to SEQ ID NO: 5781
  CDS (61)..(1473)

SEQ ID NO: 59620 - protein, 470 aa, Solanum tuberosum; identical to SEQ ID NO: 5782

SEQ ID NO: 59621 - DNA, 1708 bp, Citrus limon; identical to SEQ ID NO: 5783
  CDS (155)..(1399): n means a or g or c or t/u, s means g or c

SEQ ID NO: 59622 - protein, 414 aa, Citrus limon; identical to SEQ ID NO: 5784

SEQ ID NO: 59623 - DNA, 1782 bp, Drosophila melanogaster; identical to SEQ ID NO: 5785
  CDS (430)..(1782)

SEQ ID NO: 59624 - protein, 450 aa, Drosophila melanogaster; identical to SEQ ID NO: 5786

SEQ ID NO: 59625 - DNA, 1503 bp, Oryza sativa; identical to SEQ ID NO: 5787
  CDS (84)..(1322)

SEQ ID NO: 59626 - protein, 412 aa, Oryza sativa; identical to SEQ ID NO: 5788

SEQ ID NO: 59627 - DNA, 1859 bp, Oryza sativa; identical to SEQ ID NO: 5789
  CDS (201)..(1445)

SEQ ID NO: 59628 - protein, 414 aa, Oryza sativa; identical to SEQ ID NO: 5790

SEQ ID NO: 59629 - DNA, 1488 bp, Daucus carota; identical to SEQ ID NO: 5791
  CDS (91)..(1341)

SEQ ID NO: 59630 - protein, 416 aa, Daucus carota; identical to SEQ ID NO: 5792

SEQ ID NO: 59631 - DNA, 1512 bp, Daucus carota; identical to SEQ ID NO: 5793
  CDS (93)..(1331)

SEQ ID NO: 59632 - protein, 412 aa, Daucus carota; identical to SEQ ID NO: 5794

SEQ ID NO: 59633 - DNA, 1600 bp, Candida tropicalis; identical to SEQ ID NO: 5795
  CDS (201)..(1493)

SEQ ID NO: 59634 - protein, 430 aa, Candida tropicalis; identical to SEQ ID NO: 5796

SEQ ID NO: 59635 - DNA, 1560 bp, Glycine max; identical to SEQ ID NO: 5797
  CDS (87)..(1328)

SEQ ID NO: 59636 - protein, 413 aa, Glycine max; identical to SEQ ID NO: 5798

SEQ ID NO: 59637 - DNA, 1985 bp, Aspergillus niger; identical to SEQ ID NO: 5799
  CDS (288)..(1784)

SEQ ID NO: 59638 - protein, 498 aa, Aspergillus niger; identical to SEQ ID NO: 5800

SEQ ID NO: 59639 - DNA, 1727 bp, Homo sapiens; identical to SEQ ID NO: 5801
  CDS (67)..(1425)

SEQ ID NO: 59640 - protein, 452 aa, Homo sapiens; identical to SEQ ID NO: 5802

SEQ ID NO: 59641 - DNA, 1863 bp, Mus musculus; identical to SEQ ID NO: 5803
  CDS (24)..(1595)

SEQ ID NO: 59642 - protein, 523 aa, Mus musculus; identical to SEQ ID NO: 5804

SEQ ID NO: 59643 - DNA, 1740 bp, Brachydanio rerio; identical to SEQ ID NO: 5805
  CDS (80)..(1429)

SEQ ID NO: 59644 - protein, 449 aa, Brachydanio rerio; identical to SEQ ID NO: 5806

SEQ ID NO: 59645 - DNA, 25 bp, Artificial sequence
  (1)..(25): primer
atgacaaagattaaggtagctaacc

SEQ ID NO: 59646 - DNA, 23 bp, Artificial sequence
  (1)..(23): primer
ttacaatgcagctgcctcgaact

SEQ ID NO: 59647 - protein, 367 aa, Artificial sequence; identical to SEQ ID NO: 35141
  Variant (4)..(8): xaa in position 4 to 8 is any amino acid
  Variant (10)..(29): xaa in position 10 to 29 is any amino acid
  Variant (31)..(34): xaa in position 31 to 34 is any amino acid
  Variant (36)..(37): xaa in position 36 to 37 is any amino acid
  Variant (39)..(39): xaa in position 39 is any amino acid
  Variant (41)..(42): xaa in position 41 to 42 is any amino acid
  Variant (44)..(57): xaa in position 44 to 57 is any amino acid
  Variant (65)..(67): xaa in position 65 to 67 is any amino acid
  Variant (69)..(70): xaa in position 69 to 70 is any amino acid
  Variant (72)..(73): xaa in position 72 to 73 is any amino acid
  Variant (75)..(77): xaa in position 75 to 77 is any amino acid
  Variant (79)..(79): xaa in position 79 is any amino acid
  Variant (83)..(83): xaa in position 83 is any amino acid
  Variant (85)..(85): xaa in position 85 is any amino acid
  Variant (87)..(90): xaa in position 87 to 90 is any amino acid
  Variant (92)..(93): xaa in position 92 to 93 is any amino acid
  Variant (96)..(109): xaa in position 96 to 109 is any amino acid
  Variant (111)..(113): xaa in position 111 to 113 is any amino acid
  Variant (115)..(117): xaa in position 115 to 117 is any amino acid
  Variant (121)..(122): xaa in position 121 to 122 is any amino acid
  Variant (124)..(124): xaa in position 124 is any amino acid
  Variant (126)..(173): xaa in position 126 to 173 is any amino acid
  Variant (175)..(177): xaa in position 175 to 177 is any amino acid
  Variant (179)..(181): xaa in position 179 to 181 is any amino acid
  Variant (184)..(200): xaa in position 184 to 200 is any amino acid
  Variant (203)..(203): xaa in position 203 is any amino acid
  Variant (206)..(206): xaa in position 206 is any amino acid
  Variant (208)..(208): xaa in position 208 is any amino acid
  Variant (210)..(212): xaa in position 210 to 212 is any amino acid
  Variant (214)..(216): xaa in position 214 to 216 is any amino acid
  Variant (218)..(235): xaa in position 218 to 235 is any amino acid
  Variant (237)..(239): xaa in position 237 to 239 is any amino acid
  Variant (244)..(245): xaa in position 244 to 245 is any amino acid
  Variant (247)..(252): xaa in position 247 to 252 is any amino acid
  Variant (254)..(257): xaa in position 254 to 257 is any amino acid
  Variant (259)..(261): xaa in position 259 to 261 is any amino acid
  Variant (263)..(263): xaa in position 263 is any amino acid
  Variant (265)..(267): xaa in position 265 to 267 is any amino acid
  Variant (270)..(271): xaa in position 270 to 271 is any amino acid
  Variant (273)..(275): xaa in position 273 to 275 is any amino acid
  Variant (279)..(280): xaa in position 279 to 280 is any amino acid
  Variant (282)..(282): xaa in position 282 is any amino acid
  Variant (284)..(284): xaa in position 284 is any amino acid
  Variant (286)..(289): xaa in position 286 to 289 is any amino acid
  Variant (291)..(295): xaa in position 291 to 295 is any amino acid
  Variant (298)..(298): xaa in position 298 is any amino acid
  Variant (303)..(304): xaa in position 303 to 304 is any amino acid
  Variant (306)..(314): xaa in position 306 to 314 is any amino acid
  Variant (318)..(320): xaa in position 318 to 320 is any amino acid
  Variant (322)..(322): xaa in position 322 is any amino acid
  Variant (327)..(332): xaa in position 327 to 332 is any amino acid
  Variant (334)..(336): xaa in position 334 to 336 is any amino acid
  Variant (338)..(349): xaa in position 338 to 349 is any amino acid
  Variant (351)..(366): xaa in position 351 to 366 is any amino acid

SEQ ID NO: 59648 - protein, 410 aa, Artificial sequence; identical to SEQ ID NO: 35142
  Variant (3)..(3): xaa in position 3 is any amino acid
  Variant (5)..(6): xaa in position 5 to 6 is any amino acid
  Variant (8)..(8): xaa in position 8 is any amino acid
  Variant (11)..(11): xaa in position 11 is any amino acid
  Variant (19)..(19): xaa in position 19 is any amino acid
  Variant (22)..(23): xaa in position 22 to 23 is any amino acid
  Variant (26)..(26): xaa in position 26 is any amino acid
  Variant (30)..(30): xaa in position 30 is any amino acid
  Variant (32)..(38): xaa in position 32 to 38 is any amino acid
  Variant (40)..(40): xaa in position 40 is any amino acid
  Variant (43)..(46): xaa in position 43 to 46 is any amino acid
  Variant (49)..(49): xaa in position 49 is any amino acid
  Variant (51)..(51): xaa in position 51 is any amino acid
  Variant (53)..(53): xaa in position 53 is any amino acid
  Variant (56)..(58): xaa in position 56 to 58 is any amino acid
  Variant (60)..(60): xaa in position 60 is any amino acid
  Variant (62)..(63): xaa in position 62 to 63 is any amino acid
  Variant (65)..(66): xaa in position 65 to 66 is any amino acid
  Variant (68)..(69): xaa in position 68 to 69 is any amino acid
  Variant (79)..(79): xaa in position 79 is any amino acid
  Variant (82)..(82): xaa in position 82 is any amino acid
  Variant (85)..(85): xaa in position 85 is any amino acid
  Variant (88)..(88): xaa in position 88 is any amino acid
  Variant (91)..(91): xaa in position 91 is any amino acid
  Variant (102)..(102): xaa in position 102 is any amino acid
  Variant (111)..(115): xaa in position 111 to 115 is any amino acid
  Variant (121)..(121): xaa in position 121 is any amino acid
  Variant (123)..(123): xaa in position 123 is any amino acid
  Variant (127)..(127): xaa in position 127 is any amino acid
  Variant (133)..(133): xaa in position 133 is any amino acid
  Variant (138)..(138): xaa in position 138 is any amino acid
  Variant (142)..(147): xaa in position 142 to 147 is any amino acid
  Variant (149)..(168): xaa in position 149 to 168 is any amino acid
  Variant (170)..(178): xaa in position 170 to 178 is any amino acid
  Variant (181)..(183): xaa in position 181 to 183 is any amino acid
  Variant (187)..(187): xaa in position 187 is any amino acid
  Variant (189)..(189): xaa in position 189 is any amino acid
  Variant (192)..(193): xaa in position 192 to 193 is any amino acid
  Variant (196)..(207): xaa in position 196 to 207 is any amino acid
  Variant (209)..(209): xaa in position 209 is any amino acid
  Variant (211)..(211): xaa in position 211 is any amino acid
  Variant (220)..(220): xaa in position 220 is any amino acid
  Variant (230)..(237): xaa in position 230 to 237 is any amino acid
  Variant (239)..(240): xaa in position 239 to 240 is any amino acid
  Variant (242)..(247): xaa in position 242 to 247 is any amino acid
  Variant (259)..(261): xaa in position 259 to 261 is any amino acid
  Variant (263)..(264): xaa in position 263 to 264 is any amino acid
  Variant (267)..(269): xaa in position 267 to 269 is any amino acid
  Variant (271)..(271): xaa in position 271 is any amino acid
  Variant (282)..(283): xaa in position 282 to 283 is any amino acid
  Variant (287)..(287): xaa in position 287 is any amino acid
  Variant (298)..(299): xaa in position 298 to 299 is any amino acid
  Variant (304)..(305): xaa in position 304 to 305 is any amino acid
  Variant (307)..(307): xaa in position 307 is any amino acid
  Variant (318)..(318): xaa in position 318 is any amino acid
  Variant (320)..(321): xaa in position 320 to 321 is any amino acid
  Variant (323)..(323): xaa in position 323 is any amino acid
  Variant (325)..(326): xaa in position 325 to 326 is any amino acid
  Variant (331)..(331): xaa in position 331 is any amino acid
  Variant (339)..(339): xaa in position 339 is any amino acid
  Variant (343)..(344): xaa in position 343 to 344 is any amino acid
  Variant (346)..(347): xaa in position 346 to 347 is any amino acid
  Variant (350)..(356): xaa in position 350 to 356 is any amino acid
  Variant (358)..(360): xaa in position 358 to 360 is any amino acid
  Variant (363)..(367): xaa in position 363 to 367 is any amino acid
  Variant (370)..(374): xaa in position 370 to 374 is any amino acid
  Variant (381)..(398): xaa in position 381 to 398 is any amino acid
  Variant (400)..(401): xaa in position 400 to 401 is any amino acid
  Variant (403)..(409): xaa in position 403 to 409 is any amino acid

SEQ ID NO: 59649 - protein, 137 aa, Artificial sequence; identical to SEQ ID NO: 6194
  Variant (1)..(1): xaa in position 1 is Lys, Arg or Gln
  Variant (2)..(2): xaa in position 2 is Ile, Lys, Val or Leu
  Variant (3)..(6): xaa in position 3 to 6 is any amino acid
  Variant (7)..(7): xaa in position 7 is Pro, Ser or Thr
  Variant (8)..(8): xaa in position 8 is Ile, Val or Leu
  Variant (9)..(9): xaa in position 9 is Val or Ala
  Variant (10)..(10): xaa in position 10 is Glu or Asp
  Variant (11)..(11): xaa in position 11 is Met, Leu, Ile or Val
  Variant (12)..(12): xaa in position 12 is Asp, Gln or Leu
  Variant (16)..(16): xaa in position 16 is Met or Gln
  Variant (17)..(17): xaa in position 17 is Thr or Ala
  Variant (18)..(18): xaa in position 18 is Arg or Lys
  Variant (19)..(19): xaa in position 19 is Ile or Val
  Variant (20)..(20): xaa in position 20 is Ile, Phe or Met
  Variant (22)..(23): xaa in position 22 to 23 is any amino acid
  Variant (24)..(24): xaa in position 24 is Ile or Val
  Variant (25)..(25): xaa in position 25 is Lys, Arg or Gln
  Variant (26)..(27): xaa in position 26 to 27 is any amino acid
  Variant (28)..(28): xaa in position 28 is Leu or Phe
  Variant (29)..(29): xaa in position 29 is Ile, Val or Leu
  Variant (30)..(30): xaa in position 30 is any amino acid
  Variant (31)..(31): xaa in position 31 is Pro or Thr
  Variant (32)..(32): xaa in position 32 is Tyr, Phe, His or Asn
  Variant (33)..(33): xaa in position 33 is Leu, Val or Met
  Variant (34)..(34): xaa in position 34 is Asp, Glu or Asn
  Variant (35)..(35): xaa in position 35 is Leu, Val, Ile or Met
  Variant (36)..(38): xaa in position 36 to 38 is any amino acid
  Variant (39)..(39): xaa in position 39 is Tyr, Phe, Ser or Thr
  Variant (40)..(40): xaa in position 40 is Tyr or Phe
  Variant (41)..(41): xaa in position 41 is Asp or Ser
  Variant (43)..(43): xaa in position 43 is Gly or Ser
  Variant (44)..(44): xaa in position 44 is Ile, Leu, Val or Met
  Variant (45)..(46): xaa in position 45 to 46 is any amino acid
  Variant (48)..(48): xaa in position 48 is Asp or Asn
  Variant (49)..(49): xaa in position 49 is any amino acid
  Variant (51)..(51): xaa in position 51 is any amino acid
  Variant (53)..(53): xaa in position 53 is Gln, Lys or Arg
  Variant (54)..(54): xaa in position 54 is Val or Ile
  Variant (56)..(56): xaa in position 56 is any amino acid
  Variant (57)..(57): xaa in position 57 is Asp or Glu
  Variant (58)..(58): xaa in position 58 is Ser, Ala or Thr
  Variant (59)..(59): xaa in position 59 is Ala or Ser
  Variant (60)..(60): xaa in position 60 is any amino acid
  Variant (61)..(61): xaa in position 61 is Ala or Glu
  Variant (62)..(62): xaa in position 62 is any amino acid
  Variant (63)..(63): xaa in position 63 is Lys, Leu, Gln or Met
  Variant (64)..(64): xaa in position 64 is Lys, Glu, Gln or Arg
  Variant (65)..(65): xaa in position 65 is Tyr, His or Val
  Variant (66)..(66): xaa in position 66 is any amino acid
  Variant (67)..(67): xaa in position 67 is Val, Met or Ile
  Variant (68)..(68): xaa in position 68 is Gly or Ala
  Variant (69)..(69): xaa in position 69 is Val or Ile
  Variant (77)..(77): xaa in position 77 is Asp or Asn
  Variant (78)..(78): xaa in position 78 is Glu, Ala, Ser or Gln
  Variant (79)..(79): xaa in position 79 is any amino acid
  Variant (81)..(81): xaa in position 81 is Val, Met, Ile or Leu
  Variant (82)..(82): xaa in position 82 is any amino acid
  Variant (84)..(84): xaa in position 84 is Phe or Tyr
  Variant (85)..(85): xaa in position 85 is any amino acid
  Variant (88)..(88): xaa in position 88 is any amino acid
  Variant (91)..(91): xaa in position 91 is Lys, Arg or Leu
  Variant (95)..(95): xaa in position 95 is Gly or Ala
  Variant (97)..(97): xaa in position 97 is Ile or Leu
  Variant (99)..(99): xaa in position 99 is Asn, Ser or Ala
  Variant (100)..(100): xaa in position 100 is Ile, Ala or Tyr
  Variant (101)..(101): xaa in position 101 is Leu or Ile
  Variant (102)..(102): xaa in position 102 is Gly, Asn or Asp
  Variant (104)..(104): xaa in position 104 is Thr or Val
  Variant (105)..(105): xaa in position 105 is Val or Ile
  Variant (108)..(108): xaa in position 108 is any amino acid
  Variant (109)..(109): xaa in position 109 is Pro, Ala or Ser
  Variant (111)..(111): xaa in position 111 is Ile, Val, Leu or Met
  Variant (112)..(112): xaa in position 112 is Cys, Ile, Val or Met
  Variant (113)..(114): xaa in position 113 to 114 is any amino acid
  Variant (115)..(115): xaa in position 115 is Ile, Val or Leu
  Variant (117)..(117): xaa in position 117 is Arg, Lys or Pro
  Variant (118)..(118): xaa in position 118 is Leu, Ile, Ala or Tyr
  Variant (119)..(119): xaa in position 119 is Val, Ile or Leu
  Variant (120)..(121): xaa in position 120 to 121 is any amino acid
  Variant (123)..(124): xaa in position 123 to 124 is any amino acid
  Variant (125)..(125): xaa in position 125 is Pro or Ala
  Variant (127)..(127): xaa in position 127 is Ile, Cys, Val or Thr
  Variant (128)..(128): xaa in position 128 is Ile or Val
  Variant (129)..(129): xaa in position 129 is Gly or Ala
  Variant (133)..(133): xaa in position 133 is Phe, His or Tyr
  Variant (134)..(134): xaa in position 134 is Gly or Ala
  Variant (136)..(136): xaa in position 136 is Gln, Ile or Leu

SEQ ID NO: 59650 - protein, 166 aa, Artificial sequence; identical to SEQ ID NO: 6195
  Variant (1)..(1): xaa in position 1 is Met or Gln
  Variant (2)..(2): xaa in position 2 is Tyr, His or Phe
  Variant (4)..(6): xaa in position 4 to 6 is any amino acid
  Variant (8)..(8): xaa in position 8 is Ile or Val
  Variant (9)..(10): xaa in position 9 to 10 is any amino acid
  Variant (13)..(13): xaa in position 13 is any amino acid
  Variant (14)..(14): xaa in position 14 is Ala or Ser
  Variant (15)..(15): xaa in position 15 is Ser or Cys
  Variant (16)..(16): xaa in position 16 is Phe, Met, Leu or Ile
  Variant (17)..(18): xaa in position 17 to 18 is any amino acid
  Variant (19)..(19): xaa in position 19 is Ala, Gly or Ser
  Variant (20)..(20): xaa in position 20 is Leu, Tyr, Ile or Phe
  Variant (21)..(25): xaa in position 21 to 25 is any amino acid
  Variant (26)..(26): xaa in position 26 is Leu, Val or Ile
  Variant (27)..(27): xaa in position 27 is Tyr, Phe or Trp
  Variant (28)..(28): xaa in position 28 is Leu, Met, Phe or Ser
  Variant (29)..(29): xaa in position 29 is Ser, Thr or Ala
  Variant (32)..(32): xaa in position 32 is Asn, Asp or Ser
  Variant (35)..(35): xaa in position 35 is Leu, Ser or Met
  Variant (37)..(37): xaa in position 37 is any amino acid
  Variant (39)..(39): xaa in position 39 is Asp or His
  Variant (40)..(40): xaa in position 40 is Gly, Ala or His
  Variant (41)..(41): xaa in position 41 is any amino acid
  Variant (43)..(43): xaa in position 43 is Lys or Arg
  Variant (44)..(44): xaa in position 44 is Asp or Ala
  Variant (45)..(45): xaa in position 45 is Ile, Val, Leu or Thr
  Variant (47)..(49): xaa in position 47 to 49 is any amino acid
  Variant (50)..(50): xaa in position 50 is Tyr, Phe, Ala or Val
  Variant (51)..(56): xaa in position 51 to 56 is any amino acid
  Variant (57)..(57): xaa in position 57 is any or no amino acid
  Variant (58)..(58): xaa in position 58 is Phe, Tyr or Leu
  Variant (59)..(61): xaa in position 59 to 61 is any amino acid
  Variant (62)..(62): xaa in position 62 is Gly, Lys, Asn or Ser
  Variant (63)..(63): xaa in position 63 is Ile, Leu or Val
  Variant (64)..(64): xaa in position 64 is any amino acid
  Variant (66)..(66): xaa in position 66 is any amino acid
  Variant (67)..(67): xaa in position 67 is His or Tyr
  Variant (68)..(68): xaa in position 68 is any amino acid
  Variant (73)..(73): xaa in position 73 is Met or Ala
  Variant (74)..(74): xaa in position 74 is Val or Ala
  Variant (76)..(77): xaa in position 76 to 77 is any amino acid
  Variant (78)..(78): xaa in position 78 is Leu, Ile, Met or Val
  Variant (79)..(79): xaa in position 79 is Lys or Arg
  Variant (80)..(80): xaa in position 80 is Ser or Trp
  Variant (81)..(81): xaa in position 81 is any amino acid
  Variant (83)..(83): xaa in position 83 is Gly or Ala
  Variant (84)..(84): xaa in position 84 is Tyr, Phe or Met
  Variant (85)..(85): xaa in position 85 is Val, Ile or Leu
  Variant (86)..(86): xaa in position 86 is Trp, Met, Ile or Leu
  Variant (88)..(88): xaa in position 88 is Cys, Leu, Met or Phe
  Variant (89)..(89): xaa in position 89 is Lys or Met
  Variant (92)..(92): xaa in position 92 is Asp or Glu
  Variant (95)..(95): xaa in position 95 is Val or Ile
  Variant (96)..(96): xaa in position 96 is Gln, Met or Glu
  Variant (99)..(99): xaa in position 99 is any amino acid
  Variant (100)..(100): xaa in position 100 is Val, Leu or Ile
  Variant (102)..(102): xaa in position 102 is Gln, Ser or Thr
  Variant (103)..(103): xaa in position 103 is Gly or Ala
  Variant (104)..(104): xaa in position 104 is Phe or Tyr
  Variant (108)..(108): xaa in position 108 is Gly or Ala
  Variant (109)..(109): xaa in position 109 is Leu or Met
  Variant (111)..(111): xaa in position 111 is Thr or Ser
  Variant (113)..(113): xaa in position 113 is Val, Ile, Thr or Ala
  Variant (115)..(116): xaa in position 115 to 116 is any amino acid
  Variant (117)..(117): xaa in position 117 is Pro, Ser or Ala
  Variant (118)..(118): xaa in position 118 is Asp, Thr or Asn
  Variant (120)..(121): xaa in position 120 to 121 is any amino acid
  Variant (122)..(122): xaa in position 122 is any or no amino acid
  Variant (123)..(123): xaa in position 123 is Glu, Ala, Ile or Val
  Variant (124)..(124): xaa in position 124 is any amino acid
  Variant (127)..(127): xaa in position 127 is Ala or Ser
  Variant (133)..(133): xaa in position 133 is Arg or Lys
  Variant (135)..(135): xaa in position 135 is Tyr or Phe
  Variant (136)..(136): xaa in position 136 is Arg, Tyr or Met
  Variant (137)..(137): xaa in position 137 is any amino acid
  Variant (138)..(138): xaa in position 138 is His, Tyr or Trp
  Variant (139)..(139): xaa in position 139 is Gln or Leu
  Variant (140)..(140): xaa in position 140 is Lys, Gln, Ala or Arg
  Variant (141)..(141): xaa in position 141 is Gly or Asn
  Variant (142)..(143): xaa in position 142 to 143 is any amino acid
  Variant (148)..(148): xaa in position 148 is Ser or Pro
  Variant (149)..(149): xaa in position 149 is Ile or Val
  Variant (151)..(151): xaa in position 151 is Ser or Thr
  Variant (156)..(156): xaa in position 156 is Thr, Ser or Ala
  Variant (157)..(157): xaa in position 157 is any amino acid
  Variant (158)..(158): xaa in position 158 is Gly or Ala
  Variant (159)..(159): xaa in position 159 is Leu or Ile
  Variant (160)..(161): xaa in position 160 to 161 is any amino acid
  Variant (163)..(163): xaa in position 163 is Ala or Gly
  Variant (164)..(164): xaa in position 164 is any amino acid
  Variant (165)..(165): xaa in position 165 is Leu, Phe or Val

SEQ ID NO: 59651 - DNA, 2066 bp, Saccharomyces cerevisiae
  CDS (328)..(1800)
gcttaatctgttcggcgtattacagtgctcaactttccctttctcaatattttgttatgtgaattaggtcactaaaaattaaaacatttaagaaaaataaaagttccttccacagacgaaacactgtatatgcttcctcccagctctatttacctaattagtgacctgattaaacttttggaaagaagcattttcctcgagatttccaaacggtgcgggaaaatggcaagtgaggaaaaaaaaaactggcctaaaatattcgatgaggttaagagaagagctggttcttcaccaagtgtttcactgagaagttagctacgaaaaagcatgaatttctacagggatgcaacatgggtgctagaagatattgagaaggaggctgcaaaagaaaggatttccggctctatgcagacgctggtactgaaaagctgtaaaagatataagctgaaaagtaatccaaaacatatttatgcagttctcgattcgtgttggaaatataaaccatatttggagaaagtgatgaaaaaggcacacatattggaagatatacccaagaaaaagggcaaaccactcttttcaaggctaactttgttattgctttgccatgatttgctgttgtctaagcagaaaagaattcaaatgggcaaacaccccatcaaagattatgttttgaagtttaagagcccattgcatagcgaaatggtcaaattgaaactcaaattgaaagtaagagagctatctgagttggtattaagcgaggatatttccaatgaccttcctcctgttagatggattagaatcaatccattaaaatgccatccaaatggtgagactgagccggtgttagccgaattgaggaagaagtttactttaaaggtagacaaatggtctgaactagttcctgggtctatctattatgatgagtttattccaaacttgtttggaattcatccgtctgacaaaattacagcacatgagctttataagcatgggaagattatcattcaagatcgtgcttcttgttttccagcccacattttgaatccaggaccaagtgatattgtgatagattcctgctctgctccaggtaataagactacccatacggcctcttatatatatcccgaaccaccgaaggacaataatactcgaatatacgctttcgagaaggatcctgaaagagcaaaagttttacaaaaaatgatcaagatagctggctgttctcccaacatcagtgtcaatgtaggtgattttacaaagctcgctactcctgaaaaatataaggacgttacttgttttattgtagatccgagctgctccggtagcggtatatttggtcgtaagttttttgactcatttaatagaaggaaaattgatgataaagatgacgatggtggcattgtgccggatgagcaagaggagtttatagcaaaggaagaactacagacaaggttagcgaagctgagttcatttcagttccagatggtaaagcatgcaatgagtttcccagcggctaaaaaaatagtatacagcacatgttccattcatgcggaagaaaatgaacgagtcgtcatagaccttcttttagataagtcagttagagaatggggttggaaagtagcgccaaaaagagaagttattccttcttggcctagaagaggcaaggtagaagagttcgaagaggtttttagagatggagtcacctatgaccctcaacagcttgccgagggttgtatcagggcactaccaaaaagtgacggtggtattggtttctttgctgtctgttttgaaagagattaaactttcagaacattcatgtatatatgtgtatatctgatatgtattattgcatttttgctgtagtactacggaaaagacatttcaataatctatacatcccgcacataaaggaagattttcgggtaatatactattataaaaattatcgatgagctctgtgaaaaggtcgtaaatataaaagttctttcttgcgacagtggcaacaaccaagtgaaacagcgtgagacgagactgctctaatctatttgcagtcgtaggcattacaa

SEQ ID NO: 59652 - protein, 490 aa, Saccharomyces cerevisiae
MNFYRDATWVLEDIEKEAAKERISGSMQTLVLKSCKRYKLKSNPKHIYAVLDSCWKYKPYLEKVMKKAHILEDIPKKKGKPLFSRLTLLLLCHDLLLSKQKRIQMGKHPIKDYVLKFKSPLHSEMVKLKLKLKVRELSELVLSEDISNDLPPVRWIRINPLKCHPNGETEPVLAELRKKFTLKVDKWSELVPGSIYYDEFIPNLFGIHPSDKITAHELYKHGKIIIQDRASCFPAHILNPGPSDIVIDSCSAPGNKTTHTASYIYPEPPKDNNTRIYAFEKDPERAKVLQKMIKIAGCSPNISVNVGDFTKLATPEKYKDVTCFIVDPSCSGSGIFGRKFFDSFNRRKIDDKDDDGGIVPDEQEEFIAKEELQTRLAKLSSFQFQMVKHAMSFPAAKKIVYSTCSIHAEENERVVIDLLLDKSVREWGWKVAPKREVIPSWPRRGKVEEFEEVFRDGVTYDPQQLAEGCIRALPKSDGGIGFFAVCFERD

SEQ ID NO: 59653 - DNA, 1290 bp, Homo sapiens
  CDS (1)..(1290)
atggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtga

SEQ ID NO: 59654 - protein, 429 aa, Homo sapiens
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPR

SEQ ID NO: 59655 - DNA, 1314 bp, Archaeoglobus fulgidus DSM 4304
  CDS (1)..(1314): transl_table=11
atgtccgcacgctcagatggtagtaatgtgattcccacccaggagattgctgcaaaggttctggccgaggtcgagaggagcagaatttcggtaaagtcggctgttcagaagcttgccgggggctttgactacaaggtaaggggtagcgttcacgcctacagcgttgaaactctcaagaggctcaacgcaatagactacttccttaaatcaaccctcaaaaaattcgacgggctcgacccgtttaccagaaacctgctcaggattgccgtttacgagatgaagtacaaaggcgtgcatccagctctcgccacagattctgctgtgagaattgcaagggaaaggggaaaggcctctcttgttaatgcggttctccgcaaagtggaaaagcttgatattcaggcagagggcaggctgaaggaactttccctcacatacttccacccagagtggtttgtaaagtacgccatcgaacttctcggtgaggatggggcgctgaagctgatgaaggcaaacctgaggaatcccccaacttacgtgagggttaatgagctgaaagggtctgtggaatctgttagagagtatctggagaagaacggcgtcattctggaggagacttttctggatgaggttttccgcgttaaaggttacgaaaagcatccagcctcacttgactggcactcggaaggaaagtacgttatacaggacctggcatcgtgcttcgtttcgcatgccctcaacccatctccgggagacgtggtcatcgaccttgccgccgctccaggaatgaagaccgcccacatggcgatgctgatgcaaaatgaaggaagaatcgtggcggttgacaactctccgagcagggtgcgaaggatgaggagcaagctgaagcagcttggtgtcaaaaacgttgagataaagctcggcgatggatgcgtttttgagtgtgaggctgacaaggctctcgtcgatgcaccgtgctcctcaactggcaactacgcatcccagccaaacgtcaagtggacgttcgacgaaagaaagttcagagctacaatgaaggttcagaggaagatgattgccaacgccctgaggaatgccgatgaagtcgtttatgcaacctgcagcataaccttcgaggagaatgaggagaatctgctcaaaaccggggcgaagattctgcccctcccctcgcccttcggaaggggtgtaagggagtttagaggtgtgctgttcagggactgggaaaaggtcgtgagaagctttccacatctccacgatactgcggggttcttcatctcaaagctgacccgcgatggttag

SEQ ID NO: 59656 - protein, 437 aa, Archaeoglobus fulgidus DSM 4304
MSARSDGSNVIPTQEIAAKVLAEVERSRISVKSAVQKLAGGFDYKVRGSVHAYSVETLKRLNAIDYFLKSTLKKFDGLDPFTRNLLRIAVYEMKYKGVHPALATDSAVRIARERGKASLVNAVLRKVEKLDIQAEGRLKELSLTYFHPEWFVKYAIELLGEDGALKLMKANLRNPPTYVRVNELKGSVESVREYLEKNGVILEETFLDEVFRVKGYEKHPASLDWHSEGKYVIQDLASCFVSHALNPSPGDVVIDLAAAPGMKTAHMAMLMQNEGRIVAVDNSPSRVRRMRSKLKQLGVKNVEIKLGDGCVFECEADKALVDAPCSSTGNYASQPNVKWTFDERKFRATMKVQRKMIANALRNADEVVYATCSITFEENEENLLKTGAKILPLPSPFGRGVREFRGVLFRDWEKVVRSFPHLHDTAGFFISKLTRDG

SEQ ID NO: 59657 - DNA, 1704 bp, Arabidopsis thaliana
  CDS (1)..(1704)
atggtggcgcgtcgtaacaaaccaaaagcgccgctggtgaaacaccgattttccggcggcgacagtcacaaaccaaaaccaccaccggctactaaacaaccattttccggcgtcgagagccacaaaccaaaaacatcaccagctacaaagcaaaagttttccggcgtcgagagtcacaaaccaaaaacgccgccgggaaaacaacgattttccggcgccgagagtcgcaaaccaaaaacaccaccagctactaagcaaaagttttccagcttagagagatcagctctctacgccagaagagaagcagctaatatactccgtaccgttctccgtggtgacgccgagcgacgagccgttgcttccatcaaatcactcgtcttaagtccttccgttcgcaacaaacgcggcactttcgctcttgtctgcgagactctcaaatatcttactgtgattaaagatgttcttgatatagctaatgtattgaatagtaaatggaagaggcaagagccattggtcttcatcgtttgctacgatatcctctttggcaaggatactccatcaattggtgatgcagagaagtttcttatgcggcataaagaggcgttattgtcaggtttagctacgcttttagtgaggaagaaagtcgatagtgttgatcagttgttgggttctaagcttactggtcatttgaaaccacggtatgttcgtgttaatacgcttaagatggatgtggattctgcagtgcaggagctggagaagcattacacggtgcagaaggacgagacagttcctgacttgttggtgttgccccctggcagcgatttgcatgctcatcgtttggttgcgaatggacgtatatttttgcaggggaaagcaagttcaatggtagcagcagcactgcagccacaagcaggatgggaggttcttgatgcctgttcagctccaggaaacaaaactattcatcttgctgctcttatggaaggacaaggaaaaatcatagcatgtgagctaaatgaagaacgagttaagcgtttggaacatactataaagctctctggtgcctccaatatcgaagtctgtcatggtgattttttgggcctaaatccgaaagatccttcttttgcgaagattcgggctatattgttggatccttcttgctctggctctggcacgattacagatcgtttggaccatctccttccttctcattcagaagataataacatgaactatgactccatgagactgcacaagctcgctgttttccagaaaaaggctcttgcccatgcactctcctttccaaaggttgagagagtcgtatacagcacatgctccatctaccaaatagaaaacgaagatgtcgtctcctctgttttacctctggcatcatccttgggcttcaaacttgctaccccctttcctcagtggcagcgtcgtggtctccctgtatttgcaggatctgaacatctacttaggatggatccggtggaggacaaagaagggttcttcatcgctttattcgtcagggcaaacaaactcgataacccaaaatcgtctgaacttcccgatagagtgtgtagacgaagacccaaagaaagaaccatgcagttacatccctatctttgtcccaaaatgttcagagcttggagtgggaccttgcacaggctcaagactaggttcctgttatcacgtaatggttgttga

SEQ ID NO: 59658 - protein, 567 aa, Arabidopsis thaliana
MVARRNKPKAPLVKHRFSGGDSHKPKPPPATKQPFSGVESHKPKTSPATKQKFSGVESHKPKTPPGKQRFSGAESRKPKTPPATKQKFSSLERSALYARREAANILRTVLRGDAERRAVASIKSLVLSPSVRNKRGTFALVCETLKYLTVIKDVLDIANVLNSKWKRQEPLVFIVCYDILFGKDTPSIGDAEKFLMRHKEALLSGLATLLVRKKVDSVDQLLGSKLTGHLKPRYVRVNTLKMDVDSAVQELEKHYTVQKDETVPDLLVLPPGSDLHAHRLVANGRIFLQGKASSMVAAALQPQAGWEVLDACSAPGNKTIHLAALMEGQGKIIACELNEERVKRLEHTIKLSGASNIEVCHGDFLGLNPKDPSFAKIRAILLDPSCSGSGTITDRLDHLLPSHSEDNNMNYDSMRLHKLAVFQKKALAHALSFPKVERVVYSTCSIYQIENEDVVSSVLPLASSLGFKLATPFPQWQRRGLPVFAGSEHLLRMDPVEDKEGFFIALFVRANKLDNPKSSELPDRVCRRRPKERTMQLHPYLCPKMFRAWSGTLHRLKTRFLLSRNGC

SEQ ID NO: 59659 - DNA, 2103 bp, Caenorhabditis elegans
  CDS (1)..(2103)
atgaaagacgagccaatcatggcctgcgccgaagagaatcccgacgaaaaacccaaatgcaaccccttcggaacccgatttttgaccgatgacaccaaagttttcgagcacaacgcatgggacgacgtggaatggtccccagagcaacaggaagaagctcagcggattgtgcaaggtcaaaagtcgatgaaggttgatgaggagaaggcgatgcggcttttaagcaccccagcggatcaatgggatgctttttatgctcataatgagaatagattcttcaaagacaggaattggctgttaaaagagttcccagagcttaatgtggaggatgagagtaatttacagaaagaaaagatagaaatactggaagttggctgtggcgtcggaaataccacgttcccactgctccaagtgaacaattccagctcccggctcatgctgcacagctgtgattatgctccaaacgcgattcgagtcctgaaatcccaggacgcctacgatccggagaaaatgaacgcatttgtgtgggatatcacgcaaccggcttcccaggaggctccaaacgtcggatctctagactatattgtgtgtatctacgtgctgtcggctatccatccggataatatcaaaaatgctctgaaaaatctcgtccggctgctcaaacccggtggaagtctgctgctcaaagactacgggagatacgatttaacgcagttgcgattcaaaaaagatcgactaatcgacggaaatttgtactgccgaggagacggaaccctggtctatttcttcgatatggaagagttggagacgctgctcgccgagcacgggcttcagaagaaagtgatgcacgtggatcgacggctcattgtgaatcgagcgaaacaaaacaaaaaggcgcttctccgactttcgtgtgaatcgctcaaatttcggccggttttcgatgaaattctacaagataaggagctaaaatcgatgaaacgcgatgcgaatatcggtggatccgtcgagctgctctatgtgctcatgtatgagacacttgttggctccggattgaccagatgctctcaggagttgaaatctgtaatttcaaggagaattcagaggattaaggaggtggagcacgcgatgcaagacgagggaagaggaattaaggcgatgaaagaagcggacgatggaatgaaaaagatccaaatcccccgatatgcgcgtatcaatacactgaaatggactgcagatgaagctatgaagactctcgaaaccgaaaaatggaagattctcgggacactgaaacccgagaatttcgcggaaatggtgacaaaaatgaaggatgatgaggtgtatgtggatccgcatgtcgagaatttgattatttttgcgccgaatattcagaatttttatgaatattggatggttgagcagagatatttgattttacaggataaggcttcatgtctcccggccttcctgctcaatccacgtcccggctcccaagtattcgacacgtgtgcagctcctggaatgaagacgagccatgcggcggcaattatggagaatcagggaaaagtatgggcgatggatcgtgcggcggaccgtgtagccactatgaagcagctccttgacgcctcgaaagtcgcaatcgccagctcattttgtggagattttctgaaaactgacgtcactgataagaaattttcaaaggtcaaattcgcgattgtagaccctccgtgctctggatcaggaattgttaagcgaatggatgagattacaggaggaaatgcggagaaggagcgcctcgagaagcttaaaaatttgcaggcaatgatcctaaagcacgctctgaagcttcccggcctgaaacgagccgtctactcaacatgctctgtacacgaagaagaaaatgagcaagttgttgatgaagtgctcctggacacgtatgtccgtcaaaattatgtgctcaagaagaatgtgctcccagaatggacatatcgcggactgaagacctatgaagttggagaacattgtttgagagcaaatccgaaggtcacacttaccaatggattttttgtcgctgtttttgaacgggtcaagagctcggaataa

SEQ ID NO: 59660 - protein, 700 aa, Caenorhabditis elegans
MKDEPIMACAEENPDEKPKCNPFGTRFLTDDTKVFEHNAWDDVEWSPEQQEEAQRIVQGQKSMKVDEEKAMRLLSTPADQWDAFYAHNENRFFKDRNWLLKEFPELNVEDESNLQKEKIEILEVGCGVGNTTFPLLQVNNSSSRLMLHSCDYAPNAIRVLKSQDAYDPEKMNAFVWDITQPASQEAPNVGSLDYIVCIYVLSAIHPDNIKNALKNLVRLLKPGGSLLLKDYGRYDLTQLRFKKDRLIDGNLYCRGDGTLVYFFDMEELETLLAEHGLQKKVMHVDRRLIVNRAKQNKKALLRLSCESLKFRPVFDEILQDKELKSMKRDANIGGSVELLYVLMYETLVGSGLTRCSQELKSVISRRIQRIKEVEHAMQDEGRGIKAMKEADDGMKKIQIPRYARINTLKWTADEAMKTLETEKWKILGTLKPENFAEMVTKMKDDEVYVDPHVENLIIFAPNIQNFYEYWMVEQRYLILQDKASCLPAFLLNPRPGSQVFDTCAAPGMKTSHAAAIMENQGKVWAMDRAADRVATMKQLLDASKVAIASSFCGDFLKTDVTDKKFSKVKFAIVDPPCSGSGIVKRMDEITGGNAEKERLEKLKNLQAMILKHALKLPGLKRAVYSTCSVHEEENEQVVDEVLLDTYVRQNYVLKKNVLPEWTYRGLKTYEVGEHCLRANPKVTLTNGFFVAVFERVKSSE

SEQ ID NO: 59661 - DNA, 1320 bp, Caenorhabditis elegans
  CDS (1)..(1320)
atggcaaccgatgcgctgtacaacgaggtcgccgaaattatccgctgcgttttggccaaggagaaaagtgtgagaaatgcggtctacgggagttcgtataaaaacaaaaaggcgcttctccgactttcgtgtgaatcgctcaaatttcggccggttttcgatgaaattctacaagataaggagctaaaatcgatgaaacgcgatgcgaatatcggtggatccgtcgagctgctctatgtgctcatgtatgagacacttgttggctccggattgaccagatgctctcaggagttgaaatctgtaatttcaaggagaattcagaggattaaggaggtggagcacgcgatgcaagacgagggaagaggaattaaggcgatgaaagaagcggacgatggaatgaaaaagatccaaatcccccgatatgcgcgtatcaatacactgaaatggactgcagatgaagctatgaagactctcgaaaccgaaaaatggaagattctcgggacactgaaacccgagaatttcgcggaaatggtgacaaaaatgaaggatgatgaggtgtatgtggatccgcatgtcgagaatttgattatttttgcgccgaatattcagaatttttatgaatattggatggttgagcagagatatttgattttacaggataaggcttcatgtctcccggccttcctgctcaatccacgtcccggctcccaagtattcgacacgtgtgcagctcctggaatgaagacgagccatgcggcggcaattatggagaatcagggaaaagtatgggcgatggatcgtgcggcggaccgtgtagccactatgaagcagctccttgacgcctcgaaagtcgcaatcgccagctcattttgtggagattttctgaaaactgacgtcactgataagaaattttcaaaggtcaaattcgcgattgtagaccctccgtgctctggatcaggaattgttaagcgaatggatgagattacaggaggaaatgcggagaaggagcgcctcgagaagcttaaaaatttgcaggcaatgatcctaaagcacgctctgaagcttcccggcctgaaacgagccgtctactcaacatgctctgtacacgaagaagaaaatgagcaagttgttgatgaagtgctcctggacacgtatgtccgtcaaaattatgtgctcaagaagaatgtgctcccagaatggacatatcgcggactgaagacctatgaagttggagaacattgtttgagagcaaatccgaaggtcacacttaccaatggattttttgtcgctgtttttgaacgggtcaagagctcggaataa

SEQ ID NO: 59662 - protein, 439 aa, Caenorhabditis elegans
MATDALYNEVAEIIRCVLAKEKSVRNAVYGSSYKNKKALLRLSCESLKFRPVFDEILQDKELKSMKRDANIGGSVELLYVLMYETLVGSGLTRCSQELKSVISRRIQRIKEVEHAMQDEGRGIKAMKEADDGMKKIQIPRYARINTLKWTADEAMKTLETEKWKILGTLKPENFAEMVTKMKDDEVYVDPHVENLIIFAPNIQNFYEYWMVEQRYLILQDKASCLPAFLLNPRPGSQVFDTCAAPGMKTSHAAAIMENQGKVWAMDRAADRVATMKQLLDASKVAIASSFCGDFLKTDVTDKKFSKVKFAIVDPPCSGSGIVKRMDEITGGNAEKERLEKLKNLQAMILKHALKLPGLKRAVYSTCSVHEEENEQVVDEVLLDTYVRQNYVLKKNVLPEWTYRGLKTYEVGEHCLRANPKVTLTNGFFVAVFERVKSSE

SEQ ID NO: 59663 - DNA, 1368 bp, Schizosaccharomyces pombe 972h-
  CDS (1)..(1368)
atggatttttataatcatgctgccaacatactttcagatttaagtaaaaaaaaaggatcaattaagcaattagcatttaattcaaaaaaacatgatccaaaacgcacttatgctttggtttgcgaaactctcaaatataaacctgttttggatgaaataattgcgcgatccgattgtttcttaaaagaaaatttggctagagtccttgtccatgatttactgatgtcaaagcgagggttatccatttcaaatggtcctatcaaggaatgcattcttcgtcacaagacacgcctgaacgccgagtttgtcaaactcaaggtgaaaaaaggggttaagagccatgaggagctggcattgaaaaatcctgtgtcgctccctcgctggcttcgaataaataccattaaaagcacaaaagacgaggttttgcaaggtttaggcttggataaagtcagttcaattgaggaactgggccccgacaaattttatattgatgattgtgttgaaaacttaatagccatcgatccatcatttcctatagttgaaaattcattgtacaaggaggggaaagtgattattcaggacaaggcatcttgttttcctgctgctgtattggccgggctaactggtcacgttggtgatataatagatggatgtgctgctccagggaacaaaactactcatttagctgcttgttttccaaaatctcatatatttgcatttgaacgtgacgcgaaaagagtgcagacacttcgaaaaatggtgggaatatcaggcgctaataatgtcaccatcgaacatcaagattttaccctaactgatcccaagagtgatctttaccgaaatgtcactcatatcctgcttgatccttcttgttctggttctggaattgtgagtcgtcaagactatctgctgggtaatgaacaagacgttacggaagataccgaaagacttgaaaatttgtgtagttttcagtctaccattttaaagcatgctttacaatttcctaactgccgccatgtcacatattctacatgttcagtgcaccgtttagaaaacgaacaagtagtatgtgaggttttgtcgcaagaacctgactggaaatgtaactctttgacaaaaactctacccaactggaaaactcgaggaattccagagtattgtgctcaaccttcaatggctgaaggaatgattcggtgtaaaccaggagccggaggtactattggtttttttgtagccaatttgtatcaccctcaaagagagcaagaaactttcaaaatgtataaaaatgatgatgataccaaaaagcgtaagcgcaaaaagaaaaagaaggaagtgaagaaaaaggctcgcatacaaggtgaagagtaa

SEQ ID NO: 59664 - protein, 455 aa, Schizosaccharomyces pombe 972h-
MDFYNHAANILSDLSKKKGSIKQLAFNSKKHDPKRTYALVCETLKYKPVLDEIIARSDCFLKENLARVLVHDLLMSKRGLSISNGPIKECILRHKTRLNAEFVKLKVKKGVKSHEELALKNPVSLPRWLRINTIKSTKDEVLQGLGLDKVSSIEELGPDKFYIDDCVENLIAIDPSFPIVENSLYKEGKVIIQDKASCFPAAVLAGLTGHVGDIIDGCAAPGNKTTHLAACFPKSHIFAFERDAKRVQTLRKMVGISGANNVTIEHQDFTLTDPKSDLYRNVTHILLDPSCSGSGIVSRQDYLLGNEQDVTEDTERLENLCSFQSTILKHALQFPNCRHVTYSTCSVHRLENEQVVCEVLSQEPDWKCNSLTKTLPNWKTRGIPEYCAQPSMAEGMIRCKPGAGGTIGFFVANLYHPQREQETFKMYKNDDDTKKRKRKKKKKEVKKKARIQGEE

SEQ ID NO: 59665 - DNA, 1302 bp, Drosophila melanogaster
  CDS (1)..(1302)
atgagtaaaaaaccgcattccataaaagttcccacccaatacagggcgactgccaagattttgaaggcggcactggagcagcagaagtgcatcaagaccctaatatttgcagagaagcatgcccgtacacgctctttgcatacggttctgaaaaaatttagcgaaaatcgtgtggcactggaaaaggccatcgaagagacaggactgctcagggacaatcccagttttgatcccagtttggccaagattctagtcaccgaactgctgtttggcaggaaggagctgaacggcgaaagcaaacccgtgcaaacggtgcgaagttacaaggatcgactgctaaattccatcagagatttcggtgtccagcgaaaagaacccaatcctcgatatgtgcgcatcaacacaaatctatacagcttggcggaggccttggactacctgcataaaagcgactggcggcgcaaggagctgcctgcggacgccagctatgcggattttctgactgccatcaaatcgctggcggagaacgagttcatgaccgatctgcacgttgagggtgtgctcatttttcctgccaagtggtccaactactgggtccgccatccgttggtgcacagcaagaggtttatactgcagaacaaggccacctgtttggccgccgaactacttgctccgccgtctggggccactgtgctggatatgtgcgcagctcccggtatgaagacagtgcacatatgcaatgtgatgcagaacaagggatgcatctactccgtggagcaggaccacgtacgctacaatacgctgtgcgaaataacaaaggatgctggttgcgatattgtaaaacccattttgggagacgccttgaacctaacacccgaacgctttccggacgtagagtacatcctggtggaccctagttgctctggcagcggaatgcaaaaccgcatgaccgtgtgcgacgagccgaaggaggacaagcggctgcaaaagctgcagggtttgcaaattaagatcctgtcgcacgcgatgggcgcctttccgaacgtcaaacgcattgcctactgcacgtgttcgctgtggaaggaggaaaacgagcaggtggtgcagcgttgtcttcagctaaatccatccttcaagctgctcagctgcaagaaggccttgcgcaacaagtggcacaatgtgggcgacaaggactatcccaatattggcaagaacgtcctgtattgccagccggacagtgatcttaccgatggcatcttcctggcccttttcgagaaacgccgcgagggcgaaaaggattag

SEQ ID NO: 59666 - protein, 433 aa, Drosophila melanogaster
MSKKPHSIKVPTQYRATAKILKAALEQQKCIKTLIFAEKHARTRSLHTVLKKFSENRVALEKAIEETGLLRDNPSFDPSLAKILVTELLFGRKELNGESKPVQTVRSYKDRLLNSIRDFGVQRKEPNPRYVRINTNLYSLAEALDYLHKSDWRRKELPADASYADFLTAIKSLAENEFMTDLHVEGVLIFPAKWSNYWVRHPLVHSKRFILQNKATCLAAELLAPPSGATVLDMCAAPGMKTVHICNVMQNKGCIYSVEQDHVRYNTLCEITKDAGCDIVKPILGDALNLTPERFPDVEYILVDPSCSGSGMQNRMTVCDEPKEDKRLQKLQGLQIKILSHAMGAFPNVKRIAYCTCSLWKEENEQVVQRCLQLNPSFKLLSCKKALRNKWHNVGDKDYPNIGKNVLYCQPDSDLTDGIFLALFEKRREGEKD

SEQ ID NO: 59667 - DNA, 1398 bp, Mus musculus
  CDS (1)..(1398)
atggggctgtacgcggccgccgcggcggtgctggccggcgtggaaagccgccagggctccctcaaggggttggtgtattccagcaacttccagaacctgaagcagttgtacgctctggtgtgcgagacgcagcgctactcggccgtgctggacgctgtcatcgccagtgctgggctccttcgcgccgagaagaagctgagaccgcaccttgccaaggtgctagtgtatgaattattgctggggaaggggtttcgagggggtggaggccgatggaaggctctgctgggccggcaccaggcaaggctcaaggctgagctggcccgactcaaggttcatcggggtgtgagccgaaatgaggacctgttgcaagagagctccagacctggccatgcctaccaggtaccacggttcgtgcgtgtgaacacgctcaagacccgccctgaggatgcaatcgattatttcaagagacaaggtttctcctaccagggtcgggcttccagcctggaagacttgcgagctctcaaggggcagcattttcttttggatcccttgctgcctgagcttcttgtatttcctgcacagacagatctgcacgagcatccactctaccgtgctggccatctcatcctgcaggacaaggccagctgcctcccagccatgctgctgtcccccccgccaggctcccatgtcattgatgcctgtgctgcccctggtaacaagaccagctacattgcagcccttctaaagaaccaggggaagatctttgctttcgaccaggacgctaagcggctggcagccatggcgacgttggtggctcgggctggggtctcttgctgcgagttagcagagaaggacttcctgacagtctctccctctgaccagcgttacagccaggtccagtacatcttgctggatccttcttgtagtggctctggcatgctgagccggcagctggaggaacatggggaaggcacacctagcaaggagcgcttgcaggccttggccgggttccagcagcgggctctgtgccatgcacttaggttcccctctctgcagcgcctagtctactccacgtgttccctttgccaagaagagaatgaagacgtggtccaggaggctctacagcacaactcggggacattcaggttggctcctgtcctacccacatggcctcaccgaggtctgagtacctttccagggtctgaacactgcctccgggcttcccctgagaccacgctcactggtggcttcttcattgctgtgtttgaacgtgcagaggtggtaccaaccccagccccacagaccgatgcaatggatccagaacctctcagccaagtcccaaagagaaagagaagacgcaaagcagcagttggtgccagcatgcagccaagcacatag

SEQ ID NO: 59668 - protein, 465 aa, Mus musculus
MGLYAAAAAVLAGVESRQGSLKGLVYSSNFQNLKQLYALVCETQRYSAVLDAVIASAGLLRAEKKLRPHLAKVLVYELLLGKGFRGGGGRWKALLGRHQARLKAELARLKVHRGVSRNEDLLQESSRPGHAYQVPRFVRVNTLKTRPEDAIDYFKRQGFSYQGRASSLEDLRALKGQHFLLDPLLPELLVFPAQTDLHEHPLYRAGHLILQDKASCLPAMLLSPPPGSHVIDACAAPGNKTSYIAALLKNQGKIFAFDQDAKRLAAMATLVARAGVSCCELAEKDFLTVSPSDQRYSQVQYILLDPSCSGSGMLSRQLEEHGEGTPSKERLQALAGFQQRALCHALRFPSLQRLVYSTCSLCQEENEDVVQEALQHNSGTFRLAPVLPTWPHRGLSTFPGSEHCLRASPETTLTGGFFIAVFERAEVVPTPAPQTDAMDPEPLSQVPKRKRRRKAAVGASMQPST

SEQ ID NO: 59669 - DNA, 1401 bp, Homo sapiens
  CDS (1)..(1401)
atggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatag

SEQ ID NO: 59670 - protein, 466 aa, Homo sapiens
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPSSASQAKASAPERTPSPAPKRKKRQQRAAAGACTPPCT

SEQ ID NO: 59671 - DNA, 1455 bp, Eremothecium gossypii
  CDS (1)..(1455)
atggagttctacagagatgccagttgggtgctagaatatatcgagcaagagtttgcacggaaaagcaaggtagctggatcgctgcacagccttgtactgcagagccataagaagtacaagctaaaaagcgacgtgcggcatgtgtacgctatcgttgcatcattctggaagtacaaggcatacctggatcgtattattgagaaaagtggcctgctgaaggacgtgcctcggaagaaaggggagccagcgttcaagcgctcgacgctgggcctggtggtacacgatctgctgctgtcgaagaagaagcggatccacatgggcaagcacccgctcaaggcgtttgtgctgaagcaccagaccaggctgcggggggagtacgcaaagcagctggtgaagctcggcgtcgcggacctgtcggtgctggtgcaggacgagcgggaggacgctacgcctgtccgctggataaggctgaacccgttccggatccgcgggcagcgcgaagaggtactacaggagctgcagaagaagtttcctcgccgcgttgcggactggagagagctcacccccggaagcatatacgaagatgaatatgtggcgggcctctatggagtacatcctgcggacaaaattacctcacacgagctgtacaagagagggaagatcatcatacaggaccgtgcatcgtgctttcccgcgcagatccttgcccctgggcgctcggacgttattatcgatgcatgtgctgctcctggtaataagacgactcacgtcgcagcgcatatctttccagagggaggggcagatcatgctcagatccacgcctttgagcgtgacccgcagcgtgcaaagacattgaggaagatgattgctacagcaggatgtgacaatgccattgaggtccatgttggcgacttcacacgagatgcgcaaccggagatattcaagaatgtgacgggattcattgtagaccccagctgctctggcagcggcatttttggtcgccaacttgtagatgccacgcaggagactcagaaggggacagagaccgatccttctgcggatgtgccggaagaggaaacgtttgaggccacaaagagcgcagtagagctgaagaacagactggcgaagttatcctcgttccaatttcaaatagtcaaacatgcgatgagctttcctagcgccaaaaagctaatttatagcacctgctccgtacatgccgaggagaatgaacgagtagtaattgatctccttctggatagtaaggtccagaaaggtggctggaaggttgcttcgcgctccaaggttatacctgcctggcctagaagaggacaccaagctgagtttgaggaagtcttccctgatcaggccgaggaattggccggcggttgcatcagagtgctgccgaaggaagacggtgggatcggcttctttgcggtgtgttttgagagagaataa

SEQ ID NO: 59672 - protein, 484 aa, Eremothecium gossypii
MEFYRDASWVLEYIEQEFARKSKVAGSLHSLVLQSHKKYKLKSDVRHVYAIVASFWKYKAYLDRIIEKSGLLKDVPRKKGEPAFKRSTLGLVVHDLLLSKKKRIHMGKHPLKAFVLKHQTRLRGEYAKQLVKLGVADLSVLVQDEREDATPVRWIRLNPFRIRGQREEVLQELQKKFPRRVADWRELTPGSIYEDEYVAGLYGVHPADKITSHELYKRGKIIIQDRASCFPAQILAPGRSDVIIDACAAPGNKTTHVAAHIFPEGGADHAQIHAFERDPQRAKTLRKMIATAGCDNAIEVHVGDFTRDAQPEIFKNVTGFIVDPSCSGSGIFGRQLVDATQETQKGTETDPSADVPEEETFEATKSAVELKNRLAKLSSFQFQIVKHAMSFPSAKKLIYSTCSVHAEENERVVIDLLLDSKVQKGGWKVASRSKVIPAWPRRGHQAEFEEVFPDQAEELAGGCIRVLPKEDGGIGFFAVCFERE

SEQ ID NO: 59673 - DNA, 1308 bp, Danio rerio
  CDS (1)..(1308)
atggcactttatttaaaagcggcagagattcttgagaaagtggagcagaaaagaggagcggtgaaaactctggtttatgacagtaaatttccaaatatcaagcagctctttgcacttgtgtgtgaaacacagaaatactcctcagttctgcaggagatcatcaacagcacaaagcttttaaaagaaaccaaactccggattcatttagccaaggtactggtgtatgacctgctcattggtcatggggtaaaatgcggaggcgcctggaagacgacgatgttaaagcatcgcgccagactacaagctgctctggccagaatcaaaatcaagaggaaagtgagtcgaaatcaggaccttctgccctccagcatccagcagacacagaatgatgtaattcctcgatatgtgcgagtgaacacgctgaaaacatctctggaagatgtcatcgactatttaaaacgagagggcttttcgtatcaagggacgccaggacggcttgaggatctcgatcgtctgtcggggaagatgtttctgtgtgatctccacctcaaagatcttctggtcttcagtggaaaaacagacttccatgatcacttcctgtataaagcaggacacattatattacaaggcaaggccagttgtcttcctgctttcctcttaaaccctccagtcggcagtcatgtcattgatgcttgcgcagctccaggaaacaaaaccagccatctagcagccataatgaaaaataaagggaagttgtttgccttcgatctggatgccaaacgtctgtccaccatgagcactcttctgctccgtgctggagtcacatgtcacaaactggccaatcaggatttcctcaaagtagatccacaaaactctgagtacaaggaggtcaagtacatccttctggacccgtcctgcagcggatcagggatggtttgtctgcgggacgagctccccgagacacaggaggacggtcgtctgcaggctctggctgcgtttcagcttcactgtctgtatcatgctctgcagtttcctcagctggagcggatcgtctattcaacctgctccatccactcgcaggagaacgaggaggttgtgacggcctgcttacagcggaaccctggattcagattagtgcatcttcttccagactggcctgagaggggtcatgagcctttgacccagtgtcttcgcgcgagcacagcaaaaacccgcactcatgggttcttcgtggccatgctggagagacgccctgcgcagtcagataaagaaacccccccctgtcaacacaccattgtcatctgctag

SEQ ID NO: 59674 - protein, 435 aa, Danio rerio
MALYLKAAEILEKVEQKRGAVKTLVYDSKFPNIKQLFALVCETQKYSSVLQEIINSTKLLKETKLRIHLAKVLVYDLLIGHGVKCGGAWKTTMLKHRARLQAALARIKIKRKVSRNQDLLPSSIQQTQNDVIPRYVRVNTLKTSLEDVIDYLKREGFSYQGTPGRLEDLDRLSGKMFLCDLHLKDLLVFSGKTDFHDHFLYKAGHIILQGKASCLPAFLLNPPVGSHVIDACAAPGNKTSHLAAIMKNKGKLFAFDLDAKRLSTMSTLLLRAGVTCHKLANQDFLKVDPQNSEYKEVKYILLDPSCSGSGMVCLRDELPETQEDGRLQALAAFQLHCLYHALQFPQLERIVYSTCSIHSQENEEVVTACLQRNPGFRLVHLLPDWPERGHEPLTQCLRASTAKTRTHGFFVAMLERRPAQSDKETPPCQHTIVIC

SEQ ID NO: 59675 - DNA, 1452 bp, Danio rerio
  CDS (1)..(1452)
atggcactttatttaaaagcggcagagattcttgagaaagtggagcagaaaagaggagcggtgaaaactctggtttatgacagtaaatttccaaatatcaagcagctctttgcacttgtgtgtgaaacacagaaatactcctcagttctgcaggagatcatcgacagcacaaagcttttaaaagaaaccaaactccggattcatttagccaaggtactggtgtatgacctgctcattggtcatggggtaaaatgcggaggcgcctggaagatgacgatgttaaagcatcgcgccagactacaagctgctctggccagaatcaaaatcaagaggaaagtgagtcgaaatcaggaccttctgccctccagcatccagcagacacagaatgatgtaattcctcgatatgtgcgagtgaacacgctgaaaacatctctggaagatgtcattgactatttaaaacgagagggcttttcgtatcaagggacgccaggacggcttgaggatctcgatcgtctgtcggggaagatgtttctgtgtgatctccacctcaaagatcttctggtcttcagtggaaaaacagacttccatgatcacttcctgtataaagcaggacacattatattacaagacaaggccagttgtcttcctgctttcctcttaaaccctccagtcggcagtcatgtcattgatgcttgcgcagctccaggaaacaaaaccagccatctagcagccataatgaaaaataaagggaagttgtttgcctttgatctggatgccaaacgtctgtccaccatgagcactcttctgctccgtgctggagtcacatgtcacaaactggccaatcaggatttcctcaaagtagatccacaaaactctgagtacaaggaggtcaagtacatccttctggacccgtcctgcagcggatcagggatggtttgtctgctggacgagctccccgagacacaggaggacggtcgtctgcaggctctggctgcgtttcagcttcactgtctgaatcatgcgctgcagtttcctcagctggagcggatcgtctattcaacctgctccatccactcgcaggagaacgaggaggttgtgacggcctgcttacagcagaaccctggattcagattagtgcatcttcttccagactggcctgagaggggtcatgagcctttgacccagtgtcttcgcgcgagcacagcaaaaacccgcactcatgggttcttcgtggccatgctggagagacgccctgcgcagtcagataaagaaaacccccctgtcaacacaccattgtcatctgctagtcaggaaaaacaggacaaacctcaatcaaatccatctgatgaagaacaggagaacatggagacctcaaatgagcaaccggctaatccaagctcaaagaagaagcggaagaggaacagaaagaagcacaaaaagcaggaatcctga

SEQ ID NO: 59676 - protein, 483 aa, Danio rerio
MALYLKAAEILEKVEQKRGAVKTLVYDSKFPNIKQLFALVCETQKYSSVLQEIIDSTKLLKETKLRIHLAKVLVYDLLIGHGVKCGGAWKMTMLKHRARLQAALARIKIKRKVSRNQDLLPSSIQQTQNDVIPRYVRVNTLKTSLEDVIDYLKREGFSYQGTPGRLEDLDRLSGKMFLCDLHLKDLLVFSGKTDFHDHFLYKAGHIILQDKASCLPAFLLNPPVGSHVIDACAAPGNKTSHLAAIMKNKGKLFAFDLDAKRLSTMSTLLLRAGVTCHKLANQDFLKVDPQNSEYKEVKYILLDPSCSGSGMVCLLDELPETQEDGRLQALAAFQLHCLNHALQFPQLERIVYSTCSIHSQENEEVVTACLQQNPGFRLVHLLPDWPERGHEPLTQCLRASTAKTRTHGFFVAMLERRPAQSDKENPPVNTPLSSASQEKQDKPQSNPSDEEQENMETSNEQPANPSSKKKRKRNRKKHKKQES

SEQ ID NO: 59677 - DNA, 2193 bp, Neurospora crassa
  CDS (1)..(2193)
atgtccctctaccacgagacagccgccatcctgacggccgctggtcccaacgccacccacggcggcagtctcaagtctcgcattttcaaagacaaatccctcaagtcgcctcccgcccaagtctacgcactagcccttgaaaccagcaaatggtccgccatcctcaaagaagtcgtcgaggcctcggacctgctcaagcacgagcgaaaactcacgcccgctctctccctcttgctcgtgcacgatttgctgctttccaaatcgggtatcgccctgcccgccacccacggcttgcgggtctccattgaacgacacaaggcccgtttgaactcggagtttgtccgcgcgcgcatacggcgcaaatgtgctacactggatgcgctgcggacgcaggtagagattggcgctaggggaggatgtcccgtgcatccgcggtggatcagggtgaacacgctgaaatcgacggtggaagaacagttggctacgacgttcaaggggtgggaggtggtggagagcgtggccgaggtgatccaggcggccgatgctttcgatgggcagggaaagaagggaaaaaaggtgattcacattgatggacacattcccaatctcattgccgcctgtcccggggtagcggatttcacaaagacggaggcgtacaagtccggcaagattatcttgcaggataaagcttcgtgtttccccgcttatctgctggatcctagaccggagagagatggagatgtcatggatacgtgcgcggcgccggggaacaagacgacgcatttggcagcgattgtgcattcacgggtggaggacaataaggcgattgtctttgatggtaaaactggcaagaaaggaaacaagaagaagaggggagaagaagagcaaaaggggacgacgacgacgaccatattcgcattcgaaaaagaccctcaccgcgccaaaaccttacagaagatggtcaaaaccgccggatccgacaccttcactgtcgtcaacgccggtaaagactttctcaaggtcaaccctttggatgccaagtaccgaaacgtcggggctttacttcttgatccttcctgctctggttcgggaattgtggggagggatgatgctcccactctccaccttccctctgctccttcctcctcttcctcttcctcttcctcttcctcttcctcctcctccaccaacaccaacaccaaagccaatcccaaaggcaaacaaaataacaacaagcgcaagtctccgccaactaccacaggtacaacagagacccaagaacccccagccaaggtcctgatcgacgacgacggcgtcgccatccccgtctcctcccaggccgacctcgaagcgcgcatcgcctcgctcgcctcgtttcagctgaccctgctgcaacacgccatgtcgtttcctgctgccagacgcatcacgtacagcacttgctcgatccacgcgggggagaacgagcacgtggttttgcgggctttggcttcggatgttgcgaaaaggagagggtggagggtgttgaaacgccaagagcaggtggaggggatgaggaggtgggatgttcggggagaagccgaggcgatgaccttggaggagggaatcacaacagaaggggtaatggaagaaaaagaaaaagaaaaggaggaggtcagggatgcggttatcagggcttattatcgggatgatggtaggggcgtcatggggttctttgtggcggggtttgtgagggacgggactattgatgatccggtctatcttctagatggtgtggagcagcagcagcagcagcaagagggcgaagaggaggaagaagaacaagaagaccccgaaggaccgtttgtgagggatgagcaaggacggattgtcagagacgaaaatgggattcctacgttgaagagcacggggaagaaggcggtggatttgaaagagttggagggcgatgaagagagttcggtggagtatcgtattgaggggcaagaagaggaagatgaagaggagccgtaccagagggatgggaaggggaatcttgtgagggatgacgaggggttgccggttttgaaggaggggaggagatggaaggttgtcaagggggggaaggggcagaaagcagagggggtgagtgatgagagcgaggaggaggaggagggtagtgaggatggtgatgaatggggtggttttgatgattag

SEQ ID NO: 59678 - protein, 730 aa, Neurospora crassa
MSLYHETAAILTAAGPNATHGGSLKSRIFKDKSLKSPPAQVYALALETSKWSAILKEVVEASDLLKHERKLTPALSLLLVHDLLLSKSGIALPATHGLRVSIERHKARLNSEFVRARIRRKCATLDALRTQVEIGARGGCPVHPRWIRVNTLKSTVEEQLATTFKGWEVVESVAEVIQAADAFDGQGKKGKKVIHIDGHIPNLIAACPGVADFTKTEAYKSGKIILQDKASCFPAYLLDPRPERDGDVMDTCAAPGNKTTHLAAIVHSRVEDNKAIVFDGKTGKKGNKKKRGEEEQKGTTTTTIFAFEKDPHRAKTLQKMVKTAGSDTFTVVNAGKDFLKVNPLDAKYRNVGALLLDPSCSGSGIVGRDDAPTLHLPSAPSSSSSSSSSSSSSSSTNTNTKANPKGKQNNNKRKSPPTTTGTTETQEPPAKVLIDDDGVAIPVSSQADLEARIASLASFQLTLLQHAMSFPAARRITYSTCSIHAGENEHVVLRALASDVAKRRGWRVLKRQEQVEGMRRWDVRGEAEAMTLEEGITTEGVMEEKEKEKEEVRDAVIRAYYRDDGRGVMGFFVAGFVRDGTIDDPVYLLDGVEQQQQQQEGEEEEEEQEDPEGPFVRDEQGRIVRDENGIPTLKSTGKKAVDLKELEGDEESSVEYRIEGQEEEDEEEPYQRDGKGNLVRDDEGLPVLKEGRRWKVVKGGKGQKAEGVSDESEEEEEGSEDGDEWGGFDD

SEQ ID NO: 59679 - DNA, 1758 bp, Magnaporthe grisea 70-15
  CDS (1)..(1758)
atgcggaggatggacgccacgcattcgttcagcgtggcggataagcttagtggcaaagaaaaggaaccgcttgagtactcggacaagaccgaaggctatgatgctcaataccgaacaagcacctacctaggcggaagtctcaagtctcgggtgtttggcgcaaaaaacctcaagtcaccccccgcccaagtctatgccttggcgctggagacgtgcaaatggagcgccatactcaaggaggttgttgacagctcacagctgctaaatcatgagcgcaagctgacgccccctttggccctcctcctcgcccatgaccttctactcgccaaaggcggcgtcgctctgccggcctcgcacggtctgcgcgtcaccattgagcgccacaaggcccgcctgtcatcagagctcacgcgcgcccgcatcaggagaaaggcccctacgctcgacgctctcaaggcccaggtcgatgaggcgacgtcgtccgaagccggccatccacgctgggtgcgcgtaaacaccttgaggtcgacgcttgctgagcagctcgagatcactttttctcgctactcaaaggtcgactccgtactggatgtcgtcactaagggtagcggtaacggcgggccttcttgcaaccgcatctacctggatgagcacgtgccaaacctggtggccatctcgcctgggtcggatatcaccaagacagaggcgtacaagtctggcgccgtaattttacaggacaaggcgtcgtgctttcctgcttacctgctggatccgcgaccagaggatggagatgtcattgacgcatgcgctgcccctggaaacaagacgacgcacgcggccgcggttctagaggagtaccgtactgcggtaaacgtgaaggaatccaaggggtctcgatctacggtacatgcctttgaaaaggactcgaggcgcgccgagatcttggccaagatggtcaagatcgcaggctcagattcgttcaccgtcgtgaataagggcaaggactttatgaaggcagacccaaacagccctctctacaaagacgtggccgctctgctcctagacccgagctgttccggcagcggtattgtaggccgtgacgacgccccggagctgcatctccctgatgctcccgggtcggcaaaaaagagtcagagcaacagcaaaggaggcaaacggaagcgccaagatgagcaggaccgcaagagcaaaaagaataaacccaatgaacaggaaggcgagcaagaggaagcgggtcgtacctttgtagatgacgagggacagacgacaatggcatcgtcggcagccgacctcgccgcgcgcctggccgcgctctcgtccttccaggccacgctgctcgagcacgccatgaaattcccaagcgccaagcgcatcacctactcgacctgctctattcacgccgaggagaacgagggcgtagtgctcagaacgttgaagagaaacccaggctggaggatcatgaagagggaagagcaggtcgacggcatgcagaggtggcccgtacggggagaggtgcagttttgtgagggcgacaaggagatcgccgaaggatgcatcagggcgtacaagggtgatgggcatggtgtcatgggattctttgtcgccgctttcgtgcggaacgaagacgggcaagccacacctgcacctgcaccagtgcctacgccagatacccacagtggtgcggtggatgaggaaaacgatagggacgacgacgaatggggtggctgtagtgactag

SEQ ID NO: 59680 - protein, 585 aa, Magnaporthe grisea 70-15
MRRMDATHSFSVADKLSGKEKEPLEYSDKTEGYDAQYRTSTYLGGSLKSRVFGAKNLKSPPAQVYALALETCKWSAILKEVVDSSQLLNHERKLTPPLALLLAHDLLLAKGGVALPASHGLRVTIERHKARLSSELTRARIRRKAPTLDALKAQVDEATSSEAGHPRWVRVNTLRSTLAEQLEITFSRYSKVDSVLDVVTKGSGNGGPSCNRIYLDEHVPNLVAISPGSDITKTEAYKSGAVILQDKASCFPAYLLDPRPEDGDVIDACAAPGNKTTHAAAVLEEYRTAVNVKESKGSRSTVHAFEKDSRRAEILAKMVKIAGSDSFTVVNKGKDFMKADPNSPLYKDVAALLLDPSCSGSGIVGRDDAPELHLPDAPGSAKKSQSNSKGGKRKRQDEQDRKSKKNKPNEQEGEQEEAGRTFVDDEGQTTMASSAADLAARLAALSSFQATLLEHAMKFPSAKRITYSTCSIHAEENEGVVLRTLKRNPGWRIMKREEQVDGMQRWPVRGEVQFCEGDKEIAEGCIRAYKGDGHGVMGFFVAAFVRNEDGQATPAPAPVPTPDTHSGAVDEENDRDDDEWGGCSD

SEQ ID NO: 59681 - DNA, 1737 bp, Gibberella zeae PH-1
  CDS (1)..(1737)
atgtctctttatcatgaggctgctgagatcctgacagggtcttcttctgaaggcggaagtctcaagtcccgtgttttcaaaaagaagggcctcaagtctgctcccaaccaggtctacgccttagtcttggagagctgcaaatggagtcctatcctcaaagaagtgattgagaaatcagaacttctcaaattagagcgaaagcttacaccaacattgtcattgcttcttgtccatgacctcctgctggccaagaagggaattgcgcttccacaaggccatggcctacgcgcatctatcgagaggcacaaagcgcgcattagctcagaatttaagcttgcgcgacttcgcagaaagatgcccacactcgaggctctaaaagggcaggttgagagggaatgcgcaggcgaggaaacgaactaccctcgatgggttcgtgtcaacgccgtgaagagcacattggaagagcagctcgagaccactttctccaagtacaccagagctagatctatcaacgaggttgttaccaatgctggaagactcatatacatcgactcacacgtaccgaatctcgtggcaatcaccgcaggtatcgatctcaccaaaacagaggcctatacatctggcaaaatcattctccaagataaagcatcctgctttccggcctacctcttggatcctaggtcagaagatggagatctgatcgatgcgtgctccgcccctggcaataagacaacacatctggcagctatcgtcaagcaacatacacccgaattcgacacaccagcgcaaaccatttatgcattcgagaaagattccagaagatcgcaggtacttcacaagatggtcaaaatagctggctcagattatatgacaaagattggatttggtcaagatttcatgcaggtgaaacccacagcagacaactacaagtcagtcggagcattgctactagatcccagttgttcaggaagtggaatcgttggccgagattcgatgcctgatcttcatctgccagagccttacagcggtaacggaaaaacgccaccagcaaaaccaaacaaccgtaagaggaaacacgaaaaggtcgagccagcccctgaaaatgtcatgatagatgacgatggaaatgaaatggcgatcaaatccgagaaggacctagaaacacgtctcgaggctttatcatccttccagttggtccttctattacatgctttccggttcccatcagcaaagaagatcacatactcaacttgttctgttcacgtgcaagaaaacgagcgcgttgtcatgagagctctcgaatctgacattgccaaaagaagaggctggcgtattcttcaacgaaaggaccaggtttctggcatgagagaatggcctgttcgtggactacccgaagcatgcgaaggagacaaggaaatagcggaaggctgcattcgctcttacaaggatgatggacagggtgtaatgggattcttcgtcgctggctttgtccgatctggcgagcaagatgatgctcctgccgatgatgagggtccttatatgagagatgacagcggtgtcatcattcgtgatgtggttggcatgcccgtgttgacgtcgacaggcgaggccgtttctttgaccccaagaaatgagaagagcaatgacagcgatgaggagagtagtgaagaggaggaatctgcaagtgagagtaacagcagtgatgaggatgatgaatggggtggtttcgacgattga

SEQ ID NO: 59682 - protein, 578 aa, Gibberella zeae PH-1
MSLYHEAAEILTGSSSEGGSLKSRVFKKKGLKSAPNQVYALVLESCKWSPILKEVIEKSELLKLERKLTPTLSLLLVHDLLLAKKGIALPQGHGLRASIERHKARISSEFKLARLRRKMPTLEALKGQVERECAGEETNYPRWVRVNAVKSTLEEQLETTFSKYTRARSINEVVTNAGRLIYIDSHVPNLVAITAGIDLTKTEAYTSGKIILQDKASCFPAYLLDPRSEDGDLIDACSAPGNKTTHLAAIVKQHTPEFDTPAQTIYAFEKDSRRSQVLHKMVKIAGSDYMTKIGFGQDFMQVKPTADNYKSVGALLLDPSCSGSGIVGRDSMPDLHLPEPYSGNGKTPPAKPNNRKRKHEKVEPAPENVMIDDDGNEMAIKSEKDLETRLEALSSFQLVLLLHAFRFPSAKKITYSTCSVHVQENERVVMRALESDIAKRRGWRILQRKDQVSGMREWPVRGLPEACEGDKEIAEGCIRSYKDDGQGVMGFFVAGFVRSGEQDDAPADDEGPYMRDDSGVIIRDVVGMPVLTSTGEAVSLTPRNEKSNDSDEESSEEEESASESNSSDEDDEWGGFDD

SEQ ID NO: 59683 - DNA, 1773 bp, Ustilago maydis 521
  CDS (1)..(1773)
atggcggacttttatgttcggtcggctcaagcgcttgaccaggtgcttggggatgagtgttcggtgaaagcagcagctggggcgcatgctgattcggggcgggtgttggcgatcgtgatcaactcgttggcgtatcgaagtgcacttatgcacgcaatcgatgagtgccgggtggcgaagctcgaggaacgcatttttacgcttgctgctactcctgctcgtgctcgtgcgtcgagtgtcaaagacaagaacaagccaggcaaacagcaaggtaagaaggcggctggcaagtatcctagcaagcaagcacttttgctggttctgtgccacgatctgctgtttcaagcgcgaggcattcaggcgagcaagacgtggccacccaagctcacactcgagcggtatcgaccttcgcttcacagcgcgttggtcaaacttcagatccgactcggcaaatcgcggatacaggacctgcgttctggcgcgctgtacgagcagatgaccgcacgcatcccgcgatggattcgcatcaacccgctacgcgcaactcgcgaccaagtgttgcagtggctctcggacaaccgctacacgcaggtggatgtgcgagatgacgagatcggcggtatcaaacagtttgccgagtcaactcatgttgctggattgctcgcgtttcatccgaaagctaccagtgctctgctgaaaagcgaaatgtaccgcgaaaactggatcgtgatgcaagacctggcgagctgcttcccggcctacatcctggatccgcctgcgggcagtagtgtgattgacgctaccagtgctccgggcaacaagacaagccatctttctgccatcatgcattccaaatctggctcgacaagagaaaacggccgtattgatgcgtttgaacgagacgcggcccgatacaaaacgctcgtcaaacgactcgatgcagtgggtgcgcttgcattgcctcggccacagccaacacagcacggaaacgtaactgcacacagaagagactttctcacaaccaacccggacgactttccgaatgtaacgcacatgctgctcgatcccagttgcagcggtagtggcatcgtcaaccgtctcgactttctcaaagaagacgatgatgtcgaacacgatcccctagacgccgatgctctcgattccgacaccaccaccaagctcgccagacggcttcgacagctctcggaattccagcaactcatgattcgacatgctttcaaattccccgcgctgcgaaaggtggtgtacagcacctgcagcgtgcatgcgcaagagaacgagctggtggtcatcaacgcactacagacgcatgaggcacaaagccgaggttggaaattagcaccacgcaaacacgtgatcccaacttggccggtcagaggcgataccgacgcgtgtacaggcaaacaccatgtggcggagagtgtgattcggtgcatacctggaggtaaaggggaaggcgacaagccgaatgtcgaaagctgcaacggctttttcgtcgcctgctttattcgagacgaccaaatccaacatgacgagcaagagactgctgcaaacaagaggcctttccaggagcaagatgacgtcgatgacgacggacaggcggaggacgaagcgcaagagccgcagcagcagcagcagcagcagcagcagcaaccacagtcaaagaacgccaacgcagccgccaaccgaaagaaaaagctacagaaacgacgcaagaagcagcgtcttgaatttcaacagcaacagttgtaa

SEQ ID NO: 59684 - protein, 590 aa, Ustilago maydis 521
MADFYVRSAQALDQVLGDECSVKAAAGAHADSGRVLAIVINSLAYRSALMHAIDECRVAKLEERIFTLAATPARARASSVKDKNKPGKQQGKKAAGKYPSKQALLLVLCHDLLFQARGIQASKTWPPKLTLERYRPSLHSALVKLQIRLGKSRIQDLRSGALYEQMTARIPRWIRINPLRATRDQVLQWLSDNRYTQVDVRDDEIGGIKQFAESTHVAGLLAFHPKATSALLKSEMYRENWIVMQDLASCFPAYILDPPAGSSVIDATSAPGNKTSHLSAIMHSKSGSTRENGRIDAFERDAARYKTLVKRLDAVGALALPRPQPTQHGNVTAHRRDFLTTNPDDFPNVTHMLLDPSCSGSGIVNRLDFLKEDDDVEHDPLDADALDSDTTTKLARRLRQLSEFQQLMIRHAFKFPALRKVVYSTCSVHAQENELVVINALQTHEAQSRGWKLAPRKHVIPTWPVRGDTDACTGKHHVAESVIRCIPGGKGEGDKPNVESCNGFFVACFIRDDQIQHDEQETAANKRPFQEQDDVDDDGQAEDEAQEPQQQQQQQQQQPQSKNANAAANRKKKLQKRRKKQRLEFQQQQL

SEQ ID NO: 59685 - DNA, 1737 bp, Aspergillus nidulans FGSC A4
  CDS (1)..(1737)
atgtcgctatactacgacgccgcgtcaattctcacgacgccctccactgctggtggttcatttaagtctcggctctacaactcccgcaaccttaaagcttctcccgcacaggtttacgcgctcatcaccgaagcagccaaatgggacatcctgctcaaggaagtaatcgaccaggctggaattctgaaacttgaacccaaggttgtccctcaccattgccctgtcctgctcaccccattgcttgctcttctcctcgtccacgaccatctcctcgcaaagaatggcatcgccgcgcccgcatcccacccgctccgtcaagcagttgaaaggcacaagattcgactgaagggggaattcacaaaagcgcgcgtgcggcgcgcctgcgcgacaattccggaactgaaggaggctgttcggaaagaaaaattagctgcgctgggggccaagggtagtagtggcgcggtctatccacgctgggttcgggtcaacaatgtacggacaacgatggaggcgcagttgaagaccacctttgcggcgttcgagaatgtcgagtcactggacggtctagtggttggtggagacgataagcagaagagaatgcggttagacccgcatatcccggaccttgtggctgttgcgcctggtgttgagttctcgagtacgccggcgtacaagaatggagagattatcctgcaagataaggcatcttgtttccctgcctatctgttgcttggcgatgactgggatgggcaaggtgatttggtagatggatgcgccgcgccaggcaataagactacgcatatggcttcgttgctccgcaaagctaagtccaagaagaaggcggagtcatcccgcatcatatccatggatgcctcctcaatccgcgcaaagaccctcaagaaaatggtctctatcgctggcgcagatagcttcaccagcgtccttcagggacaggactttctcgcacttgacccgcaagaccctcgctttaaggatgtcacaggccttcttctggacccttcctgctcagggagcggcatcatcggccgcgacgatgtcccccagctcgtcctccctgcgcctgggagacccaccccagcatcaggatcgaagaaccaaacccaaggtaaaaagcgcaagcgcaacgactcatctggatcctcctccaaccaaccctccacaccctcatcattaacatcagcagcaacgccgtcaacatccgaaaacgacactcccatttccgaaataactcaagatcgcctcctcaaactctcaaaccttcagttccgaatcgtcacacatgcactcgccttccccgccgctaggaaggtgacatacagcacgtgctcaatccatcttctcgagaacgaggccgtcgtgcaacggatactggaaagtgatattgcgaagcggagaggatggagagttctcaggcgggatgagcagcctgaaggcttgaagaagtggattcatcgcggtgtgaagcgagaggagccgagtgcggatggtgccattgagggtggtgaggtgaatttgtcggatgaggagttagggggttgtttgagatgttggcctggggatgaggaggggacaggcgggttctttgttgcggggtttgtgagggagggagatgatgatggttcaatggtagatgccgagaacgagagtgaggaccaggatagcattgaacaagagaatgaagatgaggatgaggaatgggagggattctccgattaa

SEQ ID NO: 59686 - protein, 578 aa, Aspergillus nidulans FGSC A4
MSLYYDAASILTTPSTAGGSFKSRLYNSRNLKASPAQVYALITEAAKWDILLKEVIDQAGILKLEPKVVPHHCPVLLTPLLALLLVHDHLLAKNGIAAPASHPLRQAVERHKIRLKGEFTKARVRRACATIPELKEAVRKEKLAALGAKGSSGAVYPRWVRVNNVRTTMEAQLKTTFAAFENVESLDGLVVGGDDKQKRMRLDPHIPDLVAVAPGVEFSSTPAYKNGEIILQDKASCFPAYLLLGDDWDGQGDLVDGCAAPGNKTTHMASLLRKAKSKKKAESSRIISMDASSIRAKTLKKMVSIAGADSFTSVLQGQDFLALDPQDPRFKDVTGLLLDPSCSGSGIIGRDDVPQLVLPAPGRPTPASGSKNQTQGKKRKRNDSSGSSSNQPSTPSSLTSAATPSTSENDTPISEITQDRLLKLSNLQFRIVTHALAFPAARKVTYSTCSIHLLENEAVVQRILESDIAKRRGWRVLRRDEQPEGLKKWIHRGVKREEPSADGAIEGGEVNLSDEELGGCLRCWPGDEEGTGGFFVAGFVREGDDDGSMVDAENESEDQDSIEQENEDEDEEWEGFSD

SEQ ID NO: 59687 - DNA, 1509 bp, Gallus gallus
  CDS (1)..(1509)
atggcgctgtacagcgcggccgctgctgtgctgagcgggctggagcgtggcgagggaggcctcaagaacctggtgtacggcagcgactttcctgtgcgcagcgggcacgcccggcagctgtacgcgctggtggccgagactctgcgctacggcccggtgctggaggcgctgctggacggagccgcgctgctgcgcgtcgagaagaaactgccgccgccgctggccaaggtgctggtgtacgacctgctcttcggcaagggtctcaagtgcggcggccgctggaaggcgttggcccggcggcaccgtgcacggctggaggccgagctggcccggctgaaggtgcggcgtggggtgccgcgttacgtccgggtgaacgtgctgaaaacgagcgtggatgatgtggtggaattcttcaagcgccatggttactccttcctgggcagagcgaacagagatgtgggatggagggatttctgcacctgggctctggagagctctggtgctgaatgtggcaaggctgagctgtgctcgtcctctgtccacgtgggcagtgtggaagagctgaaaacgctttctgggaagaaattcatgttggatcttcatctcccggagctgctcgtcttccctccgcagacggacttccacgacagccggctctatacatcaggacacatcatcctgcaggacaaggccagctgcttgccagccttcctcctcagcccttctgctggctcccatgtgattgatgcctgtgctgcccctgggaacaaaaccagccacctggctgccatcctgaagaacaaggggcatatctttgcttttgatgtggacaccaagcgcctggctaccatgaacaccatgctgatgcgggcaggggtcaccagcttcaagctggcccagcaggacttcctgacagttgatccccacgatcccaagtacagcaaagtgaaatatatcctcctggacccttcatgcagtggctcagggatggtggcccggctgccactggatgaggctgccccgagtgcggagcggctgcaggctctgtctggcttccagcgcaggatcctgagccacgcgcttcgcttcccggcggtgcagcgcctcgtctactctacctgttcagtgcaccaggaggagaacgaggatgtggtgcacgcagtgctacaggagcagggatcggccttcaggctagcaaacgtcttcccatcctggccctgccgaggacttgctaccttcccgggggctgaatgctgcctccgtgcctctcctgcagatacactcacacagggcttctttgtggctgtcctggagcgctgcggggaggaaactgctgtccccaggatggccacactcatggggccgggtgctaacacagccttgtgctctgcggagatggcaacgagtggctcgaagcagagggagtgcgttcaccaggccatgagattcaacagtggggaaagatttttgggcctggtgaagaccacatcccacggcagagaactgtga

SEQ ID NO: 59688 - protein, 502 aa, Gallus gallus
MALYSAAAAVLSGLERGEGGLKNLVYGSDFPVRSGHARQLYALVAETLRYGPVLEALLDGAALLRVEKKLPPPLAKVLVYDLLFGKGLKCGGRWKALARRHRARLEAELARLKVRRGVPRYVRVNVLKTSVDDVVEFFKRHGYSFLGRANRDVGWRDFCTWALESSGAECGKAELCSSSVHVGSVEELKTLSGKKFMLDLHLPELLVFPPQTDFHDSRLYTSGHIILQDKASCLPAFLLSPSAGSHVIDACAAPGNKTSHLAAILKNKGHIFAFDVDTKRLATMNTMLMRAGVTSFKLAQQDFLTVDPHDPKYSKVKYILLDPSCSGSGMVARLPLDEAAPSAERLQALSGFQRRILSHALRFPAVQRLVYSTCSVHQEENEDVVHAVLQEQGSAFRLANVFPSWPCRGLATFPGAECCLRASPADTLTQGFFVAVLERCGEETAVPRMATLMGPGANTALCSAEMATSGSKQRECVHQAMRFNSGERFLGLVKTTSHGREL

SEQ ID NO: 59689 - DNA, 1479 bp, Candida glabrata CBS138
  CDS (1)..(1479)
atggaattttatagggatagcacctgggttcttgagtacttggaaggccagatagaaaagacaggtagagtgtcaggttctttacaaacgattgtgctgcgatgctgtaagcagtacaggataaagaccaacccaaaacacatatatgcgattgtatcatcatgttggaagtacaagccttatttggataagataatgaaaaagtctggtctcttggatgctattcctaggaagaaaggtaagcctgcattctcgaaactaactttactcctactatgccatgatcttttgctgtctaaagctaaaagaattcagatgggtaaacacccgattaagaattatgtgctgaagtacaaaaatgcacttaatgcagaatttgtgaaactaaaaattaaattaaagatcacagatctaagtcaagtagttgacaaagatgatgccgcagatgatatgaccccagttcgttggattagaataaatccactaagaataagcaaccatgatactgatcaggttctcaacgaactgaagaaaaaatttcctaccagagtaaacacttggaaggatattataccagggtctatatactacgacgaatttatcccaaatttatatggtatacatatcagtgataaaattacgtctcatgaactatacaaacagggtaaaattattattcaagatagagcatcctgcttcccagcacatatattaaatccttctgctgatgacgttgttatcgatgcttgttctgctccaggtaacaagactactcatgttgccgcacacatattcggcgatcctgagaacccaaggaatgataatgtacagatttatgcgtttgagaaggatccggaaagggcccaaattctacaaaaaatgattaaaactgctggttgtcacaagaatattgatgtgaatgttggagacttcactcaaattgcgactccttctaaatattctgatgtcactgggttcatattggatcctagttgttctggaagtggtatatttggtagaaaatctgtggacatacttaataatcacggcaagaagtccaacgatgaagtacctgacgagaacgatgccgaggagactactgactctaaaaacgaacaattgaaggaaagactaagtaaattagcttcattccaatttcaaattgtcagacatgctatgagtttcccaaatgccaagaaaattgtatacagcacctgttctatccatgcagaggaaaacgaaagagttgttattgatttgcttctggataagaaagtgcaatcttggggctggagagtagcgaaaaaggaattagtattaccaacgtggtacagaagagggtttaaagaagaattccaagaggtattcactgacaaaacagaacaagaatgtcaggaattggcagatggttgtgttagggctttaccaaaagaggacggtggaatcggtttttttgctgtatgttttgttagggactga

SEQ ID NO: 59690 - protein, 492 aa, Candida glabrata CBS138
MEFYRDSTWVLEYLEGQIEKTGRVSGSLQTIVLRCCKQYRIKTNPKHIYAIVSSCWKYKPYLDKIMKKSGLLDAIPRKKGKPAFSKLTLLLLCHDLLLSKAKRIQMGKHPIKNYVLKYKNALNAEFVKLKIKLKITDLSQVVDKDDAADDMTPVRWIRINPLRISNHDTDQVLNELKKKFPTRVNTWKDIIPGSIYYDEFIPNLYGIHISDKITSHELYKQGKIIIQDRASCFPAHILNPSADDVVIDACSAPGNKTTHVAAHIFGDPENPRNDNVQIYAFEKDPERAQILQKMIKTAGCHKNIDVNVGDFTQIATPSKYSDVTGFILDPSCSGSGIFGRKSVDILNNHGKKSNDEVPDENDAEETTDSKNEQLKERLSKLASFQFQIVRHAMSFPNAKKIVYSTCSIHAEENERVVIDLLLDKKVQSWGWRVAKKELVLPTWYRRGFKEEFQEVFTDKTEQECQELADGCVRALPKEDGGIGFFAVCFVRD

SEQ ID NO: 59691 - DNA, 1476 bp, Kluyveromyces lactis NRRL Y-1140
  CDS (1)..(1476)
atggaattctaccgtgatgcaacctgggtattggaattcgtggaacaggagctctctaaagacaagagagttgcaggttcgttacagaccttggtacttactagttgtaaaagatataagctgaagacaaatcctcgtcacatttatgccattgttagtagtacatggcagtatagggaatatctagataaaatcattaagaagagcgggatcttggaggacgtaccgaaaaagaaagggaaaccgctgttcaataaggataccataaggctcctagtacacgaccttttactttcaaaatcgaagcggattcagatgggtaagcatcctatcaaaactttcattttgaagcatcagactaggttaaaggctgagttgacaaagctcaaagttaaacttaaagtcaccagtctgtcgcagttaatcaaaaccgatgatggagaagatgttacaccggttcgttggatcagaattaaccctatccttgtcaaggaaagatatgacgatgttcttgctgaattaaacaagaaattcccacaaagagtgaactcttggaaacaaatcgttcctgggagcatatattacgatgagtatattccaaacttgtttggcattcatccaggtgataagatcacttcgcatgagcaatataagagggggaaaattatcattcaagacagggcatcctgtttccccgcccacatcctcaatccaaacagtactgacgttgttatcgatgcatgtgcggctcccggcaataaaaccacacacgttgcggcacatatctttggagacgttgacaccaaggtcgattcagtcaagatacatgcttttgagaaggatcctgagcgtgcaaaaactttacagatgatggttgccaccgcgggttgtgctaagggggtcaagatacatgttggtgatttcacaaaacttggtaaaccagaacttttccagaatgtaactggattcatcgttgatccaagttgttctggctctggtatatttggccgtaaggcaattgataaagtaaacttgagcaagactgggtcatcaaacaccgatgaagatcagacctcggttgaacctgtggagcaagaaaaagaattgtttgaaaaggaacaagatttgaagaatagattagccaaattatcatctttccaataccaaattgtgaaacacgccatgtctttcccatctgctaagaaaatatgctatagtacttgttctattcatgctgaagaaaacgaaagagttgtcattgatttgctcttagactcaaaggtcaaggaatggggttggaaagtaagaaagagaaccggtgtaattccaacatggcctagaagaggatggaccagtgaatttgaagaggtgtttccgaaagaggaagcaaaagagttggcagaagggtgcatcagggctttaccgaaggaagatggtggcattggctttttcgccgtatgctttgagcgagattag

SEQ ID NO: 59692 - protein, 491 aa, Kluyveromyces lactis NRRL Y-1140
MEFYRDATWVLEFVEQELSKDKRVAGSLQTLVLTSCKRYKLKTNPRHIYAIVSSTWQYREYLDKIIKKSGILEDVPKKKGKPLFNKDTIRLLVHDLLLSKSKRIQMGKHPIKTFILKHQTRLKAELTKLKVKLKVTSLSQLIKTDDGEDVTPVRWIRINPILVKERYDDVLAELNKKFPQRVNSWKQIVPGSIYYDEYIPNLFGIHPGDKITSHEQYKRGKIIIQDRASCFPAHILNPNSTDVVIDACAAPGNKTTHVAAHIFGDVDTKVDSVKIHAFEKDPERAKTLQMMVATAGCAKGVKIHVGDFTKLGKPELFQNVTGFIVDPSCSGSGIFGRKAIDKVNLSKTGSSNTDEDQTSVEPVEQEKELFEKEQDLKNRLAKLSSFQYQIVKHAMSFPSAKKICYSTCSIHAEENERVVIDLLLDSKVKEWGWKVRKRTGVIPTWPRRGWTSEFEEVFPKEEAKELAEGCIRALPKEDGGIGFFAVCFERD

SEQ ID NO: 59693 - DNA, 1482 bp, Debaryomyces hansenii CBS767
  CDS (1)..(1482)
atgaaactatactttgaagcggagcaatttttgagtccttataaaggaaagggtataggtggaagcttgcagtctcgtatttttaatgaggcgaagttagtgaactctccaaaacacatttatgcattggtttattctactttaaagtataaagaacacatacaagcgattattcggaagtctaaaataaaacagacactccaaaccaagaaattgaaaatcagtgataacttgttgttgcttgttgtgcatgacttgttgtttaattctaaaggtaggattcaactggggaaacatcctattaaagatgctatcttgcagcataagactagattacaggcagagtttactaaacttaaattgaaatataaggcgaagtctgcggaggatttaccgacttctgtatctagtgacgatgagacacctattagatggttccgtgtgaacaccattaagacgacaccagagaagtttttccaggaccatccattttttgctaagctagagccgattagttcgattgagattaaggaaacggggtttatatatacggacgactatattcctaatttgtacggtatccatcctaaggagaagttgacgtccactgcagcgtaccttaagggtgaagtgatcattcaagacagagcctcttgtttccctgcgcatattcttaacgatgacccttcagataaccatatcgaaatcatcgattcatgtgctgcgccggggaacaaaactactcattgtgcatcatatttacccagatcagaagactctgtggtgtatgcatttgaacgggattcaaaccgtgtgaaggtgctaaagactatgtgcgaaaaagccactggaatcaaatataagaacttgattcagataacgcatgctgatttcacgtccacaaagccgcaagactttccttgcgttacaggccttgtagtagatccatcatgtagtggatcggggatttttggacgtgctatagaagatgcacaactgcaagaacaagaaaaggaagagatcgataccgaaagacttaataggttggcagggttccaattcaaaatcatgaaacacgccttgctgtttccaaaagccagaaaggttgtttattccacctgttcaattcacccacatgaaaacgaaagggttgttgttgacttattgatggataaggaaataaaagcatctgggtggcagttagcttctagagacattgttatttcagaatggcccaaaagaggttggaaagaagaattcaccgctgtatgtggggggaacgaggaagaatgcgaagctttagcgggcggttgtgttagagcaacaccaaaggaagatggaggaataggattcttcgcggcatgctttattaaaaaagatatatccgacgaagattccgagagacagaaagtaaataaagaagagaatgacatagatgaagaaaccgaagaacagggcgaagaatggtcgggatttgattaa

SEQ ID NO: 59694 - protein, 493 aa, Debaryomyces hansenii CBS767
MKLYFEAEQFLSPYKGKGIGGSLQSRIFNEAKLVNSPKHIYALVYSTLKYKEHIQAIIRKSKIKQTLQTKKLKISDNLLLLVVHDLLFNSKGRIQLGKHPIKDAILQHKTRLQAEFTKLKLKYKAKSAEDLPTSVSSDDETPIRWFRVNTIKTTPEKFFQDHPFFAKLEPISSIEIKETGFIYTDDYIPNLYGIHPKEKLTSTAAYLKGEVIIQDRASCFPAHILNDDPSDNHIEIIDSCAAPGNKTTHCASYLPRSEDSVVYAFERDSNRVKVLKTMCEKATGIKYKNLIQITHADFTSTKPQDFPCVTGLVVDPSCSGSGIFGRAIEDAQLQEQEKEEIDTERLNRLAGFQFKIMKHALLFPKARKVVYSTCSIHPHENERVVVDLLMDKEIKASGWQLASRDIVISEWPKRGWKEEFTAVCGGNEEECEALAGGCVRATPKEDGGIGFFAACFIKKDISDEDSERQKVNKEENDIDEETEEQGEEWSGFD

SEQ ID NO: 59695 - DNA, 1419 bp, Oryza sativa (japonica cultivar-group)
  CDS (1)..(1419)
atgccgccgccgccgccgtcgaagaaccgcggccacgttcccgcgccccggccgcctccgggcaagccgcctgggcgacggatggcgagccgggacgcggcggagcgggcggcgttcttcgcgcggcgcgaggcggccgcggtgctccgccgcgtgctccgcggggacgcgtccaggcgcgccgcgggctccatcaagtcgctcgtgtactccccctccgtccgcaacaagcgcgccaccttcgccctcgtctgccagaccctcaagtatcttccaattctaaaggaggttttagcatcaactggagtactaaccagtaaatggaagaaacaggaagaattagttttcgtgactgcctatgacattctctttggtcaggagacagcagcttctggatccgttgaacagttaattatgttacataaggatactattatggctgctcttgagaaaatgtgtattagaaggaaggttcgtagtgttgaagacttagtaagcaagaaaaggacagtcaaaccaaaacccaggtttcttcgtgttaacacactcaggaccagtacagattctgtcatcgaagaactgaacaaaatacacaaggggaaagcaagttgtatggtggcagttgcattatgccctgagccaggctggaaggttattgatgcatgtgcggctccagggaataaaacagtccatcttgctgcactcatgaatggagaggggagtattacagcttgtgaacttaataaagagaggaccaagactttgcaaaatactatccgaagatccggagcaaacaatattgaaacaatcaatggtgactttttggatatcgatagcaatgatccatcatatgccgaggtccgagctattctattagatccctcttgctctggttccggaatctctacagagagacttgaccatttgctcccttcgcactcaagaggtaatcaggatgatgcaagtacgagttcaaggataaggaaactctccgccttccagaggaaagcgctctcacatgctctgtcattcccctctgtggagagagtggtctacagcacctgctcaatccaccaagctgagaacgaggacgtcgtgagctccgtcctgccattggcgtcatcgctcggattcgagctcgctactccattccctcaatggcgacgccgtggtctccccgtctttgaaggatctgagcatctgcttcggacggacccggaggacggcctggagggcttcttcatatcgttgttcgtgaggaaagcagcagcagcagccgatgctgtaaagcctagcaatggtggtttgggagtgagcaagcaggtttttaagagacgtaacgggctcatggctttcggctcatcgagactgtccaggatgatgatgctctgctctacccggggtctctcgagaagatga

SEQ ID NO: 59696 - protein, 472 aa, Oryza sativa (japonica cultivar-group)
MPPPPPSKNRGHVPAPRPPPGKPPGRRMASRDAAERAAFFARREAAAVLRRVLRGDASRRAAGSIKSLVYSPSVRNKRATFALVCQTLKYLPILKEVLASTGVLTSKWKKQEELVFVTAYDILFGQETAASGSVEQLIMLHKDTIMAALEKMCIRRKVRSVEDLVSKKRTVKPKPRFLRVNTLRTSTDSVIEELNKIHKGKASCMVAVALCPEPGWKVIDACAAPGNKTVHLAALMNGEGSITACELNKERTKTLQNTIRRSGANNIETINGDFLDIDSNDPSYAEVRAILLDPSCSGSGISTERLDHLLPSHSRGNQDDASTSSRIRKLSAFQRKALSHALSFPSVERVVYSTCSIHQAENEDVVSSVLPLASSLGFELATPFPQWRRRGLPVFEGSEHLLRTDPEDGLEGFFISLFVRKAAAAADAVKPSNGGLGVSKQVFKRRNGLMAFGSSRLSRMMMLCSTRGLSRR

SEQ ID NO: 59697 - DNA, 1521 bp, Yarrowia lipolytica CLIB99
  CDS (1)..(1521)
atgaacttctaccaggaggccgcccagtttctggagccgtccaagaagggctcgctacagaaccgaatatttgctcagtccaagctgctcggcaaaacgcgactcagagccgaccccaaacatgtgtttgccgtggtcttctcggccctcaaatacagaccctttctggtggacatcatcaaggctgcggaaatccccatttccgacaagcctggaaaaaccaaaatcaccatgaacatggccattcttatggcccacgacctgctctgctcccggtccaagcgtctgaccatctccaagggtcctctcaaagacatgtttctggcccaccagacccgtctcaagtccgagctgaccaaattcaagctgaaacacaaggtctcggacctcgacgagctcgtggaggaagactcgacgcccattcgatggataagaatcaacacagtgctcagtaacgaggaagagtttcacaagacgcctttgatcgcgagactcaagcctatcgacaagatcgagggcggcacaattcagcccggacagatatacaaggacattcacgtgccccatctttacggaattcaccccagagagaaactggctaattgcgagctatataagcagggcaagatcatcattcaagatcgagcctcttgctttcccgctaccattctcaacccccagcctggccagaagctcattgattgctgctctgcacccggaaacaaaaccacacacctggcctctttcgtggctggtacccctggctctattgatgcgtttgaaaaagacgccattcgagcaaagcttcttaccaagatggtcaagaccgcgggttgtcacaactgcatcaaggtgaacgtgggagacttcaccgacaccaaccccgacgactaccccgaagtggagggtattctcgtggacccatcgtgttcgggatcaggtatttttggacgaaagcacgaggacgacgctgccgcggcggaggaaaccaacagagacgaccagaaggatcagttccgactccacaagctgtccgagtttcagtaccgaatcgtcaagcatgccctgctgtttggatctgccaagaaggtggtctattctacctgctccattcacaacattgaaaacgaggaagtggttcagaaactgcttctggactcgcaggttgctgctgagggatggcagctggcccccaagttgcgtgttcttcctctatggacgcgacgaggagaccccaacggcttttcagactttcctgagaatcagagagctgctctggctgagggagtcgttcgagctctacccaaggtcgacggaggcattggcttctttgctgcctgcttcgagaagcgggatattggtgaaattggacacagagtccctaaggtgtctgaggttgagagcgcccaggaaacctcttccgatgaccacagtgaagacgccgaacaggaagaccaagaccaagaccaagacgaggaggaggttgagtctgaggaagagtggactggtttctctgattaa

SEQ ID NO: 59698 - protein, 506 aa, Yarrowia lipolytica CLIB99
MNFYQEAAQFLEPSKKGSLQNRIFAQSKLLGKTRLRADPKHVFAVVFSALKYRPFLVDIIKAAEIPISDKPGKTKITMNMAILMAHDLLCSRSKRLTISKGPLKDMFLAHQTRLKSELTKFKLKHKVSDLDELVEEDSTPIRWIRINTVLSNEEEFHKTPLIARLKPIDKIEGGTIQPGQIYKDIHVPHLYGIHPREKLANCELYKQGKIIIQDRASCFPATILNPQPGQKLIDCCSAPGNKTTHLASFVAGTPGSIDAFEKDAIRAKLLTKMVKTAGCHNCIKVNVGDFTDTNPDDYPEVEGILVDPSCSGSGIFGRKHEDDAAAAEETNRDDQKDQFRLHKLSEFQYRIVKHALLFGSAKKVVYSTCSIHNIENEEVVQKLLLDSQVAAEGWQLAPKLRVLPLWTRRGDPNGFSDFPENQRAALAEGVVRALPKVDGGIGFFAACFEKRDIGEIGHRVPKVSEVESAQETSSDDHSEDAEQEDQDQDQDEEEVESEEEWTGFSD

SEQ ID NO: 59699 - DNA, 1410 bp, Canis familiaris
  CDS (1)..(1410)
atggcgctgtacgcgacggcggcgtctgtgctggcaaacgtggagagccgacggggctccatcaaggggctggtgtacgccagcagcttccagaacgtgaagcagctgtacgcgctggtgtgcgagacgcagcgctactccgccgtgctggacgccgtgatcgccagcgccggcctcctccgcgccgagaagaagctgcggccgcacctggccaaggtcctagtgtatgagttattgctgggaagaggctttagagggggcgggggccgatggaaacctttgctggaccggcaccaggcaaggctgaaggcggagttggcccggctcaaggttcagcgacgtgtgagccgcaacgaggacctgttgcaggtgggatccaggcctggcgcagcctcccaggtgcctcgctttgtgcgtgtgaacactctcaagaccagctctgacgatgcaattgattatttcaagaggcaaggtttctcttaccagggtcgggcttctagcctcgaggacctacgggccctcaaagggaagtgctttcttctggaccccttattgccagagttgctcgtgtttccgacccagacagatcttcatgaccacccactataccaggccggtcacctcattctacaagacaaggccagctgtctcccagccatgctgctggccccacccccaggctcccacgtcattgatgcctgtgctgcccctggcaacaagaccagtcacttggccgcttttctcaagaaccaagggaggatctttgcctttgacctggatgctggacgactggcgtccatggctaccctgctggcccgggctggagtctcatgctgtgagctggctcaggaagacttcctggcagtctcaccctctgaccagcgctaccgtcaagtccagtatatcttactggatccttcttgtagtggctcaggaatgccaaccagacagctggaggagcccgggacaggcactcctagcaaggcacgcctgcaggccctagccgggttccagcagcgagcactgcgccacgcgctcaccttcccctccctgcagcgtctggtgtactccacatgttccctctgccaagaggagaatgaagatgtggtgcaggatgccctgcagcagaacccagggaccttcaggctggctcccgtcctaccctcctggccccaccgaggcctcagcagtttcccaggggctgaacactgcctccgggcctcccccgagaccacgctcactggtggcttctttgttgcagtactggaacgggtagaggttccaagctcagtcccccaggctgaagcatcggcaccagaaatctctctcagcgcagccccacggaaaaaaaggagaccacgccggactgtggcccctcgcacactgccccctacagagcaggtctcctga

SEQ ID NO: 59700 - protein, 469 aa, Canis familiaris
MALYATAASVLANVESRRGSIKGLVYASSFQNVKQLYALVCETQRYSAVLDAVIASAGLLRAEKKLRPHLAKVLVYELLLGRGFRGGGGRWKPLLDRHQARLKAELARLKVQRRVSRNEDLLQVGSRPGAASQVPRFVRVNTLKTSSDDAIDYFKRQGFSYQGRASSLEDLRALKGKCFLLDPLLPELLVFPTQTDLHDHPLYQAGHLILQDKASCLPAMLLAPPPGSHVIDACAAPGNKTSHLAAFLKNQGRIFAFDLDAGRLASMATLLARAGVSCCELAQEDFLAVSPSDQRYRQVQYILLDPSCSGSGMPTRQLEEPGTGTPSKARLQALAGFQQRALRHALTFPSLQRLVYSTCSLCQEENEDVVQDALQQNPGTFRLAPVLPSWPHRGLSSFPGAEHCLRASPETTLTGGFFVAVLERVEVPSSVPQAEASAPEISLSAAPRKKRRPRRTVAPRTLPPTEQVS

SEQ ID NO: 59701 - DNA, 1701 bp, Cryptococcus neoformans var. neoformans JEC21
  CDS (1)..(1701)
atgattacaggctcatccgcacatctcgaccacgctctggcgcctcaagtaaatacttgtttgggcaccatgaacttttacaaatctgcagctctcgcgctcgaccatcttgataagcaccagggatcagtaaaagggtctttggcagctgctggtgtgaaagcttcaggcgctgaagccaagcgtatattagcattgattatcgagaccctcaaatatcgtcctgtcctccaacaactgcttaagacggtccccatcctcgcacttgaacgtaccactttcccttcccgcacgcccgccaagaccccgacttcacaatctctcgtcctcgtactcttacacgatctcctcttctcatctaggtctcgtatcgaagcgtccgataaatggccacccaaacccgctgtgatgcgtcaccaagcgaggttaaaggctgaacttgtcagaatccaaatcagggaaggcaagacgaaaaaggaagacttggcaaagacaagtggtgaaggagaggctgtgagatatatccgatataaccccaatgcagggagaccttttgaagagctcggggagtatctgaagaagaagggatatacaaagctggatgagcctgtttatcctatacctgaaggaaagtactttgccgacccgcacctgtcagacgtgttgttagccttcccaggttcagccaattggtgggtaaatgatgaatggtacgagggcggaggtgtaatcctccaagacaaggcgagttgtttcccggctcgggttttaatggaaggatgggtggaaggtgaaggagagtgtttggacgctacgtctgcaccaggtaacaaaactagttacgtttcggctttgatggcgaacaggggcaaactccatgcatttgagcgctctcccaatcgattcaagactcttgagaagatgctcgagaaagcccgctgctccaacgtacaagctcaaagagctgacttcacagacactgatcctaaaagtaaagagttcaagaatgtcacacgcatattacttgatccgagttgttccggttcggggatcgtcaacaggttggactatctcgtggatgacgatgccgaggaatcagattcgaaaacagaacgtctagagaagttggcgagcttccagcttcaaatgatccttcacgctttcaaatttccgtcagctcaacggattgtctattccacatgctctatccaccctgaggaagacgagcgtgtcgtcatggcggctctgcagtcgaatactgccaaagagaatggatggggtctggcaagtcgagagtccgttctacccaaatgggagagaagaggaaggcctgaggaaatggaaggagacgaggaactcgccaacggcgtgattcggtgccttccagaagacaagactaacggattcttcgtctcatgcttcatgcgtggtgacacaggcattcgacctaaggccacaaagaaagcaaaggatcaacgaccacccaagcgtccactaatagaggaacaggaggagatcgctgaagaaaaaggttcccctactgttgctgttgatgaggagggtggcgaacaagctggaaaacaagacaggctggccgcgaatatccctcggaaagaaaagacaaaagctcagttggagagggctaaacgcaagaaagctcagcagaaagttaaggggaagaagcgcaaggtagagttgtaa

SEQ ID NO: 59702 - protein, 566 aa, Cryptococcus neoformans var. neoformans JEC21
MITGSSAHLDHALAPQVNTCLGTMNFYKSAALALDHLDKHQGSVKGSLAAAGVKASGAEAKRILALIIETLKYRPVLQQLLKTVPILALERTTFPSRTPAKTPTSQSLVLVLLHDLLFSSRSRIEASDKWPPKPAVMRHQARLKAELVRIQIREGKTKKEDLAKTSGEGEAVRYIRYNPNAGRPFEELGEYLKKKGYTKLDEPVYPIPEGKYFADPHLSDVLLAFPGSANWWVNDEWYEGGGVILQDKASCFPARVLMEGWVEGEGECLDATSAPGNKTSYVSALMANRGKLHAFERSPNRFKTLEKMLEKARCSNVQAQRADFTDTDPKSKEFKNVTRILLDPSCSGSGIVNRLDYLVDDDAEESDSKTERLEKLASFQLQMILHAFKFPSAQRIVYSTCSIHPEEDERVVMAALQSNTAKENGWGLASRESVLPKWERRGRPEEMEGDEELANGVIRCLPEDKTNGFFVSCFMRGDTGIRPKATKKAKDQRPPKRPLIEEQEEIAEEKGSPTVAVDEEGGEQAGKQDRLAANIPRKEKTKAQLERAKRKKAQQKVKGKKRKVEL

SEQ ID NO: 59703 - DNA, 1632 bp, Cryptococcus neoformans var. neoformans JEC21
  CDS (1)..(1632)
atgaacttttacaaatctgcagctctcgcgctcgaccatcttgataagcaccagggatcagtaaaagggtctttggcagctgctggtgtgaaagcttcaggcgctgaagccaagcgtatattagcattgattatcgagaccctcaaatatcgtcctgtcctccaacaactgcttaagacggtccccatcctcgcacttgaacgtaccactttcccttcccgcacgcccgccaagaccccgacttcacaatctctcgtcctcgtactcttacacgatctcctcttctcatctaggtctcgtatcgaagcgtccgataaatggccacccaaacccgctgtgatgcgtcaccaagcgaggttaaaggctgaacttgtcagaatccaaatcagggaaggcaagacgaaaaaggaagacttggcaaagacaagtggtgaaggagaggctgtgagatatatccgatataaccccaatgcagggagaccttttgaagagctcggggagtatctgaagaagaagggatatacaaagctggatgagcctgtttatcctatacctgaaggaaagtactttgccgacccgcacctgtcagacgtgttgttagccttcccaggttcagccaattggtgggtaaatgatgaatggtacgagggcggaggtgtaatcctccaagacaaggcgagttgtttcccggctcgggttttaatggaaggatgggtggaaggtgaaggagagtgtttggacgctacgtctgcaccaggtaacaaaactagttacgtttcggctttgatggcgaacaggggcaaactccatgcatttgagcgctctcccaatcgattcaagactcttgagaagatgctcgagaaagcccgctgctccaacgtacaagctcaaagagctgacttcacagacactgatcctaaaagtaaagagttcaagaatgtcacacgcatattacttgatccgagttgttccggttcggggatcgtcaacaggttggactatctcgtggatgacgatgccgaggaatcagattcgaaaacagaacgtctagagaagttggcgagcttccagcttcaaatgatccttcacgctttcaaatttccgtcagctcaacggattgtctattccacatgctctatccaccctgaggaagacgagcgtgtcgtcatggcggctctgcagtcgaatactgccaaagagaatggatggggtctggcaagtcgagagtccgttctacccaaatgggagagaagaggaaggcctgaggaaatggaaggagacgaggaactcgccaacggcgtgattcggtgccttccagaagacaagactaacggattcttcgtctcatgcttcatgcgtggtgacacaggcattcgacctaaggccacaaagaaagcaaaggatcaacgaccacccaagcgtccactaatagaggaacaggaggagatcgctgaagaaaaaggttcccctactgttgctgttgatgaggagggtggcgaacaagctggaaaacaagacaggctggccgcgaatatccctcggaaagaaaagacaaaagctcagttggagagggctaaacgcaagaaagctcagcagaaagttaaggggaagaagcgcaaggtagagttgtaa

SEQ ID NO: 59704 - protein, 543 aa, Cryptococcus neoformans var. neoformans JEC21
MNFYKSAALALDHLDKHQGSVKGSLAAAGVKASGAEAKRILALIIETLKYRPVLQQLLKTVPILALERTTFPSRTPAKTPTSQSLVLVLLHDLLFSSRSRIEASDKWPPKPAVMRHQARLKAELVRIQIREGKTKKEDLAKTSGEGEAVRYIRYNPNAGRPFEELGEYLKKKGYTKLDEPVYPIPEGKYFADPHLSDVLLAFPGSANWWVNDEWYEGGGVILQDKASCFPARVLMEGWVEGEGECLDATSAPGNKTSYVSALMANRGKLHAFERSPNRFKTLEKMLEKARCSNVQAQRADFTDTDPKSKEFKNVTRILLDPSCSGSGIVNRLDYLVDDDAEESDSKTERLEKLASFQLQMILHAFKFPSAQRIVYSTCSIHPEEDERVVMAALQSNTAKENGWGLASRESVLPKWERRGRPEEMEGDEELANGVIRCLPEDKTNGFFVSCFMRGDTGIRPKATKKAKDQRPPKRPLIEEQEEIAEEKGSPTVAVDEEGGEQAGKQDRLAANIPRKEKTKAQLERAKRKKAQQKVKGKKRKVEL

SEQ ID NO: 59705 - DNA, 2043 bp, Dictyostelium discoideum
  CDS (1)..(2043)
atgtgtgatttttatcaacaagcagcagatgtaattgaacaattaattcaaaagaaaggatcaattaaaggattgacatataatagaaatgtgaatgttaaaacttcaaagacatgttatgcattagtttgtgaaacattgaaatataagggtgtaattgatcaaattattgaattaacagcaggattagaaaaagaatttaaaaagaataaaactataaagtatagtttattagttgtaatgatttatgaacttttatttagtgcaaatggaaagattaaaggcggtggacaggcaaagaagctactatcgcattaccaagcaccaattaatagtgcgttagcaagaatgaaaattcaaaaaaaggtatcggaaaatattgatttactacccgacaatatcagatacccaattacattgccacgttatgttagagttaatacattattcaatgattgtgatgaaaattgtattaaaaatgtaattgagcattttgtaaatgttgaaggatttgaactattatcaaaaccaccaaaattgcaaactaaatcaattacaataaaaaaagaaaatggcacagttgaacaacaacaacaaactacaattatattgggtgaaaaagaattttatcaagatttagattttccagagattttaatatttcatcatgctgtggatttacatgatcataaaatgttgctaaatggtcaaattatacttcaagataaagcatcttgtttaccatcttttattttatcaccaccacctggttcggtttgtattgattcttgttctgcacctggtaataaaacttcattattatctgcacaaatgaaaaatactggaaaaattttcgcaattgaaaaagatacaaaacgttgtggtactttaattaaattaacaaaaagatcactttgtaaaaatattgaaacaattaatgatagttttttaaatttaaaacatgatgatccaaaatttaaagatgttgaatatattttatgtgatccatcatgttcaggatctggtatcgtaaatcgtttggattatttattaccaacaaaatattcgacagatgaaatcgtaacagatgaaaatgatgaagatttagatgaaattttaaaccaacaaaatcaatcaacaaaattacctgaaaaagaaaaagaaaaatcaatattaaataaaaaagaattaaaaaaagaaaaaaagagaaaattaaaagaaatgaaacaaggtggtaaaaaacaacaaaaagataataataataaattaccattagtaccaccaattaaaacaaaagaagaaattgaagaacaagaaagaattgaagaagagaaacgtgttaaattattagcagattttcaattatcaattattcaacattcatttgcatttccaaatgttaaaaaagttatttattcaacttgttcaactcatcaagttgaaaatgaagatgttgtaaaacgtgcaatcgatgaattaaataaagatggtgaaaagtggaaagtagttaaaattttaccacattggactaatagtagaggtttaccaatttataaaaatagtgattattcaattcgtatgacaccttcaaaagattttacaattggttttttcgttgctttatttgaaaaaattattaataataattctgaaaataataataataataataataataataataataataataataataataataataataataataataataataataataataataataataataataataataataataataataataataataataattctgaaaataataaattaaatatcaaaaatgaaaatgaagcaccaaaaattattcaatctgataaaattcatataaaacctggaaataataaaaataataatagtaataataaaaataataataataataataataaaaataataaggataaaaataataataataataaggataaaaataaaataaatataaaaaatcaaaatataaaattagaagaatcagatcaaaaacatccaaaaaagaaattaaaattaaaataa

SEQ ID NO: 59706 - protein, 680 aa, Dictyostelium discoideum
MCDFYQQAADVIEQLIQKKGSIKGLTYNRNVNVKTSKTCYALVCETLKYKGVIDQIIELTAGLEKEFKKNKTIKYSLLVVMIYELLFSANGKIKGGGQAKKLLSHYQAPINSALARMKIQKKVSENIDLLPDNIRYPITLPRYVRVNTLFNDCDENCIKNVIEHFVNVEGFELLSKPPKLQTKSITIKKENGTVEQQQQTTIILGEKEFYQDLDFPEILIFHHAVDLHDHKMLLNGQIILQDKASCLPSFILSPPPGSVCIDSCSAPGNKTSLLSAQMKNTGKIFAIEKDTKRCGTLIKLTKRSLCKNIETINDSFLNLKHDDPKFKDVEYILCDPSCSGSGIVNRLDYLLPTKYSTDEIVTDENDEDLDEILNQQNQSTKLPEKEKEKSILNKKELKKEKKRKLKEMKQGGKKQQKDNNNKLPLVPPIKTKEEIEEQERIEEEKRVKLLADFQLSIIQHSFAFPNVKKVIYSTCSTHQVENEDVVKRAIDELNKDGEKWKVVKILPHWTNSRGLPIYKNSDYSIRMTPSKDFTIGFFVALFEKIINNNSENNNNNNNNNNNNNNNNNNNNNNNNNNNNNNNNNNNNNNNNNNNSENNKLNIKNENEAPKIIQSDKIHIKPGNNKNNNSNNKNNNNNNNKNNKDKNNNNNKDKNKINIKNQNIKLEESDQKHPKKKLKLK

SEQ ID NO: 59707 - DNA, 1497 bp, Candida albicans SC5314
  CDS (1)..(1497): transl_table=12
atgatcatcaaagaccgaactgaaaaaaaaaacacatacaaaaaaaaatatccaatcatattctttggcctcatctcatctcatttcctctatatcacatatacaccaatgaagttatattttgaagcagaaaagtttttaaaaccaaacaaaggaactaacgggagtctacaatctcgtatattcaacgataaaagattaaccaattccccaaaacacatatttgccttggtctattctacattaaagtacaaagaatacatcgatgtgattgtgaaaaaatcaaaaatccaacatgatcttcaaattaaaaaagtgaagatgagcaatgaattattatgcttattggttcatgatttattgttttcttcaaaagggagaatccagagtgggaaacatcctatgaaagatgcatttttgctgaacaagacaagattacaagcagaattcaccaaattgaaattgaaatataaagtgaagtcagttgaccaattaccaacgaaggaagctgacgatgatgaaactccaatacggtggtttagaattaataccattaaaattgacatagatagattttacaccaagcatccattcttcaagcaactacaaccagtgagctcaattgacgaaatcacagaaacagggataatttattctgatgattatattcctaatttatttggggttcatccaagagagaaaatcacatcgactgaagcttatagattaggggaaataattatccaggatcgtgcatcttgtttcccaagtcacatacttaatgcagatcctgaagatgttcatacccaagttatagatgcgtgcgcagcacctggaaacaaaacgacccatgcagcagcacatctaccaaactcagattcagtcgtgtatgcatttgaaagagattcaaaaagagtgaagatattgaagaccatgtgtgagaaagccacaggtaaaacgaaaaagaaacttatccaagtgactcacgctgatttcacaaccacaaaacccgaagattttcctgatgttactggattagttattgatccatcgtgtagtggatcaggtatttttggaagggcattagaagattcacataatgaagaagaaattgaaaatgttaacacagagaggcttaacaaattagctggatttcaatttgccataatgaaacacgcattgctgtttccatcagccaggaaagttgtttattcaacatgttcaattcacgcgcaagaaaatgagagggtcgtggtggatttgctactggatccagaagtaaatcgccgggggtggaagttggctgaccgagaaattgtgttaccgaagtgggacagaagaggttttgaagaagaatttatcaagatatcaagggatcctaaagaatgtgcgagattggcaggtggttgtgtacgagcaaatcctaaagaagatggagggatcggattttttacagcatgttttgtaagatcaactgaagttaaccatgagaactga

SEQ ID NO: 59708 - protein, 498 aa, Candida albicans SC5314
MIIKDRTEKKNTYKKKYPIIFFGLISSHFLYITYTPMKLYFEAEKFLKPNKGTNGSLQSRIFNDKRLTNSPKHIFALVYSTLKYKEYIDVIVKKSKIQHDLQIKKVKMSNELLCLLVHDLLFSSKGRIQSGKHPMKDAFLSNKTRLQAEFTKLKLKYKVKSVDQLPTKEADDDETPIRWFRINTIKIDIDRFYTKHPFFKQLQPVSSIDEITETGIIYSDDYIPNLFGVHPREKITSTEAYRLGEIIIQDRASCFPSHILNADPEDVHTQVIDACAAPGNKTTHAAAHLPNSDSVVYAFERDSKRVKILKTMCEKATGKTKKKLIQVTHADFTTTKPEDFPDVTGLVIDPSCSGSGIFGRALEDSHNEEEIENVNTERLNKLAGFQFAIMKHALSFPSARKVVYSTCSIHAQENERVVVDLLSDPEVNRRGWKLADREIVLPKWDRRGFEEEFIKISRDPKECARLAGGCVRANPKEDGGIGFFTACFVRSTEVNHEN

SEQ ID NO: 59709 - DNA, 1680 bp, Aspergillus fumigatus Af293
  CDS (1)..(1680)
atgtctctttactacgacgcggtctcggttttgaccgctccatcatcaacggggggttccttcaaatcccgcatctacagctcgcggaacctcaaatcctccccggcgcaaatctacgctctggtcatcgaggcctcaaaatgggatatccttctcaaggaggtcattgaggccgcagggatcctcaagcacgagcccaagctcactcccttacttgccctactgcttgtgcacgaccacctcctcgccaagaatggcatcgcagccaacgcaaaccatccgctgcgccaggcgatcgagagacacaagactaggctaaatggagaattcgtcaaggcgcgcgtgcgccgcggatgtgcttcgatacccgatctgaaggctgccgtgctacgcgagaaacaggccgcgcagggtgcggtcgggacttcttcgacggcggtgtatccgcgctgggtgcggatcaacaatcttcgcacgacgatggaggagcagctccagtctacattcaagtcgtataccagagtcaattcgctcgcggagctaggggagaaagacgaggcgaagctgtacgttgacccgcacgttccggatcttgtggccgtcgcgccgggcgtggacttcacctcgtcccctgcctacaagaacgggcagatcatcttgcaggataaggcgtcgtgtttcccggcatatctgttacttggggatagcgaggactggtccggcgatctgctggatggatgcgcggcacctggaaacaagacgacacacatggcttcgttgcttgcgaagcatgccgccggtagggacgttacccgccacatcgtttccatggatgcgtccaaggtgcgctccaagacattgcagaaaatggtcagcgccgcgggcgcagacaatatagtcaccgtcctccagggccaggatttcctggcgctcgatccaaccgaggaacgcttcgcaaacgtcaccggcctcctcctcgaccctagttgctccggcagcgggatcgtcggtcgcgacgacgtccccaaactcgcactgcccgccgctgcatccacgccgaccagtaaatcacagggaaagaagcgcaaacgccgacacgacgacgaggaggagactcagcccggcaacgccgccgctgcgacctcaacttcagcgtccgcgacagatgaaaacgaaatcgcgagcgcaaccctcgaccgggatcgtctgacgaaactctctaacctgcaggcgcgcatcgtcgaacacgcgctgagcttccccgccgccacccgtgtcacgtacagtacgtgctccattcacctgatcgagaacgaggccgttgtgtctcgtgtactcgcctcggacgtagcgcgctctcgcgggtggagaatcatgcgccgcgaggagcaaccccgcggcatgaaggcctggccgcaccgtggtgtcaggacagagagccgatatggcgatgtgaagggcgatggggaagccactccagtggatttatcagatgaagaactagaggcttgtttgcggtgttgggccgatgatgaggagggacttggtgggttcttcgttgcaggttttgtgcgtgatgagggaagcgtagactgtccttctacgaaaaagccagcgtctcaggaaacggacgaggatacggaggccagcgatggggagtgggagggtttctctgattga

SEQ ID NO: 59710 - protein, 559 aa, Aspergillus fumigatus Af293
MSLYYDAVSVLTAPSSTGGSFKSRIYSSRNLKSSPAQIYALVIEASKWDILLKEVIEAAGILKHEPKLTPLLALLLVHDHLLAKNGIAANANHPLRQAIERHKTRLNGEFVKARVRRGCASIPDLKAAVLREKQAAQGAVGTSSTAVYPRWVRINNLRTTMEEQLQSTFKSYTRVNSLAELGEKDEAKLYVDPHVPDLVAVAPGVDFTSSPAYKNGQIILQDKASCFPAYLLLGDSEDWSGDLLDGCAAPGNKTTHMASLLAKHAAGRDVTRHIVSMDASKVRSKTLQKMVSAAGADNIVTVLQGQDFLALDPTEERFANVTGLLLDPSCSGSGIVGRDDVPKLALPAAASTPTSKSQGKKRKRRHDDEEETQPGNAAAATSTSASATDENEIASATLDRDRLTKLSNLQARIVEHALSFPAATRVTYSTCSIHLIENEAVVSRVLASDVARSRGWRIMRREEQPRGMKAWPHRGVRTESRYGDVKGDGEATPVDLSDEELEACLRCWADDEEGLGGFFVAGFVRDEGSVDCPSTKKPASQETDEDTEASDGEWEGFSD

SEQ ID NO: 59711 - DNA, 1527 bp, Strongylocentrotus purpuratus
  CDS (1)..(1527)
atgccgccgaatttcgtcaaaacagatatctacgatgaggcatctgctgtcatcagtaaggcacagataaaggaaaagtcaattaaatcgctggtttatgaaagtaattctaagaatatccgccagttgtatgccctggtctgtgagtcattaaagtatgctacaatcattgaggagatcattgacaacactgcattcctacagaaggtcccatggatggagagaaacctagcactggtgctcctgtatgactttctgtttggcaagaagcttgccggcgcatgctcgggaaagtatcgtaaggctgtggtcaaacagaagaaggagctgaaggctgagctacagaagatgaaagagaagaaaggagcgaccagtttatctgatctgttaccaagtcaagtcaaagatgaagtttctattccaaggtacatacgtgtgaacctcctgaagaccagcattgatgatgtcatcgctgctttcatcgaggctgggtacacctgtgtgatgacgagggatgaagcagaagaagagaaacaagatgctactccaaagtatatcagtaacctgagtgtggatgtgagtcggagtctgggtcagtatgagtttgctactgatcttcatctagatgatgtcctggtgtttgcagcaaggacagacttccacagtcaccctctttatcttcaaggccacatcattctcatggacaaggccagttgttttccagcttatgtcctatcagctaaaccaggctcacatgtaatagatgcttgctcagctcctggtaacaagactagccacatggctagcttgctcagaaatgatgcgaaaatttattcctacgacctggaccctaaacgaatcagtgtgatgaatacccttctagagagagcaggagtgtctgcagctaagactatccatcaggacttcttgactactgacccctgtagtaaagagaacatgcgtgtagagtacaccatagtagatccatcatgtagcgggtctggtatggctagtaggaaagactacttggtggatgacgacatgcaggaggatagagcacgactccggtccctgcatcagctccagtgccgcatcctcactcatgcgctctcctttcccagtgtgaggagagtggtgtactccacctgctcggtgcatagggaagagaatgaggatgtggtgaggactgtgttggagcagagtgatgggttcagactggtgccggtgatgcagggtacatgggatcgtagaggattgtccaccagtcaggatggggaagaggaccatataggggagtgctgcgtgcgagcatcgcctcatacggacttgactaatggattctttgtggccctctttgagcggactgggaagagtgggactggagtatcaaagagactggttccagagaacactattaacggacacggccaatctcttgacgagaagcactccaagaagaaaaagaaggctaaagtcggcaaagaggaaacagttgaaagtcaagaggaagctttgaaggctgattag

SEQ ID NO: 59712 - protein, 508 aa, Strongylocentrotus purpuratus
MPPNFVKTDIYDEASAVISKAQIKEKSIKSLVYESNSKNIRQLYALVCESLKYATIIEEIIDNTAFLQKVPWMERNLALVLLYDFLFGKKLAGACSGKYRKAVVKQKKELKAELQKMKEKKGATSLSDLLPSQVKDEVSIPRYIRVNLLKTSIDDVIAAFIEAGYTCVMTRDEAEEEKQDATPKYISNLSVDVSRSLGQYEFATDLHLDDVLVFAARTDFHSHPLYLQGHIILMDKASCFPAYVLSAKPGSHVIDACSAPGNKTSHMASLLRNDAKIYSYDLDPKRISVMNTLLERAGVSAAKTIHQDFLTTDPCSKENMRVEYTIVDPSCSGSGMASRKDYLVDDDMQEDRARLRSLHQLQCRILTHALSFPSVRRVVYSTCSVHREENEDVVRTVLEQSDGFRLVPVMQGTWDRRGLSTSQDGEEDHIGECCVRASPHTDLTNGFFVALFERTGKSGTGVSKRLVPENTINGHGQSLDEKHSKKKKKAKVGKEETVESQEEALKAD

SEQ ID NO: 59713 - DNA, 1590 bp, Trypanosoma cruzi
  CDS (1)..(1590)
atggacgtctaccggcaggctagtgaaattgtgtgcgccgtgcgtgaaggaaatggcacggcgaaggctctctgcctccggaaggagatgcagaagaagaagcagacatatgcggtggtctgcgagacgctgcggcactacgacctcttgcaggacgtgcttgaccaggcaaagttcttcaagtactacccgcgtgccaacaaggggtttgccatctgcatggcctacgacgttgtgctgggaaagggactgaacaccaaccgcgacacgacggcacaggcgatcaaaaagtccgcgccgtacttgcgggaggcgtattggcacgtgaagaagcatcacgttatcccctcacgtgcacatgagcccttcactgaggacagtaacggtgggagcaggaatgatgaggttgataataacgaggacaattacaatcgccgctgcacgctcactcagcaatgcttttctggcgattcggacagggcggctgcggtgccagagctgcagattccacggtatgcgcgagtgaatacgttgaagattgacgtggttactttagtggagcgtctccaccgcgctgctgagaagcgtggccgtgaagatgacggaagccaagggaaggaacaacaacgaaaagagaaaaaaacccatcatatgaaagggtttcgtctgttgtcggccttcactatggatcctgtggtgccgtcgctgcttgtattcccagcaggcaccgacctgcacgctcacccggcggtgcgcagcggtcaactcatcctgcaggatcgtgcatcgtgtcttcccgcatgtattctgctggacgcggtagaggtggttaggccgtcatccgctggggccggtgcaccgctggagtacatcgttgacgcctgtgccgcccctggcaacaagacgacacatctcgcagcgttgggcgccccacacgtgaaaataatggcggtcgagcgcgatgagaagcgtgcggaccttcttttccgccgtgtgcagagcctcggagccagcgactatgtgaatgttgtcaacttggactttttccagatgtcctcagcggatcgtgaggcaacggaggggattctgctggacccaagctgcagcgctagtggggtgttgacgcgcgtggatgtgtcgcttatgcggcagcgccaggcccgtgtggccgaagtcggtgaaaacaacaggggtgaggatggagctggcaacaatgagacgtgggccatcagcccagaagaacatggtaccgaatttgccagcaacgccgatcgggtcatgggccttgcgcgtctgcagcggaagcttctggcgcatgccctgctctcatttgacaattgtcgtacggtcgtgtactcaacatgctccgttcacgtggaggaaaacgagcttgtggtgcggcaggtgctggaggacacgcgggtgcaggcacgtggctgggcgttgagcaacatcatgccaacaacatggaaaacacgtgggcagaaaacggaaggcgacacattcccactggaccacaccatccgttgcgaccccgtcgcggacgccactaacggattttacgtggctcgctttgaccgcgccgtttaa

SEQ ID NO: 59714 - protein, 529 aa, Trypanosoma cruzi
MDVYRQASEIVCAVREGNGTAKALCLRKEMQKKKQTYAVVCETLRHYDLLQDVLDQAKFFKYYPRANKGFAICMAYDVVLGKGLNTNRDTTAQAIKKSAPYLREAYWHVKKHHVIPSRAHEPFTEDSNGGSRNDEVDNNEDNYNRRCTLTQQCFSGDSDRAAAVPELQIPRYARVNTLKIDVVTLVERLHRAAEKRGREDDGSQGKEQQRKEKKTHHMKGFRLLSAFTMDPVVPSLLVFPAGTDLHAHPAVRSGQLILQDRASCLPACILLDAVEVVRPSSAGAGAPLEYIVDACAAPGNKTTHLAALGAPHVKIMAVERDEKRADLLFRRVQSLGASDYVNVVNLDFFQMSSADREATEGILLDPSCSASGVLTRVDVSLMRQRQARVAEVGENNRGEDGAGNNETWAISPEEHGTEFASNADRVMGLARLQRKLLAHALLSFDNCRTVVYSTCSVHVEENELVVRQVLEDTRVQARGWALSNIMPTTWKTRGQKTEGDTFPLDHTIRCDPVADATNGFYVARFDRAV

SEQ ID NO: 59715 - DNA, 1701 bp, Trypanosoma brucei
  CDS (1)..(1701)
atggatgtttatcgacaagcaagtgaaattgtgcgggctgtgcgtgaaggaaccggcactgccaaagcgctgtgtttgcgtaaggaaatgcagaagaagcgccaaacgtacgctgttgtgtgcgagactctgcggcattatgaccttctccaggatgtcctcgagcaagcagaattctttcaatattacccacgggccaatagagattttgcgatttgcatggcttatgacgctgtgcttggaaagggagtcaacaccaaccgtgatacgaccgcgcaggctattcaaaagtcggtgtcctatcttcaggaggcatacgaacgtgtgaagaagcaccatgttattcccccacgcgccggggagctattgacagacgaggaagctggcccctgtgcacgcaccggcgatcataataatgatgggggaagggtcaaacacaacggtgttgatggcggctcgcttgggaaacattttgtttctgatggtgaaggtgccggtgacaacacccagggactgggttgtctgattccgcgttatgcgcgagtgaacacgctgaagattgatgtggacagcctggtggaacgtcttcgccgtgcctccgcgaaacgcgagcgtaacaatacggaaaactgtacaggaaacgatcatagtaggcgcgatcatcgacatcgtgcagctggaattcgtgtactgccaccctttaccttggatcctgttgtaccgtcactgctagttttcccaccaggtaccgatctacacgcccatccggccgttcgaagtggacaacttgtgctacaggaccgtgcatcgtgtcttcctgtttgtgtgctccttaatgccgtggaggttatcacgtccttctctgcttctggagaaggtgaaggtgatagcaaaccggctgaaccattggaatatgttgttgacgcctgtgcggctcctgggaataagacaactcagctggcagccctgggtgcgcctcatgtgaagataatggcgattgaacgtgacgacaagcgagctgagttgttgaggcatcgcgtgcagagcttgggggccgctgattacacaaacgtggttaatatggactttctgaagatggcacaagacgatcgtgaggtgacggaaggaattttgctggacccaagttgcagtgccagtggcgtgctgacaagagtggatgtggcccttttgcggaagcaatgcgttgctgtggatggcagcggtatctacactaacgatgttgttcgtcaagaaactgctgaggaaggggtgagcgagaccgctgttggtggggaagtgggcaccataactgcagaggctcaaggagtcgggtttgcaagcaacatggagcgcgtgatgggccttgcccggcttcagcgcaaattacttgcccactcacttctttcctttgacaattgtcgcacggttgtgtactccacatgctcagtgcatgaggcagaaaacgaggaggtagtgcggcaggttctacaggacgagcgggtacaggctcgtgggtgggcacttagcaacatcatgccgacgacgtggcggacgcgtgggtggaggaacgacagtgatacgtttccacttgagtacaccattcggtgtgaccccgaagtggacgcaaccaatggtttttttgtcgctcgtttcgaccgtgttgtggcgacgccgcagaagaggtcgaagaagaagcggtga

SEQ ID NO: 59716 - protein, 566 aa, Trypanosoma brucei
MDVYRQASEIVRAVREGTGTAKALCLRKEMQKKRQTYAVVCETLRHYDLLQDVLEQAEFFQYYPRANRDFAICMAYDAVLGKGVNTNRDTTAQAIQKSVSYLQEAYERVKKHHVIPPRAGELLTDEEAGPCARTGDHNNDGGRVKHNGVDGGSLGKHFVSDGEGAGDNTQGLGCLIPRYARVNTLKIDVDSLVERLRRASAKRERNNTENCTGNDHSRRDHRHRAAGIRVLPPFTLDPVVPSLLVFPPGTDLHAHPAVRSGQLVLQDRASCLPVCVLLNAVEVITSFSASGEGEGDSKPAEPLEYVVDACAAPGNKTTQLAALGAPHVKIMAIERDDKRAELLRHRVQSLGAADYTNVVNMDFLKMAQDDREVTEGILLDPSCSASGVLTRVDVALLRKQCVAVDGSGIYTNDVVRQETAEEGVSETAVGGEVGTITAEAQGVGFASNMERVMGLARLQRKLLAHSLLSFDNCRTVVYSTCSVHEAENEEVVRQVLQDERVQARGWALSNIMPTTWRTRGWRNDSDTFPLEYTIRCDPEVDATNGFFVARFDRVVATPQKRSKKKR

SEQ ID NO: 59717 - DNA, 1290 bp, Homo sapiens
  CDS (1)..(1290)
atggggctgtatgctgcagctgcaggcgtgttggccggcgtggagagccgccagggctctatcaaggggttggtgtactccagcaacttccagaacgtgaagcagctgtacgcgctggtgtgcggaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggctctgttgggccggcaccaaccgaggctcaaggctgagttggctcggctcaaagttcatcggggtgtgagccgaaatgaggacctgttggaagtgggatccaggcctggtccagcctcccagctgcctcgatttgtgcgtgtgaacactctcaagacctgctccgatgatgtagttgattatttcaagagacaaggtttctcctatcagggtcgggcttccagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcactcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtga

SEQ ID NO: 59718 - protein, 429 aa, Homo sapiens [sequence omitted]

SEQ ID NO: 59719 - DNA, 25 bp, Artificial sequence
  (1)..(25): primer
atgaatttctacagggatgcaacat

SEQ ID NO: 59720 - DNA, 26 bp, Artificial sequence
  (1)..(26): primer
ttaatctctttcaaaacagacagcaa

SEQ ID NO: 59721 - protein, 847 aa, Artificial sequence
  Variant (2)..(3): xaa in position 2 to 3 is any amino acid
  Variant (5)..(7): xaa in position 5 to 7 is any amino acid
  Variant (9)..(32): xaa in position 9 to 32 is any amino acid
  Variant (33)..(185): xaa in position 33 to 185 is any or no amino acid
  Variant (191)..(194): xaa in position 191 to 194 is any amino acid
  Variant (197)..(199): xaa in position 197 to 199 is any amino acid
  Variant (201)..(202): xaa in position 201 to 202 is any amino acid
  Variant (205)..(214): xaa in position 205 to 214 is any amino acid
  Variant (215)..(230): xaa in position 215 to 230 is any or no amino acid
  Variant (232)..(233): xaa in position 232 to 233 is any amino acid
  Variant (236)..(236): xaa in position 236 is any amino acid
  Variant (241)..(245): xaa in position 241 to 245 is any amino acid
  Variant (246)..(255): xaa in position 246 to 255 is any or no amino acid
  Variant (257)..(257): xaa in position 257 is any amino acid
  Variant (258)..(258): xaa in position 258 is any or no amino acid
  Variant (260)..(260): xaa in position 260 is any amino acid
  Variant (262)..(262): xaa in position 262 is any amino acid
  Variant (263)..(265): xaa in position 263 to 265 is any or no amino acid
  Variant (267)..(271): xaa in position 267 to 271 is any amino acid
  Variant (273)..(284): xaa in position 273 to 284 is any amino acid
  Variant (286)..(293): xaa in position 286 to 293 is any amino acid
  Variant (294)..(341): xaa in position 294 to 341 is any or no amino acid
  Variant (344)..(344): xaa in position 344 is any amino acid
  Variant (348)..(348): xaa in position 348 is any amino acid
  Variant (350)..(353): xaa in position 350 to 353 is any amino acid
  Variant (354)..(411): xaa in position 354 to 411 is any or no amino acid
  Variant (413)..(414): xaa in position 413 to 414 is any amino acid
  Variant (416)..(417): xaa in position 416 to 417 is any amino acid
  Variant (419)..(423): xaa in position 419 to 423 is any amino acid
  Variant (424)..(437): xaa in position 424 to 437 is any or no amino acid
  Variant (439)..(439): xaa in position 439 is any or no amino acid
  Variant (449)..(449): xaa in position 449 is any amino acid
  Variant (452)..(452): xaa in position 452 is any amino acid
  Variant (455)..(461): xaa in position 455 to 461 is any amino acid
  Variant (462)..(482): xaa in position 462 to 482 is any or no amino acid
  Variant (486)..(486): xaa in position 486 is any amino acid
  Variant (500)..(500): xaa in position 500 is any amino acid
  Variant (502)..(505): xaa in position 502 to 505 is any amino acid
  Variant (506)..(538): xaa in position 506 to 538 is any or no amino acid
  Variant (540)..(540): xaa in position 540 is any amino acid
  Variant (542)..(542): xaa in position 542 is any amino acid
  Variant (544)..(547): xaa in position 544 to 547 is any amino acid
  Variant (549)..(551): xaa in position 549 to 551 is any amino acid
  Variant (553)..(554): xaa in position 553 to 554 is any amino acid
  Variant (557)..(558): xaa in position 557 to 558 is any amino acid
  Variant (560)..(563): xaa in position 560 to 563 is any amino acid
  Variant (564)..(580): xaa in position 564 to 580 is any or no amino acid
  Variant (583)..(589): xaa in position 583 to 589 is any amino acid
  Variant (590)..(591): xaa in position 590 to 591 is any or no amino acid
  Variant (593)..(594): xaa in position 593 to 594 is any amino acid
  Variant (596)..(598): xaa in position 596 to 598 is any amino acid
  Variant (610)..(611): xaa in position 610 to 611 is any amino acid
  Variant (613)..(623): xaa in position 613 to 623 is any amino acid
  Variant (624)..(711): xaa in position 624 to 711 is any or no amino acid
  Variant (714)..(715): xaa in position 714 to 715 is any amino acid
  Variant (718)..(719): xaa in position 718 to 719 is any amino acid
  Variant (721)..(723): xaa in position 721 to 723 is any amino acid
  Variant (725)..(725): xaa in position 725 is any amino acid
  Variant (729)..(730): xaa in position 729 to 730 is any or no amino acid
  Variant (733)..(735): xaa in position 733 to 735 is any amino acid
  Variant (738)..(738): xaa in position 738 is any amino acid
  Variant (745)..(747): xaa in position 745 to 747 is any amino acid
  Variant (751)..(751): xaa in position 751 is any amino acid
  Variant (754)..(756): xaa in position 754 to 756 is any amino acid
  Variant (758)..(768): xaa in position 758 to 768 is any amino acid
  Variant (769)..(778): xaa in position 769 to 778 is any or no amino acid
  Variant (780)..(781): xaa in position 780 to 781 is any amino acid
  Variant (783)..(784): xaa in position 783 to 784 is any amino acid
  Variant (785)..(785): xaa in position 785 is any or no amino acid
  Variant (788)..(791): xaa in position 788 to 791 is any amino acid
  Variant (792)..(818): xaa in position 792 to 818 is any or no amino acid
  Variant (821)..(821): xaa in position 821 is any amino acid
  Variant (822)..(822): xaa in position 822 is any or no amino acid
  Variant (824)..(829): xaa in position 824 to 829 is any amino acid
  Variant (830)..(839): xaa in position 830 to 839 is any or no amino acid
  Variant (842)..(842): xaa in position 842 is any amino acid
  Variant (844)..(846): xaa in position 844 to 846 is any amino acid
YXXAXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLYALVXXXXKYXXXLXXVIXXXXXXXXXXXXXXXXXXXXXXXXXXLXXVLXYDLLXXXXXXXXXXXXXXXKXXIXRXXXXLXXXXXRXXXXXXXXXXXXLXXXXXXXXXXXXXXXXXXXXXXXXXXXXXXXXXXXXXXXXXXXXXXXXXXXXXXXXRWXRVNXLXXXXXXXXXXXXXXXXXXXXXXXXXXXXXXXXXXXXXXXXXXXXXXXXXXXXXXXXXXXXXXDXXVXXLXXXXXXXXXXXXXXXXXXXGXIILQDKASCXPAXLLXXXXXXXXXXXXXXXXXXXXXXXXXXXXVIDXCAAPGNKTSHLAAXLXXXXXXXXXXXXXXXXXXXXXXXXXXXXXXXXXXXXXIXAXEXXXXRXXXLXXMLXXAXXXXXXXXXXXXXXXXXXXXXDFXXXXXXXXXYXXVXXXLLDPSCSGSGIXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLXXLAXXQXXXLXHALXXFPXXXRVXYSTCSIXXXENEXVVXXXLXXXXXXXXXXXXXXXXXXXXXLXXWXXXRGXXXXXXXXXXXXXXXXXXXXXXXXXXXXXXXLRXXPXXXXXXXXXXXXXXXXFFXAXXXR

SEQ ID NO: 59722 - protein, 14 aa, Artificial sequence
  Variant (2)..(2): xaa in position 2 is Ile or Leu
  Variant (4)..(4): xaa in position 4 is Asp, Gly or Asn
  Variant (5)..(5): xaa in position 5 is Lys or Arg
  Variant (7)..(7): xaa in position 7 is Ser or Thr
  Variant (9)..(9): xaa in position 9 is Phe or Leu
  Variant (10)..(10): xaa in position 10 is Ala or Pro
  Variant (11)..(11): xaa in position 11 is Ala or Ser
  Variant (12)..(12): xaa in position 12 is any amino acid
  Variant (13)..(13): xaa in position 13 is Ile, Leu or Val
IXQXXAXCXXXXXL

SEQ ID NO: 59723 - protein, 14 aa, Artificial sequence
  Variant (2)..(2): xaa in position 2 is Ala, Cys, Gly, Ser or Thr
  Variant (4)..(4): xaa in position 4 is Ala or Ser
  Variant (8)..(8): xaa in position 8 is any amino acid
  Variant (11)..(13): xaa in position 11 to 13 is any amino acid
DXCXAPGXKTXXXA

SEQ ID NO: 59724 - protein, 11 aa, Artificial sequence
  Variant (9)..(9): xaa in position 9 is Ile or Met
  Variant (10)..(10): xaa in position 10 is any amino acid
  Variant (11)..(11): xaa in position 11 is Ala, Cys, Gly, Asn, Ser or Thr
DPSCSGSGXXX

SEQ ID NO: 59725 - protein, 42 aa, Artificial sequence
  Variant (2)..(4): xaa in position 2 to 4 is any amino acid
  Variant (6)..(8): xaa in position 6 to 8 is any amino acid
  Variant (9)..(9): xaa in position 9 is Ile, Leu, Met or Val
  Variant (10)..(10): xaa in position 10 is any amino acid
  Variant (13)..(14): xaa in position 13 to 14 is any amino acid
  Variant (15)..(15): xaa in position 15 is any or no amino acid
  Variant (17)..(17): xaa in position 17 is Asp, Gly or Pro
  Variant (18)..(21): xaa in position 18 to 21 is any amino acid
  Variant (22)..(22): xaa in position 22 is Ile, Leu or Val
  Variant (23)..(23): xaa in position 23 is any amino acid
  Variant (29)..(29): xaa in position 29 is Ile, Leu or Val
  Variant (30)..(32): xaa in position 30 to 32 is any amino acid
  Variant (34)..(34): xaa in position 34 is Asp or Asn
  Variant (36)..(36): xaa in position 36 is any amino acid
  Variant (39)..(41): xaa in position 39 to 41 is any amino acid
LXXXQXXXXXHAXXXFXXXXXXXYSTCSXXXXEXEXVVXXXL

SEQ ID NO: 59726 - DNA, 1518 bp, Saccharomyces cerevisiae; identical to SEQ ID NO: 2533
  CDS (1)..(1518)

SEQ ID NO: 59727 - protein, 505 aa, Saccharomyces cerevisiae; identical to SEQ ID NO: 2534

SEQ ID NO: 59728 - DNA, 1548 bp, Mus musculus (house mouse); identical to SEQ ID NO: 2535
  CDS (1)..(1548)

SEQ ID NO: 59729 - protein, 515 aa, Mus musculus (house mouse); identical to SEQ ID NO: 2536

SEQ ID NO: 59730 - DNA, 1593 bp, Fugu rubripes (Japanese pufferfish); identical to SEQ ID NO: 2537
  CDS (1)..(1593)

SEQ ID NO: 59731 - protein, 530 aa, Fugu rubripes (Japanese pufferfish); identical to SEQ ID NO: 2538

SEQ ID NO: 59732 - DNA, 1506 bp, Vibrio cholerae; identical to SEQ ID NO: 2539
  CDS (1)..(1506)

SEQ ID NO: 59733 - protein, 501 aa, Vibrio cholerae; identical to SEQ ID NO: 2540

SEQ ID NO: 59734 - DNA, 1470 bp, Pseudomonas aeruginosa; identical to SEQ ID NO: 2541
  CDS (1)..(1470)

SEQ ID NO: 59735 - protein, 489 aa, Pseudomonas aeruginosa; identical to SEQ ID NO: 2542

SEQ ID NO: 59736 - DNA, 1485 bp, Staphylococcus aureus; identical to SEQ ID NO: 2543
  CDS (1)..(1485)

SEQ ID NO: 59737 - protein, 494 aa, Staphylococcus aureus; identical to SEQ ID NO: 2544

SEQ ID NO: 59738 - DNA, 1488 bp, Streptococcus pneumoniae; identical to SEQ ID NO: 2545
  CDS (1)..(1488)

SEQ ID NO: 59739 - protein, 495 aa, Streptococcus pneumoniae; identical to SEQ ID NO: 2546

SEQ ID NO: 59740 - DNA, 1476 bp, Salmonella enterica subsp. enterica serovar Typhi; identical to SEQ ID NO: 2547
  CDS (1)..(1476)

SEQ ID NO: 59741 - protein, 491 aa, Salmonella enterica subsp. enterica serovar Typhi; identical to SEQ ID NO: 2548

SEQ ID NO: 59742 - DNA, 1476 bp, Agrobacterium tumefaciens; identical to SEQ ID NO: 2549
  CDS (1)..(1476)

SEQ ID NO: 59743 - protein, 491 aa, Agrobacterium tumefaciens; identical to SEQ ID NO: 2550

SEQ ID NO: 59744 - DNA, 1530 bp, Nostoc sp. PCC 7120; identical to SEQ ID NO: 2551
  CDS (1)..(1530)

SEQ ID NO: 59745 - protein, 509 aa, Nostoc sp. PCC 7120; identical to SEQ ID NO: 2552

SEQ ID NO: 59746 - DNA, 1386 bp, Agrobacterium tumefaciens; identical to SEQ ID NO: 2553
  CDS (1)..(1386)

SEQ ID NO: 59747 - protein, 461 aa, Agrobacterium tumefaciens; identical to SEQ ID NO: 2554

SEQ ID NO: 59748 - DNA, 1476 bp, Brucella melitensis; identical to SEQ ID NO: 2555
  CDS (1)..(1476)

SEQ ID NO: 59749 - protein, 491 aa, Brucella melitensis; identical to SEQ ID NO: 2556

SEQ ID NO: 59750 - DNA, 1458 bp, Zymomonas mobilis; identical to SEQ ID NO: 2557
  CDS (1)..(1458)

SEQ ID NO: 59751 - protein, 485 aa, Zymomonas mobilis; identical to SEQ ID NO: 2558

SEQ ID NO: 59752 - DNA, 1470 bp, Bacillus subtilis; identical to SEQ ID NO: 2559
  CDS (1)..(1470)

SEQ ID NO: 59753 - protein, 489 aa, Bacillus subtilis; identical to SEQ ID NO: 2560

SEQ ID NO: 59754 - DNA, 1401 bp, Mycobacterium tuberculosis; identical to SEQ ID NO: 2561
  CDS (1)..(1401)

SEQ ID NO: 59755 - protein, 466 aa, Mycobacterium tuberculosis; identical to SEQ ID NO: 2562

SEQ ID NO: 59756 - DNA, 1545 bp, Mycobacterium tuberculosis; identical to SEQ ID NO: 2563
  CDS (1)..(1545)

SEQ ID NO: 59757 - protein, 514 aa, Mycobacterium tuberculosis; identical to SEQ ID NO: 2564

SEQ ID NO: 59758 - DNA, 1320 bp, Chlamydia trachomatis; identical to SEQ ID NO: 2565
  CDS (1)..(1320)

SEQ ID NO: 59759 - protein, 439 aa, Chlamydia trachomatis; identical to SEQ ID NO: 2566

SEQ ID NO: 59760 - DNA, 1773 bp, Deinococcus radiodurans; identical to SEQ ID NO: 2567
  CDS (1)..(1773)

SEQ ID NO: 59761 - protein, 590 aa, Deinococcus radiodurans; identical to SEQ ID NO: 2568

SEQ ID NO: 59762 - DNA, 1467 bp, Pseudomonas aeruginosa; identical to SEQ ID NO: 2569
  CDS (1)..(1467)

SEQ ID NO: 59763 - protein, 488 aa, Pseudomonas aeruginosa; identical to SEQ ID NO: 2570

SEQ ID NO: 59764 - DNA, 1422 bp, Caulobacter crescentus; identical to SEQ ID NO: 2571
  CDS (1)..(1422)

SEQ ID NO: 59765 - protein, 473 aa, Caulobacter crescentus; identical to SEQ ID NO: 2572

SEQ ID NO: 59766 - DNA, 1437 bp, Borrelia burgdorferi (Lyme disease spirochete); identical to SEQ ID NO: 2573
  CDS (1)..(1437)

SEQ ID NO: 59767 - protein, 478 aa, Borrelia burgdorferi (Lyme disease spirochete); identical to SEQ ID NO: 2574

SEQ ID NO: 59768 - DNA, 1539 bp, Chlamydophila pneumoniae, Chlamydia pneumoniae; identical to SEQ ID NO: 2575
  CDS (1)..(1539)

SEQ ID NO: 59769 - protein, 512 aa, Chlamydophila pneumoniae, Chlamydia pneumoniae; identical to SEQ ID NO: 2576

SEQ ID NO: 59770 - DNA, 1476 bp, Escherichia coli; identical to SEQ ID NO: 2577
  CDS (1)..(1476)

SEQ ID NO: 59771 - protein, 491 aa, Escherichia coli; identical to SEQ ID NO: 2578

SEQ ID NO: 59772 - DNA, 1548 bp, Treponema pallidum subsp. pallidum (syphilis spirochete); identical to SEQ ID NO: 2579
  CDS (1)..(1548)

SEQ ID NO: 59773 - protein, 515 aa, Treponema pallidum subsp. pallidum (syphilis spirochete); identical to SEQ ID NO: 2580

SEQ ID NO: 59774 - DNA, 1476 bp, Buchnera sp; identical to SEQ ID NO: 2581
  CDS (1)..(1476)

SEQ ID NO: 59775 - protein, 491 aa, Buchnera sp; identical to SEQ ID NO: 2582

SEQ ID NO: 59776 - DNA, 1512 bp, Lactococcus lactis subsp. lactis; identical to SEQ ID NO: 2583
  CDS (1)..(1512)

SEQ ID NO: 59777 - protein, 503 aa, Lactococcus lactis subsp. lactis; identical to SEQ ID NO: 2584

SEQ ID NO: 59778 - DNA, 1572 bp, Drosophila melanogaster; identical to SEQ ID NO: 2585
  CDS (1)..(1572)

SEQ ID NO: 59779 - protein, 523 aa, Drosophila melanogaster; identical to SEQ ID NO: 2586

SEQ ID NO: 59780 - DNA, 1575 bp, Synechococcus sp; identical to SEQ ID NO: 2587
  CDS (1)..(1575)

SEQ ID NO: 59781 - protein, 524 aa, Synechococcus sp; identical to SEQ ID NO: 2588

SEQ ID NO: 59782 - DNA, 1485 bp, Haemophilus influenzae; identical to SEQ ID NO: 2589
  CDS (1)..(1485)

SEQ ID NO: 59783 - protein, 494 aa, Haemophilus influenzae; identical to SEQ ID NO: 2590

SEQ ID NO: 59784 - DNA, 1446 bp, Neisseria meningitidis; identical to SEQ ID NO: 2591
  CDS (1)..(1446)

SEQ ID NO: 59785 - protein, 481 aa, Neisseria meningitidis; identical to SEQ ID NO: 2592

SEQ ID NO: 59786 - DNA, 1278 bp, Helicobacter pylori; identical to SEQ ID NO: 2593
  CDS (1)..(1278)

SEQ ID NO: 59787 - protein, 425 aa, Helicobacter pylori; identical to SEQ ID NO: 2594

SEQ ID NO: 59788 - DNA, 1434 bp, Xylella fastidiosa; identical to SEQ ID NO: 2595
  CDS (1)..(1434)

SEQ ID NO: 59789 - protein, 477 aa, Xylella fastidiosa; identical to SEQ ID NO: 2596

SEQ ID NO: 59790 - DNA, 1296 bp, Aquifex aeolicus; identical to SEQ ID NO: 2597
  CDS (1)..(1296)

SEQ ID NO: 59791 - protein, 431 aa, Aquifex aeolicus; identical to SEQ ID NO: 2598

SEQ ID NO: 59792 - DNA, 1491 bp, Thermotoga maritima; identical to SEQ ID NO: 2599
  CDS (1)..(1491)

SEQ ID NO: 59793 - protein, 496 aa, Thermotoga maritima; identical to SEQ ID NO: 2600

SEQ ID NO: 59794 - DNA, 1494 bp, Kluyveromyces marxianus var. lactis, Candida sphaerica; identical to SEQ ID NO: 2601
  CDS (1)..(1494)

SEQ ID NO: 59795 - protein, 497 aa, Kluyveromyces marxianus var. lactis, Candida sphaerica; identical to SEQ ID NO: 2602

SEQ ID NO: 59796 - DNA, 2813 bp, Erwinia chrysanthemi; identical to SEQ ID NO: 2603
  CDS (322)..(1797)

SEQ ID NO: 59797 - protein, 491 aa, Erwinia chrysanthemi; identical to SEQ ID NO: 2604

SEQ ID NO: 59798 - DNA, 3244 bp, Plasmodium falciparum; identical to SEQ ID NO: 2605
  CDS (184)..(2916)

SEQ ID NO: 59799 - protein, 910 aa, Plasmodium falciparum; identical to SEQ ID NO: 2606

SEQ ID NO: 59800 - DNA, 1785 bp, Medicago sativa (alfalfa); identical to SEQ ID NO: 2607
  CDS (38)..(1585)

SEQ ID NO: 59801 - protein, 515 aa, Medicago sativa (alfalfa); identical to SEQ ID NO: 2608

SEQ ID NO: 59802 - DNA, 1689 bp, Solanum tuberosum (potato); identical to SEQ ID NO: 2609
  CDS (46)..(1581)

SEQ ID NO: 59803 - protein, 511 aa, Solanum tuberosum (potato); identical to SEQ ID NO: 2610

SEQ ID NO: 59804 - DNA, 1530 bp, Synechocystis sp; identical to SEQ ID NO: 2611
  CDS (1)..(1530)

SEQ ID NO: 59805 - protein, 509 aa, Synechocystis sp; identical to SEQ ID NO: 2612

SEQ ID NO: 59806 - DNA, 1953 bp, Nicotiana tabacum (common tobacco); identical to SEQ ID NO: 2613
  CDS (43)..(1824)

SEQ ID NO: 59807 - protein, 593 aa, Nicotiana tabacum (common tobacco); identical to SEQ ID NO: 2614

SEQ ID NO: 59808 - DNA, 1869 bp, Nicotiana tabacum (common tobacco); identical to SEQ ID NO: 2615
  CDS (22)..(1788)

SEQ ID NO: 59809 - protein, 588 aa, Nicotiana tabacum (common tobacco); identical to SEQ ID NO: 2616

SEQ ID NO: 59810 - DNA, 2058 bp, Solanum tuberosum (potato); identical to SEQ ID NO: 2617
  CDS (41)..(1774)

SEQ ID NO: 59811 - protein, 577 aa, Solanum tuberosum (potato); identical to SEQ ID NO: 2618

SEQ ID NO: 59812 - DNA, 2049 bp, Spinacia oleracea (spinach); identical to SEQ ID NO: 2619
  CDS (147)..(1871)

SEQ ID NO: 59813 - protein, 574 aa, Spinacia oleracea (spinach); identical to SEQ ID NO: 2620

SEQ ID NO: 59814 - DNA, 2359 bp, Petroselinum crispum (parsley); identical to SEQ ID NO: 2621
  CDS (172)..(1986)

SEQ ID NO: 59815 - protein, 604 aa, Petroselinum crispum (parsley); identical to SEQ ID NO: 2622

SEQ ID NO: 59816 - DNA, 1848 bp, Petroselinum crispum (parsley); identical to SEQ ID NO: 2623
  CDS (41)..(1528)

SEQ ID NO: 59817 - protein, 495 aa, Petroselinum crispum (parsley); identical to SEQ ID NO: 2624

SEQ ID NO: 59818 - DNA, 1957 bp, Petroselinum crispum (parsley); identical to SEQ ID NO: 2625
  CDS (74)..(1678)

SEQ ID NO: 59819 - protein, 534 aa, Petroselinum crispum (parsley); identical to SEQ ID NO: 2626

SEQ ID NO: 59820 - DNA, 1569 bp, Caenorhabditis elegans; identical to SEQ ID NO: 2627
  CDS (1)..(1569)

SEQ ID NO: 59821 - protein, 522 aa, Caenorhabditis elegans; identical to SEQ ID NO: 2628

SEQ ID NO: 59822 - DNA, 1779 bp, Streptomyces coelicolor; identical to SEQ ID NO: 2629
  CDS (1)..(1779)

SEQ ID NO: 59823 - protein, 592 aa, Streptomyces coelicolor; identical to SEQ ID NO: 2630

SEQ ID NO: 59824 - DNA, 1524 bp, Streptomyces coelicolor; identical to SEQ ID NO: 2631
  CDS (1)..(1524)

SEQ ID NO: 59825 - protein, 507 aa, Streptomyces coelicolor; identical to SEQ ID NO: 2632

SEQ ID NO: 59826 - DNA, 1422 bp, Schizosaccharomyces pombe; identical to SEQ ID NO: 2633
  CDS (1)..(1422)

SEQ ID NO: 59827 - protein, 473 aa, Schizosaccharomyces pombe; identical to SEQ ID NO: 2634

SEQ ID NO: 59828 - DNA, 1503 bp, Schizosaccharomyces pombe; identical to SEQ ID NO: 2635
  CDS (1)..(1503)

SEQ ID NO: 59829 - protein, 500 aa, Schizosaccharomyces pombe; identical to SEQ ID NO: 2636

SEQ ID NO: 59830 - DNA, 1428 bp, Schizosaccharomyces pombe; identical to SEQ ID NO: 2637
  CDS (1)..(1428)

SEQ ID NO: 59831 - protein, 475 aa, Schizosaccharomyces pombe; identical to SEQ ID NO: 2638

SEQ ID NO: 59832 - DNA, 1461 bp, Leuconostoc mesenteroides; identical to SEQ ID NO: 2639
  CDS (1)..(1461)

SEQ ID NO: 59833 - protein, 486 aa, Leuconostoc mesenteroides; identical to SEQ ID NO: 2640

SEQ ID NO: 59834 - DNA, 3038 bp, Corynebacterium glutamicum; identical to SEQ ID NO: 2641
  CDS (115)..(1659)

SEQ ID NO: 59835 - protein, 514 aa, Corynebacterium glutamicum; identical to SEQ ID NO: 2642

SEQ ID NO: 59836 - DNA, 1852 bp, Nicotiana tabacum; identical to SEQ ID NO: 2643
  CDS (102)..(1634)

SEQ ID NO: 59837 - protein, 510 aa, Nicotiana tabacum; identical to SEQ ID NO: 2644

SEQ ID NO: 59838 - DNA, 1821 bp, Nicotiana tabacum; identical to SEQ ID NO: 2645
  CDS (88)..(1623)

SEQ ID NO: 59839 - protein, 511 aa, Nicotiana tabacum; identical to SEQ ID NO: 2646

SEQ ID NO: 59840 - DNA, 1808 bp, Chlamydia trachomatis; identical to SEQ ID NO: 2647
  CDS (105)..(1643)

SEQ ID NO: 59841 - protein, 512 aa, Chlamydia trachomatis; identical to SEQ ID NO: 2648

SEQ ID NO: 59842 - DNA, 2750 bp, Plasmodium falciparum; identical to SEQ ID NO: 2649
  CDS (48)..(2258)

SEQ ID NO: 59843 - protein, 736 aa, Plasmodium falciparum; identical to SEQ ID NO: 2650

SEQ ID NO: 59844 - DNA, 1509 bp, Debaryomyces hansenii; identical to SEQ ID NO: 2651
  CDS (1)..(1509)

SEQ ID NO: 59845 - protein, 502 aa, Debaryomyces hansenii; identical to SEQ ID NO: 2652

SEQ ID NO: 59846 - DNA, 1503 bp, Candida glabrata; identical to SEQ ID NO: 2653
  CDS (1)..(1503)

SEQ ID NO: 59847 - protein, 500 aa, Candida glabrata; identical to SEQ ID NO: 2654

SEQ ID NO: 59848 - DNA, 1485 bp, Bacillus thuringiensis serovar konkukian str; identical to SEQ ID NO: 2655
  CDS (1)..(1485)

SEQ ID NO: 59849 - protein, 494 aa, Bacillus thuringiensis serovar konkukian str; identical to SEQ ID NO: 2656

SEQ ID NO: 59850 - DNA, 1554 bp, Oryza sativa; identical to SEQ ID NO: 2657
  CDS (1)..(1554)

SEQ ID NO: 59851 - protein, 517 aa, Oryza sativa; identical to SEQ ID NO: 2658

SEQ ID NO: 59852 - DNA, 1500 bp, Photobacterium profundum; identical to SEQ ID NO: 2659
  CDS (1)..(1500)

SEQ ID NO: 59853 - protein, 499 aa, Photobacterium profundum; identical to SEQ ID NO: 2660

SEQ ID NO: 59854 - DNA, 1551 bp, Parachlamydia sp; identical to SEQ ID NO: 2661
  CDS (1)..(1551)

SEQ ID NO: 59855 - protein, 516 aa, Parachlamydia sp; identical to SEQ ID NO: 2662

SEQ ID NO: 59856 - DNA, 1515 bp, Rhodopseudomonas palustris; identical to SEQ ID NO: 2663
  CDS (1)..(1515)

SEQ ID NO: 59857 - protein, 504 aa, Rhodopseudomonas palustris; identical to SEQ ID NO: 2664

SEQ ID NO: 59858 - DNA, 1650 bp, Corynebacterium diphtheriae; identical to SEQ ID NO: 2665
  CDS (1)..(1650)

SEQ ID NO: 59859 - protein, 549 aa, Corynebacterium diphtheriae; identical to SEQ ID NO: 2666

SEQ ID NO: 59860 - DNA, 1446 bp, uncultured bacterium 581; identical to SEQ ID NO: 2667
  CDS (1)..(1446)

SEQ ID NO: 59861 - protein, 481 aa, uncultured bacterium 581; identical to SEQ ID NO: 2668

SEQ ID NO: 59862 - DNA, 1602 bp, Nonomuraea sp; identical to SEQ ID NO: 2669
  CDS (1)..(1602)

SEQ ID NO: 59863 - protein, 533 aa, Nonomuraea sp; identical to SEQ ID NO: 2670

SEQ ID NO: 59864 - DNA, 1476 bp, Listeria monocytogenes; identical to SEQ ID NO: 2671
  CDS (1)..(1476)

SEQ ID NO: 59865 - protein, 491 aa, Listeria monocytogenes; identical to SEQ ID NO: 2672

SEQ ID NO: 59866 - DNA, 1485 bp, Bacillus cereus; identical to SEQ ID NO: 2673
  CDS (1)..(1485)

SEQ ID NO: 59867 - protein, 494 aa, Bacillus cereus; identical to SEQ ID NO: 2674

SEQ ID NO: 59868 - DNA, 1410 bp, Mycobacterium paratuberculosis; identical to SEQ ID NO: 2675
  CDS (1)..(1410)

SEQ ID NO: 59869 - protein, 469 aa, Mycobacterium paratuberculosis; identical to SEQ ID NO: 2676

SEQ ID NO: 59870 - DNA, 2454 bp, Mycobacterium paratuberculosis; identical to SEQ ID NO: 2677
  CDS (1)..(2454)

SEQ ID NO: 59871 - protein, 817 aa, Mycobacterium paratuberculosis; identical to SEQ ID NO: 2678

SEQ ID NO: 59872 - DNA, 1545 bp, Mycobacterium paratuberculosis; identical to SEQ ID NO: 2679
  CDS (1)..(1545)

SEQ ID NO: 59873 - protein, 514 aa, Mycobacterium paratuberculosis; identical to SEQ ID NO: 2680

SEQ ID NO: 59874 - DNA, 1449 bp, Lactobacillus johnsonii; identical to SEQ ID NO: 2681
  CDS (1)..(1449)

SEQ ID NO: 59875 - protein, 482 aa, Lactobacillus johnsonii; identical to SEQ ID NO: 2682

SEQ ID NO: 59876 - DNA, 1539 bp, Ashbya gossypii; identical to SEQ ID NO: 2683
  CDS (1)..(1539)

SEQ ID NO: 59877 - protein, 512 aa, Ashbya gossypii; identical to SEQ ID NO: 2684

SEQ ID NO: 59878 - DNA, 1734 bp, Oryza sativa; identical to SEQ ID NO: 2685
  CDS (1)..(1734)

SEQ ID NO: 59879 - protein, 577 aa, Oryza sativa; identical to SEQ ID NO: 2686

SEQ ID NO: 59880 - DNA, 1467 bp, Gluconobacter oxydans; identical to SEQ ID NO: 2687
  CDS (1)..(1467)

SEQ ID NO: 59881 - protein, 488 aa, Gluconobacter oxydans; identical to SEQ ID NO: 2688

SEQ ID NO: 59882 - DNA, 1581 bp, Vibrio vulnificus; identical to SEQ ID NO: 2689
  CDS (1)..(1581)

SEQ ID NO: 59883 - protein, 526 aa, Vibrio vulnificus; identical to SEQ ID NO: 2690

SEQ ID NO: 59884 - DNA, 1476 bp, Photorhabdus luminescens; identical to SEQ ID NO: 2691
  CDS (1)..(1476)

SEQ ID NO: 59885 - protein, 491 aa, Photorhabdus luminescens; identical to SEQ ID NO: 2692

SEQ ID NO: 59886 - DNA, 1539 bp, Gloeobacter violaceus; identical to SEQ ID NO: 2693
  CDS (1)..(1539)

SEQ ID NO: 59887 - protein, 512 aa, Gloeobacter violaceus; identical to SEQ ID NO: 2694

SEQ ID NO: 59888 - DNA, 1539 bp, Gloeobacter violaceus; identical to SEQ ID NO: 2695
  CDS (1)..(1539)

SEQ ID NO: 59889 - protein, 512 aa, Gloeobacter violaceus; identical to SEQ ID NO: 2696

SEQ ID NO: 59890 - DNA, 1479 bp, Chromobacterium violaceum; identical to SEQ ID NO: 2697
  CDS (1)..(1479)

SEQ ID NO: 59891 - protein, 492 aa, Chromobacterium violaceum; identical to SEQ ID NO: 2698

SEQ ID NO: 59892 - DNA, 2229 bp, Giardia lamblia ATCC 50803; identical to SEQ ID NO: 2699
  CDS (1)..(2229)

SEQ ID NO: 59893 - protein, 742 aa, Giardia lamblia ATCC 50803; identical to SEQ ID NO: 2700

SEQ ID NO: 59894 - DNA, 2850 bp, Plasmodium yoelii yoelii; identical to SEQ ID NO: 2701
  CDS (1)..(2850)

SEQ ID NO: 59895 - protein, 949 aa, Plasmodium yoelii yoelii; identical to SEQ ID NO: 2702

SEQ ID NO: 59896 - DNA, 1476 bp, Neurospora crassa; identical to SEQ ID NO: 2703
  CDS (1)..(1476)

SEQ ID NO: 59897 - protein, 491 aa, Neurospora crassa; identical to SEQ ID NO: 2704

SEQ ID NO: 59898 - DNA, 1524 bp, Synechococcus sp; identical to SEQ ID NO: 2705
  CDS (1)..(1524)

SEQ ID NO: 59899 - protein, 507 aa, Synechococcus sp; identical to SEQ ID NO: 2706

SEQ ID NO: 59900 - DNA, 1455 bp, Rhodopirellula baltica; identical to SEQ ID NO: 2707
  CDS (1)..(1455)

SEQ ID NO: 59901 - protein, 484 aa, Rhodopirellula baltica; identical to SEQ ID NO: 2708

SEQ ID NO: 59902 - DNA, 1524 bp, Prochlorococcus marinus subsp; identical to SEQ ID NO: 2709
  CDS (1)..(1524)

SEQ ID NO: 59903 - protein, 507 aa, Prochlorococcus marinus subsp; identical to SEQ ID NO: 2710

SEQ ID NO: 59904 - DNA, 1524 bp, Prochlorococcus marinus; identical to SEQ ID NO: 2711
  CDS (1)..(1524)

SEQ ID NO: 59905 - protein, 507 aa, Prochlorococcus marinus; identical to SEQ ID NO: 2712

SEQ ID NO: 59906 - DNA, 1521 bp, Prochlorococcus marinus; identical to SEQ ID NO: 2713
  CDS (1)..(1521)

SEQ ID NO: 59907 - protein, 506 aa, Prochlorococcus marinus; identical to SEQ ID NO: 2714

SEQ ID NO: 59908 - DNA, 1488 bp, Haemophilus ducreyi; identical to SEQ ID NO: 2715
  CDS (1)..(1488)

SEQ ID NO: 59909 - protein, 495 aa, Haemophilus ducreyi; identical to SEQ ID NO: 2716

SEQ ID NO: 59910 - DNA, 1497 bp, Candidatus Blochmannia floridanus; identical to SEQ ID NO: 2717
  CDS (1)..(1497)

SEQ ID NO: 59911 - protein, 498 aa, Candidatus Blochmannia floridanus; identical to SEQ ID NO: 2718

SEQ ID NO: 59912 - DNA, 1768 bp, Oryza sativa; identical to SEQ ID NO: 2719
  CDS (2)..(1768)

SEQ ID NO: 59913 - protein, 588 aa, Oryza sativa; identical to SEQ ID NO: 2720

SEQ ID NO: 59914 - DNA, 1548 bp, Bos indicus; identical to SEQ ID NO: 2721
  CDS (1)..(1548)

SEQ ID NO: 59915 - protein, 515 aa, Bos indicus; identical to SEQ ID NO: 2722

SEQ ID NO: 59916 - DNA, 1536 bp, Chlamydophila caviae; identical to SEQ ID NO: 2723
  CDS (1)..(1536)

SEQ ID NO: 59917 - protein, 511 aa, Chlamydophila caviae; identical to SEQ ID NO: 2724

SEQ ID NO: 59918 - DNA, 1524 bp, Streptomyces avermitilis; identical to SEQ ID NO: 2725
  CDS (1)..(1524)

SEQ ID NO: 59919 - protein, 507 aa, Streptomyces avermitilis; identical to SEQ ID NO: 2726

SEQ ID NO: 59920 - DNA, 1647 bp, Streptomyces avermitilis; identical to SEQ ID NO: 2727
  CDS (1)..(1647)

SEQ ID NO: 59921 - protein, 548 aa, Streptomyces avermitilis; identical to SEQ ID NO: 2728

SEQ ID NO: 59922 - DNA, 1491 bp, Nitrosomonas europaea; identical to SEQ ID NO: 2729
  CDS (1)..(1491)

SEQ ID NO: 59923 - protein, 496 aa, Nitrosomonas europaea; identical to SEQ ID NO: 2730

SEQ ID NO: 59924 - DNA, 1524 bp, Enterococcus faecalis; identical to SEQ ID NO: 2731
  CDS (1)..(1524)

SEQ ID NO: 59925 - protein, 507 aa, Enterococcus faecalis; identical to SEQ ID NO: 2732

SEQ ID NO: 59926 - DNA, 1464 bp, Tropheryma whipplei; identical to SEQ ID NO: 2733
  CDS (1)..(1464)

SEQ ID NO: 59927 - protein, 487 aa, Tropheryma whipplei; identical to SEQ ID NO: 2734

SEQ ID NO: 59928 - DNA, 2145 bp, Leishmania mexicana; identical to SEQ ID NO: 2735
  CDS (298)..(1986)

SEQ ID NO: 59929 - protein, 562 aa, Leishmania mexicana; identical to SEQ ID NO: 2736

SEQ ID NO: 59930 - DNA, 1494 bp, Dictyostelium discoideum; identical to SEQ ID NO: 2737
  CDS (1)..(1494)

SEQ ID NO: 59931 - protein, 497 aa, Dictyostelium discoideum; identical to SEQ ID NO: 2738

SEQ ID NO: 59932 - DNA, 1503 bp, Xylella fastidiosa; identical to SEQ ID NO: 2739
  CDS (1)..(1503)

SEQ ID NO: 59933 - protein, 500 aa, Xylella fastidiosa; identical to SEQ ID NO: 2740

SEQ ID NO: 59934 - DNA, 1506 bp, Vibrio parahaemolyticus; identical to SEQ ID NO: 2741
  CDS (1)..(1506)

SEQ ID NO: 59935 - protein, 501 aa, Vibrio parahaemolyticus; identical to SEQ ID NO: 2742

SEQ ID NO: 59936 - DNA, 1533 bp, Pseudomonas syringae; identical to SEQ ID NO: 2743
  CDS (1)..(1533)

SEQ ID NO: 59937 - protein, 510 aa, Pseudomonas syringae; identical to SEQ ID NO: 2744

SEQ ID NO: 59938 - DNA, 1470 bp, Pseudomonas syringae; identical to SEQ ID NO: 2745
  CDS (1)..(1470)

SEQ ID NO: 59939 - protein, 489 aa, Pseudomonas syringae; identical to SEQ ID NO: 2746

SEQ ID NO: 59940 - DNA, 1458 bp, Pseudomonas putida; identical to SEQ ID NO: 2747
  CDS (1)..(1458)

SEQ ID NO: 59941 - protein, 485 aa, Pseudomonas putida; identical to SEQ ID NO: 2748

SEQ ID NO: 59942 - DNA, 1506 bp, Pseudomonas putida; identical to SEQ ID NO: 2749
  CDS (1)..(1506)

SEQ ID NO: 59943 - protein, 501 aa, Pseudomonas putida; identical to SEQ ID NO: 2750

SEQ ID NO: 59944 - DNA, 1470 bp, Pseudomonas putida; identical to SEQ ID NO: 2751
  CDS (1)..(1470)

SEQ ID NO: 59945 - protein, 489 aa, Pseudomonas putida; identical to SEQ ID NO: 2752

SEQ ID NO: 59946 - DNA, 1485 bp, Lactobacillus plantarum; identical to SEQ ID NO: 2753
  CDS (1)..(1485)

SEQ ID NO: 59947 - protein, 494 aa, Lactobacillus plantarum; identical to SEQ ID NO: 2754

SEQ ID NO: 59948 - DNA, 1440 bp, Clostridium tetani; identical to SEQ ID NO: 2755
  CDS (1)..(1440)

SEQ ID NO: 59949 - protein, 479 aa, Clostridium tetani; identical to SEQ ID NO: 2756

SEQ ID NO: 59950 - DNA, 1512 bp, Bradyrhizobium japonicum; identical to SEQ ID NO: 2757
  CDS (1)..(1512)

SEQ ID NO: 59951 - protein, 503 aa, Bradyrhizobium japonicum; identical to SEQ ID NO: 2758

SEQ ID NO: 59952 - DNA, 1497 bp, Bacteroides thetaiotaomicron; identical to SEQ ID NO: 2759
  CDS (1)..(1497)

SEQ ID NO: 59953 - protein, 498 aa, Bacteroides thetaiotaomicron; identical to SEQ ID NO: 2760

SEQ ID NO: 59954 - DNA, 4583 bp, Mus musculus; identical to SEQ ID NO: 2761
  CDS (119)..(2488)

SEQ ID NO: 59955 - protein, 789 aa, Mus musculus; identical to SEQ ID NO: 2762

SEQ ID NO: 59956 - DNA, 1485 bp, Staphylococcus epidermidis; identical to SEQ ID NO: 2763
  CDS (1)..(1485)

SEQ ID NO: 59957 - protein, 494 aa, Staphylococcus epidermidis; identical to SEQ ID NO: 2764

SEQ ID NO: 59958 - DNA, 1590 bp, Yersinia pestis; identical to SEQ ID NO: 2765
  CDS (1)..(1590)

SEQ ID NO: 59959 - protein, 529 aa, Yersinia pestis; identical to SEQ ID NO: 2766

SEQ ID NO: 59960 - DNA, 1530 bp, Synechococcus elongatus; identical to SEQ ID NO: 2767
  CDS (1)..(1530)

SEQ ID NO: 59961 - protein, 509 aa, Synechococcus elongatus; identical to SEQ ID NO: 2768

SEQ ID NO: 59962 - DNA, 1473 bp, Shewanella oneidensis; identical to SEQ ID NO: 2769
  CDS (1)..(1473)

SEQ ID NO: 59963 - protein, 490 aa, Shewanella oneidensis; identical to SEQ ID NO: 2770

SEQ ID NO: 59964 - DNA, 1476 bp, Oceanobacillus iheyensis; identical to SEQ ID NO: 2771
  CDS (1)..(1476)

SEQ ID NO: 59965 - protein, 491 aa, Oceanobacillus iheyensis; identical to SEQ ID NO: 2772

SEQ ID NO: 59966 - DNA, 1344 bp, Corynebacterium efficiens; identical to SEQ ID NO: 2773
  CDS (1)..(1344)

SEQ ID NO: 59967 - protein, 447 aa, Corynebacterium efficiens; identical to SEQ ID NO: 2774

SEQ ID NO: 59968 - DNA, 1545 bp, Corynebacterium efficiens; identical to SEQ ID NO: 2775
  CDS (1)..(1545)

SEQ ID NO: 59969 - protein, 514 aa, Corynebacterium efficiens; identical to SEQ ID NO: 2776

SEQ ID NO: 59970 - DNA, 1668 bp, Bifidobacterium longum; identical to SEQ ID NO: 2777
  CDS (1)..(1668)

SEQ ID NO: 59971 - protein, 555 aa, Bifidobacterium longum; identical to SEQ ID NO: 2778

SEQ ID NO: 59972 - DNA, 1284 bp, Rhodococcus opacus; identical to SEQ ID NO: 2779
  CDS (1)..(1284)

SEQ ID NO: 59973 - protein, 427 aa, Rhodococcus opacus; identical to SEQ ID NO: 2780

SEQ ID NO: 59974 - DNA, 2879 bp, Leishmania guyanensis; identical to SEQ ID NO: 2781
  CDS (205)..(1893): n means a or g or c or t/u, s means g or c

SEQ ID NO: 59975 - protein, 562 aa, Leishmania guyanensis; identical to SEQ ID NO: 2782

SEQ ID NO: 59976 - DNA, 1689 bp, Leishmania mexicana; identical to SEQ ID NO: 2783
  CDS (1)..(1689): n means a or g or c or t/u, s means g or c

SEQ ID NO: 59977 - protein, 562 aa, Leishmania mexicana; identical to SEQ ID NO: 2784
  Xaa in positions 76-148, 187, 197, 224, 243, 250 and 492-510 is unknown

SEQ ID NO: 59978 - DNA, 2916 bp, Leishmania amazonensis; identical to SEQ ID NO: 2785
  CDS (207)..(1895): n means a or g or c or t/u, s means g or c

SEQ ID NO: 59979 - protein, 562 aa, Leishmania amazonensis; identical to SEQ ID NO: 2786
  Xaa in positions 463 and 481 is unknown

SEQ ID NO: 59980 - DNA, 1440 bp, Chlorobium tepidum; identical to SEQ ID NO: 2787
  CDS (1)..(1440)

SEQ ID NO: 59981 - protein, 479 aa, Chlorobium tepidum; identical to SEQ ID NO: 2788

SEQ ID NO: 59982 - DNA, 2187 bp, Methylobacterium extorquens; identical to SEQ ID NO: 2789
  CDS (640)..(2187)

SEQ ID NO: 59983 - protein, 515 aa, Methylobacterium extorquens; identical to SEQ ID NO: 2790

SEQ ID NO: 59984 - DNA, 1476 bp, Bartonella henselae; identical to SEQ ID NO: 2791
  CDS (1)..(1476)

SEQ ID NO: 59985 - protein, 491 aa, Bartonella henselae; identical to SEQ ID NO: 2792

SEQ ID NO: 59986 - DNA, 2266 bp, Toxoplasma gondii; identical to SEQ ID NO: 2793
  CDS (169)..(1851)

SEQ ID NO: 59987 - protein, 560 aa, Toxoplasma gondii; identical to SEQ ID NO: 2794

SEQ ID NO: 59988 - DNA, 1923 bp, Xanthomonas campestris; identical to SEQ ID NO: 2795
  CDS (1)..(1923)

SEQ ID NO: 59989 - protein, 640 aa, Xanthomonas campestris; identical to SEQ ID NO: 2796

SEQ ID NO: 59990 - DNA, 1431 bp, Xanthomonas campestris; identical to SEQ ID NO: 2797
  CDS (1)..(1431)

SEQ ID NO: 59991 - protein, 476 aa, Xanthomonas campestris; identical to SEQ ID NO: 2798

SEQ ID NO: 59992 - DNA, 1839 bp, Xanthomonas axonopodis; identical to SEQ ID NO: 2799
  CDS (1)..(1839)

SEQ ID NO: 59993 - protein, 612 aa, Xanthomonas axonopodis; identical to SEQ ID NO: 2800

SEQ ID NO: 59994 - DNA, 1431 bp, Xanthomonas axonopodis; identical to SEQ ID NO: 2801
  CDS (1)..(1431)

SEQ ID NO: 59995 - protein, 476 aa, Xanthomonas axonopodis; identical to SEQ ID NO: 2802

SEQ ID NO: 59996 - DNA, 1458 bp, Thermoanaerobacter tengcongensis; identical to SEQ ID NO: 2803
  CDS (1)..(1458)

SEQ ID NO: 59997 - protein, 485 aa, Thermoanaerobacter tengcongensis; identical to SEQ ID NO: 2804

SEQ ID NO: 59998 - DNA, 1762 bp, Oryza sativa; identical to SEQ ID NO: 2805
  CDS (41)..(1558)

SEQ ID NO: 59999 - protein, 505 aa, Oryza sativa; identical to SEQ ID NO: 2806

SEQ ID NO: 60000 - DNA, 1305 bp, Encephalitozoon cuniculi; identical to SEQ ID NO: 2807
  CDS (1)..(1305)

SEQ ID NO: 60001 - protein, 434 aa, Encephalitozoon cuniculi; identical to SEQ ID NO: 2808

SEQ ID NO: 60002 - DNA, 2125 bp, Drosophila melanogaster; identical to SEQ ID NO: 2809
  CDS (158)..(1738)

SEQ ID NO: 60003 - protein, 526 aa, Drosophila melanogaster; identical to SEQ ID NO: 2810

SEQ ID NO: 60004 - DNA, 1470 bp, Ralstonia solanacearum; identical to SEQ ID NO: 2811
  CDS (1)..(1470)

SEQ ID NO: 60005 - protein, 489 aa, Ralstonia solanacearum; identical to SEQ ID NO: 2812

SEQ ID NO: 60006 - DNA, 1521 bp, Enterococcus mundtii; identical to SEQ ID NO: 2813
  CDS (1)..(1521)

SEQ ID NO: 60007 - protein, 506 aa, Enterococcus mundtii; identical to SEQ ID NO: 2814

SEQ ID NO: 60008 - DNA, 2230 bp, Homo sapiens; identical to SEQ ID NO: 2815
  CDS (54)..(1601)

SEQ ID NO: 60009 - protein, 515 aa, Homo sapiens [sequence omitted]

SEQ ID NO: 60010 - DNA, 1470 bp, Rhizobium loti; identical to SEQ ID NO: 2817
  CDS (1)..(1470)

SEQ ID NO: 60011 - protein, 489 aa, Rhizobium loti; identical to SEQ ID NO: 2818

SEQ ID NO: 60012 - DNA, 1428 bp, Rhizobium loti; identical to SEQ ID NO: 2819
  CDS (1)..(1428)

SEQ ID NO: 60013 - protein, 475 aa, Rhizobium loti; identical to SEQ ID NO: 2820

SEQ ID NO: 60014 - DNA, 3584 bp, Plasmodium berghei; identical to SEQ ID NO: 2821
  CDS (370)..(3222)

SEQ ID NO: 60015 - protein, 950 aa, Plasmodium berghei; identical to SEQ ID NO: 2822

SEQ ID NO: 60016 - DNA, 1491 bp, Pasteurella multocida; identical to SEQ ID NO: 2823
  CDS (1)..(1491)

SEQ ID NO: 60017 - protein, 496 aa, Pasteurella multocida; identical to SEQ ID NO: 2824

SEQ ID NO: 60018 - DNA, 1470 bp, Pseudomonas putida; identical to SEQ ID NO: 2825
  CDS (1)..(1470)

SEQ ID NO: 60019 - protein, 489 aa, Pseudomonas putida; identical to SEQ ID NO: 2826

SEQ ID NO: 60020 - DNA, 1566 bp, Trypanosoma brucei; identical to SEQ ID NO: 2827
  CDS (1)..(1566)

SEQ ID NO: 60021 - protein, 521 aa, Trypanosoma brucei; identical to SEQ ID NO: 2828

SEQ ID NO: 60022 - DNA, 1904 bp, Triticum aestivum; identical to SEQ ID NO: 2829
  CDS (153)..(1682)

SEQ ID NO: 60023 - protein, 509 aa, Triticum aestivum; identical to SEQ ID NO: 2830

SEQ ID NO: 60024 - DNA, 2098 bp, Solanum tuberosum; identical to SEQ ID NO: 2831
  CDS (27)..(1775)

SEQ ID NO: 60025 - protein, 582 aa, Solanum tuberosum; identical to SEQ ID NO: 2832

SEQ ID NO: 60026 - DNA, 1924 bp, Dunaliella bioculata; identical to SEQ ID NO: 2833
  CDS (68)..(1840)

SEQ ID NO: 60027 - protein, 590 aa, Dunaliella bioculata; identical to SEQ ID NO: 2834

SEQ ID NO: 60028 - DNA, 1976 bp, Cyanidium caldarium; identical to SEQ ID NO: 2835
  CDS (46)..(1848)

SEQ ID NO: 60029 - protein, 600 aa, Cyanidium caldarium; identical to SEQ ID NO: 2836

SEQ ID NO: 60030 - DNA, 2106 bp, Drosophila melanogaster; identical to SEQ ID NO: 2837
  CDS (28)..(1746)

SEQ ID NO: 60031 - protein, 572 aa, Drosophila melanogaster; identical to SEQ ID NO: 2838

SEQ ID NO: 60032 - DNA, 1777 bp, Mesembryanthemum crystallinum; identical to SEQ ID NO: 2839
  CDS (39)..(1589)

SEQ ID NO: 60033 - protein, 516 aa, Mesembryanthemum crystallinum; identical to SEQ ID NO: 2840

SEQ ID NO: 60034 - DNA, 1542 bp, Mus musculus; identical to SEQ ID NO: 2841
  CDS (1)..(1542)

SEQ ID NO: 60035 - protein, 513 aa, Mus musculus; identical to SEQ ID NO: 2842

SEQ ID NO: 60036 - DNA, 1485 bp, Actinobacillus actinomycetemcomitans; identical to SEQ ID NO: 2843
  CDS (1)..(1485)

SEQ ID NO: 60037 - protein, 494 aa, Actinobacillus actinomycetemcomitans; identical to SEQ ID NO: 2844

SEQ ID NO: 60038 - DNA, 1473 bp, Buchnera aphidicola; identical to SEQ ID NO: 2845
  CDS (1)..(1473)

SEQ ID NO: 60039 - protein, 490 aa, Buchnera aphidicola; identical to SEQ ID NO: 2846

SEQ ID NO: 60040 - DNA, 1473 bp, Buchnera aphidicola; identical to SEQ ID NO: 2847
  CDS (1)..(1473)

SEQ ID NO: 60041 - protein, 490 aa, Buchnera aphidicola; identical to SEQ ID NO: 2848

SEQ ID NO: 60042 - DNA, 2049 bp, Ceratitis capitata; identical to SEQ ID NO: 2849
  CDS (60)..(1640)

SEQ ID NO: 60043 - protein, 526 aa, Ceratitis capitata; identical to SEQ ID NO: 2850

SEQ ID NO: 60044 - DNA, 1524 bp, Chlamydia muridarum; identical to SEQ ID NO: 2851
  CDS (1)..(1524)

SEQ ID NO: 60045 - protein, 507 aa, Chlamydia muridarum; identical to SEQ ID NO: 2852

SEQ ID NO: 60046 - DNA, 2062 bp, Drosophila melanogaster; identical to SEQ ID NO: 2853
  CDS (303)..(1877)

SEQ ID NO: 60047 - protein, 524 aa, Drosophila melanogaster; identical to SEQ ID NO: 2854

SEQ ID NO: 60048 - DNA, 1536 bp, Emericella nidulans; identical to SEQ ID NO: 2855
  CDS (1)..(1536)

SEQ ID NO: 60049 - protein, 511 aa, Emericella nidulans; identical to SEQ ID NO: 2856

SEQ ID NO: 60050 - DNA, 1957 bp, Leuconostoc mesenteroides; identical to SEQ ID NO: 2857
  CDS (206)..(1666)

SEQ ID NO: 60051 - protein, 486 aa, Leuconostoc mesenteroides; identical to SEQ ID NO: 2858

SEQ ID NO: 60052 - DNA, 2055 bp, Macropus robustus; identical to SEQ ID NO: 2859
  CDS (94)..(1641)

SEQ ID NO: 60053 - protein, 515 aa, Macropus robustus; identical to SEQ ID NO: 2860

SEQ ID NO: 60054 - DNA, 1530 bp, Nostoc punctiforme; identical to SEQ ID NO: 2861
  CDS (1)..(1530)

SEQ ID NO: 60055 - protein, 509 aa, Nostoc punctiforme; identical to SEQ ID NO: 2862

SEQ ID NO: 60056 - DNA, 1476 bp, Rhizobium meliloti; identical to SEQ ID NO: 2863
  CDS (1)..(1476)

SEQ ID NO: 60057 - protein, 491 aa, Rhizobium meliloti; identical to SEQ ID NO: 2864

SEQ ID NO: 60058 - DNA, 2853 bp, Homo sapiens; identical to SEQ ID NO: 2865
  CDS (273)..(2648)

SEQ ID NO: 60059 - protein, 791 aa, Homo sapiens; identical to SEQ ID NO: 2866

SEQ ID NO: 60060 - DNA, 1970 bp, Arabidopsis thaliana; identical to SEQ ID NO: 2867
  CDS (60)..(1790)

SEQ ID NO: 60061 - protein, 576 aa, Arabidopsis thaliana; identical to SEQ ID NO: 2868

SEQ ID NO: 60062 - DNA, 2112 bp, Arabidopsis thaliana; identical to SEQ ID NO: 2869
  CDS (142)..(1932)

SEQ ID NO: 60063 - protein, 596 aa, Arabidopsis thaliana; identical to SEQ ID NO: 2870

SEQ ID NO: 60064 - DNA, 2161 bp, Arabidopsis thaliana; identical to SEQ ID NO: 2871
  CDS (90)..(1967)

SEQ ID NO: 60065 - protein, 625 aa, Arabidopsis thaliana; identical to SEQ ID NO: 2872

SEQ ID NO: 60066 - DNA, 1936 bp, Arabidopsis thaliana; identical to SEQ ID NO: 2873
  CDS (136)..(1686)

SEQ ID NO: 60067 - protein, 516 aa, Arabidopsis thaliana; identical to SEQ ID NO: 2874

SEQ ID NO: 60068 - DNA, 1959 bp, Arabidopsis thaliana; identical to SEQ ID NO: 2875
  CDS (194)..(1741)

SEQ ID NO: 60069 - protein, 515 aa, Arabidopsis thaliana [sequence omitted]

SEQ ID NO: 60070 - DNA, 1503 bp, Xenopus laevis; identical to SEQ ID NO: 2877
  CDS (1)..(1503)

SEQ ID NO: 60071 - protein, 500 aa, Xenopus laevis; identical to SEQ ID NO: 2878

SEQ ID NO: 60072 - DNA, 2004 bp, Arabidopsis thaliana; identical to SEQ ID NO: 2879
  CDS (51)..(1850)

SEQ ID NO: 60073 - protein, 599 aa, Arabidopsis thaliana; identical to SEQ ID NO: 2880

SEQ ID NO: 60074 - DNA, 23 bp, Artificial sequence
  (1)..(23): primer
atgagtgaaggccccgtcaaatt

SEQ ID NO: 60075 - DNA, 25 bp, Artificial sequence
  (1)..(25): primer
ctaattatccttcgtatcttctggc

SEQ ID NO: 60076 - protein, 806 aa, Artificial sequence; identical to SEQ ID NO: 18604
  Variant (2)..(3): xaa in position 2 to 3 is any amino acid
  Variant (7)..(9): xaa in position 7 to 9 is any amino acid
  Variant (11)..(12): xaa in position 11 to 12 is any amino acid
  Variant (14)..(17): xaa in position 14 to 17 is any amino acid
  Variant (19)..(23): xaa in position 19 to 23 is any amino acid
  Variant (25)..(32): xaa in position 25 to 32 is any amino acid
  Variant (34)..(35): xaa in position 34 to 35 is any amino acid
  Variant (37)..(81): xaa in position 37 to 81 is any amino acid
  Variant (83)..(95): xaa in position 83 to 95 is any amino acid
  Variant (97)..(225): xaa in position 97 to 225 is any amino acid
  Variant (227)..(230): xaa in position 227 to 230 is any amino acid
  Variant (232)..(258): xaa in position 232 to 258 is any amino acid
  Variant (260)..(262): xaa in position 260 to 262 is any amino acid
  Variant (266)..(266): xaa in position 266 is any amino acid
  Variant (268)..(268): xaa in position 268 is any amino acid
  Variant (270)..(271): xaa in position 270 to 271 is any amino acid
  Variant (273)..(275): xaa in position 273 to 275 is any amino acid
  Variant (277)..(285): xaa in position 277 to 285 is any amino acid
  Variant (287)..(290): xaa in position 287 to 290 is any amino acid
  Variant (300)..(300): xaa in position 300 is any amino acid
  Variant (302)..(302): xaa in position 302 is any amino acid
  Variant (304)..(307): xaa in position 304 to 307 is any amino acid
  Variant (310)..(310): xaa in position 310 is any amino acid
  Variant (312)..(318): xaa in position 312 to 318 is any amino acid
  Variant (321)..(323): xaa in position 321 to 323 is any amino acid
  Variant (325)..(328): xaa in position 325 to 328 is any amino acid
  Variant (330)..(332): xaa in position 330 to 332 is any amino acid
  Variant (334)..(335): xaa in position 334 to 335 is any amino acid
  Variant (337)..(339): xaa in position 337 to 339 is any amino acid
  Variant (341)..(342): xaa in position 341 to 342 is any amino acid
  Variant (344)..(347): xaa in position 344 to 347 is any amino acid
  Variant (349)..(351): xaa in position 349 to 351 is any amino acid
  Variant (354)..(355): xaa in position 354 to 355 is any amino acid
  Variant (359)..(360): xaa in position 359 to 360 is any amino acid
  Variant (362)..(366): xaa in position 362 to 366 is any amino acid
  Variant (370)..(370): xaa in position 370 is any amino acid
  Variant (372)..(382): xaa in position 372 to 382 is any amino acid
  Variant (385)..(385): xaa in position 385 is any amino acid
  Variant (387)..(387): xaa in position 387 is any amino acid
  Variant (389)..(405): xaa in position 389 to 405 is any amino acid
  Variant (409)..(438): xaa in position 409 to 438 is any amino acid
  Variant (440)..(451): xaa in position 440 to 451 is any amino acid
  Variant (453)..(455): xaa in position 453 to 455 is any amino acid
  Variant (457)..(465): xaa in position 457 to 465 is any amino acid
  Variant (467)..(467): xaa in position 467 is any amino acid
  Variant (470)..(470): xaa in position 470 is any amino acid
  Variant (475)..(478): xaa in position 475 to 478 is any amino acid
  Variant (481)..(493): xaa in position 481 to 493 is any amino acid
  Variant (495)..(524): xaa in position 495 to 524 is any amino acid
  Variant (526)..(531): xaa in position 526 to 531 is any amino acid
  Variant (534)..(534): xaa in position 534 is any amino acid
  Variant (536)..(543): xaa in position 536 to 543 is any amino acid
  Variant (545)..(545): xaa in position 545 is any amino acid
  Variant (548)..(588): xaa in position 548 to 588 is any amino acid
  Variant (592)..(592): xaa in position 592 is any amino acid
  Variant (594)..(595): xaa in position 594 to 595 is any amino acid
  Variant (597)..(599): xaa in position 597 to 599 is any amino acid
  Variant (601)..(604): xaa in position 601 to 604 is any amino acid
  Variant (606)..(609): xaa in position 606 to 609 is any amino acid
  Variant (611)..(614): xaa in position 611 to 614 is any amino acid
  Variant (616)..(797): xaa in position 616 to 797 is any amino acid
  Variant (799)..(800): xaa in position 799 to 800 is any amino acid
  Variant (802)..(805): xaa in position 802 to 805 is any amino acid

SEQ ID NO: 60077 - protein, 150 aa, Artificial sequence; identical to SEQ ID NO: 2917
  Variant (1)..(1): xaa in position 1 is Arg or Lys
  Variant (2)..(2): xaa in position 2 is Val, Ile, Leu or Ala
  Variant (3)..(3): xaa in position 3 is Ile, Val, Met or Ala
  Variant (4)..(4): xaa in position 4 is Ile, Val, Leu, Met or Ala
  Variant (8)..(8): xaa in position 8 is Phe, Ile, Leu or Tyr
  Variant (9)..(9): xaa in position 9 is Gly or Ala
  Variant (10)..(10): xaa in position 10 is any amino acid
  Variant (11)..(11): xaa in position 11 is Asp, Ser or Asn
  Variant (12)..(13): xaa in position 12 to 13 is any amino acid
  Variant (14)..(14): xaa in position 14 is Ser, Thr or Asn
  Variant (15)..(15): xaa in position 15 is Ala, Ser, Phe or Tyr
  Variant (16)..(17): xaa in position 16 to 17 is any amino acid
  Variant (18)..(18): xaa in position 18 is Leu, Ile, Val or Phe
  Variant (19)..(21): xaa in position 19 to 21 is any amino acid
  Variant (22)..(22): xaa in position 22 is Leu, Ile or Val
  Variant (23)..(27): xaa in position 23 to 27 is any amino acid
  Variant (28)..(28): xaa in position 28 is Glu, Asp, Pro or Ser
  Variant (29)..(30): xaa in position 29 to 30 is any amino acid
  Variant (31)..(31): xaa in position 31 is Ile, Val, Leu, Thr or Met
  Variant (32)..(32): xaa in position 32 is Tyr, Phe or Leu
  Variant (33)..(33): xaa in position 33 is Arg, His or Leu
  Variant (34)..(34): xaa in position 34 is Ile, Val, Met or Leu
  Variant (37)..(37): xaa in position 37 is Tyr or Phe
  Variant (39)..(39): xaa in position 39 is Gly, Ser or Ala
  Variant (40)..(40): xaa in position 40 is Lys, Arg or Glu
  Variant (41)..(42): xaa in position 41 to 42 is any amino acid
  Variant (43)..(43): xaa in position 43 is Val, Ile, Leu, Ala or Met
  Variant (44)..(44): xaa in position 44 is any amino acid
  Variant (45)..(45): xaa in position 45 is Asn, Gly, Gln or Ala
  Variant (46)..(46): xaa in position 46 is Leu, Ile, Met, Phe or Val
  Variant (47)..(49): xaa in position 47 to 49 is any amino acid
  Variant (50)..(50): xaa in position 50 is Arg, Lys or Glu
  Variant (51)..(51): xaa in position 51 is Phe or Tyr
  Variant (52)..(52): xaa in position 52 is any amino acid
  Variant (54)..(59): xaa in position 54 to 59 is any amino acid
  Variant (60)..(60): xaa in position 60 is any or no amino acid
  Variant (61)..(61): xaa in position 61 is Trp, Met, Asn or Leu
  Variant (62)..(63): xaa in position 62 to 63 is any amino acid
  Variant (64)..(65): xaa in position 64 to 65 is any or no amino acid
  Variant (66)..(66): xaa in position 66 is Ile, Val or Ala
  Variant (67)..(68): xaa in position 67 to 68 is any amino acid
  Variant (69)..(69): xaa in position 69 is Val, Ile, Met or Leu
  Variant (70)..(70): xaa in position 70 is any amino acid
  Variant (71)..(71): xaa in position 71 is Ile, Leu, Val, Phe or Ser
  Variant (72)..(74): xaa in position 72 to 74 is any amino acid
  Variant (76)..(77): xaa in position 76 to 77 is any amino acid
  Variant (78)..(78): xaa in position 78 is Gly, Asp, Val or Ala
  Variant (79)..(81): xaa in position 79 to 81 is any amino acid
  Variant (82)..(82): xaa in position 82 is Arg or Lys
  Variant (83)..(84): xaa in position 83 to 84 is any or no amino acid
  Variant (85)..(85): xaa in position 85 is Tyr or Phe
  Variant (86)..(86): xaa in position 86 is Tyr, Phe or Trp
  Variant (87)..(87): xaa in position 87 is Asp, Glu, Ala or Asn
  Variant (88)..(89): xaa in position 88 to 89 is any amino acid
  Variant (91)..(91): xaa in position 91 is any amino acid
  Variant (92)..(92): xaa in position 92 is any or no amino acid
  Variant (93)..(93): xaa in position 93 is Leu, Ile, Val, Met or Ala
  Variant (94)..(94): xaa in position 94 is Arg, Lys or Leu
  Variant (96)..(96): xaa in position 96 is Met, Val, Ile or Leu
  Variant (97)..(97): xaa in position 97 is Val, Met, Ile, Leu or Phe
  Variant (98)..(98): xaa in position 98 is Gln, Pro or Thr
  Variant (99)..(99): xaa in position 99 is Asn or Ser
  Variant (100)..(100): xaa in position 100 is His, Gln or Pro
  Variant (101)..(102): xaa in position 101 to 102 is any amino acid
  Variant (103)..(103): xaa in position 103 is Gln, Glu, Asn or Leu
  Variant (104)..(104): xaa in position 104 is Leu, Ile, Val, Met or Thr
  Variant (105)..(105): xaa in position 105 is Leu, Met, Val, Ile, Phe or Tyr
  Variant (106)..(106): xaa in position 106 is any amino acid
  Variant (107)..(107): xaa in position 107 is Leu, Met, Ile, Val, Trp or Phe
  Variant (108)..(109): xaa in position 108 to 109 is any amino acid
  Variant (111)..(111): xaa in position 111 is Glu, Asp, Ser or Asn
  Variant (112)..(112): xaa in position 112 is any amino acid
  Variant (114)..(118): xaa in position 114 to 118 is any amino acid
  Variant (119)..(121): xaa in position 119 to 121 is any or no amino acid
  Variant (122)..(122): xaa in position 122 is Ile, Val, Leu, Phe or Met
  Variant (123)..(124): xaa in position 123 to 124 is any amino acid
  Variant (125)..(125): xaa in position 125 is Glu, Lys, Ala, Arg or His
  Variant (126)..(126): xaa in position 126 is Lys or Val
  Variant (127)..(128): xaa in position 127 to 128 is any amino acid
  Variant (129)..(129): xaa in position 129 is Val, Ile, Ala, Leu or Phe
  Variant (130)..(130): xaa in position 130 is Leu, Ile, Val, Phe or Met
  Variant (131)..(140): xaa in position 131 to 140 is any amino acid
  Variant (141)..(145): xaa in position 141 to 145 is any or no amino acid
  Variant (146)..(146): xaa in position 146 is Val, Leu, Ile, Ala or Ser
  Variant (147)..(147): xaa in position 147 is any amino acid
  Variant (148)..(148): xaa in position 148 is Gly or Ala
  Variant (149)..(149): xaa in position 149 is Gln or Arg
  Variant (150)..(150): xaa in position 150 is Tyr or Phe

SEQ ID NO: 60078 - protein, 44 aa, Artificial sequence; identical to SEQ ID NO: 2918
  Variant (1)..(1): xaa in position 1 is Tyr or Leu
  Variant (2)..(2): xaa in position 2 is any amino acid
  Variant (3)..(13): xaa in position 3 to 13 is any or no amino acid
  Variant (15)..(17): xaa in position 15 to 17 is any amino acid
  Variant (19)..(19): xaa in position 19 is Phe or Tyr
  Variant (20)..(25): xaa in position 20 to 25 is any amino acid
  Variant (26)..(26): xaa in position 26 is Ile, Val, Leu or Phe
  Variant (27)..(29): xaa in position 27 to 29 is any amino acid
  Variant (30)..(30): xaa in position 30 is Arg, Asn, Phe or Gln
  Variant (31)..(31): xaa in position 31 is Trp or Phe
  Variant (32)..(32): xaa in position 32 is any amino acid
  Variant (33)..(33): xaa in position 33 is Gly or Asp
  Variant (34)..(34): xaa in position 34 is Val or Thr
  Variant (36)..(36): xaa in position 36 is Phe or Ile
  Variant (37)..(37): xaa in position 37 is any amino acid
  Variant (38)..(38): xaa in position 38 is Leu, Met, Ile, Val or Phe
  Variant (39)..(40): xaa in position 39 to 40 is any amino acid
  Variant (41)..(41): xaa in position 41 is Gly or Ala
  Variant (43)..(43): xaa in position 43 is any amino acid
  Variant (44)..(44): xaa in position 44 is Leu, Met or Val

SEQ ID NO: 60079 - protein, 97 aa, Artificial sequence; identical to SEQ ID NO: 2919
  Variant (1)..(1): xaa in position 1 is Asn, Asp, Gln, Arg or Lys
  Variant (2)..(4): xaa in position 2 to 4 is any amino acid
  Variant (5)..(5): xaa in position 5 is Ile, Leu, Met, Phe or Val
  Variant (6)..(6): xaa in position 6 is any amino acid
  Variant (7)..(7): xaa in position 7 is Ile, Leu, Val, Ala or Ser
  Variant (8)..(8): xaa in position 8 is any amino acid
  Variant (9)..(9): xaa in position 9 is Pro or His
  Variant (10)..(12): xaa in position 10 to 12 is any amino acid
  Variant (13)..(13): xaa in position 13 is Ile, Val, Met, Leu, Phe or Ala
  Variant (14)..(19): xaa in position 14 to 19 is any amino acid
  Variant (20)..(20): xaa in position 20 is Lys, Ser or Arg
  Variant (21)..(29): xaa in position 21 to 29 is any amino acid
  Variant (30)..(35): xaa in position 30 to 35 is any or no amino acid
  Variant (36)..(36): xaa in position 36 is Leu, Ile, Met or Val
  Variant (37)..(44): xaa in position 37 to 44 is any amino acid
  Variant (45)..(64): xaa in position 45 to 64 is any or no amino acid
  Variant (65)..(65): xaa in position 65 is Ala, Gly, Pro or Ser
  Variant (66)..(66): xaa in position 66 is Tyr or Leu
  Variant (67)..(68): xaa in position 67 to 68 is any amino acid
  Variant (69)..(69): xaa in position 69 is Leu, Met or Tyr
  Variant (70)..(70): xaa in position 70 is Leu, Ile, Phe or Met
  Variant (71)..(71): xaa in position 71 is any amino acid
  Variant (72)..(72): xaa in position 72 is Asp, Glu, Ala, Asn or His
  Variant (73)..(75): xaa in position 73 to 75 is any amino acid
  Variant (76)..(76): xaa in position 76 is Gly, Ser or Asp
  Variant (77)..(80): xaa in position 77 to 80 is any amino acid
  Variant (81)..(81): xaa in position 81 is Phe or Tyr
  Variant (82)..(85): xaa in position 82 to 85 is any amino acid
  Variant (86)..(86): xaa in position 86 is any or no amino acid
  Variant (87)..(87): xaa in position 87 is Val, Ile, Leu, Ala or Gln
  Variant (88)..(90): xaa in position 88 to 90 is any amino acid
  Variant (92)..(96): xaa in position 92 to 96 is any amino acid
  Variant (97)..(97): xaa in position 97 is Ile, Val, Leu, Phe or Ala

SEQ ID NO: 60080 - DNA, 2077 bp, Saccharomyces cerevisiae; identical to SEQ ID NO: 3739
  CDS (482)..(1987)

SEQ ID NO: 60081 - protein, 501 aa, Saccharomyces cerevisiae; identical to SEQ ID NO: 3740

SEQ ID NO: 60082 - DNA, 1668 bp, Caenorhabditis elegans; identical to SEQ ID NO: 3749
  CDS (121)..(1668)

SEQ ID NO: 60083 - protein, 515 aa, Caenorhabditis elegans; identical to SEQ ID NO: 15344

SEQ ID NO: 60084 - DNA, 1365 bp, Schizosaccharomyces pombe; identical to SEQ ID NO: 3751
  CDS (1)..(1365)

SEQ ID NO: 60085 - protein, 454 aa, Schizosaccharomyces pombe; identical to SEQ ID NO: 3752

SEQ ID NO: 60086 - DNA, 1521 bp, Debaryomyces hansenii CBS767; identical to SEQ ID NO: 3757
  CDS (1)..(1521)

SEQ ID NO: 60087 - protein, 506 aa, Debaryomyces hansenii CBS767; identical to SEQ ID NO: 3758

SEQ ID NO: 60088 - DNA, 1353 bp, Yarrowia lipolytica CLIB99; identical to SEQ ID NO: 3759
  CDS (1)..(1353)

SEQ ID NO: 60089 - protein, 450 aa, Yarrowia lipolytica CLIB99; identical to SEQ ID NO: 3760

SEQ ID NO: 60090 - DNA, 1380 bp, Kluyveromyces lactis NRRL Y; identical to SEQ ID NO: 3761
  CDS (1)..(1380)

SEQ ID NO: 60091 - protein, 459 aa, Kluyveromyces lactis NRRL Y; identical to SEQ ID NO: 3762

SEQ ID NO: 60092 - DNA, 1431 bp, Candida glabrata CBS138; identical to SEQ ID NO: 3767
  CDS (1)..(1431)

SEQ ID NO: 60093 - protein, 476 aa, Candida glabrata CBS138; identical to SEQ ID NO: 3768

SEQ ID NO: 60094 - DNA, 1965 bp, Oryza sativa; identical to SEQ ID NO: 3773
  CDS (257)..(1726)

SEQ ID NO: 60095 - protein, 489 aa, Oryza sativa; identical to SEQ ID NO: 3774

SEQ ID NO: 60096 - DNA, 1374 bp, Cryptosporidium parvum; identical to SEQ ID NO: 15357
  CDS (1)..(1374)

SEQ ID NO: 60097 - protein, 457 aa, Cryptosporidium parvum; identical to SEQ ID NO: 15358

SEQ ID NO: 60098 - DNA, 1862 bp, Oryza sativa; identical to SEQ ID NO: 15359
  CDS (98)..(1573)

SEQ ID NO: 60099 - protein, 491 aa, Oryza sativa; identical to SEQ ID NO: 15360

SEQ ID NO: 60100 - DNA, 1497 bp, Ashbya gossypii; identical to SEQ ID NO: 3797
  CDS (1)..(1497)

SEQ ID NO: 60101 - protein, 498 aa, Ashbya gossypii; identical to SEQ ID NO: 3798

SEQ ID NO: 60102 - DNA, 1425 bp, Neurospora crassa; identical to SEQ ID NO: 3817
  CDS (1)..(1425)

SEQ ID NO: 60103 - protein, 474 aa, Neurospora crassa; identical to SEQ ID NO: 3818

SEQ ID NO: 60104 - DNA, 1831 bp, Arabidopsis thaliana; identical to SEQ ID NO: 3841
  CDS (116)..(1525)

SEQ ID NO: 60105 - protein, 469 aa, Arabidopsis thaliana; identical to SEQ ID NO: 3842

SEQ ID NO: 60106 - DNA, 1870 bp, Arabidopsis thaliana; identical to SEQ ID NO: 15367
  CDS (207)..(1607)

SEQ ID NO: 60107 - protein, 466 aa, Arabidopsis thaliana; identical to SEQ ID NO: 15368

SEQ ID NO: 60108 - DNA, 1711 bp, Cryptosporidium parvum; identical to SEQ ID NO: 3855
  CDS (290)..(1549)

SEQ ID NO: 60109 - protein, 419 aa, Cryptosporidium parvum; identical to SEQ ID NO: 3856

SEQ ID NO: 60110 - DNA, 1844 bp, Arabidopsis thaliana; identical to SEQ ID NO: 15371
  CDS (61)..(1521)

SEQ ID NO: 60111 - protein, 486 aa, Arabidopsis thaliana; identical to SEQ ID NO: 3858

SEQ ID NO: 60112 - DNA, 3183 bp, Arabidopsis thaliana; identical to SEQ ID NO: 15373
  CDS (1)..(3183)

SEQ ID NO: 60113 - protein, 1060 aa, Arabidopsis thaliana; identical to SEQ ID NO: 15374

SEQ ID NO: 60114 - DNA, 1629 bp, Arabidopsis thaliana; identical to SEQ ID NO: 15375
  CDS (1)..(1629)

SEQ ID NO: 60115 - protein, 542 aa, Arabidopsis thaliana; identical to SEQ ID NO: 15376

SEQ ID NO: 60116 - DNA, 1758 bp, Arabidopsis thaliana; identical to SEQ ID NO: 15377
  CDS (101)..(1552)

SEQ ID NO: 60117 - protein, 483 aa, Arabidopsis thaliana; identical to SEQ ID NO: 3864

SEQ ID NO: 60118 - DNA, 1398 bp, Arabidopsis thaliana; identical to SEQ ID NO: 3865
  CDS (1)..(1398)

SEQ ID NO: 60119 - protein, 465 aa, Arabidopsis thaliana; identical to SEQ ID NO: 3866

SEQ ID NO: 60120 - DNA, 1863 bp, Drosophila melanogaster; identical to SEQ ID NO: 15381
  CDS (77)..(1762)

SEQ ID NO: 60121 - protein, 561 aa, Drosophila melanogaster; identical to SEQ ID NO: 3868

SEQ ID NO: 60122 - DNA, 1847 bp, Homo sapiens; identical to SEQ ID NO: 15383
  CDS (45)..(1691)

SEQ ID NO: 60123 - protein, 548 aa, Homo sapiens; identical to SEQ ID NO: 15384

SEQ ID NO: 60124 - DNA, 23 bp, Artificial sequence
  (1)..(23): primer
atgtcccatcgtatagcaccttc

SEQ ID NO: 60125 - DNA, 27 bp, Artificial sequence
  (1)..(27): primer
tcaatcacaaccaaaatactttgaatc

SEQ ID NO: 60126 - protein, 466 aa, Artificial sequence; identical to SEQ ID NO: 15387
  Variant (2)..(4): xaa in position 2 to 4 is any amino acid
  Variant (5)..(8): xaa in position 5 to 8 is any or no amino acid
  Variant (10)..(12): xaa in position 10 to 12 is any amino acid
  Variant (16)..(38): xaa in position 16 to 38 is any amino acid
  Variant (41)..(57): xaa in position 41 to 57 is any amino acid
  Variant (60)..(60): xaa in position 60 is any amino acid
  Variant (62)..(78): xaa in position 62 to 78 is any amino acid
  Variant (80)..(84): xaa in position 80 to 84 is any amino acid
  Variant (86)..(86): xaa in position 86 is any amino acid
  Variant (88)..(88): xaa in position 88 is any amino acid
  Variant (90)..(110): xaa in position 90 to 110 is any amino acid
  Variant (114)..(124): xaa in position 114 to 124 is any amino acid
  Variant (126)..(134): xaa in position 126 to 134 is any amino acid
  Variant (135)..(163): xaa in position 135 to 163 is any or no amino acid
  Variant (165)..(165): xaa in position 165 is any amino acid
  Variant (167)..(168): xaa in position 167 to 168 is any amino acid
  Variant (170)..(170): xaa in position 170 is any amino acid
  Variant (173)..(174): xaa in position 173 to 174 is any amino acid
  Variant (177)..(180): xaa in position 177 to 180 is any amino acid
  Variant (183)..(189): xaa in position 183 to 189 is any amino acid
  Variant (191)..(194): xaa in position 191 to 194 is any amino acid
  Variant (198)..(214): xaa in position 198 to 214 is any amino acid
  Variant (216)..(219): xaa in position 216 to 219 is any amino acid
  Variant (221)..(222): xaa in position 221 to 222 is any amino acid
  Variant (224)..(234): xaa in position 224 to 234 is any amino acid
  Variant (236)..(293): xaa in position 236 to 293 is any amino acid
  Variant (295)..(297): xaa in position 295 to 297 is any amino acid
  Variant (299)..(341): xaa in position 299 to 341 is any amino acid
  Variant (342)..(361): xaa in position 342 to 361 is any or no amino acid
  Variant (363)..(363): xaa in position 363 is any amino acid
  Variant (365)..(380): xaa in position 365 to 380 is any amino acid
  Variant (382)..(383): xaa in position 382 to 383 is any amino acid
  Variant (385)..(400): xaa in position 385 to 400 is any amino acid
  Variant (401)..(423): xaa in position 401 to 423 is any or no amino acid
  Variant (425)..(451): xaa in position 425 to 451 is any amino acid
  Variant (453)..(455): xaa in position 453 to 455 is any amino acid
  Variant (457)..(465): xaa in position 457 to 465 is any amino acid

SEQ ID NO: 60127 - protein, 528 aa, Artificial sequence; identical to SEQ ID NO: 15388
  Variant (3)..(4): xaa in position 3 to 4 is any amino acid
  Variant (5)..(8): xaa in position 5 to 8 is any or no amino acid
  Variant (10)..(12): xaa in position 10 to 12 is any amino acid
  Variant (17)..(17): xaa in position 17 is any amino acid
  Variant (19)..(21): xaa in position 19 to 21 is any amino acid
  Variant (23)..(31): xaa in position 23 to 31 is any amino acid
  Variant (33)..(36): xaa in position 33 to 36 is any amino acid
  Variant (38)..(38): xaa in position 38 is any amino acid
  Variant (41)..(42): xaa in position 41 to 42 is any amino acid
  Variant (44)..(55): xaa in position 44 to 55 is any amino acid
  Variant (57)..(57): xaa in position 57 is any amino acid
  Variant (60)..(60): xaa in position 60 is any amino acid
  Variant (62)..(62): xaa in position 62 is any amino acid
  Variant (64)..(64): xaa in position 64 is any amino acid
  Variant (66)..(75): xaa in position 66 to 75 is any amino acid
  Variant (77)..(78): xaa in position 77 to 78 is any amino acid
  Variant (80)..(84): xaa in position 80 to 84 is any amino acid
  Variant (86)..(86): xaa in position 86 is any amino acid
  Variant (88)..(88): xaa in position 88 is any amino acid
  Variant (90)..(91): xaa in position 90 to 91 is any amino acid
  Variant (93)..(106): xaa in position 93 to 106 is any amino acid
  Variant (108)..(110): xaa in position 108 to 110 is any amino acid
  Variant (114)..(117): xaa in position 114 to 117 is any amino acid
  Variant (119)..(124): xaa in position 119 to 124 is any amino acid
  Variant (126)..(128): xaa in position 126 to 128 is any amino acid
  Variant (130)..(131): xaa in position 130 to 131 is any amino acid
  Variant (134)..(134): xaa in position 134 is any amino acid
  Variant (135)..(163): xaa in position 135 to 163 is any or no amino acid
  Variant (165)..(165): xaa in position 165 is any amino acid
  Variant (167)..(168): xaa in position 167 to 168 is any amino acid
  Variant (170)..(170): xaa in position 170 is any amino acid
  Variant (173)..(174): xaa in position 173 to 174 is any amino acid
  Variant (177)..(179): xaa in position 177 to 179 is any amino acid
  Variant (183)..(189): xaa in position 183 to 189 is any amino acid
  Variant (191)..(194): xaa in position 191 to 194 is any amino acid
  Variant (198)..(204): xaa in position 198 to 204 is any amino acid
  Variant (206)..(209): xaa in position 206 to 209 is any amino acid
  Variant (212)..(214): xaa in position 212 to 214 is any amino acid
  Variant (216)..(219): xaa in position 216 to 219 is any amino acid
  Variant (221)..(222): xaa in position 221 to 222 is any amino acid
  Variant (224)..(229): xaa in position 224 to 229 is any amino acid
  Variant (231)..(234): xaa in position 231 to 234 is any amino acid
  Variant (236)..(245): xaa in position 236 to 245 is any amino acid
  Variant (247)..(271): xaa in position 247 to 271 is any amino acid
  Variant (273)..(273): xaa in position 273 is any amino acid
  Variant (275)..(279): xaa in position 275 to 279 is any amino acid
  Variant (281)..(290): xaa in position 281 to 290 is any amino acid
  Variant (293)..(293): xaa in position 293 is any amino acid
  Variant (296)..(297): xaa in position 296 to 297 is any amino acid
  Variant (299)..(307): xaa in position 299 to 307 is any amino acid
  Variant (309)..(341): xaa in position 309 to 341 is any amino acid
  Variant (342)..(361): xaa in position 342 to 361 is any or no amino acid
  Variant (363)..(363): xaa in position 363 is any amino acid
  Variant (365)..(370): xaa in position 365 to 370 is any amino acid
  Variant (372)..(379): xaa in position 372 to 379 is any amino acid
  Variant (383)..(383): xaa in position 383 is any amino acid
  Variant (386)..(391): xaa in position 386 to 391 is any amino acid
  Variant (393)..(394): xaa in position 393 to 394 is any amino acid
  Variant (395)..(417): xaa in position 395 to 417 is any or no amino acid
  Variant (419)..(422): xaa in position 419 to 422 is any amino acid
  Variant (425)..(426): xaa in position 425 to 426 is any amino acid
  Variant (428)..(434): xaa in position 428 to 434 is any amino acid
  Variant (436)..(436): xaa in position 436 is any amino acid
  Variant (438)..(438): xaa in position 438 is any amino acid
  Variant (440)..(445): xaa in position 440 to 445 is any amino acid
  Variant (447)..(451): xaa in position 447 to 451 is any amino acid
  Variant (453)..(455): xaa in position 453 to 455 is any amino acid
  Variant (457)..(460): xaa in position 457 to 460 is any amino acid
  Variant (462)..(465): xaa in position 462 to 465 is any amino acid
  Variant (467)..(476): xaa in position 467 to 476 is any amino acid
  Variant (478)..(484): xaa in position 478 to 484 is any amino acid
  Variant (486)..(525): xaa in position 486 to 525 is any amino acid

SEQ ID NO: 60128 - protein, 45 aa, Artificial sequence; identical to SEQ ID NO: 15389
  Variant (1)..(1): xaa in position 1 is Phe, Tyr, Ser or Arg
  Variant (2)..(2): xaa in position 2 is Val, Ile, Ala or Phe
  Variant (4)..(4): xaa in position 4 is Gly or Ala
  Variant (5)..(8): xaa in position 5 to 8 is any or no amino acid
  Variant (9)..(9): xaa in position 9 is Val, Ile or Leu
  Variant (10)..(10): xaa in position 10 is any amino acid
  Variant (12)..(12): xaa in position 12 is any amino acid
  Variant (13)..(13): xaa in position 13 is Ser, Ala or Thr
  Variant (14)..(14): xaa in position 14 is Ala, Gly or Ser
  Variant (18)..(19): xaa in position 18 to 19 is Thr or Ser
  Variant (20)..(20): xaa in position 20 is Val or Leu
  Variant (21)..(21): xaa in position 21 is Cys, Ala or Ser
  Variant (22)..(23): xaa in position 22 to 23 is any amino acid
  Variant (24)..(24): xaa in position 24 is Ile or Leu
  Variant (25)..(25): xaa in position 25 is Ile, Val, Met or Phe
  Variant (26)..(27): xaa in position 26 to 27 is any amino acid
  Variant (28)..(28): xaa in position 28 is Leu or Ile
  Variant (29)..(30): xaa in position 29 to 30 is any amino acid
  Variant (31)..(31): xaa in position 31 is Pro, Gln, His or Lys
  Variant (32)..(32): xaa in position 32 is Trp, Arg or His
  Variant (33)..(33): xaa in position 33 is Val, Thr, Ala or Ile
  Variant (34)..(34): xaa in position 34 is Val or Thr
  Variant (35)..(35): xaa in position 35 is Leu, Val or Ile
  Variant (36)..(36): xaa in position 36 is Ile, Leu or Val
  Variant (37)..(37): xaa in position 37 is Ser, Asn, Glu or Thr
  Variant (38)..(38): xaa in position 38 is any amino acid
  Variant (39)..(39): xaa in position 39 is Asp or Glu
  Variant (40)..(40): xaa in position 40 is Ser, Asn or Cys
  Variant (43)..(44): xaa in position 43 to 44 is any amino acid
  Variant (45)..(45): xaa in position 45 is Leu, Pro or Val

SEQ ID NO: 60129 - protein, 78 aa, Artificial sequence; identical to SEQ ID NO: 15390
  Variant (1)..(1): xaa in position 1 is Tyr, Phe or His
  Variant (2)..(2): xaa in position 2 is Asn or Asp
  Variant (5)..(5): xaa in position 5 is any amino acid
  Variant (7)..(7): xaa in position 7 is any amino acid
  Variant (8)..(8): xaa in position 8 is Ala or Ser
  Variant (9)..(9): xaa in position 9 is any amino acid
  Variant (10)..(10): xaa in position 10 is Asp or Asn
  Variant (11)..(11): xaa in position 11 is any amino acid
  Variant (12)..(12): xaa in position 12 is Glu or Asp
  Variant (13)..(13): xaa in position 13 is any amino acid
  Variant (14)..(14): xaa in position 14 is Leu, Ala or Ile
  Variant (15)..(17): xaa in position 15 to 17 is any amino acid
  Variant (18)..(18): xaa in position 18 is Leu, Met, Val, Ile or Ala
  Variant (19)..(20): xaa in position 19 to 20 is any amino acid
  Variant (21)..(21): xaa in position 21 is Leu or Ile
  Variant (22)..(22): xaa in position 22 is Lys or Arg
  Variant (23)..(23): xaa in position 23 is any amino acid
  Variant (25)..(28): xaa in position 25 to 28 is any amino acid
  Variant (29)..(29): xaa in position 29 is Ile, Val or Met
  Variant (31)..(31): xaa in position 31 is any amino acid
  Variant (33)..(33): xaa in position 33 is Asp, Ser, Cys or Asn
  Variant (35)..(36): xaa in position 35 to 36 is any amino acid
  Variant (37)..(37): xaa in position 37 is His or Tyr
  Variant (38)..(38): xaa in position 38 is any amino acid
  Variant (39)..(39): xaa in position 39 is Arg, Ser or Asn
  Variant (40)..(44): xaa in position 40 to 44 is any amino acid
  Variant (45)..(46): xaa in position 45 to 46 is any or no amino acid
  Variant (47)..(47): xaa in position 47 is Val, Ile, Met or Leu
  Variant (48)..(48): xaa in position 48 is Tyr, Asn, Ser or Phe
  Variant (49)..(49): xaa in position 49 is Gly, Pro, Ala or Ser
  Variant (50)..(50): xaa in position 50 is any amino acid
  Variant (51)..(51): xaa in position 51 is Asp, Ser, Asn or His
  Variant (52)..(52): xaa in position 52 is Val or Ile
  Variant (53)..(53): xaa in position 53 is Ile, Val or Leu
  Variant (54)..(54): xaa in position 54 is Ile or Val
  Variant (55)..(55): xaa in position 55 is Leu, Phe, Ile or Val
  Variant (59)..(59): xaa in position 59 is Leu, Tyr, Phe or Met
  Variant (60)..(60): xaa in position 60 is any amino acid
  Variant (61)..(61): xaa in position 61 is Leu or Phe
  Variant (62)..(62): xaa in position 62 is any amino acid
  Variant (63)..(63): xaa in position 63 is Asp, His or Ser
  Variant (64)..(65): xaa in position 64 to 65 is any amino acid
  Variant (66)..(66): xaa in position 66 is any or no amino acid
  Variant (67)..(67): xaa in position 67 is Val, Leu or Ile
  Variant (68)..(69): xaa in position 68 to 69 is any amino acid
  Variant (71)..(71): xaa in position 71 is Met, Leu or Ile
  Variant (72)..(72): xaa in position 72 is Asp or Asn
  Variant (73)..(73): xaa in position 73 is Met, Leu, Ile or Val
  Variant (74)..(74): xaa in position 74 is Lys or Ser
  Variant (75)..(75): xaa in position 75 is Ile or Val
  Variant (76)..(76): xaa in position 76 is Phe or Tyr
  Variant (77)..(77): xaa in position 77 is Val, Cys or Leu
  Variant (78)..(78): xaa in position 78 is Asp, Cys or Glu

SEQ ID NO: 60130 - protein, 72 aa, Artificial sequence; identical to SEQ ID NO: 15391
  Variant (2)..(2): xaa in position 2 is any amino acid
  Variant (4)..(4): xaa in position 4 is Ile, Val, Thr or Leu
  Variant (5)..(5): xaa in position 5 is Arg or Cys
  Variant (7)..(7): xaa in position 7 is Ala, Ser, Val or Thr
  Variant (10)..(10): xaa in position 10 is Ile or Leu
  Variant (11)..(11): xaa in position 11 is any amino acid
  Variant (14)..(16): xaa in position 14 to 16 is any amino acid
  Variant (17)..(17): xaa in position 17 is Arg, Lys or Asn
  Variant (20)..(20): xaa in position 20 is Asp, Gln, Asn or Glu
  Variant (21)..(21): xaa in position 21 is Ile, Leu, Val or Met
  Variant (22)..(23): xaa in position 22 to 23 is any amino acid
  Variant (24)..(24): xaa in position 24 is Val, Ile, Cys or Ala
  Variant (25)..(25): xaa in position 25 is Leu, Ile or Met
  Variant (26)..(26): xaa in position 26 is any amino acid
  Variant (28)..(28): xaa in position 28 is Tyr or Trp
  Variant (29)..(31): xaa in position 29 to 31 is any amino acid
  Variant (35)..(35): xaa in position 35 is any amino acid
  Variant (36)..(36): xaa in position 36 is Phe, Ala or Tyr
  Variant (37)..(38): xaa in position 37 to 38 is any amino acid
  Variant (39)..(39): xaa in position 39 is Phe or Tyr
  Variant (40)..(40): xaa in position 40 is Val or Ile
  Variant (41)..(41): xaa in position 41 is any amino acid
  Variant (42)..(42): xaa in position 42 is Pro or Arg
  Variant (43)..(46): xaa in position 43 to 46 is any amino acid
  Variant (47)..(47): xaa in position 47 is Ala or Thr
  Variant (48)..(48): xaa in position 48 is Asp or Asn
  Variant (49)..(49): xaa in position 49 is Ile, Ala, Val or Leu
  Variant (50)..(50): xaa in position 50 is Ile, Val or Leu
  Variant (51)..(51): xaa in position 51 is Ile, Val or Phe
  Variant (53)..(53): xaa in position 53 is Arg, Ser or His
  Variant (54)..(54): xaa in position 54 is Gly, Met or Tyr
  Variant (55)..(55): xaa in position 55 is any amino acid
  Variant (56)..(56): xaa in position 56 is any or no amino acid
  Variant (58)..(58): xaa in position 58 is any amino acid
  Variant (59)..(59): xaa in position 59 is Val, Ile, Thr or Leu
  Variant (61)..(61): xaa in position 61 is Ile, Val, Thr or Met
  Variant (62)..(62): xaa in position 62 is any amino acid
  Variant (63)..(63): xaa in position 63 is Leu or Met
  Variant (64)..(64): xaa in position 64 is Ile, Val, Leu or Met
  Variant (65)..(65): xaa in position 65 is any amino acid
  Variant (66)..(66): xaa in position 66 is Gln, Asn or Lys
  Variant (67)..(67): xaa in position 67 is His, Phe or Asn
  Variant (68)..(68): xaa in position 68 is Ile, Val or Leu
  Variant (69)..(71): xaa in position 69 to 71 is any amino acid

SEQ ID NO: 60131 - protein, 42 aa, Artificial sequence; identical to SEQ ID NO: 15392
  Variant (1)..(1): xaa in position 1 is Leu, Ile or Val
  Variant (2)..(3): xaa in position 2 to 3 is any amino acid
  Variant (4)..(4): xaa in position 4 is Leu, Ile or Val
  Variant (5)..(6): xaa in position 5 to 6 is any amino acid
  Variant (7)..(7): xaa in position 7 is Thr, Asn or Ser
  Variant (8)..(8): xaa in position 8 is any amino acid
  Variant (9)..(9): xaa in position 9 is Gln, His or Glu
  Variant (10)..(12): xaa in position 10 to 12 is any amino acid
  Variant (13)..(13): xaa in position 13 is Met, Leu or Ile
  Variant (14)..(14): xaa in position 14 is any amino acid
  Variant (15)..(15): xaa in position 15 is Thr or Ser
  Variant (16)..(16): xaa in position 16 is any amino acid
  Variant (17)..(17): xaa in position 17 is Ile, Leu or Val
  Variant (18)..(25): xaa in position 18 to 25 is any amino acid
  Variant (26)..(26): xaa in position 26 is Asp, Glu or Asn
  Variant (27)..(27): xaa in position 27 is Phe, Trp, Leu or His
  Variant (28)..(28): xaa in position 28 is any amino acid
  Variant (30)..(30): xaa in position 30 is Tyr, Phe, Trp or Gln
  Variant (31)..(32): xaa in position 31 to 32 is any amino acid
  Variant (34)..(34): xaa in position 34 is Leu, Ile or Phe
  Variant (35)..(35): xaa in position 35 is any amino acid
  Variant (36)..(36): xaa in position 36 is Arg, Thr or Ile
  Variant (37)..(37): xaa in position 37 is Leu, Ile or Met
  Variant (38)..(38): xaa in position 38 is Val, Leu or Ile
  Variant (39)..(39): xaa in position 39 is Val, Ile, Met or Leu
  Variant (40)..(41): xaa in position 40 to 41 is any amino acid
  Variant (42)..(42): xaa in position 42 is Ala, Gly, Cys or Thr

SEQ ID NO: 60132 - protein, 29 aa, Artificial sequence
  Variant (1)..(1): xaa in position 1 is Gly or Ala
  Variant (2)..(2): xaa in position 2 is Val, Ile or Leu
  Variant (3)..(3): xaa in position 3 is any amino acid
  Variant (4)..(4): xaa in position 4 is Ile, Val or Thr
  Variant (5)..(5): xaa in position 5 is Ile, Leu, Val or Met
  Variant (7)..(7): xaa in position 7 is Ser, Ala or Gly
  Variant (9)..(10): xaa in position 9 to 10 is any amino acid
  Variant (11)..(11): xaa in position 11 is Met, Phe or Leu
  Variant (12)..(12): xaa in position 12 is Glu, Met or Asp
  Variant (13)..(13): xaa in position 13 is any amino acid
  Variant (14)..(14): xaa in position 14 is Ala, Ser or Gly
  Variant (15)..(15): xaa in position 15 is Leu, Val or Ile
  Variant (16)..(19): xaa in position 16 to 19 is any amino acid
  Variant (20)..(20): xaa in position 20 is Lys, Pro or Asn
  Variant (21)..(24): xaa in position 21 to 24 is any amino acid
  Variant (26)..(26): xaa in position 26 is Lys, Thr or Arg
  Variant (27)..(27): xaa in position 27 is Ile, Leu or Val
  Variant (29)..(29): xaa in position 29 is Ile, Leu or Val
XXXXXRXGXXXXXXXXXXXXXXXXGXXLX

SEQ ID NO: 60133 - protein, 49 aa, Artificial sequence; identical to SEQ ID NO: 15394
  Variant (1)..(1): xaa in position 1 is Leu or Ile
  Variant (2)..(2): xaa in position 2 is His, Ile, Tyr or Val
  Variant (3)..(5): xaa in position 3 to 5 is any amino acid
  Variant (6)..(6): xaa in position 6 is Leu, Ile or Phe
  Variant (8)..(9): xaa in position 8 to 9 is any amino acid
  Variant (10)..(10): xaa in position 10 is Ile or Leu
  Variant (11)..(14): xaa in position 11 to 14 is any amino acid
  Variant (15)..(17): xaa in position 15 to 17 is any or no amino acid
  Variant (18)..(18): xaa in position 18 is Val or Ile
  Variant (19)..(19): xaa in position 19 is Leu, Phe, Ile or Val
  Variant (20)..(20): xaa in position 20 is Leu or Ile
  Variant (21)..(21): xaa in position 21 is Leu, Met, Phe or Cys
  Variant (22)..(22): xaa in position 22 is Asp, Ala or Glu
  Variant (23)..(24): xaa in position 23 to 24 is any amino acid
  Variant (25)..(25): xaa in position 25 is Leu, Ile, Val or Met
  Variant (26)..(26): xaa in position 26 is any amino acid
  Variant (27)..(27): xaa in position 27 is any or no amino acid
  Variant (28)..(28): xaa in position 28 is Thr, Ser, Asn or Ala
  Variant (29)..(29): xaa in position 29 is Gly or His
  Variant (30)..(31): xaa in position 30 to 31 is any amino acid
  Variant (32)..(32): xaa in position 32 is Ala, Val, Met or Ile
  Variant (33)..(34): xaa in position 33 to 34 is any amino acid
  Variant (36)..(36): xaa in position 36 is Ile, Val or Thr
  Variant (37)..(37): xaa in position 37 is any amino acid
  Variant (38)..(38): xaa in position 38 is Val, Leu, Tyr or Ile
  Variant (40)..(40): xaa in position 40 is Leu, Ile, Val or Thr
  Variant (41)..(43): xaa in position 41 to 43 is any amino acid
  Variant (44)..(44): xaa in position 44 is Val or Ile
  Variant (45)..(48): xaa in position 45 to 48 is any amino acid

SEQ ID NO: 60134 - DNA, 2376 bp, Saccharomyces cerevisiae; identical to SEQ ID NO: 35553
  CDS (1)..(2376)

SEQ ID NO: 60135 - protein, 791 aa, Saccharomyces cerevisiae; identical to SEQ ID NO: 35554

SEQ ID NO: 60136 - DNA, 717 bp, Danio rerio; identical to SEQ ID NO: 35555
  CDS (1)..(717)

SEQ ID NO: 60137 - protein, 238 aa, Danio rerio; identical to SEQ ID NO: 35556

SEQ ID NO: 60138 - DNA, 1506 bp, Caenorhabditis elegans; identical to SEQ ID NO: 35557
  CDS (1)..(1506)

SEQ ID NO: 60139 - protein, 501 aa, Caenorhabditis elegans; identical to SEQ ID NO: 35558

SEQ ID NO: 60140 - DNA, 684 bp, Caenorhabditis elegans; identical to SEQ ID NO: 35559
  CDS (1)..(684)

SEQ ID NO: 60141 - protein, 227 aa, Caenorhabditis elegans; identical to SEQ ID NO: 35560

SEQ ID NO: 60142 - DNA, 720 bp, Homo sapiens; identical to SEQ ID NO: 35561
  CDS (1)..(720)

SEQ ID NO: 60143 - protein, 239 aa, Homo sapiens; identical to SEQ ID NO: 35562

SEQ ID NO: 60144 - DNA, 1272 bp, Leptospira interrogans serovar Lai str. 56601; identical to SEQ ID NO: 35563
  CDS (1)..(1272): transl_table=11

SEQ ID NO: 60145 - protein, 423 aa, Leptospira interrogans serovar Lai str. 56601; identical to SEQ ID NO: 35564

SEQ ID NO: 60146 - DNA, 1497 bp, Leptospira interrogans serovar Lai str. 56601; identical to SEQ ID NO: 35565
  CDS (1)..(1497): transl_table=11

SEQ ID NO: 60147 - protein, 498 aa, Leptospira interrogans serovar Lai str. 56601; identical to SEQ ID NO: 35566

SEQ ID NO: 60148 - DNA, 1287 bp, Leptospira interrogans serovar Lai str. 56601; identical to SEQ ID NO: 35567
  CDS (1)..(1287): transl_table=11

SEQ ID NO: 60149 - protein, 428 aa, Leptospira interrogans serovar Lai str. 56601; identical to SEQ ID NO: 35568

SEQ ID NO: 60150 - DNA, 870 bp, Leptospira interrogans serovar Lai str. 56601; identical to SEQ ID NO: 35569
  CDS (1)..(870): transl_table=11

SEQ ID NO: 60151 - protein, 289 aa, Leptospira interrogans serovar Lai str. 56601; identical to SEQ ID NO: 35570

SEQ ID NO: 60152 - DNA, 1281 bp, Leptospira interrogans serovar Lai str. 56601; identical to SEQ ID NO: 35571
  CDS (1)..(1281): transl_table=11

SEQ ID NO: 60153 - protein, 426 aa, Leptospira interrogans serovar Lai str. 56601; identical to SEQ ID NO: 35572

SEQ ID NO: 60154 - DNA, 1227 bp, Leptospira interrogans serovar Lai str. 56601; identical to SEQ ID NO: 35573
  CDS (1)..(1227): transl_table=11

SEQ ID NO: 60155 - protein, 408 aa, Leptospira interrogans serovar Lai str. 56601; identical to SEQ ID NO: 35574

SEQ ID NO: 60156 - DNA, 1134 bp, Leptospira interrogans serovar Lai str. 56601; identical to SEQ ID NO: 35575
  CDS (1)..(1134): transl_table=11

SEQ ID NO: 60157 - protein, 377 aa, Leptospira interrogans serovar Lai str. 56601; identical to SEQ ID NO: 35576

SEQ ID NO: 60158 - DNA, 936 bp, Leptospira interrogans serovar Lai str. 56601; identical to SEQ ID NO: 35577
  CDS (1)..(936): transl_table=11

SEQ ID NO: 60159 - protein, 311 aa, Leptospira interrogans serovar Lai str. 56601; identical to SEQ ID NO: 35578

SEQ ID NO: 60160 - DNA, 990 bp, Leptospira interrogans serovar Lai str. 56601; identical to SEQ ID NO: 35579
  CDS (1)..(990): transl_table=11

SEQ ID NO: 60161 - protein, 329 aa, Leptospira interrogans serovar Lai str. 56601; identical to SEQ ID NO: 35580

SEQ ID NO: 60162 - DNA, 1458 bp, Caenorhabditis elegans; identical to SEQ ID NO: 35581
  CDS (1)..(1458)

SEQ ID NO: 60163 - protein, 485 aa, Caenorhabditis elegans; identical to SEQ ID NO: 35582

SEQ ID NO: 60164 - DNA, 2160 bp, Eremothecium gossypii; identical to SEQ ID NO: 35583
  CDS (1)..(2160)

SEQ ID NO: 60165 - protein, 719 aa, Eremothecium gossypii; identical to SEQ ID NO: 35584

SEQ ID NO: 60166 - DNA, 3123 bp, Magnaporthe grisea 70-15; identical to SEQ ID NO: 35585
  CDS (1)..(3123)

SEQ ID NO: 60167 - protein, 1040 aa, Magnaporthe grisea 70-15; identical to SEQ ID NO: 35586

SEQ ID NO: 60168 - DNA, 2940 bp, Gibberella zeae PH-1; identical to SEQ ID NO: 35587
  CDS (1)..(2940)

SEQ ID NO: 60169 - protein, 979 aa, Gibberella zeae PH-1; identical to SEQ ID NO: 35588

SEQ ID NO: 60170 - DNA, 2943 bp, Aspergillus nidulans FGSC A4; identical to SEQ ID NO: 35589
  CDS (1)..(2943)

SEQ ID NO: 60171 - protein, 980 aa, Aspergillus nidulans FGSC A4; identical to SEQ ID NO: 35590

SEQ ID NO: 60172 - DNA, 2607 bp, Candida glabrata CBS138; identical to SEQ ID NO: 35591
  CDS (1)..(2607)

SEQ ID NO: 60173 - protein, 868 aa, Candida glabrata CBS138; identical to SEQ ID NO: 35592

SEQ ID NO: 60174 - DNA, 2379 bp, Kluyveromyces lactis NRRL Y-1140; identical to SEQ ID NO: 35593
  CDS (1)..(2379)

SEQ ID NO: 60175 - protein, 792 aa, Kluyveromyces lactis NRRL Y-1140; identical to SEQ ID NO: 35594

SEQ ID NO: 60176 - DNA, 2301 bp, Yarrowia lipolytica CLIB99; identical to SEQ ID NO: 35595
  CDS (1)..(2301)

SEQ ID NO: 60177 - protein, 766 aa, Yarrowia lipolytica CLIB99; identical to SEQ ID NO: 35596

SEQ ID NO: 60178 - DNA, 2466 bp, Candida albicans SC5314; identical to SEQ ID NO: 35597
  CDS (1)..(2466): transl_table=12

SEQ ID NO: 60179 - protein, 821 aa, Candida albicans SC5314; identical to SEQ ID NO: 35598

SEQ ID NO: 60180 - DNA, 1137 bp, Leptospira interrogans serovar Copenhageni str. Fiocruz L1-130; identical to SEQ ID NO: 35599
  CDS (1)..(1137): transl_table=11

SEQ ID NO: 60181 - protein, 378 aa, Leptospira interrogans serovar Copenhageni str. Fiocruz L1-130; identical to SEQ ID NO: 35600

SEQ ID NO: 60182 - DNA, 1209 bp, Leptospira interrogans serovar Copenhageni str. Fiocruz L1-130; identical to SEQ ID NO: 35601
  CDS (1)..(1209): transl_table=11

SEQ ID NO: 60183 - protein, 402 aa, Leptospira interrogans serovar Copenhageni str. Fiocruz L1-130; identical to SEQ ID NO: 35602

SEQ ID NO: 60184 - DNA, 1566 bp, Leptospira interrogans serovar Copenhageni str. Fiocruz L1-130; identical to SEQ ID NO: 35603
  CDS (1)..(1566): transl_table=11

SEQ ID NO: 60185 - protein, 521 aa, Leptospira interrogans serovar Copenhageni str. Fiocruz L1-130; identical to SEQ ID NO: 35604

SEQ ID NO: 60186 - DNA, 1134 bp, Leptospira interrogans serovar Copenhageni str. Fiocruz L1-130; identical to SEQ ID NO: 35605
  CDS (1)..(1134): transl_table=11

SEQ ID NO: 60187 - protein, 377 aa, Leptospira interrogans serovar Copenhageni str. Fiocruz L1-130; identical to SEQ ID NO: 35606

SEQ ID NO: 60188 - DNA, 1281 bp, Leptospira interrogans serovar Copenhageni str. Fiocruz L1-130; identical to SEQ ID NO: 35607
  CDS (1)..(1281): transl_table=11

SEQ ID NO: 60189 - protein, 426 aa, Leptospira interrogans serovar Copenhageni str. Fiocruz L1-130; identical to SEQ ID NO: 35608

SEQ ID NO: 60190 - DNA, 1719 bp, Leptospira interrogans serovar Copenhageni str. Fiocruz L1-130; identical to SEQ ID NO: 35609
  CDS (1)..(1719): transl_table=11

SEQ ID NO: 60191 - protein, 572 aa, Leptospira interrogans serovar Copenhageni str. Fiocruz L1-130; identical to SEQ ID NO: 35610

SEQ ID NO: 60192 - DNA, 1272 bp, Leptospira interrogans serovar Copenhageni str. Fiocruz L1-130; identical to SEQ ID NO: 35611
  CDS (1)..(1272): transl_table=11

SEQ ID NO: 60193 - protein, 423 aa, Leptospira interrogans serovar Copenhageni str. Fiocruz L1-130; identical to SEQ ID NO: 35612

SEQ ID NO: 60194 - DNA, 819 bp, Leptospira interrogans serovar Copenhageni str. Fiocruz L1-130; identical to SEQ ID NO: 35613
  CDS (1)..(819): transl_table=11

SEQ ID NO: 60195 - protein, 272 aa, Leptospira interrogans serovar Copenhageni str. Fiocruz L1-130; identical to SEQ ID NO: 35614

SEQ ID NO: 60196 - DNA, 1320 bp, Caenorhabditis briggsae; identical to SEQ ID NO: 35615
  CDS (1)..(1320)

SEQ ID NO: 60197 - protein, 439 aa, Caenorhabditis briggsae; identical to SEQ ID NO: 35616

SEQ ID NO: 60198 - DNA, 720 bp, Homo sapiens; identical to SEQ ID NO: 35617
  CDS (1)..(720)

SEQ ID NO: 60199 - protein, 239 aa, Homo sapiens; identical to SEQ ID NO: 35618

SEQ ID NO: 60200 - DNA, 720 bp, Homo sapiens; identical to SEQ ID NO: 35619
  CDS (1)..(720)

SEQ ID NO: 60201 - protein, 239 aa, Homo sapiens; identical to SEQ ID NO: 35620

SEQ ID NO: 60202 - DNA, 24 bp, Artificial sequence
  (1)..(24): primer
atggtagcgacatcttcaaagagg

SEQ ID NO: 60203 - DNA, 23 bp, Artificial sequence
  (1)..(23): primer
ttactccggagagttggcgctta

SEQ ID NO: 60204 - protein, 380 aa, Artificial sequence; identical to SEQ ID NO: 35623
  Variant (2)..(9): xaa in position 2 to 9 is any amino acid
  Variant (10)..(11): xaa in position 10 to 11 is any or no amino acid
  Variant (13)..(13): xaa in position 13 is any amino acid
  Variant (15)..(18): xaa in position 15 to 18 is any amino acid
  Variant (20)..(21): xaa in position 20 to 21 is any amino acid
  Variant (24)..(24): xaa in position 24 is any amino acid
  Variant (27)..(28): xaa in position 27 to 28 is any amino acid
  Variant (30)..(31): xaa in position 30 to 31 is any amino acid
  Variant (32)..(33): xaa in position 32 to 33 is any or no amino acid
  Variant (35)..(36): xaa in position 35 to 36 is any amino acid
  Variant (38)..(38): xaa in position 38 is any amino acid
  Variant (40)..(41): xaa in position 40 to 41 is any amino acid
  Variant (43)..(45): xaa in position 43 to 45 is any or no amino acid
  Variant (47)..(52): xaa in position 47 to 52 is any amino acid
  Variant (53)..(53): xaa in position 53 is any or no amino acid
  Variant (55)..(59): xaa in position 55 to 59 is any amino acid
  Variant (61)..(62): xaa in position 61 to 62 is any amino acid
  Variant (64)..(64): xaa in position 64 is any amino acid
  Variant (66)..(67): xaa in position 66 to 67 is any amino acid
  Variant (69)..(75): xaa in position 69 to 75 is any amino acid
  Variant (76)..(90): xaa in position 76 to 90 is any or no amino acid
  Variant (93)..(94): xaa in position 93 to 94 is any amino acid
  Variant (96)..(97): xaa in position 96 to 97 is any amino acid
  Variant (99)..(105): xaa in position 99 to 105 is any amino acid
  Variant (106)..(128): xaa in position 106 to 128 is any or no amino acid
  Variant (130)..(137): xaa in position 130 to 137 is any amino acid
  Variant (139)..(143): xaa in position 139 to 143 is any amino acid
  Variant (145)..(151): xaa in position 145 to 151 is any amino acid
  Variant (153)..(166): xaa in position 153 to 166 is any amino acid
  Variant (167)..(214): xaa in position 167 to 214 is any or no amino acid
  Variant (216)..(217): xaa in position 216 to 217 is any amino acid
  Variant (219)..(219): xaa in position 219 is any amino acid
  Variant (221)..(221): xaa in position 221 is any amino acid
  Variant (222)..(222): xaa in position 222 is any or no amino acid
  Variant (224)..(228): xaa in position 224 to 228 is any amino acid
  Variant (229)..(265): xaa in position 229 to 265 is any or no amino acid
  Variant (267)..(268): xaa in position 267 to 268 is any amino acid
  Variant (270)..(271): xaa in position 270 to 271 is any amino acid
  Variant (273)..(274): xaa in position 273 to 274 is any amino acid
  Variant (276)..(296): xaa in position 276 to 296 is any amino acid
  Variant (297)..(311): xaa in position 297 to 311 is any or no amino acid
  Variant (313)..(314): xaa in position 313 to 314 is any amino acid
  Variant (316)..(337): xaa in position 316 to 337 is any amino acid
  Variant (338)..(364): xaa in position 338 to 364 is any or no amino acid
  Variant (366)..(378): xaa in position 366 to 378 is any amino acid
  Variant (379)..(379): xaa in position 379 is any or no amino acid

SEQ ID NO: 60205 - protein, 46 aa, Artificial sequence; identical to SEQ ID NO: 35624
  Variant (2)..(4): xaa in position 2 to 4 is any or no amino acid
  Variant (6)..(13): xaa in position 6 to 13 is any amino acid
  Variant (14)..(14): xaa in position 14 is any or no amino acid
  Variant (16)..(17): xaa in position 16 to 17 is any amino acid
  Variant (18)..(18): xaa in position 18 is Phe, Ile, Leu or Val
  Variant (19)..(19): xaa in position 19 is any amino acid
  Variant (20)..(20): xaa in position 20 is Ile, Leu or Val
  Variant (21)..(22): xaa in position 21 to 22 is any amino acid
  Variant (24)..(24): xaa in position 24 is any amino acid
  Variant (25)..(25): xaa in position 25 is Phe, Ile or Leu
  Variant (26)..(27): xaa in position 26 to 27 is any amino acid
  Variant (28)..(28): xaa in position 28 is Phe, Ile, Leu or Val
  Variant (29)..(29): xaa in position 29 is Pro or Ser
  Variant (30)..(31): xaa in position 30 to 31 is any amino acid
  Variant (32)..(32): xaa in position 32 is Ile, Leu or Val
  Variant (33)..(37): xaa in position 33 to 37 is any amino acid
  Variant (39)..(45): xaa in position 39 to 45 is any amino acid
  Variant (46)..(46): xaa in position 46 is Asn or Ser

SEQ ID NO: 60206 - DNA, 1062 bp, Saccharomyces cerevisiae
  CDS (1)..(1062)
atgtcattaccacaatggtgtccaccgcattccaccttaaaaagaaatccaactacaggagaggacgtatactgcatatgtaaaaggccagactatggggagctgatggtgggatgtgatggttgtgatgactggtttcatttcacctgccttcatattcctgagcagtttaaggacctggtgttctctttttattgtccttactgtcaagcggggattactggtaagaataaggacgccataatcaatggtgaagggagcttgccaaaaaccttatggaaaagaaaatgtaggataagtgattgctacaaaccatgtttacaggatagtaaatactgttctgaggaacatggtagagaatttgtgaatgatatttggtcgcgattgaaaacagatgaggatagagcagtcgtcaagaaaatggtcgaacaaacaggacacatagataaattcaagaaatttggacaactggatttcattgataacaatatagttgtaaaaacagatgacgaaaaggaaatattcgatcaaattgttgtacgagacatgacgttaaaaactcttgaagatgatctgcaagaggttcaagagatatcgctaccattattcaaaaaaaagctagaacttttggaagtatatttgggatggttagacaacgtatataccgaaatgcgcaagctggacgatgatgctgcaagccatgtggaatgtggtaaagaagattccaaggggacaaaaaggaagaagaagaaaaatagcagcaggagtagggctaggaaaaatatatgtggctattgttctacatacgagcgaataccctgctctgtggaagaatttgtcagagattttggaagtaatgaggaagccaccaaaatacatgaggtatgcacgaagtggaagtgtaacagacatttggattgggtgtctactaatcaggaacaatacctccagcagattgactctttagaatctatgcaagaaaggttgcaacatctgatacaggccaggaaaaagcaactaaatatacaatactatgaggaaattttaagaagaggtttgtaa

SEQ ID NO: 60207 - protein, 353 aa, Saccharomyces cerevisiae
MSLPQWCPPHSTLKRNPTTGEDVYCICKRPDYGELMVGCDGCDDWFHFTCLHIPEQFKDLVFSFYCPYCQAGITGKNKDAIINGEGSLPKTLWKRKCRISDCYKPCLQDSKYCSEEHGREFVNDIWSRLKTDEDRAVVKKMVEQTGHIDKFKKFGQLDFIDNNIVVKTDDEKEIFDQIVVRDMTLKTLEDDLQEVQEISLPLFKKKLELLEVYLGWLDNVYTEMRKLDDDAASHVECGKEDSKGTKRKKKKNSSRSRARKNICGYCSTYERIPCSVEEFVRDFGSNEEATKIHEVCTKWKCNRHLDWVSTNQEQYLQQIDSLESMQERLQHLIQARKKQLNIQYYEEILRRGL

SEQ ID NO: 60208 - DNA, 1047 bp, Eremothecium gossypii
  CDS (1)..(1047)
atgggatttcgtattagagatgcacattaccatacgctagccgctaaccgttggtcaatagcgatgagcctaccagactggtgtcctccattccaaggtaccaagcaggaccccagcacgggcgaggatgtgtactgcatctgcaagaagccggacggcggcgagctgatggtgcagtgcgacggatgtggcgactggttccatttcacgtgcatccggatccccagcgcgtacaagagcttggtattctcgttctactgcccctattgccaggcaggtatcacgtacagcgggacgggcgcgctgccgaggacggtgtggaagcggcggtgccgcatggagggttgctaccgggcttgcgcgcgcgacagcaagtactgcgggccggagcacggggaggcgtacatgcgggcgctggtggagcgcgcggggccgggtgggcaggcggtggtgcagcagatggtgcgtacggggcagttcgagagcctgggcacgggcgcgctgccgctagcgcggcgcgacgtggacccggcgctgtacgaccgggtggtgggcgcggacgcgcggctcggggagctggaggcggaggcgcgcgaggtgcgcgaggcgcggcggtccgcgctgtgcgcacaactggccgcgctgagcgcgtacctggcgtgggtgcgtgaggtgaatgacgcgctgttccatgacacagaggaggcggctccgcggcgcggcaaggcgcgcgcgcgccgcaagcccaagcgcgcgctctgcggcttccgcgccgactaccaggcgccgctgccggccgcggactttgccgccagctacgcggacgacgcggcgctcctgcacggcgtgtgctgtcgcctgcgctgcccgcgccaccaagactgggccagcatgcggctcggctccgtgcagttcgagctcgaggcgctcgacagcgcggagcagcggctgcagctgctcatcagcatgcgcaaggaacacctgtcgctgcgcttccacgagctccgcgccggcgcacacccgcgcgtggccacgcctgctacgtag

SEQ ID NO: 60209 - protein, 348 aa, Eremothecium gossypii
MGFRIRDAHYHTLAANRWSIAMSLPDWCPPFQGTKQDPSTGEDVYCICKKPDGGELMVQCDGCGDWFHFTCIRIPSAYKSLVFSFYCPYCQAGITYSGTGALPRTVWKRRCRMEGCYRACARDSKYCGPEHGEAYMRALVERAGPGGQAVVQQMVRTGQFESLGTGALPLARRDVDPALYDRVVGADARLGELEAEAREVREARRSALCAQLAALSAYLAWVREVNDALFHDTEEAAPRRGKARARRKPKRALCGFRADYQAPLPAADFAASYADDAALLHGVCCRLRCPRHQDWASMRLGSVQFELEALDSAEQRLQLLISMRKEHLSLRFHELRAGAHPRVATPAT

SEQ ID NO: 60210 - DNA, 1083 bp, Candida glabrata CBS138
  CDS (1)..(1083)
atgtctaatttattgcctgaatggtgtccgccatactctacaaccaaaatagatactaacactggtgaggatgtctattgtatatgtaagaaacctgattatggtgagttaatggtgggatgtgacggatgtgatgactggtttcactttgagtgtatgaagatacctgaaacatacaggaatttagtcgagtctttcatatgtccgtattgccgtgtaggcataactggtcctggatctaaaggtgatggtgaatgccccaaatcattatggaagaaaaagtgtaggctccaggattgctatgagccttgcgaatctggtagcaaatactgttccaaagagcatgggaaagagtatatgtctcgattactaaataaggtaaaaatcaaaaacgaccttaataatagatacgctaatgagtctgatgataagctgttgaaagatgtttatcacgctaccaagaataatgtagagaagtttaaaacctttggttcctcatcatttatcgattccgatatcgatagagttgataggcatggtgagatttacgacaagataatcaatgatgataaatactataaagatctgttaacagaaaaagataacataacgaacaatcaaattgagggcttaaaaaagaaagtagaagagcttgataaatacttagactggattagctcagtcaataaactaatcaatggagaggataatactattgaacaagaagagaatgtgaatgataccattaagaccaagaaaaagaaaaagaaatctcaaaaaagaagatcaaagaaggctatctgcggttattctctcaacctagccaagataccttgcaatccagaagagttttacaacaaatattccgaaataacgacaagtacaccagattgtaatgaaatagaaggtatttgcattaaattaagatgtaacaagcactccgactggtctaccatgacctcagatcagtacacaaggcaaatcatttctcttgagactcatttgaagcgcttagacctatcaatatcgacaaggaaaaggcaacttaatatcaattattttgagcatataatgagatcatag

SEQ ID NO: 60211 - protein, 360 aa, Candida glabrata CBS138
MSNLLPEWCPPYSTTKIDTNTGEDVYCICKKPDYGELMVGCDGCDDWFHFECMKIPETYRNLVESFICPYCRVGITGPGSKGDGECPKSLWKKKCRLQDCYEPCESGSKYCSKEHGKEYMSRLLNKVKIKNDLNNRYANESDDKLLKDVYHATKNNVEKFKTFGSSSFIDSDIDRVDRHGEIYDKIINDDKYYKDLLTEKDNITNNQIEGLKKKVEELDKYLDWISSVNKLINGEDNTIEQEENVNDTIKTKKKKKKSQKRRSKKAICGYSLNLAKIPCNPEEFYNKYSEITTSTPDCNEIEGICIKLRCNKHSDWSTMTSDQYTRQIISLETHLKRLDLSISTRKRQLNINYFEHIMRS

SEQ ID NO: 60212 - DNA, 1029 bp, Kluyveromyces lactis NRRL Y-1140
  CDS (1)..(1029)
atgtcattacctagttggtgccccaggtatgacagcaggaaacacgacccaaaaactggggaagaagtttattgtatatgtaagaaaccagacactggggagttgatggtaggatgtgatggatgtgatgattggtttcatttttcctgtttaaagatccccgagaaatatagagatctcgttttttcattctactgttcgtattgtagtgctggaattacaggaccggcattgataaatggcggcaaactaccgaaaactctttggaagaggaaatgcaggctccctgaatgctatacagagtgtgatgccaattcaagaagcaaatattgttcaaagaaacatgctgttcaatacgttcaaagcattgttgataagttaaatctacctggcgtagataagattgcattgttgagacagcttctaaacgagacaacatcattggaggaatttaaaacgctaggacgagacaagcttccagaagtcacgtcacctttatccaaagatcaatattccaagttgctagaaaatgatcagcatttaaacaaattaattaacgaacacgatgagttggtttcggtcaagctttcaaaactaaatgaagaagatgcagtaatagagaaatacgtcaactggatcggtgaagttaacgagagattatccccacatttcaatcagcctacaggtcgaaagaagtcgaaaagtgcaagtaaagttacaatatgcggctaccataatgagttcacgatccctcggtcagttgaggagtttttagataagctacttcagttgaaagaagacgaaaacagtaatatcacatcagttgacggtgtttgtgtaaagacaaaatgtgctaagcatcaggattggattacattgtcccaaaacgatctctcggaacagaaggactctctagaaaacgtcaaaagaagactcgatttactaattagcgtcagaacgaaccaattgagaatctcattcttcgaacaagagatgtccaatcgcgtcctacccggtgttaagacctag

SEQ ID NO: 60213 - protein, 342 aa, Kluyveromyces lactis NRRL Y-1140
MSLPSWCPRYDSRKHDPKTGEEVYCICKKPDTGELMVGCDGCDDWFHFSCLKIPEKYRDLVFSFYCSYCSAGITGPALINGGKLPKTLWKRKCRLPECYTECDANSRSKYCSKKHAVQYVQSIVDKLNLPGVDKIALLRQLLNETTSLEEFKTLGRDKLPEVTSPLSKDQYSKLLENDQHLNKLINEHDELVSVKLSKLNEEDAVIEKYVNWIGEVNERLSPHFNQPTGRKKSKSASKVTICGYHNEFTIPRSVEEFLDKLLQLKEDENSNITSVDGVCVKTKCAKHQDWITLSQNDLSEQKDSLENVKRRLDLLISVRTNQLRISFFEQEMSNRVLPGVKT

SEQ ID NO: 60214 - DNA, 1425 bp, Debaryomyces hansenii CBS767
  CDS (1)..(1425)
atggatatttattcagaagtacaagaaatgtcaacttcacttcatgaacatataaaactgccaccagaagacaataaaactaaattgaaggatctatctgcatctacttcaaccttggataaaggtttatctggaaatatggaaaacgagcaaggcaaaaaaagacgatctgcatcaccagcaatttcgaacaaagagttcaagaaaaataaacttgaaaaagaagattcacaagatgactatagcggctctccatctgggctttctaatagatatccaacagaggaaatagaagacgagtcgtacgaagaaatagccaaacaatataagaaattttctaatgcacctaagtttaatctcaacagtgaagaattattctgtatctgtcgaaagccagactatggaggagagttaatgatttcatgtgacaattgtgatgaatggtttcacttcaaatgtatgaagttgaatgaagatcattccaagttaatagccaaattctattgcaagttctgtcgctggaaaggaatcagtagtacaaaatggaaaagaaaatgccgtttagattggtgctgggaacctattagagctgattctaaatcaaaatattgttgcgatgaacatggtgtaacttttattaaagaaaatttattaaggaaaactggaattaatgatttgaacccaacagatattaaatcaatatttaattattgtatctcatcgggtaatagctataaaaatctagttcaattgggttcagatttccctgaattaccagaaatttcttcacttaaagaggatggatctgacatttcacagttgcctggagatcttgaaaataggttgactaagataaattcaaatctagatagaattaattcaattactgatttgtgcaagctcaagagtgattatttactcaagattaaggaaaaaattaagattattaatgaaaggttacaggcatcttatcaagatgaagaacaagttgaaaaatgtgaagaatcgcttaaaagtaaaagatcgacgaaagaatctaaaagtaagaagtccaagaaatttgacctttgttgctacgacaaatctctaaatcaaggaatacaaacagatgtgcagtcgaaaaacgcctttgaaaagttcattaattctgctgatatatacactgattataaagaacaaattgatagtctaataagtttttatcgtgacaatatggatgatatcgattcaaattcattgtttaataactctatgtgtatacaggataaacgaaagtgtccaaggcataatggttggtggaacttaataaatgatgaacttgttaaaaggttcaatgaattatcccttactgcaaaaaaattggaagatgagaaattgatgattttaagaaattatagcatcaagatatatgaactgcgaacgtag

SEQ ID NO: 60215 - protein, 474 aa, Debaryomyces hansenii CBS767
MDIYSEVQEMSTSLHEHIKLPPEDNKTKLKDLSASTSTLDKGLSGNMENEQGKKRRSASPAISNKEFKKNKLEKEDSQDDYSGSPSGLSNRYPTEEIEDESYEEIAKQYKKFSNAPKFNLNSEELFCICRKPDYGGELMISCDNCDEWFHFKCMKLNEDHSKLIAKFYCKFCRWKGISSTKWKRKCRLDWCWEPIRADSKSKYCCDEHGVTFIKENLLRKTGINDLNPTDIKSIFNYCISSGNSYKNLVQLGSDFPELPEISSLKEDGSDISQLPGDLENRLTKINSNLDRINSITDLCKLKSDYLLKIKEKIKIINERLQASYQDEEQVEKCEESLKSKRSTKESKSKKSKKFDLCCYDKSLNQGIQTDVQSKNAFEKFINSADIYTDYKEQIDSLISFYRDNMDDIDSNSLFNNSMCIQDKRKCPRHNGWWNLINDELVKRFNELSLTAKKLEDEKLMILRNYSIKIYELRT

SEQ ID NO: 60216 - DNA, 1464 bp, Yarrowia lipolytica CLIB122
  CDS (1)..(1464)
atgtcttctaacgacgcgacttcggacgatacagacgccacggtcgaagaagacttcaaacgggagcccgagacagctgccaacctcgagagcaaccctcctagcgatccgccggttgagaatgaagaggcgagtgacagtgacgagcctagtggtggattttcatactctttgttgaagaagagtgttcctatgaaagagaaccaagcggagacagcaaagcccgaatctgtgatgaaatccgacccggttgtcaaagctgagctgctcacgtccgaggcaggatcagccacgccctcggctactgaatcgcctcgagaaacgccctccgatctgatgtctcccgaccccgatcacattcccagcaagtcttccaagcggcgtcaaccgaaacccaagagccgtcctgctccgaaaaagaagctgaaagtcgccgttgcgaaggactacaagttgccccccggtgctccacccgttgacaccagtcaccatggcgacgaagatcaccaggatctattttgtgtgtgcagacgacctgacgacggaaagtggatgattggatgcgattactgcgaagaatggatccatggaagctgtgtgggtataactccagccagagcaaaactcatgcacaagttctgctgtccttactgcacacacaaggccgaaaagatgcgtcccggcgaagaggccacggtggcccatcagatgacgctgaaacacggcacagaaaccacctggaagcgcgtttgtcgactggaagagtgccacaaggctgtctcataccccagcaagtactgctgcagagaacacggtctggagtacatgaagggcagagtggctgctctcagcaccaacagcaactcaagtgtggctgacgacactgaggagccgtttggaaagctttccgaggaacgtctagctgccatcgtccaacagactcccaacctggctgcgttcaagactctaggctcgactactcccgtcgaagcgtctcctgtgactcctaaacaaccctccacgcagctcaagtttgtggaacaaaagctcaagtacatgactctggtcaaggaccgaaccaagagtctcagtgaagaggccgctacagccgcgggagtaagaaagaaggatttatgtggctacgattcgcgtctggacaaggatcatgacatctgggcgaatgaatttgctgcccaggatgaactggtgggtattgccatgagtgatgatactagtaagacagtcactccttcccacgacgctctacacaacaaggaacacatttgcttgcaggacaagcggaaatgctataaccatctaggctgggctgctctgattaccgaccggctgaatttgcagctggctattctccagcgggaaatggagagaagcgaaggcgacgaggccgatctgaaggagattgagcggctgagaagcgttgagagtaagacgtggatcaagtga

SEQ ID NO: 60217 - protein, 487 aa, Yarrowia lipolytica CLIB122
MSSNDATSDDTDATVEEDFKREPETAANLESNPPSDPPVENEEASDSDEPSGGFSYSLLKKSVPMKENQAETAKPESVMKSDPVVKAELLTSEAGSATPSATESPRETPSDLMSPDPDHIPSKSSKRRQPKPKSRPAPKKKLKVAVAKDYKLPPGAPPVDTSHHGDEDHQDLFCVCRRPDDGKWMIGCDYCEEWIHGSCVGITPARAKLMHKFCCPYCTHKAEKMRPGEEATVAHQMTLKHGTETTWKRVCRLEECHKAVSYPSKYCCREHGLEYMKGRVAALSTNSNSSVADDTEEPFGKLSEERLAAIVQQTPNLAAFKTLGSTTPVEASPVTPKQPSTQLKFVEQKLKYMTLVKDRTKSLSEEAATAAGVRKKDLCGYDSRLDKDHDIWANEFAAQDELVGIAMSDDTSKTVTPSHDALHNKEHICLQDKRKCYNHLGWAALITDRLNLQLAILQREMERSEGDEADLKEIERLRSVESKTWIK

SEQ ID NO: 60218 - DNA, 1716 bp, Cryptococcus neoformans var. neoformans JEC21
  CDS (1)..(1716)
atgtccgaagctggagaaaacagagaggaggatagcggggccaagctacagacatccgagctggaacaaaatgacttgggtcacgaagaacgggaaagtaagaggagaaaattagacaacggagaggaatcagcagaacaaattgtttcacgacaagcctcaccagtgccaaatccttcacaggagggagaatcaccttctgctacagaacagccaccagcaaaagccctcactccctctgtgccctccccaaaacaatcatccgcgaaacctgatatcatcgccgcacccgagccggctgaggtgctcaacgtccttcccgctgctaccatagggcccatcaacggtacggagaacgaaccttcaggacagccactcaatgtctccgtttgttcccctcccacgatggtgaaggatgaggatatagagattgtggatggaacagttcccgagtttgcacctgcgcctgttagagacgaaaacgaaatgataaaaaaggaagatgtatctactcctgctgcggccgactcaccggctacagaaaaggatgaggtttcatcggccaaggggaaaacaaaatccgctcttgtgtcaaaatcccaagctagcaaggggaagaaggcacctgcaaagaagggcaaagcaaagacaaaggtggaagaattaaaagggagcaaggaacgttctgcaagtgtttccgttagtgcctcacatctttatttcaggtcatctactgaaagttcaacccaggaatcacgcgattcgactcctcctgtgtcgaccgatcaaagccaatttacctccccttccggagctcccatagactccaacgctgtctattgtatttgtcgcagaccagataccgacgacgacgacggtctgatggtcgggtgtgagagctgtgatgggtggttccatgcgtcttgcgtgggcctggatgaggagatggtggagctgctggatgtttatatctgtaagagctgtgaacgaactcaaaggacgatatataagcaggtttgtaaaagagacgggtgtaggaaatctgttgctggatcgagctccaagttttgctcttcacaatgtgcatttagatattcgcaagctatgctaggcgcgatcaccaacaaaaccgcaatcaagcagttaagcaaagctctcacatcttttcctcggcccaaactcggagtgaccgtggaacatcacgttccggcaaagtcagaaacctcaatcttctcagtgtacgatgacactcaaactcagcttttaactctccaaaaacgacaggaaggtgcacaaaaggccatggaacgcatacaaaagcgtcaagcccttttgcgaaacgcggtggacagatgcgaacaattaccgcccatcgcagcgactgaaactgaagaatcgcaacaaaaaggcaagaaacgtaaagccgggcgaccggcagacgacagaccgtgtgggtgggaagctagcctgatcgccgaggacgaagaagtagaagaattagtcaagggggaaggagatgaaatggaagtggttgaaggagaaagagaggtgtgcatgcttccaagaaggaggtgtgaccggcatcagggatggcagaagactgtcgctgtatctctggatctcgaattggccactttggtaagtgtagcaagttctccagctcgcggattgtttcaatcgtctcacaaagccacacatgcagacgcgcacgtatga

SEQ ID NO: 60219 - protein, 571 aa, Cryptococcus neoformans var. neoformans JEC21
MSEAGENREEDSGAKLQTSELEQNDLGHEERESKRRKLDNGEESAEQIVSRQASPVPNPSQEGESPSATEQPPAKALTPSVPSPKQSSAKPDIIAAPEPAEVLNVLPAATIGPINGTENEPSGQPLNVSVCSPPTMVKDEDIEIVDGTVPEFAPAPVRDENEMIKKEDVSTPAAADSPATEKDEVSSAKGKTKSALVSKSQASKGKKAPAKKGKAKTKVEELKGSKERSASVSVSASHLYFRSSTESSTQESRDSTPPVSTDQSQFTSPSGAPIDSNAVYCICRRPDTDDDDGLMVGCESCDGWFHASCVGLDEEMVELLDVYICKSCERTQRTIYKQVCKRDGCRKSVAGSSSKFCSSQCAFRYSQAMLGAITNKTAIKQLSKALTSFPRPKLGVTVEHHVPAKSETSIFSVYDDTQTQLLTLQKRQEGAQKAMERIQKRQALLRNAVDRCEQLPPIAATETEESQQKGKKRKAGRPADDRPCGWEASLIAEDEEVEELVKGEGDEMEVVEGEREVCMLPRRRCDRHQGWQKTVAVSLDLELATLVSVASSPARGLFQSSHKATHADAHV

SEQ ID NO: 60220 - DNA, 1221 bp, Candida albicans SC5314
  CDS (1)..(1221): transl_table=12
atggaccccgatactactcaatacgataaggtgaaaggagaatggtccgaaaatctgatagatatcaaaagcaatctaaaaagaagtaaaccctcacattcaataccgtcaaaaagggtcaaacatgatgtagattcatcgccacttgtggaggaatccaacgaggaaatcgccagacagtacaaaaaattcataaatgcacctaaatacgatcttaatagtgaagaattgttttgtgtatgcagacgtcccgacttgggtgaaatgatggttgcttgtgatggatgtgaagaatggttccatttcaagtgcatgaaaatcaatgaaaaatactccaacttgatagccaaatactattgcaaattttgcgaatggaagggggaaggtaattctcaatggaaaagaaaatgccgcctagaaaactgtaatgagccgataggagagagatccaaatattgttcgaaagaacacggaatagaatttataaaactgctgttgttggaatcaaaaacaaactccaccgatagtccctccttacaaaacttggatgcacattttataaaggatgttttgaactatgtatcaggtgactttgataaactacagcaaatgggatcaagttttccagagttggaggtagttaagaactataaaaatgataacacagctttagatggattcccagagactgtaaaaatagatttacaaaggacaaatgaaaaattggatgcgttgtcgaaacaggtaacaaaacaagaacaagtattaaaggcattagttaataccaaagacaatataaaacatttgaatgaaagactcactaatatagtatatgaagacctgtctctggacaagcagacttcgaaaaagaagaaaggcgctagaggcaagaaaaagatagatatctgcttttgtgataaaggcgaccaactgattgtacaactgatcactgattctgaaactatctttgatgatttattgaaagttataaaagcccgagtttttgagaatggggaagctgaggaagaagacatggattggtttatgaacgatttgtgtataaaagacaagaagaagtgtgttcgtcatagtggttggtggaatctatactacgatgaagctggcagaaacttggagcagttgcagagcaagctcgaagagacaatggaacaaaaagaatccatactaagaaattattctatcagtgtatacgaatcttaa

SEQ ID NO: 60221 - protein, 406 aa, Candida albicans SC5314
MDPDTTQYDKVKGEWSENSIDIKSNLKRSKPSHSIPSKRVKHDVDSSPLVEESNEEIARQYKKFINAPKYDLNSEELFCVCRRPDLGEMMVACDGCEEWFHFKCMKINEKYSNLIAKYYCKFCEWKGEGNSQWKRKCRLENCNEPIGERSKYCSKEHGIEFIKSSLLESKTNSTDSPSLQNLDAHFIKDVLNYVSGDFDKLQQMGSSFPELEVVKNYKNDNTALDGFPETVKIDLQRTNEKLDALSKQVTKQEQVLKALVNTKDNIKHLNERLTNIVYEDSSSDKQTSKKKKGARGKKKIDICFCDKGDQSIVQSITDSETIFDDLLKVIKARVFENGEAEEEDMDWFMNDLCIKDKKKCVRHSGWWNLYYDEAGRNLEQLQSKLEETMEQKESILRNYSISVYES

SEQ ID NO: 60222 - DNA, 2586 bp, Aspergillus fumigatus Af293
  CDS (1)..(2586)
atggctggacacgcgaccgcgcctgcggagcccagccaggccaacggctcaacaggtctcgacccatccaccacaaatccttacgagacaaatccggagttgattccgcccaccgatccatttctctctcgaagccggcaatacggccgctatgccccgcatgtcgatgatttcaaaccccgctacgatggttggtaccaggcggaaccggatgccatttcgtattgggaggagatagtgcgaacattctgcaccccgcaaaattccctgaatgtgcctgggacaagggaggtatacgctgctggcagtgttctaatcaaaatcgaccaggagcctgcggccggtgcggctgcggagcgatattcaaatgtgaatacgaacgagttgagtgctgctagaagagcgcaggattctcttcaagaactcggcgttgcgataccgatcatatacttttgtggcacagttgacggaaagaatgtcaccgtggagtcgagaattcccggggtgtctctggaggttgcctggaagtatctcaccattgaacagattggcgcttttaaacaacaatgccgtcgggttattcagcgccttgcactcgtcgagcctgcaccggattctgcgtcgtatgtctgcggcgaactcaactctcaatcacctccgggcgtcgaggactccgaaagggatatattgtttcaaggcagaaaggggacggagcagctccacctggttcacaacgatatgattcggtcgaatatcgtggtcaaggatggccggatcgttggcattctcggctggcggcaatgtgggttctttggctttgagcgagcaaagcagatacatcgtcagtttcggataccggagcgtcctgtcattgacaatggcggggtcaacgtaacacaggtctgggccgacctctatgatgatattccagacgttggtgggacgaacggcttcccagatcatcagactccagttgcaccagaggtgaaaattgagcctctgcagccgtcgttggacaagtatcccccaagcaatgaagcggaaaccctgcccgctctggcacaacttgatggcacccttttgcccgaagaacatccgacgccgaggaaagtcgctgacctgaagagcgaattggcctcaagagcatcatcggcagatcgatcttcgccgtctggctccaccaaggcagccgggaaaagaaaaccgggccctagtgcgtcgaagaaagggacagccaagaaacaagccacaaagaaacgcaaaatagacgaacttgcgagcgaagatgcggagagtcgtcgctccaacaccccttcttcgacgcgcgccagcaggacgcccggaactaagaagcagggatccgtatctgtcgcgggctctccggctcctgaaggcacgaaaaggaagaagaatgccaagaaggcgaaagtagagaaagcggaagaggaagaagagcaagaagaagattcgtcagaggatgacggggttttctgcatctgtcgcaagggtgatgatcatacgtggatgattgcatgcgacggtggatgtgatgattggtttcatggaaaatgcatcaacatcgatcccaaagatgcagatttgatagacaaatacatctgcccgaattgcaaggcggagggcaaaggttggacgacgtggaaacccatgtgtcgactaaagggttgtcggaaacccgctcgtgtgacaggcaagaaccccagtaagtattgctctgacgagcacggccgggagttcatgcgtcaacgggtccagcaactcaacagaagccccggggatcctgccaagaaagaatgggatgagcttggcagcagaggcggtgttcttacaacgggtgatctccacgcggtcgtcatggccgtctcctctgcggaggagttccgtaaacttggagagcgcattatttcgccgccgccagaagaggaggaccctgtgacaggagcaaggttgagcaagaaactgggcttggacgtggatcccgaaggcctgacctattctcatgacgaggcatctaaacttgagcaattacgcaaacaaagagaggaccttttccaccggcgcgacgtactcaacgcgcgttccacgttcatggcactcgttcgtcagcgatcaaagagcattgtcgagaagctgaagcaaacagatccaaagggaggatggaaggatatctgtgggttcgacacacgcctcgcatggtccgacgaggaattcaatgagtggagactgtccaagctcggagccaaagcgcttgaggagggcacccctgaggcactcgcttccagctatccagacgctgtggatgcggatggcgacacggccatgaatggcaccaaggcggaggaggaagatgaggacgagttggccaaattgacccgtggagtctgtacgaagaagcgttgcgagagacacaagcaatgggtcaaggttcaccagtccgaagttctcttcgaggaaaacaagctgaagcaggaccttgccacgtgcgagaaagaagcccagaatgttgtcgaaagggctgttctccgaatgtgggctgaaaaggaaaatgccgagaatggcagcgagtga

SEQ ID NO: 60223 - protein, 861 aa, Aspergillus fumigatus Af293
MAGHATAPAEPSQANGSTGLDPSTTNPYETNPELIPPTDPFLSRSRQYGRYAPHVDDFKPRYDGWYQAEPDAISYWEEIVRTFCTPQNSLNVPGTREVYAAGSVLIKIDQEPAAGAAAERYSNVNTNELSAARRAQDSLQELGVAIPIIYFCGTVDGKNVTVESRIPGVSLEVAWKYLTIEQIGAFKQQCRRVIQRLALVEPAPDSASYVCGELNSQSPPGVEDSERDILFQGRKGTEQLHLVHNDMIRSNIVVKDGRIVGILGWRQCGFFGFERAKQIHRQFRIPERPVIDNGGVNVTQVWADLYDDIPDVGGTNGFPDHQTPVAPEVKIEPLQPSLDKYPPSNEAETLPALAQLDGTLLPEEHPTPRKVADLKSELASRASSADRSSPSGSTKAAGKRKPGPSASKKGTAKKQATKKRKIDELASEDAESRRSNTPSSTRASRTPGTKKQGSVSVAGSPAPEGTKRKKNAKKAKVEKAEEEEEQEEDSSEDDGVFCICRKGDDHTWMIACDGGCDDWFHGKCINIDPKDADLIDKYICPNCKAEGKGWTTWKPMCRLKGCRKPARVTGKNPSKYCSDEHGREFMRQRVQQLNRSPGDPAKKEWDELGSRGGVLTTGDLHAVVMAVSSAEEFRKLGERIISPPPEEEDPVTGARLSKKLGLDVDPEGLTYSHDEASKLEQLRKQREDLFHRRDVLNARSTFMALVRQRSKSIVEKLKQTDPKGGWKDICGFDTRLAWSDEEFNEWRLSKLGAKALEEGTPEALASSYPDAVDADGDTAMNGTKAEEEDEDELAKLTRGVCTKKRCERHKQWVKVHQSEVLFEENKLKQDLATCEKEAQNVVERAVLRMWAEKENAENGSE

SEQ ID NO: 60224 - DNA, 1767 bp, Cryptococcus neoformans var
  CDS (1)..(1767)
atgtccgaagctggcgaaaacagagaggaggatagcggggccaagctacagacgtccgagctggaacaaaatgacttgggccacgaagaacgggaaagtaagaggagaaaattggacaacggagaggaatcagcagaacaaattgtttcacgacaagcctcaccagtgccaaatcctccacaggagggagaaccacgttctgctacagaacagccaccagcaaaagccctcactccatctgtgccctccccaaaacaatcatccgcgaaacctgatatcatcgccgcacccgagccggctgaggtgctcaacgtccttcccgctgctaccatagggcccatcaacggtacggagaacgaaccttcaggacagccactcaatgtctccgtttgttcccctccttccacgatggtgaaggatgaggatatagagattgtggatggaacagttcccgagtttgcacctgcgcctgttagagacgaaaacgaaatgataaaaaaggaagatgtatctactcctgctgcggccgactcaccggctacagaaaaggatgatgtttcatcggccaaggggaaaacaaaatccgctcttgtgacaaaatcccaagctagcaaggggaagaaggcacctgcaaagaagggcaaagcaaagacaaaggtggaagaattaaaagggagcaaggaacgttctgcaagtgtttccgttagtgcctcacatctttatttcaggtcatctactgaaagttcaacccaggaatcacgcgattcgactcctcctgtgtcgaccgatcaaagccaatttacctccccttccggagctcccatagactccaacgctgtctattgtatttgtcgcagaccagataccgacgacgacgacggtctgatggtcgggtgtgagagctgtgatgggtggttccatgcgtcttgcgtgggcctggatgaggagatggtggagctgctggatgtttatatctgtaagagctgtgaacgaactcaaaggacgatatataagcaggtttgtaaaagagacgggtgtaggaaatctgttgctggatcgagctccaagttttgctcttcacaatgtgcatttagatattcgcaagctatgctaggcgcgatcaccaacaaaaccgcaatcaagcagttgagcaaagctctcacatcttttcctcggcccaaactcggagtgaccgtggaacatcacgttccggcaaagtcagaaacctcaatcttctcagtgtacgatgacactcaaactcagcttttaactctccaaaaacgacaggaaggtgcacaaaaggccatggaacgcatacaaaagcgtcaagcccttttgcgaaacgcggtggacagatgcgaacaattaccgcccatcgcagcgactgaaactgaagagtcgcaacaaaaaggcaagaaacgtaaagccgggcgaccggcagacgacagaccgtgtgggtgggaagctagcctgatcgccgaggacgaagaagtggaagaattagtcaagggggaaggagatgaaatggaagtggttgaaggagaaagagaggtgtgcatgcttccaagaaggaggtgtgaccggcatcagggatggcagaagactgtcgctgtatctctggatctcgaattggccactttgacgcgcacgtatgaaagcctgcaggagaatcagcgattgatagaagaggccaatcaagccttgaaaatatccgaagaggctcgagaaatgtttttggcgaaaaaacaggctgtgaagcgcaaatag

SEQ ID NO: 60225 - protein, 588 aa, Cryptococcus neoformans var
MSEAGENREEDSGAKLQTSELEQNDLGHEERESKRRKLDNGEESAEQIVSRQASPVPNPPQEGEPRSATEQPPAKALTPSVPSPKQSSAKPDIIAAPEPAEVLNVLPAATIGPINGTENEPSGQPLNVSVCSPPSTMVKDEDIEIVDGTVPEFAPAPVRDENEMIKKEDVSTPAAADSPATEKDDVSSAKGKTKSALVTKSQASKGKKAPAKKGKAKTKVEELKGSKERSASVSVSASHLYFRSSTESSTQESRDSTPPVSTDQSQFTSPSGAPIDSNAVYCICRRPDTDDDDGLMVGCESCDGWFHASCVGLDEEMVELLDVYICKSCERTQRTIYKQVCKRDGCRKSVAGSSSKFCSSQCAFRYSQAMLGAITNKTAIKQLSKALTSFPRPKLGVTVEHHVPAKSETSIFSVYDDTQTQLLTLQKRQEGAQKAMERIQKRQALLRNAVDRCEQLPPIAATETEESQQKGKKRKAGRPADDRPCGWEASLIAEDEEVEELVKGEGDEMEVVEGEREVCMLPRRRCDRHQGWQKTVAVSLDLELATLTRTYESLQENQRLIEEANQALKISEEAREMFLAKKQAVKRK

SEQ ID NO: 60226 - DNA, 24 bp, Artificial sequence
  (1)..(24): primer
atgtcattaccacaatggtgtcca

SEQ ID NO: 60227 - DNA, 27 bp, Artificial sequence
  (1)..(27): primer
ttacaaacctcttcttaaaatttcctc

SEQ ID NO: 60228 - protein, 354 aa, Artificial sequence
  Variant (4)..(5): xaa in position 4 to 5 is any amino acid
  Variant (8)..(11): xaa in position 8 to 11 is any amino acid
  Variant (12)..(14): xaa in position 12 to 14 is any or no amino acid
  Variant (16)..(17): xaa in position 16 to 17 is any amino acid
  Variant (19)..(20): xaa in position 19 to 20 is any amino acid
  Variant (22)..(23): xaa in position 22 to 23 is any amino acid
  Variant (27)..(28): xaa in position 27 to 28 is any amino acid
  Variant (30)..(38): xaa in position 30 to 38 is any amino acid
  Variant (40)..(44): xaa in position 40 to 44 is any amino acid
  Variant (46)..(47): xaa in position 46 to 47 is any amino acid
  Variant (49)..(55): xaa in position 49 to 55 is any amino acid
  Variant (56)..(76): xaa in position 56 to 76 is any or no amino acid
  Variant (79)..(80): xaa in position 79 to 80 is any amino acid
  Variant (83)..(85): xaa in position 83 to 85 is any amino acid
  Variant (87)..(93): xaa in position 87 to 93 is any amino acid
  Variant (95)..(95): xaa in position 95 is any amino acid
  Variant (96)..(98): xaa in position 96 to 98 is any or no amino acid
  Variant (102)..(104): xaa in position 102 to 104 is any amino acid
  Variant (106)..(209): xaa in position 106 to 209 is any amino acid
  Variant (210)..(244): xaa in position 210 to 244 is any or no amino acid
  Variant (246)..(287): xaa in position 246 to 287 is any amino acid
  Variant (288)..(325): xaa in position 288 to 325 is any or no amino acid
  Variant (327)..(330): xaa in position 327 to 330 is any amino acid
  Variant (331)..(332): xaa in position 331 to 332 is any or no amino acid
  Variant (334)..(335): xaa in position 334 to 335 is any amino acid
  Variant (337)..(338): xaa in position 337 to 338 is any amino acid
  Variant (340)..(353): xaa in position 340 to 353 is any amino acid
CICXXPDXXXXXXXMXXCXXCXXWFHXXCXXXXXXXXXLXXXXXCXXCXXXXXXXXXXXXXXXXXXXXXXXXXXXXWKXXCRXXXCXXXXXXXSXXXXKYCXXXHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXCXXXXXXCXXHXXWXXXXXXXXXXXXXXL

SEQ ID NO: 60229 - protein, 49 aa, Artificial sequence
  Variant (2)..(2): xaa in position 2 is Ile or Val
  Variant (4)..(5): xaa in position 4 to 5 is Lys or Arg
  Variant (8)..(8): xaa in position 8 is any amino acid
  Variant (9)..(12): xaa in position 9 to 12 is any or no amino acid
  Variant (14)..(14): xaa in position 14 is any amino acid
  Variant (15)..(15): xaa in position 15 is any or no amino acid
  Variant (17)..(17): xaa in position 17 is Ile or Val
  Variant (18)..(18): xaa in position 18 is Ala, Gly, Gln or Ser
  Variant (20)..(20): xaa in position 20 is Asp or Glu
  Variant (21)..(21): xaa in position 21 is Gly, Asn or Ser
  Variant (23)..(24): xaa in position 23 to 24 is Asp, Glu or Gly
  Variant (28)..(29): xaa in position 28 to 29 is any amino acid
  Variant (31)..(31): xaa in position 31 is Ile, Leu, Met or Val
  Variant (32)..(32): xaa in position 32 is any amino acid
  Variant (33)..(33): xaa in position 33 is Ile or Leu
  Variant (34)..(34): xaa in position 34 is Asp, Asn or Pro
  Variant (35)..(35): xaa in position 35 is Glu or Ser
  Variant (36)..(39): xaa in position 36 to 39 is any amino acid
  Variant (41)..(41): xaa in position 41 is Ile, Leu or Val
  Variant (42)..(43): xaa in position 42 to 43 is any amino acid
  Variant (44)..(44): xaa in position 44 is Phe or Tyr
  Variant (45)..(45): xaa in position 45 is any amino acid
  Variant (47)..(48): xaa in position 47 to 48 is any amino acid
CXCXXPDXXXXXGXXMXXCXXCXXWFHXXCXXXXXXXXXLXXXXXCXXC

SEQ ID NO: 60230 - protein, 24 aa, Artificial sequence
  Variant (2)..(3): xaa in position 2 to 3 is any amino acid
  Variant (6)..(6): xaa in position 6 is Ile, Leu or Met
  Variant (7)..(8): xaa in position 7 to 8 is any amino acid
  Variant (10)..(16): xaa in position 10 to 16 is any amino acid
  Variant (17)..(20): xaa in position 17 to 20 is any or no amino acid
KXXCRXXXCXXXXXXXXXXXSKYC

SEQ ID NO: 60231 - protein, 16 aa, Artificial sequence
  Variant (2)..(2): xaa in position 2 is any amino acid
  Variant (3)..(3): xaa in position 3 is Lys or Arg
  Variant (5)..(5): xaa in position 5 is any amino acid
  Variant (6)..(6): xaa in position 6 is Asp, Gly or Gln
  Variant (8)..(9): xaa in position 8 to 9 is any amino acid
  Variant (10)..(15): xaa in position 10 to 15 is any or no amino acid
CXXHXXWXXXXXXXXL

SEQ ID NO: 60232 - DNA, 1113 bp, Saccharomyces cerevisiae; identical to SEQ ID NO: 21037
  CDS (1)..(1113)

SEQ ID NO: 60233 - protein, 370 aa, Saccharomyces cerevisiae; identical to SEQ ID NO: 21038

SEQ ID NO: 60234 - DNA, 1389 bp, Aeropyrum pernix; identical to SEQ ID NO: 21039
  CDS (1)..(1389)

SEQ ID NO: 60235 - protein, 462 aa, Aeropyrum pernix; identical to SEQ ID NO: 21040

SEQ ID NO: 60236 - DNA, 1035 bp, Agrobacterium tumefaciens; identical to SEQ ID NO: 21041
  CDS (1)..(1035)

SEQ ID NO: 60237 - protein, 344 aa, Agrobacterium tumefaciens; identical to SEQ ID NO: 21042

SEQ ID NO: 60238 - DNA, 1338 bp, Medicago sativa (alfalfa); identical to SEQ ID NO: 21043
  CDS (121)..(1191)

SEQ ID NO: 60239 - protein, 356 aa, Medicago sativa (alfalfa); identical to SEQ ID NO: 21044

SEQ ID NO: 60240 - DNA, 1950 bp, Azotobacter vinelandii; identical to SEQ ID NO: 21045
  CDS (478)..(1881)

SEQ ID NO: 60241 - protein, 467 aa, Azotobacter vinelandii; identical to SEQ ID NO: 21046

SEQ ID NO: 60242 - DNA, 1600 bp, Hordeum vulgare (barley); identical to SEQ ID NO: 21047
  CDS (281)..(1585)

SEQ ID NO: 60243 - protein, 434 aa, Hordeum vulgare (barley); identical to SEQ ID NO: 21048

SEQ ID NO: 60244 - DNA, 1335 bp, Bacillus subtilis; identical to SEQ ID NO: 21049
  CDS (1)..(1335)

SEQ ID NO: 60245 - protein, 444 aa, Bacillus subtilis; identical to SEQ ID NO: 21050

SEQ ID NO: 60246 - DNA, 2352 bp, Bacillus cereus; identical to SEQ ID NO: 21051
  CDS (860)..(2194)

SEQ ID NO: 60247 - protein, 444 aa, Bacillus cereus; identical to SEQ ID NO: 21052

SEQ ID NO: 60248 - DNA, 1122 bp, Gallus gallus (chicken); identical to SEQ ID NO: 21053
  CDS (1)..(1122)

SEQ ID NO: 60249 - protein, 373 aa, Gallus gallus (chicken); identical to SEQ ID NO: 21054

SEQ ID NO: 60250 - DNA, 2192 bp, Clostridium acetobutylicum; identical to SEQ ID NO: 21055
  CDS (396)..(1727): n means a or g or c or t/u, s means g or c

SEQ ID NO: 60251 - protein, 443 aa, Clostridium acetobutylicum; identical to SEQ ID NO: 21056

SEQ ID NO: 60252 - DNA, 1410 bp, Escherichia coli; identical to SEQ ID NO: 21057
  CDS (1)..(1410)

SEQ ID NO: 60253 - protein, 469 aa, Escherichia coli; identical to SEQ ID NO: 21058

SEQ ID NO: 60254 - DNA, 1448 bp, Phaseolus vulgaris (kidney bean); identical to SEQ ID NO: 21059
  CDS (69)..(1139)

SEQ ID NO: 60255 - protein, 356 aa, Phaseolus vulgaris (kidney bean); identical to SEQ ID NO: 21060

SEQ ID NO: 60256 - DNA, 1353 bp, Phaseolus vulgaris (kidney bean); identical to SEQ ID NO: 21061
  CDS (116)..(1186)

SEQ ID NO: 60257 - protein, 356 aa, Phaseolus vulgaris (kidney bean); identical to SEQ ID NO: 21062

SEQ ID NO: 60258 - DNA, 1454 bp, Phaseolus vulgaris (kidney bean); identical to SEQ ID NO: 21063
  CDS (123)..(1193)

SEQ ID NO: 60259 - protein, 356 aa, Phaseolus vulgaris (kidney bean); identical to SEQ ID NO: 21064

SEQ ID NO: 60260 - DNA, 1510 bp, Phaseolus vulgaris (kidney bean); identical to SEQ ID NO: 21065
  CDS (64)..(1353)

SEQ ID NO: 60261 - protein, 429 aa, Phaseolus vulgaris (kidney bean); identical to SEQ ID NO: 21066

SEQ ID NO: 60262 - DNA, 1421 bp, Cricetulus griseus (Chinese hamster); identical to SEQ ID NO: 21067
  CDS (147)..(1268): n means a or g or c or t/u, s means g or c

SEQ ID NO: 60263 - protein, 373 aa, Cricetulus griseus (Chinese hamster); identical to SEQ ID NO: 21068

SEQ ID NO: 60264 - DNA, 1910 bp, Azospirillum brasilense; identical to SEQ ID NO: 21069
  CDS (351)..(1757)

SEQ ID NO: 60265 - protein, 468 aa, Azospirillum brasilense; identical to SEQ ID NO: 21070

SEQ ID NO: 60266 - DNA, 1205 bp, Frankia sp; identical to SEQ ID NO: 21071
  CDS (59)..(1117)

SEQ ID NO: 60267 - protein, 352 aa, Frankia sp; identical to SEQ ID NO: 21072

SEQ ID NO: 60268 - DNA, 1429 bp, Lactuca sativa (garden lettuce); identical to SEQ ID NO: 21073
  CDS (16)..(1092)

SEQ ID NO: 60269 - protein, 358 aa, Lactuca sativa (garden lettuce); identical to SEQ ID NO: 21074

SEQ ID NO: 60270 - DNA, 1434 bp, Pisum sativum (garden pea); identical to SEQ ID NO: 21075
  CDS (83)..(1150)

SEQ ID NO: 60271 - protein, 355 aa, Pisum sativum (garden pea); identical to SEQ ID NO: 21076

SEQ ID NO: 60272 - DNA, 1540 bp, Pisum sativum (garden pea); identical to SEQ ID NO: 21077
  CDS (68)..(1360)

SEQ ID NO: 60273 - protein, 430 aa, Pisum sativum (garden pea); identical to SEQ ID NO: 21078

SEQ ID NO: 60274 - DNA, 1169 bp, Oryza sativa (rice); identical to SEQ ID NO: 21079
  CDS (59)..(1132)

SEQ ID NO: 60275 - protein, 357 aa, Oryza sativa (rice); identical to SEQ ID NO: 21080

SEQ ID NO: 60276 - DNA, 1287 bp, Oryza sativa (rice); identical to SEQ ID NO: 21081
  CDS (1)..(1287)

SEQ ID NO: 60277 - protein, 428 aa, Oryza sativa (rice); identical to SEQ ID NO: 21082

SEQ ID NO: 60278 - DNA, 1553 bp, Oryza sativa (rice); identical to SEQ ID NO: 21083
  CDS (55)..(1125)

SEQ ID NO: 60279 - protein, 356 aa, Oryza sativa (rice); identical to SEQ ID NO: 21084

SEQ ID NO: 60280 - DNA, 1208 bp, Streptomyces hygroscopicus; identical to SEQ ID NO: 21085
  CDS (136)..(1158)

SEQ ID NO: 60281 - protein, 340 aa, Streptomyces hygroscopicus; identical to SEQ ID NO: 21086

SEQ ID NO: 60282 - DNA, 1032 bp, Streptomyces viridochromogenes; identical to SEQ ID NO: 21087
  CDS (1)..(1032)

SEQ ID NO: 60283 - protein, 343 aa, Streptomyces viridochromogenes; identical to SEQ ID NO: 21088

SEQ ID NO: 60284 - DNA, 1270 bp, Bradyrhizobium japonicum; identical to SEQ ID NO: 21089
  CDS (281)..(1270)

SEQ ID NO: 60285 - protein, 329 aa, Bradyrhizobium japonicum; identical to SEQ ID NO: 21090

SEQ ID NO: 60286 - DNA, 1446 bp, Helicobacter pylori; identical to SEQ ID NO: 21091
  CDS (1)..(1446)

SEQ ID NO: 60287 - protein, 481 aa, Helicobacter pylori; identical to SEQ ID NO: 21092

SEQ ID NO: 60288 - DNA, 1368 bp, Bacillus halodurans; identical to SEQ ID NO: 21093
  CDS (1)..(1368)

SEQ ID NO: 60289 - protein, 455 aa, Bacillus halodurans; identical to SEQ ID NO: 21094

SEQ ID NO: 60290 - DNA, 1410 bp, Caulobacter crescentus; identical to SEQ ID NO: 21095
  CDS (1)..(1410)

SEQ ID NO: 60291 - protein, 469 aa, Caulobacter crescentus; identical to SEQ ID NO: 21096

SEQ ID NO: 60292 - DNA, 1035 bp, Sinorhizobium meliloti; identical to SEQ ID NO: 21097
  CDS (1)..(1035)

SEQ ID NO: 60293 - protein, 344 aa, Sinorhizobium meliloti; identical to SEQ ID NO: 21098

SEQ ID NO: 60294 - DNA, 1212 bp, Squalus acanthias (spiny dogfish); identical to SEQ ID NO: 21099
  CDS (1)..(1212)

SEQ ID NO: 60295 - protein, 403 aa, Squalus acanthias (spiny dogfish); identical to SEQ ID NO: 21100

SEQ ID NO: 60296 - DNA, 1617 bp, Xenopus laevis (African clawed frog); identical to SEQ ID NO: 21101
  CDS (65)..(1243)

SEQ ID NO: 60297 - protein, 392 aa, Xenopus laevis (African clawed frog); identical to SEQ ID NO: 21102

SEQ ID NO: 60298 - DNA, 1942 bp, Calothrix sp; identical to SEQ ID NO: 21103
  CDS (375)..(1790)

SEQ ID NO: 60299 - protein, 471 aa, Calothrix sp; identical to SEQ ID NO: 21104

SEQ ID NO: 60300 - DNA, 1098 bp, Paracentrotus lividus (common urchin); identical to SEQ ID NO: 21105
  CDS (1)..(1098)

SEQ ID NO: 60301 - protein, 365 aa, Paracentrotus lividus (common urchin); identical to SEQ ID NO: 21106

SEQ ID NO: 60302 - DNA, 1340 bp, Nicotiana plumbaginifolia (curled-leaved tobacco); identical to SEQ ID NO: 21107
  CDS (16)..(1086)

SEQ ID NO: 60303 - protein, 356 aa, Nicotiana plumbaginifolia (curled-leaved tobacco); identical to SEQ ID NO: 21108

SEQ ID NO: 60304 - DNA, 2045 bp, Panulirus argus (spiny lobster); identical to SEQ ID NO: 21109
  CDS (56)..(1141)

SEQ ID NO: 60305 - protein, 361 aa, Panulirus argus (spiny lobster); identical to SEQ ID NO: 21110

SEQ ID NO: 60306 - DNA, 1450 bp, Glycine max (soybean); identical to SEQ ID NO: 21111
  CDS (78)..(1145)

SEQ ID NO: 60307 - protein, 355 aa, Glycine max (soybean); identical to SEQ ID NO: 21112

SEQ ID NO: 60308 - DNA, 1642 bp, Arabidopsis thaliana (mouse-ear cress); identical to SEQ ID NO: 21113
  CDS (138)..(1430)

SEQ ID NO: 60309 - protein, 430 aa, Arabidopsis thaliana (mouse-ear cress); identical to SEQ ID NO: 21114

SEQ ID NO: 60310 - DNA, 1617 bp, Rhizobium leguminosarum; identical to SEQ ID NO: 21115
  CDS (569)..(1549)

SEQ ID NO: 60311 - protein, 326 aa, Rhizobium leguminosarum; identical to SEQ ID NO: 21116

SEQ ID NO: 60312 - DNA, 1575 bp, Brassica napus (rape); identical to SEQ ID NO: 21117
  CDS (95)..(1381)

SEQ ID NO: 60313 - protein, 428 aa, Brassica napus (rape); identical to SEQ ID NO: 21118

SEQ ID NO: 60314 - DNA, 1423 bp, Pinus sylvestris (Scotch pine); identical to SEQ ID NO: 21119
  CDS (34)..(1107)

SEQ ID NO: 60315 - protein, 357 aa, Pinus sylvestris (Scotch pine); identical to SEQ ID NO: 21120

SEQ ID NO: 60316 - DNA, 1359 bp, Zea mays (maize); identical to SEQ ID NO: 21121
  CDS (10)..(1083)

SEQ ID NO: 60317 - protein, 357 aa, Zea mays (maize); identical to SEQ ID NO: 21122

SEQ ID NO: 60318 - DNA, 1369 bp, Zea mays (maize); identical to SEQ ID NO: 21123
  CDS (103)..(1209)

SEQ ID NO: 60319 - protein, 368 aa, Zea mays (maize); identical to SEQ ID NO: 21124

SEQ ID NO: 60320 - DNA, 1317 bp, Zea mays (maize); identical to SEQ ID NO: 21125
  CDS (63)..(1133)

SEQ ID NO: 60321 - protein, 356 aa, Zea mays (maize); identical to SEQ ID NO: 21126

SEQ ID NO: 60322 - DNA, 1490 bp, Zea mays (maize); identical to SEQ ID NO: 21127
  CDS (85)..(1152)

SEQ ID NO: 60323 - protein, 355 aa, Zea mays (maize); identical to SEQ ID NO: 21128

SEQ ID NO: 60324 - DNA, 1483 bp, Zea mays (maize); identical to SEQ ID NO: 21129
  CDS (48)..(1319)

SEQ ID NO: 60325 - protein, 423 aa, Zea mays (maize); identical to SEQ ID NO: 21130

SEQ ID NO: 60326 - DNA, 1400 bp, Brassica napus (rape); identical to SEQ ID NO: 21131
  CDS (68)..(1138)

SEQ ID NO: 60327 - protein, 356 aa, Brassica napus (rape); identical to SEQ ID NO: 21132

SEQ ID NO: 60328 - DNA, 1370 bp, Sus scrofa domestica (domestic pig); identical to SEQ ID NO: 21133
  CDS (118)..(1239)

SEQ ID NO: 60329 - protein, 373 aa, Sus scrofa domestica (domestic pig); identical to SEQ ID NO: 21134

SEQ ID NO: 60330 - DNA, 1433 bp, Glycine max (soybean); identical to SEQ ID NO: 21135
  CDS (70)..(1137)

SEQ ID NO: 60331 - protein, 355 aa, Glycine max (soybean); identical to SEQ ID NO: 21136

SEQ ID NO: 60332 - DNA, 1354 bp, Brassica napus (rape); identical to SEQ ID NO: 21137
  CDS (62)..(1132)

SEQ ID NO: 60333 - protein, 356 aa, Brassica napus (rape); identical to SEQ ID NO: 21138

SEQ ID NO: 60334 - DNA, 1333 bp, Raphanus sativus (radish); identical to SEQ ID NO: 21139
  CDS (37)..(1101)

SEQ ID NO: 60335 - protein, 354 aa, Raphanus sativus (radish); identical to SEQ ID NO: 21140

SEQ ID NO: 60336 - DNA, 1484 bp, Raphanus sativus (radish); identical to SEQ ID NO: 21141
  CDS (170)..(1240)

SEQ ID NO: 60337 - protein, 356 aa, Raphanus sativus (radish); identical to SEQ ID NO: 21142

SEQ ID NO: 60338 - DNA, 1326 bp, Raphanus sativus (radish); identical to SEQ ID NO: 21143
  CDS (65)..(1135)

SEQ ID NO: 60339 - protein, 356 aa, Raphanus sativus (radish); identical to SEQ ID NO: 21144

SEQ ID NO: 60340 - DNA, 1416 bp, Vitis vinifera (grape); identical to SEQ ID NO: 21145
  CDS (88)..(1158)

SEQ ID NO: 60341 - protein, 356 aa, Vitis vinifera (grape); identical to SEQ ID NO: 21146

SEQ ID NO: 60342 - DNA, 1305 bp, Vitis vinifera (grape); identical to SEQ ID NO: 21147
  CDS (24)..(1094)

SEQ ID NO: 60343 - protein, 356 aa, Vitis vinifera (grape); identical to SEQ ID NO: 21148

SEQ ID NO: 60344 - DNA, 1346 bp, Nicotiana tabacum (common tobacco); identical to SEQ ID NO: 21149
  CDS (21)..(1091)

SEQ ID NO: 60345 - protein, 356 aa, Nicotiana tabacum (common tobacco); identical to SEQ ID NO: 21150

SEQ ID NO: 60346 - DNA, 1381 bp, Nicotiana tabacum (common tobacco); identical to SEQ ID NO: 21151
  CDS (54)..(1124)

SEQ ID NO: 60347 - protein, 356 aa, Nicotiana tabacum (common tobacco); identical to SEQ ID NO: 21152

SEQ ID NO: 60348 - DNA, 1310 bp, Glycine max (soybean); identical to SEQ ID NO: 21153
  CDS (62)..(1129)

SEQ ID NO: 60349 - protein, 355 aa, Glycine max (soybean); identical to SEQ ID NO: 21154

SEQ ID NO: 60350 - DNA, 2030 bp, Chlamydomonas reinhardtii; identical to SEQ ID NO: 21155
  CDS (84)..(1232)

SEQ ID NO: 60351 - protein, 382 aa, Chlamydomonas reinhardtii; identical to SEQ ID NO: 21156

SEQ ID NO: 60352 - DNA, 1604 bp, Chlamydomonas reinhardtii; identical to SEQ ID NO: 21157
  CDS (12)..(1154)

SEQ ID NO: 60353 - protein, 380 aa, Chlamydomonas reinhardtii; identical to SEQ ID NO: 21158

SEQ ID NO: 60354 - DNA, 1376 bp, Daucus carota (carrot); identical to SEQ ID NO: 21159
  CDS (84)..(1142)

SEQ ID NO: 60355 - protein, 352 aa, Daucus carota (carrot); identical to SEQ ID NO: 21160

SEQ ID NO: 60356 - DNA, 1537 bp, Daucus carota (carrot); identical to SEQ ID NO: 21161
  CDS (17)..(1315)

SEQ ID NO: 60357 - protein, 432 aa, Daucus carota (carrot); identical to SEQ ID NO: 21162

SEQ ID NO: 60358 - DNA, 1167 bp, Caenorhabditis elegans; identical to SEQ ID NO: 21163
  CDS (10)..(1167)

SEQ ID NO: 60359 - protein, 385 aa, Caenorhabditis elegans; identical to SEQ ID NO: 21164

SEQ ID NO: 60360 - DNA, 1080 bp, Schizosaccharomyces pombe; identical to SEQ ID NO: 21165
  CDS (1)..(1080)

SEQ ID NO: 60361 - protein, 359 aa, Schizosaccharomyces pombe; identical to SEQ ID NO: 21166

SEQ ID NO: 60362 - DNA, 1597 bp, Brassica napus; identical to SEQ ID NO: 21167
  CDS (97)..(1383)

SEQ ID NO: 60363 - protein, 428 aa, Brassica napus; identical to SEQ ID NO: 21168

SEQ ID NO: 60364 - DNA, 1425 bp, Medicago truncatula; identical to SEQ ID NO: 21169
  CDS (73)..(1143)

SEQ ID NO: 60365 - protein, 356 aa, Medicago truncatula; identical to SEQ ID NO: 21170

SEQ ID NO: 60366 - DNA, 1488 bp, Medicago truncatula; identical to SEQ ID NO: 21171
  CDS (145)..(1215)

SEQ ID NO: 60367 - protein, 356 aa, Medicago truncatula; identical to SEQ ID NO: 21172

SEQ ID NO: 60368 - DNA, 1495 bp, Hevea brasiliensis; identical to SEQ ID NO: 21173
  CDS (114)..(1184)

SEQ ID NO: 60369 - protein, 356 aa, Hevea brasiliensis; identical to SEQ ID NO: 21174

SEQ ID NO: 60370 - DNA, 2160 bp, Helicobacter pylori; identical to SEQ ID NO: 21175
  CDS (573)..(2018)

SEQ ID NO: 60371 - protein, 481 aa, Helicobacter pylori; identical to SEQ ID NO: 21176

SEQ ID NO: 60372 - DNA, 1203 bp, Aedes aegypti; identical to SEQ ID NO: 21177
  CDS (1)..(1203)

SEQ ID NO: 60373 - protein, 400 aa, Aedes aegypti; identical to SEQ ID NO: 21178

SEQ ID NO: 60374 - DNA, 1518 bp, Skeletonema costatum; identical to SEQ ID NO: 21179
  CDS (40)..(1272): n means a or g or c or t/u, s means g or c

SEQ ID NO: 60375 - protein, 410 aa, Skeletonema costatum; identical to SEQ ID NO: 21180

SEQ ID NO: 60376 - DNA, 2193 bp, Drosophila melanogaster; identical to SEQ ID NO: 21181
  CDS (184)..(1383)

SEQ ID NO: 60377 - protein, 399 aa, Drosophila melanogaster; identical to SEQ ID NO: 21182

SEQ ID NO: 60378 - DNA, 1410 bp, Rhodospirillum rubrum; identical to SEQ ID NO: 21183
  CDS (1)..(1410)

SEQ ID NO: 60379 - protein, 469 aa, Rhodospirillum rubrum; identical to SEQ ID NO: 21184

SEQ ID NO: 60380 - DNA, 1889 bp, Xenopus laevis; identical to SEQ ID NO: 21185
  CDS (23)..(1117)

SEQ ID NO: 60381 - protein, 364 aa, Xenopus laevis; identical to SEQ ID NO: 21186

SEQ ID NO: 60382 - DNA, 1523 bp, Nicotiana attenuata; identical to SEQ ID NO: 21187
  CDS (51)..(1349)

SEQ ID NO: 60383 - protein, 432 aa, Nicotiana attenuata; identical to SEQ ID NO: 21188

SEQ ID NO: 60384 - DNA, 1410 bp, Erwinia carotovora; identical to SEQ ID NO: 21189
  CDS (1)..(1410)

SEQ ID NO: 60385 - protein, 469 aa, Erwinia carotovora; identical to SEQ ID NO: 21190

SEQ ID NO: 60386 - DNA, 1122 bp, Xenopus laevis; identical to SEQ ID NO: 21191
  CDS (1)..(1122)

SEQ ID NO: 60387 - protein, 373 aa, Xenopus laevis; identical to SEQ ID NO: 21192

SEQ ID NO: 60388 - DNA, 1359 bp, Elaeagnus umbellata; identical to SEQ ID NO: 21193
  CDS (36)..(1103)

SEQ ID NO: 60389 - protein, 355 aa, Elaeagnus umbellata; identical to SEQ ID NO: 21194

SEQ ID NO: 60390 - DNA, 1410 bp, Photobacterium profundum; identical to SEQ ID NO: 21195
  CDS (1)..(1410)

SEQ ID NO: 60391 - protein, 469 aa, Photobacterium profundum; identical to SEQ ID NO: 21196

SEQ ID NO: 60392 - DNA, 1038 bp, Rhodopseudomonas palustris; identical to SEQ ID NO: 21197
  CDS (1)..(1038)

SEQ ID NO: 60393 - protein, 345 aa, Rhodopseudomonas palustris; identical to SEQ ID NO: 21198

SEQ ID NO: 60394 - DNA, 1410 bp, Rhodopseudomonas palustris; identical to SEQ ID NO: 21199
  CDS (1)..(1410)

SEQ ID NO: 60395 - protein, 469 aa, Rhodopseudomonas palustris; identical to SEQ ID NO: 21200

SEQ ID NO: 60396 - DNA, 1122 bp, Rattus norvegicus; identical to SEQ ID NO: 21201
  CDS (1)..(1122)

SEQ ID NO: 60397 - protein, 373 aa, Rattus norvegicus; identical to SEQ ID NO: 21202

SEQ ID NO: 60398 - DNA, 1278 bp, Triticum aestivum; identical to SEQ ID NO: 21203
  CDS (116)..(1204)

SEQ ID NO: 60399 - protein, 362 aa, Triticum aestivum; identical to SEQ ID NO: 21204

SEQ ID NO: 60400 - DNA, 1299 bp, Triticum aestivum; identical to SEQ ID NO: 21205
  CDS (82)..(1170)

SEQ ID NO: 60401 - protein, 362 aa, Triticum aestivum; identical to SEQ ID NO: 21206

SEQ ID NO: 60402 - DNA, 1341 bp, Triticum aestivum; identical to SEQ ID NO: 21207
  CDS (28)..(1092)

SEQ ID NO: 60403 - protein, 354 aa, Triticum aestivum; identical to SEQ ID NO: 21208

SEQ ID NO: 60404 - DNA, 1634 bp, Aiptasia pallida; identical to SEQ ID NO: 21209
  CDS (77)..(1186)

SEQ ID NO: 60405 - protein, 369 aa, Aiptasia pallida; identical to SEQ ID NO: 21210

SEQ ID NO: 60406 - DNA, 1445 bp, Datisca glomerata; identical to SEQ ID NO: 21211
  CDS (77)..(1147)

SEQ ID NO: 60407 - protein, 356 aa, Datisca glomerata; identical to SEQ ID NO: 21212

SEQ ID NO: 60408 - DNA, 1065 bp, Glomus mosseae; identical to SEQ ID NO: 21213
  CDS (1)..(1065)

SEQ ID NO: 60409 - protein, 354 aa, Glomus mosseae; identical to SEQ ID NO: 21214

SEQ ID NO: 60410 - DNA, 1341 bp, Thermus thermophilus; identical to SEQ ID NO: 21215
  CDS (1)..(1341)

SEQ ID NO: 60411 - protein, 446 aa, Thermus thermophilus; identical to SEQ ID NO: 21216

SEQ ID NO: 60412 - DNA, 1413 bp, Geobacter sulfurreducens; identical to SEQ ID NO: 21217
  CDS (1)..(1413)

SEQ ID NO: 60413 - protein, 470 aa, Geobacter sulfurreducens; identical to SEQ ID NO: 21218

SEQ ID NO: 60414 - DNA, 1290 bp, Phragmites australis; identical to SEQ ID NO: 21219
  CDS (1)..(1290)

SEQ ID NO: 60415 - protein, 429 aa, Phragmites australis; identical to SEQ ID NO: 21220

SEQ ID NO: 60416 - DNA, 1290 bp, Phragmites australis; identical to SEQ ID NO: 21221
  CDS (1)..(1290)

SEQ ID NO: 60417 - protein, 429 aa, Phragmites australis; identical to SEQ ID NO: 21222

SEQ ID NO: 60418 - DNA, 1409 bp, Camellia sinensis; identical to SEQ ID NO: 21223
  CDS (126)..(1196)

SEQ ID NO: 60419 - protein, 356 aa, Camellia sinensis; identical to SEQ ID NO: 21224

SEQ ID NO: 60420 - DNA, 1525 bp, Xenopus laevis; identical to SEQ ID NO: 21225
  CDS (30)..(1145)

SEQ ID NO: 60421 - protein, 371 aa, Xenopus laevis; identical to SEQ ID NO: 21226

SEQ ID NO: 60422 - DNA, 1050 bp, Neurospora crassa; identical to SEQ ID NO: 21227
  CDS (1)..(1050)

SEQ ID NO: 60423 - protein, 349 aa, Neurospora crassa; identical to SEQ ID NO: 21228

SEQ ID NO: 60424 - DNA, 1101 bp, Rhodopirellula baltica; identical to SEQ ID NO: 21229
  CDS (1)..(1101)

SEQ ID NO: 60425 - protein, 366 aa, Rhodopirellula baltica; identical to SEQ ID NO: 21230

SEQ ID NO: 60426 - DNA, 1440 bp, Helicobacter hepaticus; identical to SEQ ID NO: 21231
  CDS (1)..(1440)

SEQ ID NO: 60427 - protein, 479 aa, Helicobacter hepaticus; identical to SEQ ID NO: 21232

SEQ ID NO: 60428 - DNA, 1811 bp, Brachydanio rerio; identical to SEQ ID NO: 21233
  CDS (122)..(1240)

SEQ ID NO: 60429 - protein, 372 aa, Brachydanio rerio; identical to SEQ ID NO: 21234

SEQ ID NO: 60430 - DNA, 1029 bp, Streptomyces avermitilis; identical to SEQ ID NO: 21235
  CDS (1)..(1029)

SEQ ID NO: 60431 - protein, 342 aa, Streptomyces avermitilis; identical to SEQ ID NO: 21236

SEQ ID NO: 60432 - DNA, 1080 bp, Coxiella burnetii; identical to SEQ ID NO: 21237
  CDS (1)..(1080)

SEQ ID NO: 60433 - protein, 359 aa, Coxiella burnetii; identical to SEQ ID NO: 21238

SEQ ID NO: 60434 - DNA, 1659 bp, Pantoea agglomerans; identical to SEQ ID NO: 21239
  CDS (223)..(1632)

SEQ ID NO: 60435 - protein, 469 aa, Pantoea agglomerans; identical to SEQ ID NO: 21240

SEQ ID NO: 60436 - DNA, 1401 bp, Securigera parviflora; identical to SEQ ID NO: 21241
  CDS (99)..(1169)

SEQ ID NO: 60437 - protein, 356 aa, Securigera parviflora; identical to SEQ ID NO: 21242

SEQ ID NO: 60438 - DNA, 1508 bp, Securigera parviflora; identical to SEQ ID NO: 21243
  CDS (105)..(1175)

SEQ ID NO: 60439 - protein, 356 aa, Securigera parviflora; identical to SEQ ID NO: 21244

SEQ ID NO: 60440 - DNA, 1313 bp, Arabidopsis thaliana; identical to SEQ ID NO: 21245
  CDS (53)..(1117)

SEQ ID NO: 60441 - protein, 354 aa, Arabidopsis thaliana; identical to SEQ ID NO: 21246

SEQ ID NO: 60442 - DNA, 1263 bp, Opsanus beta; identical to SEQ ID NO: 21247
  CDS (33)..(1154)

SEQ ID NO: 60443 - protein, 373 aa, Opsanus beta; identical to SEQ ID NO: 21248

SEQ ID NO: 60444 - DNA, 1434 bp, Yersinia pestis; identical to SEQ ID NO: 21249
  CDS (1)..(1434)

SEQ ID NO: 60445 - protein, 477 aa, Yersinia pestis; identical to SEQ ID NO: 21250

SEQ ID NO: 60446 - DNA, 1338 bp, Bifidobacterium longum; identical to SEQ ID NO: 21251
  CDS (1)..(1338)

SEQ ID NO: 60447 - protein, 445 aa, Bifidobacterium longum; identical to SEQ ID NO: 21252

SEQ ID NO: 60448 - DNA, 2681 bp, Acetobacter diazotrophicus; identical to SEQ ID NO: 21253
  CDS (832)..(2292)

SEQ ID NO: 60449 - protein, 486 aa, Acetobacter diazotrophicus; identical to SEQ ID NO: 21254

SEQ ID NO: 60450 - DNA, 1640 bp, Crataegus crus; identical to SEQ ID NO: 21255
  CDS (85)..(1383)

SEQ ID NO: 60451 - protein, 432 aa, Crataegus crus; identical to SEQ ID NO: 21256

SEQ ID NO: 60452 - DNA, 1340 bp, Phytophthora infestans; identical to SEQ ID NO: 21257
  CDS (56)..(1129)

SEQ ID NO: 60453 - protein, 357 aa, Phytophthora infestans; identical to SEQ ID NO: 21258

SEQ ID NO: 60454 - DNA, 1369 bp, Canis familiaris; identical to SEQ ID NO: 21259
  CDS (248)..(1369)

SEQ ID NO: 60455 - protein, 373 aa, Canis familiaris; identical to SEQ ID NO: 21260

SEQ ID NO: 60456 - DNA, 1905 bp, Homo sapiens; identical to SEQ ID NO: 21261
  CDS (644)..(1765)

SEQ ID NO: 60457 - protein, 373 aa, Homo sapiens [sequence omitted]

SEQ ID NO: 60458 - DNA, 1520 bp, Oncorhynchus mykiss; identical to SEQ ID NO: 21263
  CDS (7)..(1122)

SEQ ID NO: 60459 - protein, 371 aa, Oncorhynchus mykiss; identical to SEQ ID NO: 21264

SEQ ID NO: 60460 - DNA, 1840 bp, Oncorhynchus mykiss; identical to SEQ ID NO: 21265
  CDS (76)..(1191)

SEQ ID NO: 60461 - protein, 371 aa, Oncorhynchus mykiss; identical to SEQ ID NO: 21266

SEQ ID NO: 60462 - DNA, 1681 bp, Oncorhynchus mykiss; identical to SEQ ID NO: 21267
  CDS (160)..(1281)

SEQ ID NO: 60463 - protein, 373 aa, Oncorhynchus mykiss; identical to SEQ ID NO: 21268

SEQ ID NO: 60464 - DNA, 1926 bp, Oreochromis niloticus; identical to SEQ ID NO: 21269
  CDS (94)..(1209)

SEQ ID NO: 60465 - protein, 371 aa, Oreochromis niloticus; identical to SEQ ID NO: 21270

SEQ ID NO: 60466 - DNA, 1429 bp, Arabidopsis thaliana; identical to SEQ ID NO: 21271
  CDS (91)..(1161)

SEQ ID NO: 60467 - protein, 356 aa, Arabidopsis thaliana; identical to SEQ ID NO: 21272

SEQ ID NO: 60468 - DNA, 1356 bp, Oryza sativa; identical to SEQ ID NO: 21273
  CDS (1)..(1356)

SEQ ID NO: 60469 - protein, 451 aa, Oryza sativa; identical to SEQ ID NO: 21274

SEQ ID NO: 60470 - DNA, 1544 bp, Bostrychus sinensis; identical to SEQ ID NO: 21275
  CDS (90)..(1205)

SEQ ID NO: 60471 - protein, 371 aa, Bostrychus sinensis; identical to SEQ ID NO: 21276

SEQ ID NO: 60472 - DNA, 1696 bp, Lotus japonicus; identical to SEQ ID NO: 21277
  CDS (147)..(1439): n means a or g or c or t/u, s means g or c

SEQ ID NO: 60473 - protein, 430 aa, Lotus japonicus; identical to SEQ ID NO: 21278
  Xaa in positions 263 and 284 is unknown

SEQ ID NO: 60474 - DNA, 1233 bp, Gelidium crinale; identical to SEQ ID NO: 21279
  CDS (66)..(1121): n means a or g or c or t/u, s means g or c

SEQ ID NO: 60475 - protein, 351 aa, Gelidium crinale; identical to SEQ ID NO: 21280

SEQ ID NO: 60476 - DNA, 1338 bp, Vitis vinifera; identical to SEQ ID NO: 21281
  CDS (27)..(1097)

SEQ ID NO: 60477 - protein, 356 aa, Vitis vinifera; identical to SEQ ID NO: 21282

SEQ ID NO: 60478 - DNA, 1557 bp, Populus alba x Populus tremula; identical to SEQ ID NO: 21283
  CDS (114)..(1184)

SEQ ID NO: 60479 - protein, 356 aa, Populus alba x Populus tremula; identical to SEQ ID NO: 21284

SEQ ID NO: 60480 - DNA, 1541 bp, Glycine max; identical to SEQ ID NO: 21285
  CDS (30)..(1328)

SEQ ID NO: 60481 - protein, 432 aa, Glycine max; identical to SEQ ID NO: 21286

SEQ ID NO: 60482 - DNA, 1410 bp, Rhizobium loti; identical to SEQ ID NO: 21287
  CDS (1)..(1410)

SEQ ID NO: 60483 - protein, 469 aa, Rhizobium loti; identical to SEQ ID NO: 21288

SEQ ID NO: 60484 - DNA, 1041 bp, Rhizobium loti; identical to SEQ ID NO: 21289
  CDS (1)..(1041)

SEQ ID NO: 60485 - protein, 346 aa, Rhizobium loti; identical to SEQ ID NO: 21290

SEQ ID NO: 60486 - DNA, 1494 bp, Oryza sativa; identical to SEQ ID NO: 21291
  CDS (122)..(1234)

SEQ ID NO: 60487 - protein, 370 aa, Oryza sativa; identical to SEQ ID NO: 21292

SEQ ID NO: 60488 - DNA, 1296 bp, Beta vulgaris subsp; identical to SEQ ID NO: 21293
  CDS (1)..(1296)

SEQ ID NO: 60489 - protein, 431 aa, Beta vulgaris subsp; identical to SEQ ID NO: 21294

SEQ ID NO: 60490 - DNA, 1071 bp, Beta vulgaris subsp; identical to SEQ ID NO: 21295
  CDS (1)..(1071)

SEQ ID NO: 60491 - protein, 356 aa, Beta vulgaris subsp; identical to SEQ ID NO: 21296

SEQ ID NO: 60492 - DNA, 1374 bp, Avicennia marina; identical to SEQ ID NO: 21297
  CDS (65)..(1135)

SEQ ID NO: 60493 - protein, 356 aa, Avicennia marina; identical to SEQ ID NO: 21298

SEQ ID NO: 60494 - DNA, 1122 bp, Cricetulus griseus; identical to SEQ ID NO: 21299
  CDS (1)..(1122)

SEQ ID NO: 60495 - protein, 373 aa, Cricetulus griseus; identical to SEQ ID NO: 21300

SEQ ID NO: 60496 - DNA, 1410 bp, Shewanella violacea; identical to SEQ ID NO: 21301
  CDS (1)..(1410)

SEQ ID NO: 60497 - protein, 469 aa, Shewanella violacea; identical to SEQ ID NO: 21302

SEQ ID NO: 60498 - DNA, 1387 bp, Arabidopsis thaliana; identical to SEQ ID NO: 21303
  CDS (79)..(1149)

SEQ ID NO: 60499 - protein, 356 aa, Arabidopsis thaliana; identical to SEQ ID NO: 21304

SEQ ID NO: 60500 - DNA, 1269 bp, Arabidopsis thaliana; identical to SEQ ID NO: 21305
  CDS (44)..(1114)

SEQ ID NO: 60501 - protein, 356 aa, Arabidopsis thaliana; identical to SEQ ID NO: 21306

SEQ ID NO: 60502 - DNA, 1403 bp, Glycine max; identical to SEQ ID NO: 21307
  CDS (60)..(1130)

SEQ ID NO: 60503 - protein, 356 aa, Glycine max; identical to SEQ ID NO: 21308

SEQ ID NO: 60504 - DNA, 1044 bp, Arabidopsis thaliana; identical to SEQ ID NO: 21309
  CDS (1)..(1044)

SEQ ID NO: 60505 - protein, 347 aa, Arabidopsis thaliana; identical to SEQ ID NO: 21310

SEQ ID NO: 60506 - DNA, 1122 bp, Acomys cahirinus; identical to SEQ ID NO: 21311
  CDS (1)..(1122)

SEQ ID NO: 60507 - protein, 373 aa, Acomys cahirinus; identical to SEQ ID NO: 21312

SEQ ID NO: 60508 - DNA, 1577 bp, Canavalia lineata; identical to SEQ ID NO: 21313
  CDS (91)..(1383)

SEQ ID NO: 60509 - protein, 430 aa, Canavalia lineata; identical to SEQ ID NO: 21314

SEQ ID NO: 60510 - DNA, 1666 bp, Juglans nigra; identical to SEQ ID NO: 21315
  CDS (96)..(1394)

SEQ ID NO: 60511 - protein, 432 aa, Juglans nigra; identical to SEQ ID NO: 21316

SEQ ID NO: 60512 - DNA, 1590 bp, Nicotiana sylvestris; identical to SEQ ID NO: 21317
  CDS (67)..(1365)

SEQ ID NO: 60513 - protein, 432 aa, Nicotiana sylvestris; identical to SEQ ID NO: 21318

SEQ ID NO: 60514 - DNA, 1345 bp, Canavalia lineata; identical to SEQ ID NO: 21319
  CDS (83)..(1150)

SEQ ID NO: 60515 - protein, 355 aa, Canavalia lineata; identical to SEQ ID NO: 21320

SEQ ID NO: 60516 - DNA, 1668 bp, Opsanus beta; identical to SEQ ID NO: 21321
  CDS (1)..(1185)

SEQ ID NO: 60517 - protein, 394 aa, Opsanus beta; identical to SEQ ID NO: 21322

SEQ ID NO: 60518 - DNA, 1032 bp, Streptomyces coelicolor; identical to SEQ ID NO: 21323
  CDS (1)..(1032)

SEQ ID NO: 60519 - protein, 343 aa, Streptomyces coelicolor; identical to SEQ ID NO: 21324

SEQ ID NO: 60520 - DNA, 1579 bp, Mesembryanthemum crystallinum; identical to SEQ ID NO: 21325
  CDS (88)..(1389): n means a or g or c or t/u, s means g or c

SEQ ID NO: 60521 - protein, 433 aa, Mesembryanthemum crystallinum; identical to SEQ ID NO: 21326

SEQ ID NO: 60522 - DNA, 1410 bp, Enterobacter gergoviae; identical to SEQ ID NO: 21327
  CDS (1)..(1410)

SEQ ID NO: 60523 - protein, 469 aa, Enterobacter gergoviae; identical to SEQ ID NO: 21328

SEQ ID NO: 60524 - DNA, 1451 bp, Pinus sylvestris; identical to SEQ ID NO: 21329
  CDS (78)..(1145)

SEQ ID NO: 60525 - protein, 355 aa, Pinus sylvestris; identical to SEQ ID NO: 21330

SEQ ID NO: 60526 - DNA, 1346 bp, Alnus glutinosa; identical to SEQ ID NO: 21331
  CDS (50)..(1120)

SEQ ID NO: 60527 - protein, 356 aa, Alnus glutinosa; identical to SEQ ID NO: 21332

SEQ ID NO: 60528 - DNA, 1821 bp, Drosophila melanogaster; identical to SEQ ID NO: 21333
  CDS (148)..(1257)

SEQ ID NO: 60529 - protein, 369 aa, Drosophila melanogaster; identical to SEQ ID NO: 21334

SEQ ID NO: 60530 - DNA, 1595 bp, Medicago sativa; identical to SEQ ID NO: 21335
  CDS (88)..(1374)

SEQ ID NO: 60531 - protein, 428 aa, Medicago sativa; identical to SEQ ID NO: 21336

SEQ ID NO: 60532 - DNA, 1071 bp, Glycine max; identical to SEQ ID NO: 21337
  CDS (1)..(1071)

SEQ ID NO: 60533 - protein, 356 aa, Glycine max; identical to SEQ ID NO: 21338

SEQ ID NO: 60534 - DNA, 1372 bp, Medicago sativa; identical to SEQ ID NO: 21339
  CDS (92)..(1162)

SEQ ID NO: 60535 - protein, 356 aa, Medicago sativa; identical to SEQ ID NO: 21340

SEQ ID NO: 60536 - DNA, 1065 bp, Agaricus bisporus; identical to SEQ ID NO: 21341
  CDS (1)..(1065)

SEQ ID NO: 60537 - protein, 354 aa, Agaricus bisporus; identical to SEQ ID NO: 21342

SEQ ID NO: 60538 - DNA, 1245 bp, Amanita muscaria; identical to SEQ ID NO: 21343
  CDS (96)..(1160)

SEQ ID NO: 60539 - protein, 354 aa, Amanita muscaria; identical to SEQ ID NO: 21344

SEQ ID NO: 60540 - DNA, 1110 bp, Ashbya gossypii; identical to SEQ ID NO: 21345
  CDS (1)..(1110)

SEQ ID NO: 60541 - protein, 369 aa, Ashbya gossypii; identical to SEQ ID NO: 21346

SEQ ID NO: 60542 - DNA, 1119 bp, Candida glabrata; identical to SEQ ID NO: 21347
  CDS (1)..(1119)

SEQ ID NO: 60543 - protein, 372 aa, Candida glabrata; identical to SEQ ID NO: 21348

SEQ ID NO: 60544 - DNA, 1083 bp, Colletotrichum gloeosporioides; identical to SEQ ID NO: 21349
  CDS (1)..(1083)

SEQ ID NO: 60545 - protein, 360 aa, Colletotrichum gloeosporioides; identical to SEQ ID NO: 21350

SEQ ID NO: 60546 - DNA, 1077 bp, Cryptococcus neoformans; identical to SEQ ID NO: 21351
  CDS (1)..(1077)

SEQ ID NO: 60547 - protein, 358 aa, Cryptococcus neoformans; identical to SEQ ID NO: 21352

SEQ ID NO: 60548 - DNA, 1113 bp, Debaryomyces hansenii; identical to SEQ ID NO: 21353
  CDS (1)..(1113)

SEQ ID NO: 60549 - protein, 370 aa, Debaryomyces hansenii; identical to SEQ ID NO: 21354

SEQ ID NO: 60550 - DNA, 1038 bp, Emericella nidulans; identical to SEQ ID NO: 21355
  CDS (1)..(1038)

SEQ ID NO: 60551 - protein, 345 aa, Emericella nidulans; identical to SEQ ID NO: 21356

SEQ ID NO: 60552 - DNA, 1335 bp, Fusarium solani; identical to SEQ ID NO: 21357
  CDS (91)..(1161)

SEQ ID NO: 60553 - protein, 356 aa, Fusarium solani; identical to SEQ ID NO: 21358

SEQ ID NO: 60554 - DNA, 1062 bp, Gibberella fujikuroi; identical to SEQ ID NO: 21359
  CDS (1)..(1062)

SEQ ID NO: 60555 - protein, 353 aa, Gibberella fujikuroi; identical to SEQ ID NO: 21360

SEQ ID NO: 60556 - DNA, 1119 bp, Kluyveromyces lactis; identical to SEQ ID NO: 21361
  CDS (1)..(1119)

SEQ ID NO: 60557 - protein, 372 aa, Kluyveromyces lactis; identical to SEQ ID NO: 21362

SEQ ID NO: 60558 - DNA, 1429 bp, Lactuca sativa; identical to SEQ ID NO: 21363
  CDS (16)..(1092)

SEQ ID NO: 60559 - protein, 358 aa, Lactuca sativa; identical to SEQ ID NO: 21364

SEQ ID NO: 60560 - DNA, 1062 bp, Lupinus luteus; identical to SEQ ID NO: 21365
  CDS (1)..(1062)

SEQ ID NO: 60561 - protein, 353 aa, Lupinus luteus; identical to SEQ ID NO: 21366

SEQ ID NO: 60562 - DNA, 1813 bp, Neisseria gonorrhoeae; identical to SEQ ID NO: 21367
  CDS (123)..(1541)

SEQ ID NO: 60563 - protein, 472 aa, Neisseria gonorrhoeae; identical to SEQ ID NO: 21368

SEQ ID NO: 60564 - DNA, 1089 bp, Neurospora crassa; identical to SEQ ID NO: 21369
  CDS (1)..(1089)

SEQ ID NO: 60565 - protein, 362 aa, Neurospora crassa; identical to SEQ ID NO: 21370

SEQ ID NO: 60566 - DNA, 1065 bp, Suillus bovinus; identical to SEQ ID NO: 21371
  CDS (1)..(1065)

SEQ ID NO: 60567 - protein, 354 aa, Suillus bovinus; identical to SEQ ID NO: 21372

SEQ ID NO: 60568 - DNA, 1300 bp, Tuber borchii; identical to SEQ ID NO: 21373
  CDS (45)..(1121)

SEQ ID NO: 60569 - protein, 358 aa, Tuber borchii; identical to SEQ ID NO: 21374

SEQ ID NO: 60570 - DNA, 1407 bp, Vigna aconitifolia; identical to SEQ ID NO: 21375
  CDS (78)..(1148)

SEQ ID NO: 60571 - protein, 356 aa, Vigna aconitifolia; identical to SEQ ID NO: 21376

SEQ ID NO: 60572 - DNA, 1095 bp, Yarrowia lipolytica; identical to SEQ ID NO: 21377
  CDS (1)..(1095)

SEQ ID NO: 60573 - protein, 364 aa, Yarrowia lipolytica; identical to SEQ ID NO: 21378

SEQ ID NO: 60574 - DNA, 24 bp, Artificial sequence
  (1)..(24): primer
atggctgaagcaagcatcgaaaag

SEQ ID NO: 60575 - DNA, 27 bp, Artificial sequence
  (1)..(27): primer
ttatgaagattctctttcaaattcctt

SEQ ID NO: 60576 - protein, 448 aa, Artificial sequence; identical to SEQ ID NO: 21381
  Variant (2)..(2): xaa in position 2 is any amino acid
  Variant (4)..(12): xaa in position 4 to 12 is any amino acid
  Variant (13)..(13): xaa in position 13 is any or no amino acid
  Variant (18)..(18): xaa in position 18 is any amino acid
  Variant (20)..(20): xaa in position 20 is any amino acid
  Variant (22)..(22): xaa in position 22 is any amino acid
  Variant (23)..(33): xaa in position 23 to 33 is any or no amino acid
  Variant (35)..(35): xaa in position 35 is any or no amino acid
  Variant (37)..(37): xaa in position 37 is any or no amino acid
  Variant (39)..(39): xaa in position 39 is any amino acid
  Variant (41)..(45): xaa in position 41 to 45 is any amino acid
  Variant (46)..(51): xaa in position 46 to 51 is any or no amino acid
  Variant (53)..(53): xaa in position 53 is any amino acid
  Variant (54)..(54): xaa in position 54 is any or no amino acid
  Variant (56)..(56): xaa in position 56 is any amino acid
  Variant (63)..(63): xaa in position 63 is any amino acid
  Variant (64)..(64): xaa in position 64 is any or no amino acid
  Variant (67)..(67): xaa in position 67 is any amino acid
  Variant (69)..(69): xaa in position 69 is any amino acid
  Variant (70)..(70): xaa in position 70 is any or no amino acid
  Variant (74)..(74): xaa in position 74 is any or no amino acid
  Variant (76)..(76): xaa in position 76 is any or no amino acid
  Variant (78)..(79): xaa in position 78 to 79 is any amino acid
  Variant (80)..(88): xaa in position 80 to 88 is any or no amino acid
  Variant (90)..(90): xaa in position 90 is any amino acid
  Variant (95)..(98): xaa in position 95 to 98 is any amino acid
  Variant (99)..(103): xaa in position 99 to 103 is any or no amino acid
  Variant (109)..(114): xaa in position 109 to 114 is any amino acid
  Variant (115)..(125): xaa in position 115 to 125 is any or no amino acid
  Variant (127)..(129): xaa in position 127 to 129 is any amino acid
  Variant (131)..(131): xaa in position 131 is any amino acid
  Variant (133)..(141): xaa in position 133 to 141 is any amino acid
  Variant (142)..(149): xaa in position 142 to 149 is any or no amino acid
  Variant (152)..(153): xaa in position 152 to 153 is any or no amino acid
  Variant (155)..(155): xaa in position 155 is any amino acid
  Variant (162)..(165): xaa in position 162 to 165 is any amino acid
  Variant (166)..(174): xaa in position 166 to 174 is any or no amino acid
  Variant (176)..(176): xaa in position 176 is any or no amino acid
  Variant (180)..(180): xaa in position 180 is any amino acid
  Variant (181)..(183): xaa in position 181 to 183 is any or no amino acid
  Variant (194)..(194): xaa in position 194 is any amino acid
  Variant (196)..(196): xaa in position 196 is any amino acid
  Variant (198)..(201): xaa in position 198 to 201 is any amino acid
  Variant (202)..(222): xaa in position 202 to 222 is any or no amino acid
  Variant (227)..(227): xaa in position 227 is any amino acid
  Variant (231)..(233): xaa in position 231 to 233 is any amino acid
  Variant (236)..(236): xaa in position 236 is any amino acid
  Variant (240)..(240): xaa in position 240 is any amino acid
  Variant (242)..(242): xaa in position 242 is any amino acid
  Variant (244)..(244): xaa in position 244 is any amino acid
  Variant (249)..(249): xaa in position 249 is any amino acid
  Variant (252)..(252): xaa in position 252 is any or no amino acid
  Variant (260)..(261): xaa in position 260 to 261 is any amino acid
  Variant (262)..(269): xaa in position 262 to 269 is any or no amino acid
  Variant (272)..(273): xaa in position 272 to 273 is any amino acid
  Variant (276)..(276): xaa in position 276 is any amino acid
  Variant (279)..(279): xaa in position 279 is any amino acid
  Variant (285)..(285): xaa in position 285 is any amino acid
  Variant (288)..(288): xaa in position 288 is any amino acid
  Variant (290)..(291): xaa in position 290 to 291 is any amino acid
  Variant (294)..(295): xaa in position 294 to 295 is any amino acid
  Variant (297)..(298): xaa in position 297 to 298 is any amino acid
  Variant (303)..(303): xaa in position 303 is any amino acid
  Variant (304)..(304): xaa in position 304 is any or no amino acid
  Variant (306)..(306): xaa in position 306 is any amino acid
  Variant (311)..(314): xaa in position 311 to 314 is any or no amino acid
  Variant (316)..(316): xaa in position 316 is any amino acid
  Variant (318)..(318): xaa in position 318 is any amino acid
  Variant (320)..(320): xaa in position 320 is any amino acid
  Variant (321)..(322): xaa in position 321 to 322 is any or no amino acid
  Variant (325)..(326): xaa in position 325 to 326 is any amino acid
  Variant (329)..(331): xaa in position 329 to 331 is any amino acid
  Variant (332)..(333): xaa in position 332 to 333 is any or no amino acid
  Variant (335)..(336): xaa in position 335 to 336 is any amino acid
  Variant (337)..(337): xaa in position 337 is any or no amino acid
  Variant (339)..(341): xaa in position 339 to 341 is any amino acid
  Variant (343)..(346): xaa in position 343 to 346 is any amino acid
  Variant (347)..(347): xaa in position 347 is any or no amino acid
  Variant (350)..(351): xaa in position 350 to 351 is any amino acid
  Variant (354)..(354): xaa in position 354 is any amino acid
  Variant (355)..(355): xaa in position 355 is any or no amino acid
  Variant (357)..(360): xaa in position 357 to 360 is any amino acid
  Variant (361)..(383): xaa in position 361 to 383 is any or no amino acid
  Variant (389)..(389): xaa in position 389 is any amino acid
  Variant (393)..(394): xaa in position 393 to 394 is any amino acid
  Variant (396)..(397): xaa in position 396 to 397 is any amino acid
  Variant (399)..(400): xaa in position 399 to 400 is any amino acid
  Variant (412)..(417): xaa in position 412 to 417 is any amino acid
  Variant (418)..(421): xaa in position 418 to 421 is any or no amino acid
  Variant (424)..(424): xaa in position 424 is any amino acid
  Variant (430)..(430): xaa in position 430 is any amino acid
  Variant (431)..(431): xaa in position 431 is any or no amino acid
  Variant (434)..(434): xaa in position 434 is any amino acid
  Variant (438)..(438): xaa in position 438 is any amino acid
  Variant (440)..(442): xaa in position 440 to 442 is any amino acid
  Variant (444)..(445): xaa in position 444 to 445 is any amino acid
  Variant (447)..(447): xaa in position 447 is any amino acid

SEQ ID NO: 60577 - protein, 17 aa, Artificial sequence
  Variant (2)..(2): xaa in position 2 is Asp, Gly, Asn, Gln or Ser
  Variant (3)..(3): xaa in position 3 is Phe or Tyr
  Variant (9)..(9): xaa in position 9 is any amino acid
  Variant (11)..(12): xaa in position 11 to 12 is any amino acid
  Variant (13)..(13): xaa in position 13 is any or no amino acid
  Variant (15)..(16): xaa in position 15 to 16 is any or no amino acid
WXXDGSSTXQXXXGXXS

SEQ ID NO: 60578 - protein, 51 aa, Artificial sequence; identical to SEQ ID NO: 21383
  Variant (2)..(6): xaa in position 2 to 6 is any amino acid
  Variant (8)..(23): xaa in position 8 to 23 is any amino acid
  Variant (24)..(26): xaa in position 24 to 26 is any or no amino acid
  Variant (28)..(28): xaa in position 28 is any amino acid
  Variant (30)..(30): xaa in position 30 is Asn, Pro, Gln or Thr
  Variant (32)..(32): xaa in position 32 is Phe or Tyr
  Variant (33)..(33): xaa in position 33 is any amino acid
  Variant (34)..(34): xaa in position 34 is Phe, Ile, Leu, Met or Val
  Variant (35)..(35): xaa in position 35 is Phe, Ile, Leu or Met
  Variant (36)..(50): xaa in position 36 to 50 is any amino acid
  Variant (51)..(51): xaa in position 51 is Ala, Gly, Ile, Leu or Pro

SEQ ID NO: 60579 - protein, 34 aa, Artificial sequence; identical to SEQ ID NO: 21384
  Variant (2)..(2): xaa in position 2 is any amino acid
  Variant (3)..(3): xaa in position 3 is Phe, Ile, Leu or Val
  Variant (4)..(4): xaa in position 4 is any amino acid
  Variant (5)..(5): xaa in position 5 is Asp, Glu or His
  Variant (6)..(11): xaa in position 6 to 11 is any amino acid
  Variant (12)..(12): xaa in position 12 is Ile, Leu, Met or Val
  Variant (13)..(13): xaa in position 13 is any amino acid
  Variant (14)..(14): xaa in position 14 is Ala or Ser
  Variant (15)..(15): xaa in position 15 is Glu or Gly
  Variant (16)..(16): xaa in position 16 is Phe, Ile, Leu or Val
  Variant (17)..(19): xaa in position 17 to 19 is any amino acid
  Variant (21)..(21): xaa in position 21 is any amino acid
  Variant (23)..(23): xaa in position 23 is Ala, Gly or Pro
  Variant (26)..(27): xaa in position 26 to 27 is any amino acid
  Variant (28)..(28): xaa in position 28 is Ala, Gly or Ser
  Variant (32)..(32): xaa in position 32 is Phe or Tyr
  Variant (34)..(34): xaa in position 34 is Ile or Val

SEQ ID NO: 60580 - protein, 33 aa, Artificial sequence; identical to SEQ ID NO: 21385
  Variant (2)..(2): xaa in position 2 is any amino acid
  Variant (3)..(3): xaa in position 3 is Ala, Gly or Ser
  Variant (5)..(5): xaa in position 5 is Phe, Trp or Tyr
  Variant (6)..(6): xaa in position 6 is Phe, Ile or Leu
  Variant (7)..(7): xaa in position 7 is Leu or Met
  Variant (8)..(8): xaa in position 8 is any amino acid
  Variant (10)..(10): xaa in position 10 is any amino acid
  Variant (11)..(11): xaa in position 11 is Ala, Cys, Gly, Ser or Thr
  Variant (12)..(14): xaa in position 12 to 14 is any amino acid
  Variant (15)..(15): xaa in position 15 is Ala, Asp, Glu, Gly or Asn
  Variant (16)..(18): xaa in position 16 to 18 is any amino acid
  Variant (19)..(19): xaa in position 19 is Glu, Asn, Ser or Thr
  Variant (20)..(22): xaa in position 20 to 22 is any amino acid
  Variant (25)..(25): xaa in position 25 is any amino acid
  Variant (26)..(26): xaa in position 26 is any or no amino acid
  Variant (28)..(28): xaa in position 28 is any amino acid
  Variant (29)..(30): xaa in position 29 to 30 is any or no amino acid

SEQ ID NO: 60581 - protein, 51 aa, Artificial sequence; identical to SEQ ID NO: 21386
  Variant (4)..(4): xaa in position 4 is any or no amino acid
  Variant (6)..(6): xaa in position 6 is any or no amino acid
  Variant (9)..(16): xaa in position 9 to 16 is any amino acid
  Variant (18)..(18): xaa in position 18 is Ala, Ile or Val
  Variant (19)..(19): xaa in position 19 is Ala, Gly, Pro or Ser
  Variant (20)..(20): xaa in position 20 is any amino acid
  Variant (22)..(22): xaa in position 22 is Ala, Gly or Ser
  Variant (23)..(23): xaa in position 23 is Ala, Cys, Gly, Ser or Thr
  Variant (25)..(25): xaa in position 25 is any amino acid
  Variant (27)..(36): xaa in position 27 to 36 is any amino acid
  Variant (37)..(37): xaa in position 37 is any or no amino acid
  Variant (39)..(39): xaa in position 39 is Trp or Tyr
  Variant (40)..(40): xaa in position 40 is any amino acid
  Variant (45)..(45): xaa in position 45 is Pro or Thr
  Variant (46)..(46): xaa in position 46 is Ala, Gly, Asn, Ser or Thr
  Variant (47)..(47): xaa in position 47 is Ala, Gly, Ser or Val
  Variant (48)..(48): xaa in position 48 is Asn, Gln or Ser
  Variant (49)..(50): xaa in position 49 to 50 is any amino acid
  Variant (51)..(51): xaa in position 51 is Ala or Pro

SEQ ID NO: 60582 - DNA, 276 bp, Escherichia coli
  CDS (1)..(276)
atggtggtgggggaaggattactcagcgctgcgcgcttcgcccttcgggtcgttgcctgcggcaacgctctctcgctggcgctcaagtcgaaccttggtcgaagcttctcatccttccccgcttgggcagaatatttgattgcggattcgtttgagaattccggggcttttgaaagtgatggtggtgggggaaggattactcagcgctgcgcgcttcgcccttcgggtcgttgcctgcggcaacgctctctcgctgacgctcgagccgaaccttag

SEQ ID NO: 60583 - protein, 91 aa, Escherichia coli
MVVGEGLLSAARFALRVVACGNALSLALKSNLGRSFSSFPAWAEYLIADSFENSGAFESDGGGGRITQRCALRPSGRCLRQRSLADARAEP

SEQ ID NO: 60584 - DNA, 570 bp, Escherichia coli O157:H7 EDL933
  CDS (1)..(570): transl_table=11
gtgatggtggtgggggaaggattactcagcgctgcgcgcttcgcccttcaggtcgttgcctgcggcaacgctctctcgctggcgctcgagtcgaaccttagtcgaagcttctcatccttctccgcttgggcagaatatttatttacggattcgcttgagagttcagggacttttgaaagtgatggtggtgggggaaggattcgaaccttcgaagtcgatgacggcagatttacagtctgctccctttggccgctcgggaaccccaccaggggtaattcaaattttgaggtaatgcttgagatggcggtggggaaaggattattcgtcgcttcgctcctcacccttcgggccgttgcctgtgaaaacgttctctcgctttcgctcgagtcgaaccttagtcgaaggttctcacccttccccgatgagtgcaaactttcacaatctcaccgaagttaccacatcgctgtggtgaatcatggtggtgggggaaggattcgaaccttcgaagtcgatgacggcagatttacagtctgctccctttggccgctcgggaaccccaccacggggtaa

SEQ ID NO: 60585 - protein, 189 aa, Escherichia coli O157:H7 EDL933
MMVVGEGLLSAARFALQVVACGNALSLALESNLSRSFSSFSAWAEYLFTDSLESSGTFESDGGGGRIRTFEVDDGRFTVCSLWPLGNPTRGNSNFEVMLEMAVGKGLFVASLLTLRAVACENVLSLSLESNLSRRFSPFPDECKLSQSHRSYHIAVVNHGGGGRIRTFEVDDGRFTVCSLWPLGNPTTG

SEQ ID NO: 60586 - DNA, 276 bp, Escherichia coli O157:H7
  CDS (1)..(276): transl_table=11
atggtggtgggggaaggattactcagcgctgcgcgcttcgcccttcgggtcgttgcctgcggcaacgctctctcgctggcgctcaagtcgaaccttggtcgaagcttctcatccttccccgcttgggcagaatatttaattacggattcgtttgagagttcagggacttttgaaagtgatggtggtgggggaaggattactcagcgctgcgcgcttcgcccttcaggtcgttgcctgcggcaacgctctctcgctggcgctcgagtcgaaccttag

SEQ ID NO: 60587 - protein, 91 aa, Escherichia coli O157:H7
MVVGEGLLSAARFALRVVACGNALSLALKSNLGRSFSSFPAWAEYLITDSFESSGTFESDGGGGRITQRCALRPSGRCLRQRSLAGARVEP

SEQ ID NO: 60588 - DNA, 570 bp, Escherichia coli K12
  CDS (1)..(570): transl_table=11
gtgatggtggtgggggaaggattactcagcgctgcgcgcttcgcccttcgggtcgttgcctgcggcaacgctctctcgctggcgctcgagtcgaaccttggtcgaagcttctcatccttccccgcatgggcagaatatttaattgcggattcgttgggaagttcagggacttttgaaagtgatggtggtgggggaaggattcgaaccttcgaagtcgatgacggcagatttacagtctgctccctttggccgctcgggaaccccaccaggggtaattcaaattttgaggtaatgcttgagatggtggtgggggaaggattattcgtcgcttcgctcctcacccttcgggccgttgcctgtggcaacgttctctcgctttcgctcgaatcgaaccttagtcgaaggttctcacccttccccgatgagtgcaaactttcacaatctcaccgaagttaccacatcgctgtggtgaattatggtggtgggggaaggattcgaaccttcgaagtcgatgacggcagatttacagtctgctccctttggccgctcgggaaccccaccacggggtaa

SEQ ID NO: 60589 - protein, 189 aa, Escherichia coli K12
MMVVGEGLLSAARFALRVVACGNALSLALESNLGRSFSSFPAWAEYLIADSLGSSGTFESDGGGGRIRTFEVDDGRFTVCSLWPLGNPTRGNSNFEVMLEMVVGEGLFVASLLTLRAVACGNVLSLSLESNLSRRFSPFPDECKLSQSHRSYHIAVVNYGGGGRIRTFEVDDGRFTVCSLWPLGNPTTG

SEQ ID NO: 60590 - DNA, 22 bp, Artificial sequence
  (1)..(22): primer
atggtggtgggggaaggattac

SEQ ID NO: 60591 - DNA, 23 bp, Artificial sequence
  (1)..(23): primer
ttaaggttcggctcgagcgtcag

SEQ ID NO: 60592 - protein, 99 aa, Artificial sequence
  Variant (16)..(16): xaa in position 16 is any amino acid
  Variant (29)..(29): xaa in position 29 is any amino acid
  Variant (33)..(33): xaa in position 33 is any amino acid
  Variant (40)..(40): xaa in position 40 is any amino acid
  Variant (47)..(48): xaa in position 47 to 48 is any amino acid
  Variant (51)..(53): xaa in position 51 to 53 is any amino acid
  Variant (56)..(56): xaa in position 56 is any amino acid
  Variant (67)..(69): xaa in position 67 to 69 is any amino acid
  Variant (70)..(78): xaa in position 70 to 78 is any or no amino acid
  Variant (80)..(80): xaa in position 80 is any amino acid
  Variant (82)..(82): xaa in position 82 is any amino acid
  Variant (84)..(84): xaa in position 84 is any amino acid
  Variant (86)..(88): xaa in position 86 to 88 is any amino acid
  Variant (90)..(91): xaa in position 90 to 91 is any amino acid
  Variant (93)..(98): xaa in position 93 to 98 is any amino acid
MVVGEGLLSAARFALXVVACGNALSLALXSNLXRSFSSFXAWAEYLXXDSXXXSGXFESDGGGGRIXXXXXXXXXXXXCXLXPXGXXXRXXSXXXXXXE

SEQ ID NO: 60593 - protein, 66 aa, Artificial sequence
  Variant (16)..(16): xaa in position 16 is any amino acid
  Variant (29)..(29): xaa in position 29 is any amino acid
  Variant (33)..(33): xaa in position 33 is any amino acid
  Variant (40)..(40): xaa in position 40 is any amino acid
  Variant (47)..(48): xaa in position 47 to 48 is any amino acid
  Variant (51)..(53): xaa in position 51 to 53 is any amino acid
  Variant (56)..(56): xaa in position 56 is any amino acid
MVVGEGLLSAARFALXVVACGNALSLALXSNLXRSFSSFXAWAEYLXXDSXXXSGXFESDGGGGRI

SEQ ID NO: 60594 - DNA, 264 bp, Escherichia coli
  CDS (1)..(264)
atgcacactaactggcaagtttgcagcctggtcgtgcaggccaaaagcgaacgaatttcagacatcagcacccaactgaacgcctttcccggctgtgaagttgctgtcagcgacgcgccgagcggtcagttgattgtggtggtggaagcagaagacagcgaaacgctgatccaaaccattgagtcagtacgcaacgtagagggcgtgctggcggtgtcgctggtttatcaccagcaggaagagcaaggtgaggaaacaccatga

SEQ ID NO: 60595 - protein, 87 aa, Escherichia coli
MHTNWQVCSLVVQAKSERISDISTQLNAFPGCEVAVSDAPSGQLIVVVEAEDSETLIQTIESVRNVEGVLAVSLVYHQQEEQGEETP

SEQ ID NO: 60596 - DNA, 342 bp, Vibrio cholerae O1 biovar eltor str. N16961
  CDS (1)..(342): transl_table=11
gtggataaattggagagcaagatgtcacaaccctcagcttcactgcacgaagtacacatttccagcttggtggttcacaccttgccagagcatttgctcacagtgaaacagcaggtgagcgagctgcgtgatgtggaaatttacggcgaggatccgcaaggcaaactcgtcgttgtgattgaaaccgatcgtcaaggcttcatcaccgaaaccatagaacatattaataatcttcccaatgtgctcaacgcttttctggtgtttcatcagatagagacggtaacggaagaagaacaattacacactggaaataccttttctgaactcgagggtaatgtatga

SEQ ID NO: 60597 - protein, 113 aa, Vibrio cholerae O1 biovar eltor str. N16961
MDKLESKMSQPSASLHEVHISSLVVHTLPEHLLTVKQQVSELRDVEIYGEDPQGKLVVVIETDRQGFITETIEHINNLPNVLNAFLVFHQIETVTEEEQLHTGNTFSELEGNV

SEQ ID NO: 60598 - DNA, 276 bp, Pasteurella multocida subsp. multocida str. Pm70
  CDS (1)..(276): transl_table=11
atgactgaacaaatcacaatggaaaatgcgaaaaattggcatgtctgtgggcttgtgattcaagggaatccccaaaaattagaagcaattcagaccgcacttttagcaataccgtatacggaaattcctgcattggacgcggaaaccggtaagcttgttgtggtgatgcaatcgcacgatcaacatcttttacatcaacaaatggaagcgacacgcgatattgacggcgtcattgacgtgtccttggtttaccatcaacaagacgaaaacgaataa

SEQ ID NO: 60599 - protein, 91 aa, Pasteurella multocida subsp. multocida str. Pm70
MTEQITMENAKNWHVCGLVIQGNPQKLEAIQTALLAIPYTEIPALDAETGKLVVVMQSHDQHLLHQQMEATRDIDGVIDVSLVYHQQDENE

SEQ ID NO: 60600 - DNA, 330 bp, Pseudomonas aeruginosa PAO1
  CDS (1)..(330): transl_table=11
atgcctgaagccctgcagatcgccagcctcatcctgcattgccgacccgagcgactgccggcggtgaaggccaacctggcgctgctcgacggcctggagatctaccaggaaagcccgcagggcaagctgatcctggtgctggaagccgaacgcgaagaacagattctcgacaccctgggccagttgcagaacctgccaggagtgctcaacgccgtgctggtctaccacgagatcctgcacgacgacgatagcaacgacgcggcggccatgaccgaccgcgcgataccgtgctcgcccgaggagacaatcgatgaacctcacccgtcgtga

SEQ ID NO: 60601 - protein, 109 aa, Pseudomonas aeruginosa PAO1
MPEALQIASLILHCRPERLPAVKANLALLDGLEIYQESPQGKLILVLEAEREEQILDTLGQLQNLPGVLNAVLVYHEILHDDDSNDAAAMTDRAIPCSPEETIDEPHPS

SEQ ID NO: 60602 - DNA, 264 bp, Salmonella typhimurium LT2
  CDS (1)..(264): transl_table=11
atgcgcactaactggcaggtctgtagcctggtcgtgcaggccaaaagtcagaacatcgccgccattggcacacagttgaacacgttgccgggttgcgaagtcgcgttaagcgatgttgaaagcgggcaactgatcgtggtggcggaagcagatcagagtgaaacgctgatgcaaacaattgagtcagtacgcaatgtcgagggcgtactggcggtgtcgctggtttatcaccagcaggatgagcaaggtgaggaaacaccatga

SEQ ID NO: 60603 - protein, 87 aa, Salmonella typhimurium LT2
MRTNWQVCSLVVQAKSQNIAAIGTQLNTLPGCEVALSDVESGQLIVVAEADQSETLMQTIESVRNVEGVLAVSLVYHQQDEQGEETP

SEQ ID NO: 60604 - DNA, 273 bp, Yersinia pestis KIM
  CDS (1)..(273): transl_table=11
gtgaagatggacgataacgaatggcatgtttgtggattggtgctgcaagccaaaccggcacgttttgtgcagctgatggaccacctgctcgctatcccgggaacagaaatacccaccagtgaccctgctttgggcaagttggtggtggttatgcaggcagcgcgctcagacacgctcctgaatcatattgagtcagcacgtaatctggatggtgtgttggctgtatcgctggtttatcaccagcaggatttgcaaggtgaggaaatgccatga

SEQ ID NO: 60605 - protein, 90 aa, Yersinia pestis KIM
MKMDDNEWHVCGLVLQAKPARFVQLMDHLLAIPGTEIPTSDPALGKLVVVMQAARSDTLLNHIESARNLDGVLAVSLVYHQQDLQGEEMP

SEQ ID NO: 60606 - DNA, 285 bp, Shewanella oneidensis MR-1
  CDS (1)..(285): transl_table=11
atgagtcaggaataccatgttaccagcctcgtggtacatgccgcgcccaatgccttacaacaggtagaggccgatataaccgccttaaagggctgcgatatccacgccatttcccccgaaggtaaattggttattaccctcgaaggagatagccaaaaggccattctcgataatgttgaagccatcaatgccctgtccggcgtgttatccgccagtttgatttaccaccaagtcgagcccctagaacaagaactgttagaaaaaatgagtgaggaaacactatga

SEQ ID NO: 60607 - protein, 94 aa, Shewanella oneidensis MR-1
MSQEYHVTSLVVHAAPNALQQVEADITALKGCDIHAISPEGKLVITLEGDSQKAILDNVEAINALSGVLSASLIYHQVEPLEQELLEKMSEETL

SEQ ID NO: 60608 - DNA, 306 bp, Vibrio vulnificus CMCP6
  CDS (1)..(306): transl_table=11
atggcactaaatgaagtgcatatttcaagtttagtggtacacgtggcccctgagcacttaggcacgataaagacgcagatcgaaaccatcgagaacgcggaaatttatggtgatagcccagaaggcaaaatcgtcgtggttctggaaaccgaaaaccaaggtttcgttaccgacaccattgaaaccatcaacaatttaccgaacgttctcagcacggttctggtttatcaccaaattgaaaccgatctggatgacacggacgaagacactggaacacaacattcccaaatcgagggtgaagtatga

SEQ ID NO: 60609 - protein, 101 aa, Vibrio vulnificus CMCP6
MALNEVHISSLVVHVAPEHLGTIKTQIETIENAEIYGDSPEGKIVVVLETENQGFVTDTIETINNLPNVLSTVLVYHQIETDLDDTDEDTGTQHSQIEGEV

SEQ ID NO: 60610 - DNA, 333 bp, Bradyrhizobium japonicum USDA 110
  CDS (1)..(333): transl_table=11
atggcccaaccctcactcaatcataaagtcacgctcaaccgccgcgccttgatcaccggccgggtgctcagcgccgaccgtatcgtgccgccgccgggctacgaaatcgccagcatcatcgtgcaggcgcgccccgagcgcctcgccgaggtcgaagccgagatcattgcgcttgccggctgcgagatccacggccgcgacccgcgcggcaagctcgtcgtcgtgaccgaagcgccggatgccggcagcctcggcaccatgctcaacaccatccagtcgctgcaacacgtctattccgcggcgctggtcttccacgccatcgaaaccgcctga

SEQ ID NO: 60611 - protein, 110 aa, Bradyrhizobium japonicum USDA 110
MAQPSLNHKVTLNRRALITGRVLSADRIVPPPGYEIASIIVQARPERLAEVEAEIIALAGCEIHGRDPRGKLVVVTEAPDAGSLGTMLNTIQSLQHVYSAALVFHAIETA

SEQ ID NO: 60612 - DNA, 309 bp, Vibrio parahaemolyticus RIMD 2210633
  CDS (1)..(309): transl_table=11
atgtcactaaatgaagtgcatatttcaagtttggtagtgcacgtgctgcctgagcatctggatgaaattaagacgcaaattgaaacgtatgaaaacgcggaaatttacggagacagtccagaaggcaaaatcgttgtagtgcttgaaaccgaaaaccaaggtttcatcacagacactatcgatgccattaacaatttaccgaatgttttgagcacagtgttggtttatcaccaaatcgaaactgcgcttgaagaaacggatgaagaagacactggaacacaacattcccaaatcgagggtgaagtatga

SEQ ID NO: 60613 - protein, 102 aa, Vibrio parahaemolyticus RIMD 2210633
MSLNEVHISSLVVHVLPEHLDEIKTQIETYENAEIYGDSPEGKIVVVLETENQGFITDTIDAINNLPNVLSTVLVYHQIETALEETDEEDTGTQHSQIEGEV

SEQ ID NO: 60614 - DNA, 360 bp, Helicobacter hepaticus ATCC 51449
  CDS (1)..(360): transl_table=11
atgaatatctcaagtatcgttgtgaaaactactcaagaaagttttgaatctgtaaaaaatgctattaaagaaatacagggttgtgaaatatatattgaagacaaagctacaaatcagcttattgtcgttatagaatctcaaaacaccgaagaagaagtagctattaacaaacatatagaatctatggcgggagtaatgagcgcaaatatgcactatgcctatcaagaagatgagattaacgcacaacttaaatccatagatggtggtataagcgagtttctcaataatgattctatccctgctgaaaatattgcttactctggttctatagcacatcttatggggaaaaagcgcaaataa

SEQ ID NO: 60615 - protein, 119 aa, Helicobacter hepaticus ATCC 51449
MNISSIVVKTTQESFESVKNAIKEIQGCEIYIEDKATNQLIVVIESQNTEEEVAINKHIESMAGVMSANMHYAYQEDEINAQLKSIDGGISEFLNNDSIPAENIAYSGSIAHLMGKKRK

SEQ ID NO: 60616 - DNA, 264 bp, Haemophilus ducreyi 35000HP
  CDS (1)..(264): transl_table=11
atgaatacttttcgtgaagaccaaaattggtatgtttgtagtttagtagtacaagcgaagcctgccaaattaccccaagtgaaagcggatattttaactattcctcacgctgaaattcatggcgaaaaagcagaagaaggtaaattagtcgtgactttagagagtgatcatcaattagcgttagcggacttaattgataagctaaaagagatcaacggcgtgatcgttgtttcgttaatatctaattaccttgatgaaaaataa

SEQ ID NO: 60617 - protein, 87 aa, Haemophilus ducreyi 35000HP
MNTFREDQNWYVCSLVVQAKPAKLPQVKADILTIPHAEIHGEKAEEGKLVVTLESDHQLALADLIDKLKEINGVIVVSLISNYLDEK

SEQ ID NO: 60618 - DNA, 336 bp, Bordetella bronchiseptica RB50
  CDS (1)..(336): transl_table=11
atggcgcagccccccatgtcagcgcttccctcccgcgcactcgccccgccgccggtggccgagctgcatatcaccagcatggtcgtgcacgccctgcccgggcgcgcgcaggcgctgggcgcggccatcgccgccctgcccggcgcggaaatccatgcggtgtccgataccggcaagctggtcgtcacgctcgaagcccacagcacaggcgaaatgctggagcgcatcgccgccgtgcagggccaggacggcgtgctcgcttcggcgatggtctatcaacatatcgatactttggactcgatgaacgaggagattgacgatgtcaatggctcgtag

SEQ ID NO: 60619 - protein, 111 aa, Bordetella bronchiseptica RB50
MAQPPMSALPSRALAPPPVAELHITSMVVHALPGRAQALGAAIAALPGAEIHAVSDTGKLVVTLEAHSTGEMLERIAAVQGQDGVLASAMVYQHIDTLDSMNEEIDDVNGS

SEQ ID NO: 60620 - DNA, 306 bp, Vibrio vulnificus YJ016
  CDS (1)..(306): transl_table=11
atggcactaaatgaagtgcatatttcaagtttagtggtacacgtagcccctgagcacctaggcacgataaagacgcagatcgaagccatcgagaacgcggaaatttatggtgatagcccagaaggcaaaatcgtcgtggttctggaaaccgaaaaccaaggtttcgttaccgacaccattgaaaccatcaacaatttaccgaacgttctcagcacggttctggtttatcaccaaattgaaaccgatctggatgacacggacgaagacactggaacacaacattcccaaatcgagggtgaagtatga

SEQ ID NO: 60621 - protein, 101 aa, Vibrio vulnificus YJ016
MALNEVHISSLVVHVAPEHLGTIKTQIEAIENAEIYGDSPEGKIVVVLETENQGFVTDTIETINNLPNVLSTVLVYHQIETDLDDTDEDTGTQHSQIEGEV

SEQ ID NO: 60622 - DNA, 330 bp, Cupriavidus necator
  CDS (1)..(330): transl_table=11
atgccgactgcgaagcgtgccatccccatacagccactcccatgcggcgaggagtggcatatcgccggcatcgtggtgcacacccttcccgacagcctgccccaggtgcgagcggccattgaggccataaccggcgccgagatccacgcggtcagcgacgacggcaagctggtcgtcaccgtcgaggcgcccacgtcgcgcgccattgccgcacacctcacctgcctccaccagttggagggcgtgctctccgccgcgctggtctaccagcacaacgaagacgccgcagcgatgaacgaggagatggccgatgaagatctctcgtcgtga

SEQ ID NO: 60623 - protein, 109 aa, Cupriavidus necator
MPTAKRAIPIQPLPCGEEWHIAGIVVHTLPDSLPQVRAAIEAITGAEIHAVSDDGKLVVTVEAPTSRAIAAHLTCLHQLEGVLSAALVYQHNEDAAAMNEEMADEDLSS

SEQ ID NO: 60624 - DNA, 270 bp, Erwinia carotovora subsp. atroseptica SCRI1043
  CDS (1)..(270): transl_table=11
atgagcacagtctggcatgtttgcagtgtcgtggttcacgtcaagacggaacgtatggcggcggtgagcgacgtattggaaaaattacccaatgtggaggttgccgccagcgatagcgataccggaaaaatggccgtggtgctggagtcagattcagaagacacgctgttaaaacacatagcgtcaatacgcgagcttgcaggcgtattggcggtttcgctggtttatcaccagcttgatgaacaatctcagggtgaggaaataccatga

SEQ ID NO: 60625 - protein, 89 aa, Erwinia carotovora subsp. atroseptica SCRI1043
MSTVWHVCSVVVHVKTERMAAVSDVLEKLPNVEVAASDSDTGKMAVVLESDSEDTLLKHIASIRELAGVLAVSLVYHQLDEQSQGEEIP

SEQ ID NO: 60626 - DNA, 267 bp, Yersinia pseudotuberculosis IP 32953
  CDS (1)..(267): transl_table=11
atggacgataacgaatggcatgtttgtggattggtgctgcaagccaaaccggcacgttttgtgcagcttatggaccacctgctcgctatcccgggaacagaaatacccaccagtgaccctgctttgggcaagttggtggtggttatgcaggcagcgcgctcagacacgctcctgaatcatattgagtcagcgcgtaatctggatggtgtgctggctgtatcgctggtttatcaccagcaggatttgcaaggtgaggaaatgccatga

SEQ ID NO: 60627 - protein, 88 aa, Yersinia pseudotuberculosis IP 32953
MDDNEWHVCGLVLQAKPARFVQLMDHLLAIPGTEIPTSDPALGKLVVVMQAARSDTLLNHIESARNLDGVLAVSLVYHQQDLQGEEMP

SEQ ID NO: 60628 - DNA, 264 bp, Mannheimia succiniciproducens MBEL55E
  CDS (1)..(264): transl_table=11
atgagtaattttaatttaaacgaaaactggtatgtgtgtagtcttgtagttcaagccagaccggaaaaactttcacaggtgaaagcggatattttagctattccgaccgctgaaattcacggtgaaaagctggaagaaggtaaacttgtggttaccttggaaagtagcagacagcttgccttagctgatttaatcgatgaagttaaagatataagcggagtgatcgtggtgtctttaatttcaaattatcttgatgaaaaatag

SEQ ID NO: 60629 - protein, 87 aa, Mannheimia succiniciproducens MBEL55E
MSNFNLNENWYVCSLVVQARPEKLSQVKADILAIPTAEIHGEKLEEGKLVVTLESSRQLALADLIDEVKDISGVIVVSLISNYLDEK

SEQ ID NO: 60630 - DNA, 273 bp, Photobacterium profundum SS9
  CDS (1)..(273): transl_table=11
atggcgcaagaagaagtacatatatcaagcctagttgttcatgtaaaacctgaatatttagaagaagtaaaagctcagatacttgaaatgccaaatactgaaatacctggcgaaagccctgagggaaagattattgtagtattggaaacagcaaatcaaggatatgttactgatactatagataaaataaataatttagaacatgtgttaataacttttttagtgtatcaccaaattgaacactttgattcgcaatctgaggatgattcatga

SEQ ID NO: 60631 - protein, 90 aa, Photobacterium profundum SS9
MAQEEVHISSLVVHVKPEYLEEVKAQILEMPNTEIPGESPEGKIIVVLETANQGYVTDTIDKINNLEHVLITFLVYHQIEHFDSQSEDDS

SEQ ID NO: 60632 - DNA, 264 bp, Salmonella enterica subsp. enterica serovar Paratyphi A str. ATCC
  CDS (1)..(264): transl_table=11
atgcacactaactggcaggtctgtagcctggtcgtgcaggccaaaagtcagaacatcgccgccattggcacacaattgaacacgttgccgggttgcgaagtcgcgttaagcgacgttgaaagcgggcaactgatcgtggtggcggaagcagatcagagtgaaacgctgatgcaaacaattgagtcagtacgcaatgttgagggcgtgctggcggtgtcgctggtttatcaccagcaggatgagcaaggtgaggaaacaccatga

SEQ ID NO: 60633 - protein, 87 aa, Salmonella enterica subsp. enterica serovar Paratyphi A str. ATCC
MHTNWQVCSLVVQAKSQNIAAIGTQLNTLPGCEVALSDVESGQLIVVAEADQSETLMQTIESVRNVEGVLAVSLVYHQQDEQGEETP

SEQ ID NO: 60634 - DNA, 285 bp, Vibrio fischeri ES114
  CDS (1)..(285): transl_table=11
atgttagagaatttgcctgaaaatgaagttcatatttcaagcttagtggttcatgtaagacctgagtcactggaaataacaaaagaaaagatattagcactgccgaatacggaaatatatggagaaagtgaagagggcaagattattgttgttcttgaaactgaaaaccaaggatatatcaccgattcaatcgataaaataaatgacttcgaagacgtactaaatgtcgctttagtatttcaccaaatcgagcactttgattcgcaatgtgaggatgaatcatga

SEQ ID NO: 60635 - protein, 94 aa, Vibrio fischeri ES114
MLENLPENEVHISSLVVHVRPESLEITKEKILALPNTEIYGESEEGKIIVVLETENQGYITDSIDKINDFEDVLNVALVFHQIEHFDSQCEDES

SEQ ID NO: 60636 - DNA, 531 bp, Salmonella enterica subsp. enterica serovar Choleraesuis str
  CDS (1)..(531): transl_table=11
atgcctgtgcgcaggcctgtactgaatcgctttttcttccgcgccacaccagggcctgggatctggtttttacgctcacggaaaactgcctcgccaggcaatcggttgaatgccatcgttgccaggacagttgtgaacctatggccattacctttcgtcccacgctatccggcatttaccagccgcagcttgacccgcaggcctgtaacggatgcggggcgtgtgtggctatctgtcccgtgtcagccatcaaagcggagaaccaccatgcgcactaactggcaggtctgtagcctggtcgtgcaggccaaaagtcagaacatcgccgccattggcacacagttgaacacgttgccgggttgcgaagtcgcgttaagcgacgttgaaagcgggcaactgatcgtggtggcggaagcagaccagagtgaaacgctgatgcaaacaattgagtcagtacgcaatgtcgagggcgtactggcggtgtcgctggtttatcaccagcaggatgagcaaggtgaggaaacaccatga

SEQ ID NO: 60637 - protein, 176 aa, Salmonella enterica subsp. enterica serovar Choleraesuis str
MPVRRPVLNRFFFRATPGPGIWFLRSRKTASPGNRLNAIVARTVVNLWPLPFVPRYPAFTSRSLTRRPVTDAGRVWLSVPCQPSKRRTTMRTNWQVCSLVVQAKSQNIAAIGTQLNTLPGCEVALSDVESGQLIVVAEADQSETLMQTIESVRNVEGVLAVSLVYHQQDEQGEETP

SEQ ID NO: 60638 - DNA, 282 bp, Haemophilus influenzae 86-028NP
  CDS (1)..(282): transl_table=11
atgaataatacaaatttaatattagaaaatgcgagggattggcacgttgttggattgatcgtgcaaggtaatccaaaaaaattatcagcaattcaaaccgcacttttagcgattgagcatactgaaattccgacttttgatgaaaaacttggaaaatttgtggtggtaatgcaatcgaacgatcagcatctcttgcttgaaaaaatggaaagtgtgaaagatatcgacggtgtgattaatgtatcgttggtgtatcacgagcaagatgaacaaaataaataa

SEQ ID NO: 60639 - protein, 93 aa, Haemophilus influenzae 86-028NP
MNNTNLILENARDWHVVGLIVQGNPKKLSAIQTALLAIEHTEIPTFDEKLGKFVVVMQSNDQHLLLEKMESVKDIDGVINVSLVYHEQDEQNK

SEQ ID NO: 60640 - DNA, 339 bp, Ralstonia eutropha JMP134
  CDS (1)..(339): transl_table=11
atgccagctgcaagatcttttatacccatcgggccggtctccgccggcgaggaatggcatatcgccgggattgtcgtgtacgcgcatcccgacagcgtgagccgcgtgcgcgccgccgtcgaagccatgacgggcgtggagatccatgctgccagcgaagccggcaagctggtcgtcaccgtcgaagccccctcctcccgcgccattgccgcgcagctgacctgccttcaccagctcgaaggcgtgctgtcggccaccctggtctatcagcacaacgaagacgccgaagccatgaacgaggagatcgacgatgaaagtctctcgtcgggatttcattaa

SEQ ID NO: 60641 - protein, 112 aa, Ralstonia eutropha JMP134
MPAARSFIPIGPVSAGEEWHIAGIVVYAHPDSVSRVRAAVEAMTGVEIHAASEAGKLVVTVEAPSSRAIAAQLTCLHQLEGVLSATLVYQHNEDAEAMNEEIDDESLSSGFH

SEQ ID NO: 60642 - DNA, 315 bp, Magnetospirillum magnetotacticum MS-1
  CDS (1)..(315)
atgagactcgcgaacttcgttgccaccgagaagtccaagcccagggagcaggtggagaatatctgcggcgtgctgatccacgccaagccggagcgcaggcacgaggttcaggacgccctcggccggatacccggcgtcgaggttcacaccatgaccgacgatggccggatggttgttaccgtcgaggatgcccagggcaactgggcgggcgccaccatcaccagcctgaccgacatccggggcattttgaacgtgtccttggtctatcaccattttgattccgatcttgatctggaaggggagagtttttcatga

SEQ ID NO: 60643 - protein, 104 aa, Magnetospirillum magnetotacticum MS-1
MRLANFVATEKSKPREQVENICGVLIHAKPERRHEVQDALGRIPGVEVHTMTDDGRMVVTVEDAQGNWAGATITSLTDIRGILNVSLVYHHFDSDLDLEGESFS

SEQ ID NO: 60644 - DNA, 270 bp, Actinobacillus pleuropneumoniae serovar 1 str. 4074
  CDS (1)..(270)
atgagtacggaaaacttaaacgaagcgaaaaactggtatgtatgtagcttagtcgttcaagcaaaaccagcaaaattagcgcaagtgaaagcggacattcttaccattccgtttgcagaaattcatggtgagaaagccgaggaaggcaaactggtagtgacacttgagagtgacagacagcttgctttagccgatttaatcgatcaggtaaaggatattgacggtgtgattgtcgtattgttaatttccaattatctggatgaacaatag

SEQ ID NO: 60645 - protein, 89 aa, Actinobacillus pleuropneumoniae serovar 1 str. 4074
MSTENLNEAKNWYVCSLVVQAKPAKLAQVKADILTIPFAEIHGEKAEEGKLVVTLESDRQLALADLIDQVKDIDGVIVVLLISNYLDEQ

SEQ ID NO: 60646 - DNA, 282 bp, Haemophilus influenzae R2846
  CDS (1)..(282)
atgaataatacaaatttaatattagaaaatgcgggagattggcacgttgttggattgatcgtgcaaggtaatccaaaaaaactatcagcaattcaaaccgcacttttagcgattgagcatactgaaattccgacttttgatgaaaaacttgggaaatttgtggtggtaatgcaatcgtacgatcagcatctcttgcttgaaaaaatggaaagtgtgaaagatatcgacggtgtgattaatgtatcgttggtgtatcacgagcaagatgaacaaaataaataa

SEQ ID NO: 60647 - protein, 93 aa, Haemophilus influenzae R2846
MNNTNLILENAGDWHVVGLIVQGNPKKLSAIQTALLAIEHTEIPTFDEKLGKFVVVMQSYDQHLLLEKMESVKDIDGVINVSLVYHEQDEQNK

SEQ ID NO: 60648 - DNA, 258 bp, Shewanella baltica OS155
  CDS (1)..(258): transl_table=11
atgagcaacgaactccatatcaccagtttagtggtgcaggtcttaccgcagaaaatggcagacgttagacaagagatcatgaccattgaaaatgccgaactttccgtcaacaacgaagtgaagttggtcgtagtcatcgagggcgagactcagcgcgccttgatggacagtatagaagcgatcaatgccattccgggcgtgttatccgccactatggtttaccaccagagtgaagtgctcgaagagggtgaagaatga

SEQ ID NO: 60649 - protein, 85 aa, Shewanella baltica OS155
MSNELHITSLVVQVLPQKMADVRQEIMTIENAELSVNNEVKLVVVIEGETQRALMDSIEAINAIPGVLSATMVYHQSEVLEEGEE

SEQ ID NO: 60650 - DNA, 270 bp, Shewanella baltica OS155
  CDS (1)..(270): transl_table=11
atgagtcaggaataccacgtcaccagccttgtggtgcatgccgcacctaaagtcttacagcaggttgaagccaatatccgctcattaatgggcgccgatattcatgcggttacgcccgaagggaaattggttgtcaccctcgaagggagtagccaaagggcgatactcgacaatattgaagccatcaatgccctgtccggcgtgttatctgccagtttgatttaccaccaagtcgcacctttagaacaagagagtgaggaaagattatga

SEQ ID NO: 60651 - protein, 89 aa, Shewanella baltica OS155
MSQEYHVTSLVVHAAPKVLQQVEANIRSLMGADIHAVTPEGKLVVTLEGSSQRAILDNIEAINALSGVLSASLIYHQVAPLEQESEERL

SEQ ID NO: 60652 - DNA, 270 bp, Shewanella amazonensis SB2B
  CDS (1)..(270): transl_table=11
atgacacaggaatatcacgtcaccagtctggtggtgcatgccgcccccagccaggccaatgtcatcagtgatgccattgacgccctgcccggcgccgaggttcatgccaccagtcccgaaggcaagttggtcgtcaccctggaagggtcaacccagcgagccattctcgacaatgtcgaggccatcaatgcccttaacggggtgctatccagcagtctgatctatcaccaatcagagcaagaacaacaagtgagtgaggaaacaccatga

SEQ ID NO: 60653 - protein, 89 aa, Shewanella amazonensis SB2B
MTQEYHVTSLVVHAAPSQANVISDAIDALPGAEVHATSPEGKLVVTLEGSTQRAILDNVEAINALNGVLSSSLIYHQSEQEQQVSEETP

SEQ ID NO: 60654 - DNA, 330 bp, Ralstonia metallidurans CH34
  CDS (1)..(330): transl_table=11
atgccagcatcaggagtgtcgattcccatcgtgcccgtgccggccggcgaagagtggcatatcgccggcatcatggtgtacgcgaacccggaaaagctcgatgccgtctgctcggccatcgacgccatgactggcatggagatccatgcgatcagtgacgccggcaagatcgtcgtcaccgcggaagcacccagctcgcgcgccatcgccgcgcaactcacctgtctgcatcaactcgaaggcgtcttttccgccacgctggtctaccagcacaacgaagatgccgccgccatgaacgaggagatctccgatgccactcacgcgccgtga

SEQ ID NO: 60655 - protein, 109 aa, Ralstonia metallidurans CH34
MPASGVSIPIVPVPAGEEWHIAGIMVYANPEKLDAVCSAIDAMTGMEIHAISDAGKIVVTAEAPSSRAIAAQLTCLHQLEGVFSATLVYQHNEDAAAMNEEISDATHAP

SEQ ID NO: 60656 - DNA, 258 bp, Shewanella frigidimarina NCIMB 400
  CDS (1)..(258): transl_table=11
atgagcaatgaacttcacgtaaccagcctaattgtccaagtacaccctgagcaaatggctgaagtaagacaaaaaattatggccatcaaaaatgctgagttgtcagctaataatgacgttaagttagttgttgtcgttgaaggtccgagccaacgatcgttgatggatgatatatcaacaattaatgccattccgggtgtgttgactgccaccatggtgtatcaccaaagtgaagagcttgaagaaggtgaagtatga

SEQ ID NO: 60657 - protein, 85 aa, Shewanella frigidimarina NCIMB 400
MSNELHVTSLIVQVHPEQMAEVRQKIMAIKNAELSANNDVKLVVVVEGPSQRSLMDDISTINAIPGVLTATMVYHQSEELEEGEV

SEQ ID NO: 60658 - DNA, 255 bp, Pseudomonas stutzeri
  CDS (1)..(255): transl_table=11
atgggacaccctttgcatatcgccagcctcctggtgcactgccgccccgagtggctggccgcgctgaaaaccaacctccagttgctacccggtctcgagctgcatcaggaaagccccagcggcaagctggtggtggtgctcgaggccgagcacgagtcgcgcatcctcgctgcgatcgaccacatccagcagctgcctggcgtccttaacgccgccctggtctaccacgaagaactcctcgaaggagacgcctga

SEQ ID NO: 60659 - protein, 84 aa, Pseudomonas stutzeri
MGHPLHIASLLVHCRPEWLAALKTNLQLLPGLELHQESPSGKLVVVLEAEHESRILAAIDHIQQLPGVLNAALVYHEELLEGDA

SEQ ID NO: 60660 - DNA, 315 bp, Magnetospirillum magnetotacticum
  CDS (1)..(315): transl_table=11
atgagactcgcgaccttcgttgccaccgagaagtccaagcccagggagcaggtggagaatatctgcggcgtgctgatccacgccaagccggagcgcaggcacgaggttcaggacgccctcggccggatacccggcgtcgaggttcacaccatgaccgacgatggccggatggttgttaccgtcgaggatgcccagggcaactgggcgggcgccaccatcaccagcctgaccgacatccggggcattttgaacgtgtccttggtctatcaccattttgattccgatcttgatctggaaggggagagtttttcatga

SEQ ID NO: 60661 - protein, 104 aa, Magnetospirillum magnetotacticum
MRLATFVATEKSKPREQVENICGVLIHAKPERRHEVQDALGRIPGVEVHTMTDDGRMVVTVEDAQGNWAGATITSLTDIRGILNVSLVYHHFDSDLDLEGESFS

SEQ ID NO: 60662 - DNA, 348 bp, Rhodopseudomonas sp
  CDS (1)..(348): transl_table=11
gtgacgcccgccctgccaacggaggttcccgtgccaaataatcccgtcctcgatcgccgcgcgctgttctccggccgcttcaagaatccgaacgccgtggtgcgaccgcccggcggcgagatcgccagcatcctggtgcaggctcgtccggaacggctcgacgaggtcgccgccgcgatcgtagccttcgccggctgcgaagtgttcgcccgcgatccgcaaggcaagctggtggtggtgatcgacgccgaggattccggcgtgatcggctcgacgctcaacgccatcgcggcgctgcccaacgtgtattccgccgccttggtgttccacgccatcgaagccggctag

SEQ ID NO: 60663 - protein, 115 aa, Rhodopseudomonas sp
MTPALPTEVPVPNNPVLDRRALFSGRFKNPNAVVRPPGGEIASILVQARPERLDEVAAAIVAFAGCEVFARDPQGKLVVVIDAEDSGVIGSTLNAIAALPNVYSAALVFHAIEAG

SEQ ID NO: 60664 - DNA, 282 bp, Haemophilus influenzae
  CDS (1)..(282): transl_table=11
atgaataatacaaatttaatattagaaaatgcgagagattggcacgtngttggattgatcgtgcaaggtaatccaaaaaaattatcagcaattcaaaccgcacttttagcgattgagcatactgaaattccgactcttgatgaaaaacttggaaaatttgtggtggtaatgcaatcgaacgatcagcatctcttgcttgaaaaaatggaaagtgtgaaagatatcgacggtgtgattaatgtatcgttggtgtatcacgagcaagatgaacaaaataaatag

SEQ ID NO: 60665 - protein, 93 aa, Haemophilus influenzae
MNNTNLILENARDWHVVGLIVQGNPKKLSAIQTALLAIEHTEIPTLDEKLGKFVVVMQSNDQHLLLEKMESVKDIDGVINVSLVYHEQDEQNK

SEQ ID NO: 60666 - DNA, 20 bp, Artificial sequence
  (1)..(20): primer
atgcacactaactggcaagt

SEQ ID NO: 60667 - DNA, 25 bp, Artificial sequence
  (1)..(25): primer
ttatggtgtttcctcaccttgctct

SEQ ID NO: 60668 - protein, 74 aa, Artificial sequence
  Variant (2)..(3): xaa in position 2 to 3 is any amino acid
  Variant (7)..(9): xaa in position 7 to 9 is any amino acid
  Variant (11)..(12): xaa in position 11 to 12 is any amino acid
  Variant (14)..(15): xaa in position 14 to 15 is any amino acid
  Variant (17)..(19): xaa in position 17 to 19 is any amino acid
  Variant (21)..(22): xaa in position 21 to 22 is any amino acid
  Variant (24)..(26): xaa in position 24 to 26 is any amino acid
  Variant (29)..(34): xaa in position 29 to 34 is any amino acid
  Variant (35)..(35): xaa in position 35 is any or no amino acid
  Variant (41)..(41): xaa in position 41 is any amino acid
  Variant (44)..(49): xaa in position 44 to 49 is any amino acid
  Variant (51)..(53): xaa in position 51 to 53 is any amino acid
  Variant (55)..(56): xaa in position 55 to 56 is any amino acid
  Variant (58)..(59): xaa in position 58 to 59 is any amino acid
  Variant (61)..(62): xaa in position 61 to 62 is any amino acid
  Variant (65)..(67): xaa in position 65 to 67 is any amino acid
  Variant (71)..(73): xaa in position 71 to 73 is any amino acid
IXXLVVXXXPXXLXXVXXXIXXIXXXEIXXXXXXXGKLVVXLEXXXXXXLXXXIXXIXXLXXVLXXXLVYXXXE

SEQ ID NO: 60669 - protein, 43 aa, Artificial sequence
  Variant (2)..(8): xaa in position 2 to 8 is any amino acid
  Variant (9)..(9): xaa in position 9 is any or no amino acid
  Variant (11)..(11): xaa in position 11 is any amino acid
  Variant (12)..(12): xaa in position 12 is Phe, Ile, Leu or Met
  Variant (13)..(13): xaa in position 13 is Ala, Ile or Val
  Variant (15)..(15): xaa in position 15 is Thr or Val
  Variant (16)..(16): xaa in position 16 is any amino acid
  Variant (17)..(17): xaa in position 17 is Asp, Glu or Gln
  Variant (18)..(18): xaa in position 18 is Ala, Asp, Gly, Ser or Thr
  Variant (19)..(20): xaa in position 19 to 20 is any amino acid
  Variant (21)..(21): xaa in position 21 is Ala, Glu, Gly, Gln or Ser
  Variant (22)..(23): xaa in position 22 to 23 is any amino acid
  Variant (24)..(24): xaa in position 24 is Ala, Ile, Leu or Val
  Variant (25)..(27): xaa in position 25 to 27 is any amino acid
  Variant (28)..(28): xaa in position 28 is Ile, Leu, Met or Val
  Variant (29)..(29): xaa in position 29 is Ala, Asp, Glu, Asn or Thr
  Variant (30)..(32): xaa in position 30 to 32 is any amino acid
  Variant (33)..(33): xaa in position 33 is Ala, Asp, Glu, Asn, Gln or Ser
  Variant (34)..(34): xaa in position 34 is Phe, Ile, Leu or Val
  Variant (35)..(36): xaa in position 35 to 36 is any amino acid
  Variant (37)..(37): xaa in position 37 is Ile or Val
  Variant (38)..(39): xaa in position 38 to 39 is any amino acid
  Variant (40)..(40): xaa in position 40 is Ala, Ser, Thr or Val
  Variant (41)..(41): xaa in position 41 is any amino acid
  Variant (43)..(43): xaa in position 43 is Ile or Val
EXXXXXXXXGXXXVXXXXXXXXXXXXXXXXXXXXXXXXXXXLX

SEQ ID NO: 60670 - DNA, 2374 bp, Escherichia coli K12; identical to SEQ ID NO: 1805
  CDS (86)..(2281)

SEQ ID NO: 60671 - protein, 731 aa, Escherichia coli K12; identical to SEQ ID NO: 1806

SEQ ID NO: 60672 - DNA, 2961 bp, Hafnia alvei; identical to SEQ ID NO: 1807
  CDS (185)..(2404)

SEQ ID NO: 60673 - protein, 739 aa, Hafnia alvei; identical to SEQ ID NO: 1808

SEQ ID NO: 60674 - DNA, 4341 bp, Escherichia coli; identical to SEQ ID NO: 1809
  CDS (660)..(2858)

SEQ ID NO: 60675 - protein, 732 aa, Escherichia coli; identical to SEQ ID NO: 1810

SEQ ID NO: 60676 - DNA, 1850 bp, Bacillus subtilis; identical to SEQ ID NO: 1811
  CDS (312)..(1784)

SEQ ID NO: 60677 - protein, 490 aa, Bacillus subtilis; identical to SEQ ID NO: 1812

SEQ ID NO: 60678 - DNA, 3091 bp, Lactobacillus sp; identical to SEQ ID NO: 1813
  CDS (572)..(2767)

SEQ ID NO: 60679 - protein, 731 aa, Lactobacillus sp; identical to SEQ ID NO: 1814

SEQ ID NO: 60680 - DNA, 1449 bp, Bacillus halodurans; identical to SEQ ID NO: 1815
  CDS (1)..(1449)

SEQ ID NO: 60681 - protein, 482 aa, Bacillus halodurans; identical to SEQ ID NO: 1816

SEQ ID NO: 60682 - DNA, 2196 bp, Sinorhizobium meliloti; identical to SEQ ID NO: 1817
  CDS (1)..(2196)

SEQ ID NO: 60683 - protein, 731 aa, Sinorhizobium meliloti; identical to SEQ ID NO: 1818

SEQ ID NO: 60684 - DNA, 1380 bp, Listeria innocua; identical to SEQ ID NO: 1819
  CDS (1)..(1380)

SEQ ID NO: 60685 - protein, 459 aa, Listeria innocua; identical to SEQ ID NO: 1820

SEQ ID NO: 60686 - DNA, 2307 bp, Yersinia pestis; identical to SEQ ID NO: 1821
  CDS (1)..(2307)

SEQ ID NO: 60687 - protein, 768 aa, Yersinia pestis; identical to SEQ ID NO: 1822

SEQ ID NO: 60688 - DNA, 2145 bp, Salmonella enterica subsp. enterica serovar Typhi; identical to SEQ ID NO: 1823
  CDS (1)..(2145)

SEQ ID NO: 60689 - protein, 714 aa, Salmonella enterica subsp. enterica serovar Typhi; identical to SEQ ID NO: 1824

SEQ ID NO: 60690 - DNA, 1467 bp, Nostoc sp. PCC 7120; identical to SEQ ID NO: 1825
  CDS (1)..(1467)

SEQ ID NO: 60691 - protein, 488 aa, Nostoc sp. PCC 7120; identical to SEQ ID NO: 1826

SEQ ID NO: 60692 - DNA, 2163 bp, Yersinia pestis; identical to SEQ ID NO: 1827
  CDS (1)..(2163)

SEQ ID NO: 60693 - protein, 720 aa, Yersinia pestis; identical to SEQ ID NO: 1828

SEQ ID NO: 60694 - DNA, 2271 bp, Salmonella enterica subsp. enterica serovar Typhi; identical to SEQ ID NO: 1829
  CDS (1)..(2271)

SEQ ID NO: 60695 - protein, 756 aa, Salmonella enterica subsp. enterica serovar Typhi; identical to SEQ ID NO: 1830

SEQ ID NO: 60696 - DNA, 2148 bp, Escherichia coli; identical to SEQ ID NO: 1831
  CDS (1)..(2148)

SEQ ID NO: 60697 - protein, 715 aa, Escherichia coli; identical to SEQ ID NO: 1832

SEQ ID NO: 60698 - DNA, 2835 bp, Escherichia coli; identical to SEQ ID NO: 1833
  CDS (571)..(2712)

SEQ ID NO: 60699 - protein, 713 aa, Escherichia coli; identical to SEQ ID NO: 1834

SEQ ID NO: 60700 - DNA, 1446 bp, Clostridium acetobutylicum; identical to SEQ ID NO: 1835
  CDS (1)..(1446)

SEQ ID NO: 60701 - protein, 481 aa, Clostridium acetobutylicum; identical to SEQ ID NO: 1836

SEQ ID NO: 60702 - DNA, 1464 bp, Clostridium acetobutylicum; identical to SEQ ID NO: 1837
  CDS (1)..(1464)

SEQ ID NO: 60703 - protein, 487 aa, Clostridium acetobutylicum; identical to SEQ ID NO: 1838

SEQ ID NO: 60704 - DNA, 2256 bp, Pseudomonas aeruginosa; identical to SEQ ID NO: 1839
  CDS (1)..(2256)

SEQ ID NO: 60705 - protein, 751 aa, Pseudomonas aeruginosa; identical to SEQ ID NO: 1840

SEQ ID NO: 60706 - DNA, 2853 bp, Mycobacterium leprae; identical to SEQ ID NO: 1841
  CDS (1)..(2853)

SEQ ID NO: 60707 - protein, 950 aa, Mycobacterium leprae; identical to SEQ ID NO: 1842

SEQ ID NO: 60708 - DNA, 2202 bp, Vibrio cholerae; identical to SEQ ID NO: 1843
  CDS (1)..(2202)

SEQ ID NO: 60709 - protein, 733 aa, Vibrio cholerae; identical to SEQ ID NO: 1844

SEQ ID NO: 60710 - DNA, 2163 bp, Vibrio cholerae; identical to SEQ ID NO: 1845
  CDS (1)..(2163)

SEQ ID NO: 60711 - protein, 720 aa, Vibrio cholerae; identical to SEQ ID NO: 1846

SEQ ID NO: 60712 - DNA, 2163 bp, Haemophilus influenzae; identical to SEQ ID NO: 1847
  CDS (1)..(2163)

SEQ ID NO: 60713 - protein, 720 aa, Haemophilus influenzae; identical to SEQ ID NO: 1848

SEQ ID NO: 60714 - DNA, 2844 bp, Mycobacterium tuberculosis; identical to SEQ ID NO: 1849
  CDS (1)..(2844)

SEQ ID NO: 60715 - protein, 947 aa, Mycobacterium tuberculosis; identical to SEQ ID NO: 1850

SEQ ID NO: 60716 - DNA, 1476 bp, Streptococcus pneumoniae; identical to SEQ ID NO: 1851
  CDS (1)..(1476)

SEQ ID NO: 60717 - protein, 491 aa, Streptococcus pneumoniae; identical to SEQ ID NO: 1852

SEQ ID NO: 60718 - DNA, 1476 bp, Bacillus halodurans; identical to SEQ ID NO: 1853
  CDS (1)..(1476)

SEQ ID NO: 60719 - protein, 491 aa, Bacillus halodurans; identical to SEQ ID NO: 1854

SEQ ID NO: 60720 - DNA, 2349 bp, Sinorhizobium meliloti; identical to SEQ ID NO: 1855
  CDS (1)..(2349)

SEQ ID NO: 60721 - protein, 782 aa, Sinorhizobium meliloti; identical to SEQ ID NO: 1856

SEQ ID NO: 60722 - DNA, 1476 bp, Streptococcus pneumoniae; identical to SEQ ID NO: 1857
  CDS (1)..(1476)

SEQ ID NO: 60723 - protein, 491 aa, Streptococcus pneumoniae; identical to SEQ ID NO: 1858

SEQ ID NO: 60724 - DNA, 2271 bp, Escherichia coli; identical to SEQ ID NO: 1859
  CDS (1)..(2271)

SEQ ID NO: 60725 - protein, 756 aa, Escherichia coli; identical to SEQ ID NO: 1860

SEQ ID NO: 60726 - DNA, 1443 bp, Bacillus subtilis; identical to SEQ ID NO: 1861
  CDS (1)..(1443)

SEQ ID NO: 60727 - protein, 480 aa, Bacillus subtilis; identical to SEQ ID NO: 1862

SEQ ID NO: 60728 - DNA, 1452 bp, Synechocystis sp; identical to SEQ ID NO: 1863
  CDS (1)..(1452)

SEQ ID NO: 60729 - protein, 483 aa, Synechocystis sp; identical to SEQ ID NO: 1864

SEQ ID NO: 60730 - DNA, 2307 bp, Yersinia pseudotuberculosis IP 32953; identical to SEQ ID NO: 1865
  CDS (1)..(2307)

SEQ ID NO: 60731 - protein, 768 aa, Yersinia pseudotuberculosis IP 32953; identical to SEQ ID NO: 1866

SEQ ID NO: 60732 - DNA, 1467 bp, Symbiobacterium thermophilum; identical to SEQ ID NO: 1867
  CDS (1)..(1467)

SEQ ID NO: 60733 - protein, 488 aa, Symbiobacterium thermophilum; identical to SEQ ID NO: 1868

SEQ ID NO: 60734 - DNA, 1410 bp, Symbiobacterium thermophilum; identical to SEQ ID NO: 1869
  CDS (1)..(1410)

SEQ ID NO: 60735 - protein, 469 aa, Symbiobacterium thermophilum; identical to SEQ ID NO: 1870

SEQ ID NO: 60736 - DNA, 2154 bp, Erwinia carotovora; identical to SEQ ID NO: 1871
  CDS (1)..(2154)

SEQ ID NO: 60737 - protein, 717 aa, Erwinia carotovora; identical to SEQ ID NO: 1872

SEQ ID NO: 60738 - DNA, 2790 bp, Acinetobacter sp; identical to SEQ ID NO: 1873
  CDS (1)..(2790)

SEQ ID NO: 60739 - protein, 929 aa, Acinetobacter sp; identical to SEQ ID NO: 1874

SEQ ID NO: 60740 - DNA, 1482 bp, Bacillus thuringiensis; identical to SEQ ID NO: 1875
  CDS (1)..(1482)

SEQ ID NO: 60741 - protein, 493 aa, Bacillus thuringiensis; identical to SEQ ID NO: 1876

SEQ ID NO: 60742 - DNA, 1422 bp, Bacillus thuringiensis; identical to SEQ ID NO: 1877
  CDS (1)..(1422)

SEQ ID NO: 60743 - protein, 473 aa, Bacillus thuringiensis; identical to SEQ ID NO: 1878

SEQ ID NO: 60744 - DNA, 2358 bp, Rhodopseudomonas palustris; identical to SEQ ID NO: 1879
  CDS (1)..(2358)

SEQ ID NO: 60745 - protein, 785 aa, Rhodopseudomonas palustris; identical to SEQ ID NO: 1880

SEQ ID NO: 60746 - DNA, 2837 bp, Shigella boydii; identical to SEQ ID NO: 1881
  CDS (165)..(2435)

SEQ ID NO: 60747 - protein, 756 aa, Shigella boydii; identical to SEQ ID NO: 1882

SEQ ID NO: 60748 - DNA, 1380 bp, Listeria monocytogenes; identical to SEQ ID NO: 1883
  CDS (1)..(1380)

SEQ ID NO: 60749 - protein, 459 aa, Listeria monocytogenes; identical to SEQ ID NO: 1884

SEQ ID NO: 60750 - DNA, 1482 bp, Bacillus cereus; identical to SEQ ID NO: 1885
  CDS (1)..(1482)

SEQ ID NO: 60751 - protein, 493 aa, Bacillus cereus; identical to SEQ ID NO: 1886

SEQ ID NO: 60752 - DNA, 1422 bp, Bacillus cereus; identical to SEQ ID NO: 1887
  CDS (1)..(1422)

SEQ ID NO: 60753 - protein, 473 aa, Bacillus cereus; identical to SEQ ID NO: 1888

SEQ ID NO: 60754 - DNA, 1458 bp, Mycobacterium paratuberculosis; identical to SEQ ID NO: 1889
  CDS (1)..(1458)

SEQ ID NO: 60755 - protein, 485 aa, Mycobacterium paratuberculosis; identical to SEQ ID NO: 1890

SEQ ID NO: 60756 - DNA, 2853 bp, Mycobacterium paratuberculosis; identical to SEQ ID NO: 1891
  CDS (1)..(2853)

SEQ ID NO: 60757 - protein, 950 aa, Mycobacterium paratuberculosis; identical to SEQ ID NO: 1892

SEQ ID NO: 60758 - DNA, 2100 bp, Lactobacillus johnsonii; identical to SEQ ID NO: 1893
  CDS (1)..(2100)

SEQ ID NO: 60759 - protein, 699 aa, Lactobacillus johnsonii; identical to SEQ ID NO: 1894

SEQ ID NO: 60760 - DNA, 3625 bp, Vibrio parahaemolyticus; identical to SEQ ID NO: 1895
  CDS (1451)..(3625)

SEQ ID NO: 60761 - protein, 724 aa, Vibrio parahaemolyticus; identical to SEQ ID NO: 1896

SEQ ID NO: 60762 - DNA, 2142 bp, Shigella flexneri; identical to SEQ ID NO: 1897
  CDS (1)..(2142)

SEQ ID NO: 60763 - protein, 713 aa, Shigella flexneri; identical to SEQ ID NO: 1898

SEQ ID NO: 60764 - DNA, 2181 bp, Vibrio vulnificus; identical to SEQ ID NO: 1899
  CDS (1)..(2181)

SEQ ID NO: 60765 - protein, 726 aa, Vibrio vulnificus; identical to SEQ ID NO: 1900

SEQ ID NO: 60766 - DNA, 2307 bp, Photorhabdus luminescens; identical to SEQ ID NO: 1901
  CDS (1)..(2307)

SEQ ID NO: 60767 - protein, 768 aa, Photorhabdus luminescens; identical to SEQ ID NO: 1902

SEQ ID NO: 60768 - DNA, 1404 bp, Gloeobacter violaceus; identical to SEQ ID NO: 1903
  CDS (1)..(1404)

SEQ ID NO: 60769 - protein, 467 aa, Gloeobacter violaceus; identical to SEQ ID NO: 1904

SEQ ID NO: 60770 - DNA, 2259 bp, Chromobacterium violaceum; identical to SEQ ID NO: 1905
  CDS (1)..(2259)

SEQ ID NO: 60771 - protein, 752 aa, Chromobacterium violaceum; identical to SEQ ID NO: 1906

SEQ ID NO: 60772 - DNA, 1251 bp, Chromobacterium violaceum; identical to SEQ ID NO: 1907
  CDS (1)..(1251)

SEQ ID NO: 60773 - protein, 416 aa, Chromobacterium violaceum; identical to SEQ ID NO: 1908

SEQ ID NO: 60774 - DNA, 2352 bp, Fusobacterium nucleatum subsp; identical to SEQ ID NO: 1909
  CDS (1)..(2352)

SEQ ID NO: 60775 - protein, 783 aa, Fusobacterium nucleatum subsp; identical to SEQ ID NO: 1910

SEQ ID NO: 60776 - DNA, 2196 bp, Shigella flexneri; identical to SEQ ID NO: 1911
  CDS (1)..(2196)

SEQ ID NO: 60777 - protein, 731 aa, Shigella flexneri; identical to SEQ ID NO: 1912

SEQ ID NO: 60778 - DNA, 2271 bp, Bordetella pertussis; identical to SEQ ID NO: 1913
  CDS (1)..(2271)

SEQ ID NO: 60779 - protein, 756 aa, Bordetella pertussis; identical to SEQ ID NO: 1914

SEQ ID NO: 60780 - DNA, 2271 bp, Bordetella parapertussis; identical to SEQ ID NO: 1915
  CDS (1)..(2271)

SEQ ID NO: 60781 - protein, 756 aa, Bordetella parapertussis; identical to SEQ ID NO: 1916

SEQ ID NO: 60782 - DNA, 1422 bp, Bacillus cereus; identical to SEQ ID NO: 1917
  CDS (1)..(1422)

SEQ ID NO: 60783 - protein, 473 aa, Bacillus cereus; identical to SEQ ID NO: 1918

SEQ ID NO: 60784 - DNA, 1422 bp, Bacillus anthracis; identical to SEQ ID NO: 1919
  CDS (1)..(1422)

SEQ ID NO: 60785 - protein, 473 aa, Bacillus anthracis; identical to SEQ ID NO: 1920

SEQ ID NO: 60786 - DNA, 2271 bp, Shigella flexneri; identical to SEQ ID NO: 1921
  CDS (1)..(2271)

SEQ ID NO: 60787 - protein, 756 aa, Shigella flexneri; identical to SEQ ID NO: 1922

SEQ ID NO: 60788 - DNA, 2136 bp, Shigella flexneri; identical to SEQ ID NO: 1923
  CDS (1)..(2136)

SEQ ID NO: 60789 - protein, 711 aa, Shigella flexneri; identical to SEQ ID NO: 1924

SEQ ID NO: 60790 - DNA, 2127 bp, Escherichia coli; identical to SEQ ID NO: 1925
  CDS (1)..(2127)

SEQ ID NO: 60791 - protein, 708 aa, Escherichia coli; identical to SEQ ID NO: 1926

SEQ ID NO: 60792 - DNA, 1563 bp, Oryza sativa; identical to SEQ ID NO: 1927
  CDS (1)..(1563)

SEQ ID NO: 60793 - protein, 520 aa, Oryza sativa; identical to SEQ ID NO: 1928

SEQ ID NO: 60794 - DNA, 2181 bp, Vibrio parahaemolyticus; identical to SEQ ID NO: 1929
  CDS (1)..(2181)

SEQ ID NO: 60795 - protein, 726 aa, Vibrio parahaemolyticus; identical to SEQ ID NO: 1930

SEQ ID NO: 60796 - DNA, 4026 bp, Vibrio parahaemolyticus; identical to SEQ ID NO: 1931
  CDS (1779)..(3914)

SEQ ID NO: 60797 - protein, 711 aa, Vibrio parahaemolyticus; identical to SEQ ID NO: 1932

SEQ ID NO: 60798 - DNA, 1461 bp, Clostridium tetani; identical to SEQ ID NO: 1933
  CDS (1)..(1461)

SEQ ID NO: 60799 - protein, 486 aa, Clostridium tetani; identical to SEQ ID NO: 1934

SEQ ID NO: 60800 - DNA, 1416 bp, Clostridium tetani; identical to SEQ ID NO: 1935
  CDS (1)..(1416)

SEQ ID NO: 60801 - protein, 471 aa, Clostridium tetani; identical to SEQ ID NO: 1936

SEQ ID NO: 60802 - DNA, 2766 bp, Bradyrhizobium japonicum; identical to SEQ ID NO: 1937
  CDS (1)..(2766)

SEQ ID NO: 60803 - protein, 921 aa, Bradyrhizobium japonicum; identical to SEQ ID NO: 1938

SEQ ID NO: 60804 - DNA, 2517 bp, Bradyrhizobium japonicum; identical to SEQ ID NO: 1939
  CDS (1)..(2517)

SEQ ID NO: 60805 - protein, 838 aa, Bradyrhizobium japonicum; identical to SEQ ID NO: 1940

SEQ ID NO: 60806 - DNA, 2181 bp, Vibrio vulnificus; identical to SEQ ID NO: 1941
  CDS (1)..(2181)

SEQ ID NO: 60807 - protein, 726 aa, Vibrio vulnificus; identical to SEQ ID NO: 1942

SEQ ID NO: 60808 - DNA, 2109 bp, Vibrio vulnificus; identical to SEQ ID NO: 1943
  CDS (1)..(2109)

SEQ ID NO: 60809 - protein, 702 aa, Vibrio vulnificus; identical to SEQ ID NO: 1944

SEQ ID NO: 60810 - DNA, 2163 bp, Shewanella oneidensis; identical to SEQ ID NO: 1945
  CDS (1)..(2163)

SEQ ID NO: 60811 - protein, 720 aa, Shewanella oneidensis; identical to SEQ ID NO: 1946

SEQ ID NO: 60812 - DNA, 1419 bp, Oceanobacillus iheyensis; identical to SEQ ID NO: 1947
  CDS (1)..(1419)

SEQ ID NO: 60813 - protein, 472 aa, Oceanobacillus iheyensis; identical to SEQ ID NO: 1948

SEQ ID NO: 60814 - DNA, 2154 bp, Escherichia coli O6; identical to SEQ ID NO: 1949
  CDS (1)..(2154)

SEQ ID NO: 60815 - protein, 717 aa, Escherichia coli O6; identical to SEQ ID NO: 1950

SEQ ID NO: 60816 - DNA, 2271 bp, Escherichia coli O6; identical to SEQ ID NO: 1951
  CDS (1)..(2271)

SEQ ID NO: 60817 - protein, 756 aa, Escherichia coli O6; identical to SEQ ID NO: 1952

SEQ ID NO: 60818 - DNA, 2370 bp, Escherichia coli O6; identical to SEQ ID NO: 1953
  CDS (1)..(2370)

SEQ ID NO: 60819 - protein, 789 aa, Escherichia coli O6; identical to SEQ ID NO: 1954

SEQ ID NO: 60820 - DNA, 2136 bp, Escherichia coli O6; identical to SEQ ID NO: 1955
  CDS (1)..(2136)

SEQ ID NO: 60821 - protein, 711 aa, Escherichia coli O6; identical to SEQ ID NO: 1956

SEQ ID NO: 60822 - DNA, 2208 bp, Escherichia coli O6; identical to SEQ ID NO: 1957
  CDS (1)..(2208)

SEQ ID NO: 60823 - protein, 735 aa, Escherichia coli O6; identical to SEQ ID NO: 1958

SEQ ID NO: 60824 - DNA, 2142 bp, Escherichia coli O6; identical to SEQ ID NO: 1959
  CDS (1)..(2142)

SEQ ID NO: 60825 - protein, 713 aa, Escherichia coli O6; identical to SEQ ID NO: 1960

SEQ ID NO: 60826 - DNA, 1488 bp, Thermoanaerobacter tengcongensis; identical to SEQ ID NO: 1961
  CDS (1)..(1488)

SEQ ID NO: 60827 - protein, 495 aa, Thermoanaerobacter tengcongensis; identical to SEQ ID NO: 1962

SEQ ID NO: 60828 - DNA, 1419 bp, Thermoanaerobacter tengcongensis; identical to SEQ ID NO: 1963
  CDS (1)..(1419)

SEQ ID NO: 60829 - protein, 472 aa, Thermoanaerobacter tengcongensis; identical to SEQ ID NO: 1964

SEQ ID NO: 60830 - DNA, 2352 bp, Fusobacterium nucleatum; identical to SEQ ID NO: 1965
  CDS (1)..(2352)

SEQ ID NO: 60831 - protein, 783 aa, Fusobacterium nucleatum; identical to SEQ ID NO: 1966

SEQ ID NO: 60832 - DNA, 1431 bp, Clostridium perfringens; identical to SEQ ID NO: 1967
  CDS (1)..(1431)

SEQ ID NO: 60833 - protein, 476 aa, Clostridium perfringens; identical to SEQ ID NO: 1968

SEQ ID NO: 60834 - DNA, 1455 bp, Clostridium perfringens; identical to SEQ ID NO: 1969
  CDS (1)..(1455)

SEQ ID NO: 60835 - protein, 484 aa, Clostridium perfringens; identical to SEQ ID NO: 1970

SEQ ID NO: 60836 - DNA, 2280 bp, Ralstonia solanacearum; identical to SEQ ID NO: 1971
  CDS (1)..(2280)

SEQ ID NO: 60837 - protein, 759 aa, Ralstonia solanacearum; identical to SEQ ID NO: 1972

SEQ ID NO: 60838 - DNA, 2271 bp, Salmonella typhimurium; identical to SEQ ID NO: 1973
  CDS (1)..(2271)

SEQ ID NO: 60839 - protein, 756 aa, Salmonella typhimurium; identical to SEQ ID NO: 1974

SEQ ID NO: 60840 - DNA, 2136 bp, Salmonella typhimurium; identical to SEQ ID NO: 1975
  CDS (1)..(2136)

SEQ ID NO: 60841 - protein, 711 aa, Salmonella typhimurium; identical to SEQ ID NO: 1976

SEQ ID NO: 60842 - DNA, 2199 bp, Salmonella typhimurium; identical to SEQ ID NO: 1977
  CDS (1)..(2199)

SEQ ID NO: 60843 - protein, 732 aa, Salmonella typhimurium; identical to SEQ ID NO: 1978

SEQ ID NO: 60844 - DNA, 2142 bp, Salmonella typhimurium; identical to SEQ ID NO: 1979
  CDS (1)..(2142)

SEQ ID NO: 60845 - protein, 713 aa, Salmonella typhimurium; identical to SEQ ID NO: 1980

SEQ ID NO: 60846 - DNA, 2136 bp, Vibrio vulnificus; identical to SEQ ID NO: 1981
  CDS (1)..(2136)

SEQ ID NO: 60847 - protein, 711 aa, Vibrio vulnificus; identical to SEQ ID NO: 1982

SEQ ID NO: 60848 - DNA, 2163 bp, Pasteurella multocida; identical to SEQ ID NO: 1983
  CDS (1)..(2163)

SEQ ID NO: 60849 - protein, 720 aa, Pasteurella multocida; identical to SEQ ID NO: 1984

SEQ ID NO: 60850 - DNA, 2139 bp, Moritella japonica; identical to SEQ ID NO: 1985
  CDS (1)..(2139)

SEQ ID NO: 60851 - protein, 712 aa, Moritella japonica; identical to SEQ ID NO: 1986

SEQ ID NO: 60852 - DNA, 1479 bp, Streptomyces coelicolor; identical to SEQ ID NO: 1987
  CDS (1)..(1479)

SEQ ID NO: 60853 - protein, 492 aa, Streptomyces coelicolor; identical to SEQ ID NO: 1988

SEQ ID NO: 60854 - DNA, 2130 bp, Eikenella corrodens; identical to SEQ ID NO: 1989
  CDS (1)..(2130)

SEQ ID NO: 60855 - protein, 709 aa, Eikenella corrodens; identical to SEQ ID NO: 1990

SEQ ID NO: 60856 - DNA, 2271 bp, Escherichia coli; identical to SEQ ID NO: 1859
  CDS (4)..(2271)

SEQ ID NO: 60857 - protein, 755 aa, Escherichia coli; identical to SEQ ID NO: 1992

SEQ ID NO: 60858 - DNA, 2196 bp, Lactobacillus sp; identical to SEQ ID NO: 1993
  CDS (1)..(2196)

SEQ ID NO: 60859 - protein, 731 aa, Lactobacillus sp; identical to SEQ ID NO: 1814

SEQ ID NO: 60860 - DNA, 1482 bp, Bacillus anthracis; identical to SEQ ID NO: 1995
  CDS (1)..(1482)

SEQ ID NO: 60861 - protein, 493 aa, Bacillus anthracis; identical to SEQ ID NO: 1996

SEQ ID NO: 60862 - DNA, 1383 bp, Bacillus cereus; identical to SEQ ID NO: 1997
  CDS (1)..(1383)

SEQ ID NO: 60863 - protein, 460 aa, Bacillus cereus; identical to SEQ ID NO: 1998

SEQ ID NO: 60864 - DNA, 20 bp, Artificial sequence
  (1)..(20): primer
atggggcagggttttccacc

SEQ ID NO: 60865 - DNA, 25 bp, Artificial sequence
  (1)..(25): primer
ttacttcaacacataaccgtacaac

SEQ ID NO: 60866 - protein, 642 aa, Artificial sequence; identical to SEQ ID NO: 2902
  Variant (2)..(5): xaa in position 2 to 5 is any amino acid
  Variant (7)..(58): xaa in position 7 to 58 is any amino acid
  Variant (60)..(61): xaa in position 60 to 61 is any amino acid
  Variant (63)..(66): xaa in position 63 to 66 is any amino acid
  Variant (68)..(71): xaa in position 68 to 71 is any amino acid
  Variant (73)..(76): xaa in position 73 to 76 is any amino acid
  Variant (78)..(90): xaa in position 78 to 90 is any amino acid
  Variant (92)..(92): xaa in position 92 is any amino acid
  Variant (94)..(113): xaa in position 94 to 113 is any amino acid
  Variant (116)..(116): xaa in position 116 is any amino acid
  Variant (120)..(131): xaa in position 120 to 131 is any amino acid
  Variant (133)..(188): xaa in position 133 to 188 is any amino acid
  Variant (191)..(191): xaa in position 191 is any amino acid
  Variant (193)..(215): xaa in position 193 to 215 is any amino acid
  Variant (217)..(217): xaa in position 217 is any amino acid
  Variant (219)..(224): xaa in position 219 to 224 is any amino acid
  Variant (226)..(290): xaa in position 226 to 290 is any amino acid
  Variant (292)..(292): xaa in position 292 is any amino acid
  Variant (295)..(300): xaa in position 295 to 300 is any amino acid
  Variant (302)..(302): xaa in position 302 is any amino acid
  Variant (304)..(305): xaa in position 304 to 305 is any amino acid
  Variant (307)..(333): xaa in position 307 to 333 is any amino acid
  Variant (337)..(337): xaa in position 337 is any amino acid
  Variant (339)..(341): xaa in position 339 to 341 is any amino acid
  Variant (343)..(355): xaa in position 343 to 355 is any amino acid
  Variant (357)..(370): xaa in position 357 to 370 is any amino acid
  Variant (372)..(457): xaa in position 372 to 457 is any amino acid
  Variant (460)..(460): xaa in position 460 is any amino acid
  Variant (462)..(494): xaa in position 462 to 494 is any amino acid
  Variant (496)..(497): xaa in position 496 to 497 is any amino acid
  Variant (499)..(505): xaa in position 499 to 505 is any amino acid
  Variant (507)..(520): xaa in position 507 to 520 is any amino acid
  Variant (522)..(524): xaa in position 522 to 524 is any amino acid
  Variant (526)..(620): xaa in position 526 to 620 is any amino acid
  Variant (622)..(624): xaa in position 622 to 624 is any amino acid
  Variant (626)..(630): xaa in position 626 to 630 is any amino acid
  Variant (635)..(640): xaa in position 635 to 640 is any amino acid

SEQ ID NO: 60867 - protein, 101 aa, Artificial sequence; identical to SEQ ID NO: 1322
  Variant (2)..(23): xaa in position 2 to 23 is any amino acid
  Variant (24)..(30): xaa in position 24 to 30 is any or no amino acid
  Variant (32)..(32): xaa in position 32 is any amino acid
  Variant (37)..(39): xaa in position 37 to 39 is any amino acid
  Variant (41)..(55): xaa in position 41 to 55 is any amino acid
  Variant (56)..(57): xaa in position 56 to 57 is any or no amino acid
  Variant (59)..(62): xaa in position 59 to 62 is any amino acid
  Variant (64)..(64): xaa in position 64 is any amino acid
  Variant (67)..(70): xaa in position 67 to 70 is any amino acid
  Variant (72)..(72): xaa in position 72 is any amino acid
  Variant (75)..(77): xaa in position 75 to 77 is any amino acid
  Variant (79)..(85): xaa in position 79 to 85 is any amino acid
  Variant (87)..(90): xaa in position 87 to 90 is any amino acid
  Variant (92)..(93): xaa in position 92 to 93 is any amino acid
  Variant (97)..(97): xaa in position 97 is any amino acid
  Variant (100)..(100): xaa in position 100 is any amino acid

SEQ ID NO: 60868 - protein, 76 aa, Artificial sequence; identical to SEQ ID NO: 2897
  Variant (1)..(1): xaa in position 1 is Leu, Met or Val
  Variant (2)..(2): xaa in position 2 is Gly or Asp
  Variant (3)..(3): xaa in position 3 is Asp, Ser, Asn, Gln or Gly
  Variant (4)..(4): xaa in position 4 is Leu or Arg
  Variant (5)..(6): xaa in position 5 to 6 is any amino acid
  Variant (7)..(7): xaa in position 7 is His or Pro
  Variant (8)..(8): xaa in position 8 is any amino acid
  Variant (9)..(9): xaa in position 9 is Gly, Ser, Glu or Asp
  Variant (10)..(13): xaa in position 10 to 13 is any amino acid
  Variant (14)..(14): xaa in position 14 is Ala or Ser
  Variant (15)..(15): xaa in position 15 is Gln, Glu or Met
  Variant (16)..(18): xaa in position 16 to 18 is any amino acid
  Variant (19)..(19): xaa in position 19 is Ala or Ser
  Variant (20)..(21): xaa in position 20 to 21 is any amino acid
  Variant (22)..(22): xaa in position 22 is Phe, Tyr, Trp or Val
  Variant (23)..(23): xaa in position 23 is any amino acid
  Variant (24)..(24): xaa in position 24 is Ala, Ser or Val
  Variant (25)..(27): xaa in position 25 to 27 is any amino acid
  Variant (28)..(28): xaa in position 28 is Tyr, Phe or Trp
  Variant (29)..(30): xaa in position 29 to 30 is any amino acid
  Variant (31)..(31): xaa in position 31 is Val, Thr, Leu or Ile
  Variant (32)..(32): xaa in position 32 is any amino acid
  Variant (34)..(34): xaa in position 34 is Thr or Ser
  Variant (35)..(35): xaa in position 35 is Ser or Thr
  Variant (36)..(36): xaa in position 36 is any amino acid
  Variant (37)..(37): xaa in position 37 is Ser, Ala or Gly
  Variant (38)..(38): xaa in position 38 is Asn, Ile, Val or Ser
  Variant (39)..(51): xaa in position 39 to 51 is any amino acid
  Variant (52)..(52): xaa in position 52 is Val, Ile, Leu or Ala
  Variant (53)..(53): xaa in position 53 is Leu, Ile, Val or Met
  Variant (54)..(55): xaa in position 54 to 55 is any amino acid
  Variant (57)..(57): xaa in position 57 is Asn or Asp
  Variant (58)..(58): xaa in position 58 is any amino acid
  Variant (60)..(60): xaa in position 60 is Lys, Gln or Arg
  Variant (61)..(61): xaa in position 61 is Ser or Ala
  Variant (62)..(65): xaa in position 62 to 65 is any amino acid
  Variant (66)..(66): xaa in position 66 is any or no amino acid
  Variant (67)..(67): xaa in position 67 is Leu, Ile, Met or Val
  Variant (68)..(73): xaa in position 68 to 73 is any amino acid
  Variant (74)..(74): xaa in position 74 is Pro or Ala
  Variant (75)..(75): xaa in position 75 is any amino acid
  Variant (76)..(76): xaa in position 76 is Tyr, Phe or Trp

SEQ ID NO: 60869 - protein, 39 aa, Artificial sequence; identical to SEQ ID NO: 2898
  Variant (1)..(1): xaa in position 1 is Val, Ile, Leu, Phe or Thr
  Variant (2)..(2): xaa in position 2 is Ile, Val, Leu, Phe or Ala
  Variant (3)..(5): xaa in position 3 to 5 is any amino acid
  Variant (6)..(6): xaa in position 6 is Thr, Asn or Ser
  Variant (7)..(7): xaa in position 7 is Tyr, Phe or Pro
  Variant (8)..(8): xaa in position 8 is Asp, Tyr, Phe or His
  Variant (10)..(12): xaa in position 10 to 12 is any amino acid
  Variant (13)..(13): xaa in position 13 is Asn, Asp or Ser
  Variant (14)..(25): xaa in position 14 to 25 is any amino acid
  Variant (26)..(29): xaa in position 26 to 29 is any or no amino acid
  Variant (30)..(30): xaa in position 30 is Ile, Val, Leu or Phe
  Variant (31)..(31): xaa in position 31 is any amino acid
  Variant (32)..(32): xaa in position 32 is Phe, Val, Trp or Ile
  Variant (34)..(34): xaa in position 34 is Glu, Ser or Cys
  Variant (36)..(36): xaa in position 36 is Trp or His
  Variant (37)..(37): xaa in position 37 is any amino acid
  Variant (38)..(38): xaa in position 38 is Ala, Gly, Pro or Val
  Variant (39)..(39): xaa in position 39 is Tyr, His or Phe

SEQ ID NO: 60870 - protein, 84 aa, Artificial sequence; identical to SEQ ID NO: 2899
  Variant (1)..(1): xaa in position 1 is Ser or Leu
  Variant (2)..(2): xaa in position 2 is any amino acid
  Variant (5)..(7): xaa in position 5 to 7 is any amino acid
  Variant (8)..(8): xaa in position 8 is Ala, Gly or Ser
  Variant (9)..(9): xaa in position 9 is Leu, Phe, Met or Ile
  Variant (10)..(10): xaa in position 10 is Ser, Thr, Arg or Glu
  Variant (11)..(11): xaa in position 11 is Gln or Met
  Variant (12)..(12): xaa in position 12 is any amino acid
  Variant (13)..(13): xaa in position 13 is Ser or Ala
  Variant (14)..(14): xaa in position 14 is any amino acid
  Variant (15)..(15): xaa in position 15 is Ile, Leu, Met, Val or Phe
  Variant (16)..(16): xaa in position 16 is His, Asn, Leu or Ile
  Variant (17)..(25): xaa in position 17 to 25 is any amino acid
  Variant (26)..(33): xaa in position 26 to 33 is any or no amino acid
  Variant (34)..(34): xaa in position 34 is Phe, Val, Leu, Met or Ile
  Variant (35)..(42): xaa in position 35 to 42 is any amino acid
  Variant (43)..(43): xaa in position 43 is Ser or Thr
  Variant (44)..(44): xaa in position 44 is Thr or Ser
  Variant (46)..(47): xaa in position 46 to 47 is any amino acid
  Variant (48)..(48): xaa in position 48 is Tyr, Gln or Val
  Variant (49)..(49): xaa in position 49 is any amino acid
  Variant (50)..(50): xaa in position 50 is Leu, Ile, Phe or Met
  Variant (51)..(51): xaa in position 51 is any amino acid
  Variant (52)..(52): xaa in position 52 is Ala or Ser
  Variant (53)..(53): xaa in position 53 is Ser, Ala or Thr
  Variant (54)..(54): xaa in position 54 is any amino acid
  Variant (55)..(55): xaa in position 55 is Asp or Glu
  Variant (56)..(63): xaa in position 56 to 63 is any amino acid
  Variant (64)..(65): xaa in position 64 to 65 is any or no amino acid
  Variant (66)..(66): xaa in position 66 is Gly, Ala, Lys or Asn
  Variant (67)..(73): xaa in position 67 to 73 is any amino acid
  Variant (74)..(74): xaa in position 74 is Ile, Val, Leu, Tyr or Phe
  Variant (75)..(80): xaa in position 75 to 80 is any amino acid
  Variant (81)..(81): xaa in position 81 is Arg or Lys
  Variant (82)..(83): xaa in position 82 to 83 is any amino acid
  Variant (84)..(84): xaa in position 84 is Ile, Leu, Val, Met, Phe, Ala or Thr

SEQ ID NO: 60871 - protein, 31 aa, Artificial sequence; identical to SEQ ID NO: 2900
  Variant (1)..(1): xaa in position 1 is Val, Ile, Leu, Cys or Arg
  Variant (2)..(5): xaa in position 2 to 5 is any amino acid
  Variant (6)..(9): xaa in position 6 to 9 is any or no amino acid
  Variant (10)..(10): xaa in position 10 is Gly, Thr, Asp or Asn
  Variant (11)..(11): xaa in position 11 is any amino acid
  Variant (12)..(12): xaa in position 12 is Ile, Val or Thr
  Variant (13)..(13): xaa in position 13 is any amino acid
  Variant (14)..(14): xaa in position 14 is Ala, Gly, Thr or Leu
  Variant (15)..(16): xaa in position 15 to 16 is any amino acid
  Variant (17)..(17): xaa in position 17 is Val, Ile, Ala, Leu or Phe
  Variant (18)..(19): xaa in position 18 to 19 is any amino acid
  Variant (24)..(24): xaa in position 24 is Ile, Val or Phe
  Variant (25)..(26): xaa in position 25 to 26 is any amino acid
  Variant (27)..(27): xaa in position 27 is Val, Leu, Ile, Phe or Met
  Variant (28)..(29): xaa in position 28 to 29 is any amino acid
  Variant (31)..(31): xaa in position 31 is Glu or Gln

SEQ ID NO: 60872 - DNA, 1182 bp, Escherichia coli; identical to SEQ ID NO: 40261
  CDS (1)..(1182)

SEQ ID NO: 60873 - protein, 393 aa, Escherichia coli; identical to SEQ ID NO: 40262

SEQ ID NO: 60874 - DNA, 996 bp, Mesorhizobium loti MAFF303099; identical to SEQ ID NO: 40263
  CDS (1)..(996): transl_table=11

SEQ ID NO: 60875 - protein, 331 aa, Mesorhizobium loti MAFF303099; identical to SEQ ID NO: 40264

SEQ ID NO: 60876 - DNA, 987 bp, Mesorhizobium loti MAFF303099; identical to SEQ ID NO: 40265
  CDS (1)..(987): transl_table=11

SEQ ID NO: 60877 - protein, 328 aa, Mesorhizobium loti MAFF303099; identical to SEQ ID NO: 40266

SEQ ID NO: 60878 - DNA, 1017 bp, Mesorhizobium loti MAFF303099; identical to SEQ ID NO: 40267
  CDS (1)..(1017): transl_table=11

SEQ ID NO: 60879 - protein, 338 aa, Mesorhizobium loti MAFF303099; identical to SEQ ID NO: 40268

SEQ ID NO: 60880 - DNA, 1098 bp, Mesorhizobium loti MAFF303099; identical to SEQ ID NO: 40269
  CDS (1)..(1098): transl_table=11

SEQ ID NO: 60881 - protein, 365 aa, Mesorhizobium loti MAFF303099; identical to SEQ ID NO: 40270

SEQ ID NO: 60882 - DNA, 969 bp, Mesorhizobium loti MAFF303099; identical to SEQ ID NO: 40271
  CDS (1)..(969): transl_table=11

SEQ ID NO: 60883 - protein, 322 aa, Mesorhizobium loti MAFF303099; identical to SEQ ID NO: 40272

SEQ ID NO: 60884 - DNA, 993 bp, Mesorhizobium loti MAFF303099; identical to SEQ ID NO: 40273
  CDS (1)..(993): transl_table=11

SEQ ID NO: 60885 - protein, 330 aa, Mesorhizobium loti MAFF303099; identical to SEQ ID NO: 40274

SEQ ID NO: 60886 - DNA, 1332 bp, Mesorhizobium loti MAFF303099; identical to SEQ ID NO: 40275
  CDS (1)..(1332): transl_table=11

SEQ ID NO: 60887 - protein, 443 aa, Mesorhizobium loti MAFF303099; identical to SEQ ID NO: 40276

SEQ ID NO: 60888 - DNA, 1287 bp, Mesorhizobium loti MAFF303099; identical to SEQ ID NO: 40277
  CDS (1)..(1287): transl_table=11

SEQ ID NO: 60889 - protein, 428 aa, Mesorhizobium loti MAFF303099; identical to SEQ ID NO: 40278

SEQ ID NO: 60890 - DNA, 996 bp, Mesorhizobium loti MAFF303099; identical to SEQ ID NO: 40279
  CDS (1)..(996): transl_table=11

SEQ ID NO: 60891 - protein, 331 aa, Mesorhizobium loti MAFF303099; identical to SEQ ID NO: 40280

SEQ ID NO: 60892 - DNA, 978 bp, Mesorhizobium loti MAFF303099; identical to SEQ ID NO: 40281
  CDS (1)..(978): transl_table=11

SEQ ID NO: 60893 - protein, 325 aa, Mesorhizobium loti MAFF303099; identical to SEQ ID NO: 40282

SEQ ID NO: 60894 - DNA, 999 bp, Mesorhizobium loti MAFF303099; identical to SEQ ID NO: 40283
  CDS (1)..(999): transl_table=11

SEQ ID NO: 60895 - protein, 332 aa, Mesorhizobium loti MAFF303099; identical to SEQ ID NO: 40284

SEQ ID NO: 60896 - DNA, 1002 bp, Mesorhizobium loti MAFF303099; identical to SEQ ID NO: 40285
  CDS (1)..(1002): transl_table=11

SEQ ID NO: 60897 - protein, 333 aa, Mesorhizobium loti MAFF303099; identical to SEQ ID NO: 40286

SEQ ID NO: 60898 - DNA, 1029 bp, Mesorhizobium loti MAFF303099; identical to SEQ ID NO: 40287
  CDS (1)..(1029): transl_table=11

SEQ ID NO: 60899 - protein, 342 aa, Mesorhizobium loti MAFF303099; identical to SEQ ID NO: 40288

SEQ ID NO: 60900 - DNA, 1062 bp, Mesorhizobium loti MAFF303099; identical to SEQ ID NO: 40289
  CDS (1)..(1062): transl_table=11

SEQ ID NO: 60901 - protein, 353 aa, Mesorhizobium loti MAFF303099; identical to SEQ ID NO: 40290

SEQ ID NO: 60902 - DNA, 975 bp, Mesorhizobium loti MAFF303099; identical to SEQ ID NO: 40291
  CDS (1)..(975): transl_table=11

SEQ ID NO: 60903 - protein, 324 aa, Mesorhizobium loti MAFF303099; identical to SEQ ID NO: 40292

SEQ ID NO: 60904 - DNA, 954 bp, Thermotoga maritima MSB8; identical to SEQ ID NO: 40293
  CDS (1)..(954): transl_table=11

SEQ ID NO: 60905 - protein, 317 aa, Thermotoga maritima MSB8; identical to SEQ ID NO: 40294

SEQ ID NO: 60906 - DNA, 996 bp, Thermotoga maritima MSB8; identical to SEQ ID NO: 40295
  CDS (1)..(996): transl_table=11

SEQ ID NO: 60907 - protein, 331 aa, Thermotoga maritima MSB8; identical to SEQ ID NO: 40296

SEQ ID NO: 60908 - DNA, 1014 bp, Vibrio cholerae O1 biovar eltor str. N16961; identical to SEQ ID NO: 40297
  CDS (1)..(1014): transl_table=11

SEQ ID NO: 60909 - protein, 337 aa, Vibrio cholerae O1 biovar eltor str. N16961; identical to SEQ ID NO: 40298

SEQ ID NO: 60910 - DNA, 999 bp, Vibrio cholerae O1 biovar eltor str. N16961; identical to SEQ ID NO: 40299
  CDS (1)..(999): transl_table=11

SEQ ID NO: 60911 - protein, 332 aa, Vibrio cholerae O1 biovar eltor str. N16961; identical to SEQ ID NO: 40300

SEQ ID NO: 60912 - DNA, 1167 bp, Bacillus halodurans C-125; identical to SEQ ID NO: 40301
  CDS (1)..(1167): transl_table=11

SEQ ID NO: 60913 - protein, 388 aa, Bacillus halodurans C-125; identical to SEQ ID NO: 40302

SEQ ID NO: 60914 - DNA, 945 bp, Bacillus halodurans C-125; identical to SEQ ID NO: 40303
  CDS (1)..(945): transl_table=11

SEQ ID NO: 60915 - protein, 314 aa, Bacillus halodurans C-125; identical to SEQ ID NO: 40304

SEQ ID NO: 60916 - DNA, 969 bp, Pasteurella multocida subsp. multocida str. Pm70; identical to SEQ ID NO: 40305
  CDS (1)..(969): transl_table=11

SEQ ID NO: 60917 - protein, 322 aa, Pasteurella multocida subsp. multocida str. Pm70; identical to SEQ ID NO: 40306

SEQ ID NO: 60918 - DNA, 1011 bp, Pasteurella multocida subsp. multocida str. Pm70; identical to SEQ ID NO: 40307
  CDS (1)..(1011): transl_table=11

SEQ ID NO: 60919 - protein, 336 aa, Pasteurella multocida subsp. multocida str. Pm70; identical to SEQ ID NO: 40308

SEQ ID NO: 60920 - DNA, 993 bp, Pasteurella multocida subsp. multocida str. Pm70; identical to SEQ ID NO: 40309
  CDS (1)..(993): transl_table=11

SEQ ID NO: 60921 - protein, 330 aa, Pasteurella multocida subsp. multocida str. Pm70; identical to SEQ ID NO: 40310

SEQ ID NO: 60922 - DNA, 1044 bp, Pasteurella multocida subsp. multocida str. Pm70; identical to SEQ ID NO: 40311
  CDS (1)..(1044): transl_table=11

SEQ ID NO: 60923 - protein, 347 aa, Pasteurella multocida subsp. multocida str. Pm70; identical to SEQ ID NO: 40312

SEQ ID NO: 60924 - DNA, 972 bp, Pasteurella multocida subsp. multocida str. Pm70; identical to SEQ ID NO: 40313
  CDS (1)..(972): transl_table=11

SEQ ID NO: 60925 - protein, 323 aa, Pasteurella multocida subsp. multocida str. Pm70; identical to SEQ ID NO: 40314

SEQ ID NO: 60926 - DNA, 999 bp, Pseudomonas aeruginosa PAO1; identical to SEQ ID NO: 40315
  CDS (1)..(999): transl_table=11

SEQ ID NO: 60927 - protein, 332 aa, Pseudomonas aeruginosa PAO1; identical to SEQ ID NO: 40316

SEQ ID NO: 60928 - DNA, 942 bp, Lactococcus lactis subsp. lactis Il1403; identical to SEQ ID NO: 40317
  CDS (1)..(942): transl_table=11

SEQ ID NO: 60929 - protein, 313 aa, Lactococcus lactis subsp. lactis Il1403; identical to SEQ ID NO: 40318

SEQ ID NO: 60930 - DNA, 1011 bp, Escherichia coli O157:H7 EDL933; identical to SEQ ID NO: 40319
  CDS (1)..(1011): n means a or g or c or t/u, s means g or c

SEQ ID NO: 60931 - protein, 336 aa, Escherichia coli O157:H7 EDL933; identical to SEQ ID NO: 40320
  Xaa in position 300 is unknown

SEQ ID NO: 60932 - DNA, 966 bp, Escherichia coli O157:H7 EDL933; identical to SEQ ID NO: 40321
  CDS (1)..(966): n means a or g or c or t/u, s means g or c

SEQ ID NO: 60933 - protein, 321 aa, Escherichia coli O157:H7 EDL933; identical to SEQ ID NO: 40322
  Xaa in position 201 is unknown

SEQ ID NO: 60934 - DNA, 1809 bp, Mycobacterium leprae TN; identical to SEQ ID NO: 40323
  CDS (1)..(1809): transl_table=11

SEQ ID NO: 60935 - protein, 602 aa, Mycobacterium leprae TN; identical to SEQ ID NO: 40324

SEQ ID NO: 60936 - DNA, 1029 bp, Escherichia coli O157:H7; identical to SEQ ID NO: 40325
  CDS (1)..(1029): transl_table=11

SEQ ID NO: 60937 - protein, 342 aa, Escherichia coli O157:H7; identical to SEQ ID NO: 40326

SEQ ID NO: 60938 - DNA, 1011 bp, Escherichia coli O157:H7; identical to SEQ ID NO: 40327
  CDS (1)..(1011): transl_table=11

SEQ ID NO: 60939 - protein, 336 aa, Escherichia coli O157:H7; identical to SEQ ID NO: 40328

SEQ ID NO: 60940 - DNA, 999 bp, Escherichia coli O157:H7; identical to SEQ ID NO: 40329
  CDS (1)..(999): transl_table=11

SEQ ID NO: 60941 - protein, 332 aa, Escherichia coli O157:H7; identical to SEQ ID NO: 40330

SEQ ID NO: 60942 - DNA, 975 bp, Escherichia coli O157:H7; identical to SEQ ID NO: 40331
  CDS (1)..(975): transl_table=11

SEQ ID NO: 60943 - protein, 324 aa, Escherichia coli O157:H7; identical to SEQ ID NO: 40332

SEQ ID NO: 60944 - DNA, 1917 bp, Mycoplasma pulmonis UAB CTIP; identical to SEQ ID NO: 40333
  CDS (1)..(1917): transl_table=4

SEQ ID NO: 60945 - protein, 638 aa, Mycoplasma pulmonis UAB CTIP; identical to SEQ ID NO: 40334

SEQ ID NO: 60946 - DNA, 1035 bp, Agrobacterium tumefaciens str. C58; identical to SEQ ID NO: 40335
  CDS (1)..(1035): transl_table=11

SEQ ID NO: 60947 - protein, 344 aa, Agrobacterium tumefaciens str. C58; identical to SEQ ID NO: 40336

SEQ ID NO: 60948 - DNA, 1377 bp, Agrobacterium tumefaciens str. C58; identical to SEQ ID NO: 40337
  CDS (1)..(1377): transl_table=11

SEQ ID NO: 60949 - protein, 458 aa, Agrobacterium tumefaciens str. C58; identical to SEQ ID NO: 40338

SEQ ID NO: 60950 - DNA, 975 bp, Sinorhizobium meliloti 1021; identical to SEQ ID NO: 40339
  CDS (1)..(975): transl_table=11

SEQ ID NO: 60951 - protein, 324 aa, Sinorhizobium meliloti 1021; identical to SEQ ID NO: 40340

SEQ ID NO: 60952 - DNA, 1083 bp, Sinorhizobium meliloti 1021; identical to SEQ ID NO: 40341
  CDS (1)..(1083): transl_table=11

SEQ ID NO: 60953 - protein, 360 aa, Sinorhizobium meliloti 1021; identical to SEQ ID NO: 40342

SEQ ID NO: 60954 - DNA, 1005 bp, Sinorhizobium meliloti 1021; identical to SEQ ID NO: 40343
  CDS (1)..(1005): transl_table=11

SEQ ID NO: 60955 - protein, 334 aa, Sinorhizobium meliloti 1021; identical to SEQ ID NO: 40344

SEQ ID NO: 60956 - DNA, 1050 bp, Sinorhizobium meliloti 1021; identical to SEQ ID NO: 40345
  CDS (1)..(1050): transl_table=11

SEQ ID NO: 60957 - protein, 349 aa, Sinorhizobium meliloti 1021; identical to SEQ ID NO: 40346

SEQ ID NO: 60958 - DNA, 1008 bp, Sinorhizobium meliloti 1021; identical to SEQ ID NO: 40347
  CDS (1)..(1008): transl_table=11

SEQ ID NO: 60959 - protein, 335 aa, Sinorhizobium meliloti 1021; identical to SEQ ID NO: 40348

SEQ ID NO: 60960 - DNA, 1050 bp, Yersinia pestis CO92; identical to SEQ ID NO: 40349
  CDS (1)..(1050): transl_table=11

SEQ ID NO: 60961 - protein, 349 aa, Yersinia pestis CO92; identical to SEQ ID NO: 40350

SEQ ID NO: 60962 - DNA, 999 bp, Caulobacter crescentus CB15; identical to SEQ ID NO: 40351
  CDS (1)..(999): transl_table=11

SEQ ID NO: 60963 - protein, 332 aa, Caulobacter crescentus CB15; identical to SEQ ID NO: 40352

SEQ ID NO: 60964 - DNA, 996 bp, Sinorhizobium meliloti 1021; identical to SEQ ID NO: 40353
  CDS (1)..(996): transl_table=11

SEQ ID NO: 60965 - protein, 331 aa, Sinorhizobium meliloti 1021; identical to SEQ ID NO: 40354

SEQ ID NO: 60966 - DNA, 1065 bp, Sinorhizobium meliloti 1021; identical to SEQ ID NO: 40355
  CDS (1)..(1065): transl_table=11

SEQ ID NO: 60967 - protein, 354 aa, Sinorhizobium meliloti 1021; identical to SEQ ID NO: 40356

SEQ ID NO: 60968 - DNA, 954 bp, Sinorhizobium meliloti 1021; identical to SEQ ID NO: 40357
  CDS (1)..(954): transl_table=11

SEQ ID NO: 60969 - protein, 317 aa, Sinorhizobium meliloti 1021; identical to SEQ ID NO: 40358

SEQ ID NO: 60970 - DNA, 1032 bp, Sinorhizobium meliloti 1021; identical to SEQ ID NO: 40359
  CDS (1)..(1032): transl_table=11

SEQ ID NO: 60971 - protein, 343 aa, Sinorhizobium meliloti 1021; identical to SEQ ID NO: 40360

SEQ ID NO: 60972 - DNA, 963 bp, Sinorhizobium meliloti 1021; identical to SEQ ID NO: 40361
  CDS (1)..(963): transl_table=11

SEQ ID NO: 60973 - protein, 320 aa, Sinorhizobium meliloti 1021; identical to SEQ ID NO: 40362

SEQ ID NO: 60974 - DNA, 999 bp, Sinorhizobium meliloti 1021; identical to SEQ ID NO: 40363
  CDS (1)..(999): transl_table=11

SEQ ID NO: 60975 - protein, 332 aa, Sinorhizobium meliloti 1021; identical to SEQ ID NO: 40364

SEQ ID NO: 60976 - DNA, 996 bp, Sinorhizobium meliloti 1021; identical to SEQ ID NO: 40365
  CDS (1)..(996): transl_table=11

SEQ ID NO: 60977 - protein, 331 aa, Sinorhizobium meliloti 1021; identical to SEQ ID NO: 40366

SEQ ID NO: 60978 - DNA, 1215 bp, Sinorhizobium meliloti 1021; identical to SEQ ID NO: 40367
  CDS (1)..(1215): transl_table=11

SEQ ID NO: 60979 - protein, 404 aa, Sinorhizobium meliloti 1021; identical to SEQ ID NO: 40368

SEQ ID NO: 60980 - DNA, 1362 bp, Sinorhizobium meliloti 1021; identical to SEQ ID NO: 40369
  CDS (1)..(1362): transl_table=11

SEQ ID NO: 60981 - protein, 453 aa, Sinorhizobium meliloti 1021; identical to SEQ ID NO: 40370

SEQ ID NO: 60982 - DNA, 1323 bp, Sinorhizobium meliloti 1021; identical to SEQ ID NO: 40371
  CDS (1)..(1323): transl_table=11

SEQ ID NO: 60983 - protein, 440 aa, Sinorhizobium meliloti 1021; identical to SEQ ID NO: 40372

SEQ ID NO: 60984 - DNA, 1026 bp, Sinorhizobium meliloti 1021; identical to SEQ ID NO: 40373
  CDS (1)..(1026): transl_table=11

SEQ ID NO: 60985 - protein, 341 aa, Sinorhizobium meliloti 1021; identical to SEQ ID NO: 40374

SEQ ID NO: 60986 - DNA, 957 bp, Sinorhizobium meliloti 1021; identical to SEQ ID NO: 40375
  CDS (1)..(957): transl_table=11

SEQ ID NO: 60987 - protein, 318 aa, Sinorhizobium meliloti 1021; identical to SEQ ID NO: 40376

SEQ ID NO: 60988 - DNA, 966 bp, Salmonella typhimurium LT2; identical to SEQ ID NO: 40377
  CDS (1)..(966): transl_table=11

SEQ ID NO: 60989 - protein, 321 aa, Salmonella typhimurium LT2; identical to SEQ ID NO: 40378

SEQ ID NO: 60990 - DNA, 1047 bp, Ralstonia solanacearum GMI1000; identical to SEQ ID NO: 40379
  CDS (1)..(1047): transl_table=11

SEQ ID NO: 60991 - protein, 348 aa, Ralstonia solanacearum GMI1000; identical to SEQ ID NO: 40380

SEQ ID NO: 60992 - DNA, 1008 bp, Ralstonia solanacearum GMI1000; identical to SEQ ID NO: 40381
  CDS (1)..(1008): transl_table=11

SEQ ID NO: 60993 - protein, 335 aa, Ralstonia solanacearum GMI1000; identical to SEQ ID NO: 40382

SEQ ID NO: 60994 - DNA, 1197 bp, Ralstonia solanacearum GMI1000; identical to SEQ ID NO: 40383
  CDS (1)..(1197): transl_table=11

SEQ ID NO: 60995 - protein, 398 aa, Ralstonia solanacearum GMI1000; identical to SEQ ID NO: 40384

SEQ ID NO: 60996 - DNA, 1107 bp, Agrobacterium tumefaciens str. C58; identical to SEQ ID NO: 40385
  CDS (1)..(1107): transl_table=11

SEQ ID NO: 60997 - protein, 368 aa, Agrobacterium tumefaciens str. C58; identical to SEQ ID NO: 40386

SEQ ID NO: 60998 - DNA, 981 bp, Agrobacterium tumefaciens str. C58; identical to SEQ ID NO: 40387
  CDS (1)..(981): transl_table=11

SEQ ID NO: 60999 - protein, 326 aa, Agrobacterium tumefaciens str. C58; identical to SEQ ID NO: 40388

SEQ ID NO: 61000 - DNA, 1197 bp, Agrobacterium tumefaciens str. C58; identical to SEQ ID NO: 40389
  CDS (1)..(1197): transl_table=11

SEQ ID NO: 61001 - protein, 398 aa, Agrobacterium tumefaciens str. C58; identical to SEQ ID NO: 40390

SEQ ID NO: 61002 - DNA, 1023 bp, Agrobacterium tumefaciens str. C58; identical to SEQ ID NO: 40391
  CDS (1)..(1023): transl_table=11

SEQ ID NO: 61003 - protein, 340 aa, Agrobacterium tumefaciens str. C58; identical to SEQ ID NO: 40392

SEQ ID NO: 61004 - DNA, 1005 bp, Agrobacterium tumefaciens str. C58; identical to SEQ ID NO: 40393
  CDS (1)..(1005): transl_table=11

SEQ ID NO: 61005 - protein, 334 aa, Agrobacterium tumefaciens str. C58; identical to SEQ ID NO: 40394

SEQ ID NO: 61006 - DNA, 981 bp, Agrobacterium tumefaciens str. C58; identical to SEQ ID NO: 40395
  CDS (1)..(981): transl_table=11

SEQ ID NO: 61007 - protein, 326 aa, Agrobacterium tumefaciens str. C58; identical to SEQ ID NO: 40396

SEQ ID NO: 61008 - DNA, 1065 bp, Agrobacterium tumefaciens str. C58; identical to SEQ ID NO: 40397
  CDS (1)..(1065): transl_table=11

SEQ ID NO: 61009 - protein, 354 aa, Agrobacterium tumefaciens str. C58; identical to SEQ ID NO: 40398

SEQ ID NO: 61010 - DNA, 1002 bp, Agrobacterium tumefaciens str. C58; identical to SEQ ID NO: 40399
  CDS (1)..(1002): transl_table=11

SEQ ID NO: 61011 - protein, 333 aa, Agrobacterium tumefaciens str. C58; identical to SEQ ID NO: 40400

SEQ ID NO: 61012 - DNA, 1314 bp, Agrobacterium tumefaciens str. C58; identical to SEQ ID NO: 40401
  CDS (1)..(1314): transl_table=11

SEQ ID NO: 61013 - protein, 437 aa, Agrobacterium tumefaciens str. C58; identical to SEQ ID NO: 40402

SEQ ID NO: 61014 - DNA, 984 bp, Agrobacterium tumefaciens str. C58; identical to SEQ ID NO: 40403
  CDS (1)..(984): transl_table=11

SEQ ID NO: 61015 - protein, 327 aa, Agrobacterium tumefaciens str. C58; identical to SEQ ID NO: 40404

SEQ ID NO: 61016 - DNA, 1164 bp, Brucella melitensis 16M; identical to SEQ ID NO: 40405
  CDS (1)..(1164): transl_table=11

SEQ ID NO: 61017 - protein, 387 aa, Brucella melitensis 16M; identical to SEQ ID NO: 40406

SEQ ID NO: 61018 - DNA, 1170 bp, Brucella melitensis 16M; identical to SEQ ID NO: 40407
  CDS (1)..(1170): transl_table=11

SEQ ID NO: 61019 - protein, 389 aa, Brucella melitensis 16M; identical to SEQ ID NO: 40408

SEQ ID NO: 61020 - DNA, 1191 bp, Brucella melitensis 16M; identical to SEQ ID NO: 40409
  CDS (1)..(1191): transl_table=11

SEQ ID NO: 61021 - protein, 396 aa, Brucella melitensis 16M; identical to SEQ ID NO: 40410

SEQ ID NO: 61022 - DNA, 1197 bp, Brucella melitensis 16M; identical to SEQ ID NO: 40411
  CDS (1)..(1197): transl_table=11

SEQ ID NO: 61023 - protein, 398 aa, Brucella melitensis 16M; identical to SEQ ID NO: 40412

SEQ ID NO: 61024 - DNA, 1029 bp, Clostridium perfringens str. 13; identical to SEQ ID NO: 40413
  CDS (1)..(1029): transl_table=11

SEQ ID NO: 61025 - protein, 342 aa, Clostridium perfringens str. 13; identical to SEQ ID NO: 40414

SEQ ID NO: 61026 - DNA, 936 bp, Clostridium perfringens str. 13; identical to SEQ ID NO: 40415
  CDS (1)..(936): transl_table=11

SEQ ID NO: 61027 - protein, 311 aa, Clostridium perfringens str. 13; identical to SEQ ID NO: 40416

SEQ ID NO: 61028 - DNA, 915 bp, Corynebacterium glutamicum ATCC 13032; identical to SEQ ID NO: 40417
  CDS (1)..(915): transl_table=11

SEQ ID NO: 61029 - protein, 304 aa, Corynebacterium glutamicum ATCC 13032; identical to SEQ ID NO: 40418

SEQ ID NO: 61030 - DNA, 1020 bp, Fusobacterium nucleatum subsp. nucleatum ATCC 25586; identical to SEQ ID NO: 40419
  CDS (1)..(1020): transl_table=11

SEQ ID NO: 61031 - protein, 339 aa, Fusobacterium nucleatum subsp. nucleatum ATCC 25586; identical to SEQ ID NO: 40420

SEQ ID NO: 61032 - DNA, 957 bp, Thermoanaerobacter tengcongensis MB4; identical to SEQ ID NO: 40421
  CDS (1)..(957): transl_table=11

SEQ ID NO: 61033 - protein, 318 aa, Thermoanaerobacter tengcongensis MB4; identical to SEQ ID NO: 40422

SEQ ID NO: 61034 - DNA, 1191 bp, Thermoanaerobacter tengcongensis MB4; identical to SEQ ID NO: 40423
  CDS (1)..(1191): transl_table=11

SEQ ID NO: 61035 - protein, 396 aa, Thermoanaerobacter tengcongensis MB4; identical to SEQ ID NO: 40424

SEQ ID NO: 61036 - DNA, 975 bp, Thermoanaerobacter tengcongensis MB4; identical to SEQ ID NO: 40425
  CDS (1)..(975): transl_table=11

SEQ ID NO: 61037 - protein, 324 aa, Thermoanaerobacter tengcongensis MB4; identical to SEQ ID NO: 40426

SEQ ID NO: 61038 - DNA, 1245 bp, Streptomyces coelicolor A3(2); identical to SEQ ID NO: 40427
  CDS (1)..(1245): transl_table=11

SEQ ID NO: 61039 - protein, 414 aa, Streptomyces coelicolor A3(2); identical to SEQ ID NO: 40428

SEQ ID NO: 61040 - DNA, 1956 bp, Streptomyces coelicolor A3(2); identical to SEQ ID NO: 40429
  CDS (1)..(1956): transl_table=11

SEQ ID NO: 61041 - protein, 651 aa, Streptomyces coelicolor A3(2); identical to SEQ ID NO: 40430

SEQ ID NO: 61042 - DNA, 1293 bp, Streptomyces coelicolor A3(2); identical to SEQ ID NO: 40431
  CDS (1)..(1293): transl_table=11

SEQ ID NO: 61043 - protein, 430 aa, Streptomyces coelicolor A3(2); identical to SEQ ID NO: 40432

SEQ ID NO: 61044 - DNA, 1020 bp, Streptomyces coelicolor A3(2); identical to SEQ ID NO: 40433
  CDS (1)..(1020): transl_table=11

SEQ ID NO: 61045 - protein, 339 aa, Streptomyces coelicolor A3(2); identical to SEQ ID NO: 40434

SEQ ID NO: 61046 - DNA, 1146 bp, Yersinia pestis KIM; identical to SEQ ID NO: 40435
  CDS (1)..(1146): transl_table=11

SEQ ID NO: 61047 - protein, 381 aa, Yersinia pestis KIM; identical to SEQ ID NO: 40436

SEQ ID NO: 61048 - DNA, 1065 bp, Yersinia pestis KIM; identical to SEQ ID NO: 40437
  CDS (1)..(1065): transl_table=11

SEQ ID NO: 61049 - protein, 354 aa, Yersinia pestis KIM; identical to SEQ ID NO: 40438

SEQ ID NO: 61050 - DNA, 996 bp, Yersinia pestis KIM; identical to SEQ ID NO: 40439
  CDS (1)..(996): transl_table=11

SEQ ID NO: 61051 - protein, 331 aa, Yersinia pestis KIM; identical to SEQ ID NO: 40440

SEQ ID NO: 61052 - DNA, 1026 bp, Yersinia pestis KIM; identical to SEQ ID NO: 40441
  CDS (1)..(1026): transl_table=11

SEQ ID NO: 61053 - protein, 341 aa, Yersinia pestis KIM; identical to SEQ ID NO: 40442

SEQ ID NO: 61054 - DNA, 999 bp, Yersinia pestis KIM; identical to SEQ ID NO: 40443
  CDS (1)..(999): transl_table=11

SEQ ID NO: 61055 - protein, 332 aa, Yersinia pestis KIM; identical to SEQ ID NO: 40444

SEQ ID NO: 61056 - DNA, 1011 bp, Yersinia pestis KIM; identical to SEQ ID NO: 40445
  CDS (1)..(1011): transl_table=11

SEQ ID NO: 61057 - protein, 336 aa, Yersinia pestis KIM; identical to SEQ ID NO: 40446

SEQ ID NO: 61058 - DNA, 1194 bp, Yersinia pestis KIM; identical to SEQ ID NO: 40447
  CDS (1)..(1194): transl_table=11

SEQ ID NO: 61059 - protein, 397 aa, Yersinia pestis KIM; identical to SEQ ID NO: 40448

SEQ ID NO: 61060 - DNA, 933 bp, Streptococcus agalactiae 2603V/R; identical to SEQ ID NO: 40449
  CDS (1)..(933): transl_table=11

SEQ ID NO: 61061 - protein, 310 aa, Streptococcus agalactiae 2603V/R; identical to SEQ ID NO: 40450

SEQ ID NO: 61062 - DNA, 939 bp, Oceanobacillus iheyensis HTE831; identical to SEQ ID NO: 40451
  CDS (1)..(939): transl_table=11

SEQ ID NO: 61063 - protein, 312 aa, Oceanobacillus iheyensis HTE831; identical to SEQ ID NO: 40452

SEQ ID NO: 61064 - DNA, 1218 bp, Bifidobacterium longum NCC2705; identical to SEQ ID NO: 40453
  CDS (1)..(1218): transl_table=11

SEQ ID NO: 61065 - protein, 405 aa, Bifidobacterium longum NCC2705; identical to SEQ ID NO: 40454

SEQ ID NO: 61066 - DNA, 1128 bp, Brucella suis 1330; identical to SEQ ID NO: 40455
  CDS (1)..(1128): transl_table=11

SEQ ID NO: 61067 - protein, 375 aa, Brucella suis 1330; identical to SEQ ID NO: 40456

SEQ ID NO: 61068 - DNA, 1239 bp, Brucella suis 1330; identical to SEQ ID NO: 40457
  CDS (1)..(1239): transl_table=11

SEQ ID NO: 61069 - protein, 412 aa, Brucella suis 1330; identical to SEQ ID NO: 40458

SEQ ID NO: 61070 - DNA, 1191 bp, Brucella suis 1330; identical to SEQ ID NO: 40459
  CDS (1)..(1191): transl_table=11

SEQ ID NO: 61071 - protein, 396 aa, Brucella suis 1330; identical to SEQ ID NO: 40460

SEQ ID NO: 61072 - DNA, 1170 bp, Brucella suis 1330; identical to SEQ ID NO: 40461
  CDS (1)..(1170): transl_table=11

SEQ ID NO: 61073 - protein, 389 aa, Brucella suis 1330; identical to SEQ ID NO: 40462

SEQ ID NO: 61074 - DNA, 1029 bp, Shigella flexneri 2a str. 301; identical to SEQ ID NO: 40463
  CDS (1)..(1029): transl_table=11

SEQ ID NO: 61075 - protein, 342 aa, Shigella flexneri 2a str. 301; identical to SEQ ID NO: 40464

SEQ ID NO: 61076 - DNA, 1011 bp, Shigella flexneri 2a str. 301; identical to SEQ ID NO: 40465
  CDS (1)..(1011): transl_table=11

SEQ ID NO: 61077 - protein, 336 aa, Shigella flexneri 2a str. 301; identical to SEQ ID NO: 40466

SEQ ID NO: 61078 - DNA, 999 bp, Shigella flexneri 2a str. 301; identical to SEQ ID NO: 40467
  CDS (1)..(999): transl_table=11

SEQ ID NO: 61079 - protein, 332 aa, Shigella flexneri 2a str. 301; identical to SEQ ID NO: 40468

SEQ ID NO: 61080 - DNA, 966 bp, Shigella flexneri 2a str. 301; identical to SEQ ID NO: 40469
  CDS (1)..(966): transl_table=11

SEQ ID NO: 61081 - protein, 321 aa, Shigella flexneri 2a str. 301; identical to SEQ ID NO: 40470

SEQ ID NO: 61082 - DNA, 942 bp, Streptococcus agalactiae NEM316; identical to SEQ ID NO: 40471
  CDS (1)..(942): transl_table=11

SEQ ID NO: 61083 - protein, 313 aa, Streptococcus agalactiae NEM316; identical to SEQ ID NO: 40472

SEQ ID NO: 61084 - DNA, 990 bp, Escherichia coli CFT073; identical to SEQ ID NO: 40473
  CDS (1)..(990): transl_table=11

SEQ ID NO: 61085 - protein, 329 aa, Escherichia coli CFT073; identical to SEQ ID NO: 40474

SEQ ID NO: 61086 - DNA, 1011 bp, Escherichia coli CFT073; identical to SEQ ID NO: 40475
  CDS (1)..(1011): transl_table=11

SEQ ID NO: 61087 - protein, 336 aa, Escherichia coli CFT073; identical to SEQ ID NO: 40476

SEQ ID NO: 61088 - DNA, 999 bp, Escherichia coli CFT073; identical to SEQ ID NO: 40477
  CDS (1)..(999): transl_table=11

SEQ ID NO: 61089 - protein, 332 aa, Escherichia coli CFT073; identical to SEQ ID NO: 40478

SEQ ID NO: 61090 - DNA, 990 bp, Escherichia coli CFT073; identical to SEQ ID NO: 40479
  CDS (1)..(990): transl_table=11

SEQ ID NO: 61091 - protein, 329 aa, Escherichia coli CFT073; identical to SEQ ID NO: 40480

SEQ ID NO: 61092 - DNA, 987 bp, Vibrio vulnificus CMCP6; identical to SEQ ID NO: 40481
  CDS (1)..(987): transl_table=11

SEQ ID NO: 61093 - protein, 328 aa, Vibrio vulnificus CMCP6; identical to SEQ ID NO: 40482

SEQ ID NO: 61094 - DNA, 1086 bp, Bradyrhizobium japonicum USDA 110; identical to SEQ ID NO: 40483
  CDS (1)..(1086): transl_table=11

SEQ ID NO: 61095 - protein, 361 aa, Bradyrhizobium japonicum USDA 110; identical to SEQ ID NO: 40484

SEQ ID NO: 61096 - DNA, 978 bp, Bradyrhizobium japonicum USDA 110; identical to SEQ ID NO: 40485
  CDS (1)..(978): transl_table=11

SEQ ID NO: 61097 - protein, 325 aa, Bradyrhizobium japonicum USDA 110; identical to SEQ ID NO: 40486

SEQ ID NO: 61098 - DNA, 1191 bp, Bradyrhizobium japonicum USDA 110; identical to SEQ ID NO: 40487
  CDS (1)..(1191): transl_table=11

SEQ ID NO: 61099 - protein, 396 aa, Bradyrhizobium japonicum USDA 110; identical to SEQ ID NO: 40488

SEQ ID NO: 61100 - DNA, 1029 bp, Bradyrhizobium japonicum USDA 110; identical to SEQ ID NO: 40489
  CDS (1)..(1029): transl_table=11

SEQ ID NO: 61101 - protein, 342 aa, Bradyrhizobium japonicum USDA 110; identical to SEQ ID NO: 40490

SEQ ID NO: 61102 - DNA, 1041 bp, Bradyrhizobium japonicum USDA 110; identical to SEQ ID NO: 40491
  CDS (1)..(1041): transl_table=11

SEQ ID NO: 61103 - protein, 346 aa, Bradyrhizobium japonicum USDA 110; identical to SEQ ID NO: 40492

SEQ ID NO: 61104 - DNA, 1011 bp, Clostridium tetani E88; identical to SEQ ID NO: 40493
  CDS (1)..(1011): transl_table=11

SEQ ID NO: 61105 - protein, 336 aa, Clostridium tetani E88; identical to SEQ ID NO: 40494

SEQ ID NO: 61106 - DNA, 987 bp, Clostridium tetani E88; identical to SEQ ID NO: 40495
  CDS (1)..(987): transl_table=11

SEQ ID NO: 61107 - protein, 328 aa, Clostridium tetani E88; identical to SEQ ID NO: 40496

SEQ ID NO: 61108 - DNA, 951 bp, Clostridium tetani E88; identical to SEQ ID NO: 40497
  CDS (1)..(951): transl_table=11

SEQ ID NO: 61109 - protein, 316 aa, Clostridium tetani E88; identical to SEQ ID NO: 40498

SEQ ID NO: 61110 - DNA, 1233 bp, Tropheryma whipplei str. Twist; identical to SEQ ID NO: 40499
  CDS (1)..(1233): transl_table=11

SEQ ID NO: 61111 - protein, 410 aa, Tropheryma whipplei str. Twist; identical to SEQ ID NO: 40500

SEQ ID NO: 61112 - DNA, 1224 bp, Tropheryma whipplei TW08/27; identical to SEQ ID NO: 40501
  CDS (1)..(1224): transl_table=11

SEQ ID NO: 61113 - protein, 407 aa, Tropheryma whipplei TW08/27; identical to SEQ ID NO: 40502

SEQ ID NO: 61114 - DNA, 1005 bp, Pseudomonas syringae pv. tomato str. DC3000; identical to SEQ ID NO: 40503
  CDS (1)..(1005): transl_table=11

SEQ ID NO: 61115 - protein, 334 aa, Pseudomonas syringae pv. tomato str. DC3000; identical to SEQ ID NO: 40504

SEQ ID NO: 61116 - DNA, 990 bp, Pseudomonas syringae pv. tomato str. DC3000; identical to SEQ ID NO: 40505
  CDS (1)..(990): transl_table=11

SEQ ID NO: 61117 - protein, 329 aa, Pseudomonas syringae pv. tomato str. DC3000; identical to SEQ ID NO: 40506

SEQ ID NO: 61118 - DNA, 1137 bp, Pseudomonas syringae pv. tomato str. DC3000; identical to SEQ ID NO: 40507
  CDS (1)..(1137): transl_table=11

SEQ ID NO: 61119 - protein, 378 aa, Pseudomonas syringae pv. tomato str. DC3000; identical to SEQ ID NO: 40508

SEQ ID NO: 61120 - DNA, 1026 bp, Pseudomonas syringae pv. tomato str. DC3000; identical to SEQ ID NO: 40509
  CDS (1)..(1026): transl_table=11

SEQ ID NO: 61121 - protein, 341 aa, Pseudomonas syringae pv. tomato str. DC3000; identical to SEQ ID NO: 40510

SEQ ID NO: 61122 - DNA, 984 bp, Vibrio parahaemolyticus RIMD 2210633; identical to SEQ ID NO: 40511
  CDS (1)..(984): transl_table=11

SEQ ID NO: 61123 - protein, 327 aa, Vibrio parahaemolyticus RIMD 2210633; identical to SEQ ID NO: 40512

SEQ ID NO: 61124 - DNA, 990 bp, Vibrio parahaemolyticus RIMD 2210633; identical to SEQ ID NO: 40513
  CDS (1)..(990): transl_table=11

SEQ ID NO: 61125 - protein, 329 aa, Vibrio parahaemolyticus RIMD 2210633; identical to SEQ ID NO: 40514

SEQ ID NO: 61126 - DNA, 1011 bp, Salmonella enterica subsp. enterica serovar Typhi Ty2; identical to SEQ ID NO: 40515
  CDS (1)..(1011): transl_table=11

SEQ ID NO: 61127 - protein, 336 aa, Salmonella enterica subsp. enterica serovar Typhi Ty2; identical to SEQ ID NO: 40516

SEQ ID NO: 61128 - DNA, 1044 bp, Salmonella enterica subsp. enterica serovar Typhi Ty2; identical to SEQ ID NO: 40517
  CDS (1)..(1044): transl_table=11

SEQ ID NO: 61129 - protein, 347 aa, Salmonella enterica subsp. enterica serovar Typhi Ty2; identical to SEQ ID NO: 40518

SEQ ID NO: 61130 - DNA, 999 bp, Streptomyces avermitilis MA-4680; identical to SEQ ID NO: 40519
  CDS (1)..(999): transl_table=11

SEQ ID NO: 61131 - protein, 332 aa, Streptomyces avermitilis MA-4680; identical to SEQ ID NO: 40520

SEQ ID NO: 61132 - DNA, 1020 bp, Streptomyces avermitilis MA-4680; identical to SEQ ID NO: 40521
  CDS (1)..(1020): transl_table=11

SEQ ID NO: 61133 - protein, 339 aa, Streptomyces avermitilis MA-4680; identical to SEQ ID NO: 40522

SEQ ID NO: 61134 - DNA, 1293 bp, Streptomyces avermitilis MA-4680; identical to SEQ ID NO: 40523
  CDS (1)..(1293): transl_table=11

SEQ ID NO: 61135 - protein, 430 aa, Streptomyces avermitilis MA-4680; identical to SEQ ID NO: 40524

SEQ ID NO: 61136 - DNA, 1947 bp, Streptomyces avermitilis MA-4680; identical to SEQ ID NO: 40525
  CDS (1)..(1947): transl_table=11

SEQ ID NO: 61137 - protein, 648 aa, Streptomyces avermitilis MA-4680; identical to SEQ ID NO: 40526

SEQ ID NO: 61138 - DNA, 1245 bp, Streptomyces avermitilis MA-4680; identical to SEQ ID NO: 40527
  CDS (1)..(1245): transl_table=11

SEQ ID NO: 61139 - protein, 414 aa, Streptomyces avermitilis MA-4680; identical to SEQ ID NO: 40528

SEQ ID NO: 61140 - DNA, 960 bp, Streptomyces avermitilis MA-4680; identical to SEQ ID NO: 40529
  CDS (1)..(960): transl_table=11

SEQ ID NO: 61141 - protein, 319 aa, Streptomyces avermitilis MA-4680; identical to SEQ ID NO: 40530

SEQ ID NO: 61142 - DNA, 936 bp, Bacillus cereus ATCC 14579; identical to SEQ ID NO: 40531
  CDS (1)..(936): transl_table=11

SEQ ID NO: 61143 - protein, 311 aa, Bacillus cereus ATCC 14579; identical to SEQ ID NO: 40532

SEQ ID NO: 61144 - DNA, 996 bp, Bacillus cereus ATCC 14579; identical to SEQ ID NO: 40533
  CDS (1)..(996): transl_table=11

SEQ ID NO: 61145 - protein, 331 aa, Bacillus cereus ATCC 14579; identical to SEQ ID NO: 40534

SEQ ID NO: 61146 - DNA, 954 bp, Bacillus cereus ATCC 14579; identical to SEQ ID NO: 40535
  CDS (1)..(954): transl_table=11

SEQ ID NO: 61147 - protein, 317 aa, Bacillus cereus ATCC 14579; identical to SEQ ID NO: 40536

SEQ ID NO: 61148 - DNA, 1011 bp, Shigella flexneri 2a str. 2457T; identical to SEQ ID NO: 40537
  CDS (1)..(1011): transl_table=11

SEQ ID NO: 61149 - protein, 336 aa, Shigella flexneri 2a str. 2457T; identical to SEQ ID NO: 40538

SEQ ID NO: 61150 - DNA, 1062 bp, Rhodopirellula baltica SH 1; identical to SEQ ID NO: 40539
  CDS (1)..(1062): transl_table=11

SEQ ID NO: 61151 - protein, 353 aa, Rhodopirellula baltica SH 1; identical to SEQ ID NO: 40540

SEQ ID NO: 61152 - DNA, 972 bp, Rhodopirellula baltica SH 1; identical to SEQ ID NO: 40541
  CDS (1)..(972): transl_table=11

SEQ ID NO: 61153 - protein, 323 aa, Rhodopirellula baltica SH 1; identical to SEQ ID NO: 40542

SEQ ID NO: 61154 - DNA, 939 bp, Chromobacterium violaceum ATCC 12472; identical to SEQ ID NO: 40543
  CDS (1)..(939): transl_table=11

SEQ ID NO: 61155 - protein, 312 aa, Chromobacterium violaceum ATCC 12472; identical to SEQ ID NO: 40544

SEQ ID NO: 61156 - DNA, 981 bp, Gloeobacter violaceus PCC 7421; identical to SEQ ID NO: 40545
  CDS (1)..(981): transl_table=11

SEQ ID NO: 61157 - protein, 326 aa, Gloeobacter violaceus PCC 7421; identical to SEQ ID NO: 40546

SEQ ID NO: 61158 - DNA, 972 bp, Photorhabdus luminescens subsp. laumondii TTO1; identical to SEQ ID NO: 40547
  CDS (1)..(972): transl_table=11

SEQ ID NO: 61159 - protein, 323 aa, Photorhabdus luminescens subsp. laumondii TTO1; identical to SEQ ID NO: 40548

SEQ ID NO: 61160 - DNA, 1008 bp, Vibrio vulnificus YJ016; identical to SEQ ID NO: 40549
  CDS (1)..(1008): transl_table=11

SEQ ID NO: 61161 - protein, 335 aa, Vibrio vulnificus YJ016; identical to SEQ ID NO: 40550

SEQ ID NO: 61162 - DNA, 987 bp, Vibrio vulnificus YJ016; identical to SEQ ID NO: 40551
  CDS (1)..(987): transl_table=11

SEQ ID NO: 61163 - protein, 328 aa, Vibrio vulnificus YJ016; identical to SEQ ID NO: 40552

SEQ ID NO: 61164 - DNA, 954 bp, Bacillus cereus ATCC 10987; identical to SEQ ID NO: 40553
  CDS (1)..(954): transl_table=11

SEQ ID NO: 61165 - protein, 317 aa, Bacillus cereus ATCC 10987; identical to SEQ ID NO: 40554

SEQ ID NO: 61166 - DNA, 1323 bp, Mycoplasma mobile 163K; identical to SEQ ID NO: 40555
  CDS (1)..(1323): transl_table=4

SEQ ID NO: 61167 - protein, 440 aa, Mycoplasma mobile 163K; identical to SEQ ID NO: 40556

SEQ ID NO: 61168 - DNA, 936 bp, Bacillus anthracis str. Sterne; identical to SEQ ID NO: 40557
  CDS (1)..(936): transl_table=11

SEQ ID NO: 61169 - protein, 311 aa, Bacillus anthracis str. Sterne; identical to SEQ ID NO: 40558

SEQ ID NO: 61170 - DNA, 954 bp, Bacillus anthracis str. Sterne; identical to SEQ ID NO: 40559
  CDS (1)..(954): transl_table=11

SEQ ID NO: 61171 - protein, 317 aa, Bacillus anthracis str. Sterne; identical to SEQ ID NO: 40560

SEQ ID NO: 61172 - DNA, 936 bp, Bacillus thuringiensis serovar konkukian str. 97-27; identical to SEQ ID NO: 40561
  CDS (1)..(936): transl_table=11

SEQ ID NO: 61173 - protein, 311 aa, Bacillus thuringiensis serovar konkukian str. 97-27; identical to SEQ ID NO: 40562

SEQ ID NO: 61174 - DNA, 990 bp, Bacillus thuringiensis serovar konkukian str. 97-27; identical to SEQ ID NO: 40563
  CDS (1)..(990): transl_table=11

SEQ ID NO: 61175 - protein, 329 aa, Bacillus thuringiensis serovar konkukian str. 97-27; identical to SEQ ID NO: 40564

SEQ ID NO: 61176 - DNA, 954 bp, Bacillus thuringiensis serovar konkukian str. 97-27; identical to SEQ ID NO: 40565
  CDS (1)..(954): transl_table=11

SEQ ID NO: 61177 - protein, 317 aa, Bacillus thuringiensis serovar konkukian str. 97-27; identical to SEQ ID NO: 40566

SEQ ID NO: 61178 - DNA, 969 bp, Erwinia carotovora subsp. atroseptica SCRI1043; identical to SEQ ID NO: 40567
  CDS (1)..(969): transl_table=11

SEQ ID NO: 61179 - protein, 322 aa, Erwinia carotovora subsp. atroseptica SCRI1043; identical to SEQ ID NO: 40568

SEQ ID NO: 61180 - DNA, 1182 bp, Erwinia carotovora subsp. atroseptica SCRI1043; identical to SEQ ID NO: 40569
  CDS (1)..(1182): transl_table=11

SEQ ID NO: 61181 - protein, 393 aa, Erwinia carotovora subsp. atroseptica SCRI1043; identical to SEQ ID NO: 40570

SEQ ID NO: 61182 - DNA, 1032 bp, Erwinia carotovora subsp. atroseptica SCRI1043; identical to SEQ ID NO: 40571
  CDS (1)..(1032): transl_table=11

SEQ ID NO: 61183 - protein, 343 aa, Erwinia carotovora subsp. atroseptica SCRI1043; identical to SEQ ID NO: 40572

SEQ ID NO: 61184 - DNA, 1098 bp, Erwinia carotovora subsp. atroseptica SCRI1043; identical to SEQ ID NO: 40573
  CDS (1)..(1098): transl_table=11

SEQ ID NO: 61185 - protein, 365 aa, Erwinia carotovora subsp. atroseptica SCRI1043; identical to SEQ ID NO: 40574

SEQ ID NO: 61186 - DNA, 987 bp, Erwinia carotovora subsp. atroseptica SCRI1043; identical to SEQ ID NO: 40575
  CDS (1)..(987): transl_table=11

SEQ ID NO: 61187 - protein, 328 aa, Erwinia carotovora subsp. atroseptica SCRI1043; identical to SEQ ID NO: 40576

SEQ ID NO: 61188 - DNA, 996 bp, Erwinia carotovora subsp. atroseptica SCRI1043; identical to SEQ ID NO: 40577
  CDS (1)..(996): transl_table=11

SEQ ID NO: 61189 - protein, 331 aa, Erwinia carotovora subsp. atroseptica SCRI1043; identical to SEQ ID NO: 40578

SEQ ID NO: 61190 - DNA, 963 bp, Erwinia carotovora subsp. atroseptica SCRI1043; identical to SEQ ID NO: 40579
  CDS (1)..(963): transl_table=11

SEQ ID NO: 61191 - protein, 320 aa, Erwinia carotovora subsp. atroseptica SCRI1043; identical to SEQ ID NO: 40580

SEQ ID NO: 61192 - DNA, 978 bp, Propionibacterium acnes KPA171202; identical to SEQ ID NO: 40581
  CDS (1)..(978): transl_table=11

SEQ ID NO: 61193 - protein, 325 aa, Propionibacterium acnes KPA171202; identical to SEQ ID NO: 40582

SEQ ID NO: 61194 - DNA, 1350 bp, Leifsonia xyli subsp. xyli str. CTCB07; identical to SEQ ID NO: 40583
  CDS (1)..(1350): transl_table=11

SEQ ID NO: 61195 - protein, 449 aa, Leifsonia xyli subsp. xyli str. CTCB07; identical to SEQ ID NO: 40584

SEQ ID NO: 61196 - DNA, 1128 bp, Yersinia pseudotuberculosis IP 32953; identical to SEQ ID NO: 40585
  CDS (1)..(1128): transl_table=11

SEQ ID NO: 61197 - protein, 375 aa, Yersinia pseudotuberculosis IP 32953; identical to SEQ ID NO: 40586

SEQ ID NO: 61198 - DNA, 1029 bp, Yersinia pseudotuberculosis IP 32953; identical to SEQ ID NO: 40587
  CDS (1)..(1029): transl_table=11

SEQ ID NO: 61199 - protein, 342 aa, Yersinia pseudotuberculosis IP 32953; identical to SEQ ID NO: 40588

SEQ ID NO: 61200 - DNA, 999 bp, Yersinia pseudotuberculosis IP 32953; identical to SEQ ID NO: 40589
  CDS (1)..(999): transl_table=11

SEQ ID NO: 61201 - protein, 332 aa, Yersinia pseudotuberculosis IP 32953; identical to SEQ ID NO: 40590

SEQ ID NO: 61202 - DNA, 1011 bp, Yersinia pseudotuberculosis IP 32953; identical to SEQ ID NO: 40591
  CDS (1)..(1011): transl_table=11

SEQ ID NO: 61203 - protein, 336 aa, Yersinia pseudotuberculosis IP 32953; identical to SEQ ID NO: 40592

SEQ ID NO: 61204 - DNA, 1050 bp, Yersinia pseudotuberculosis IP 32953; identical to SEQ ID NO: 40593
  CDS (1)..(1050): transl_table=11

SEQ ID NO: 61205 - protein, 349 aa, Yersinia pseudotuberculosis IP 32953; identical to SEQ ID NO: 40594

SEQ ID NO: 61206 - DNA, 1062 bp, Yersinia pseudotuberculosis IP 32953; identical to SEQ ID NO: 40595
  CDS (1)..(1062): transl_table=11

SEQ ID NO: 61207 - protein, 353 aa, Yersinia pseudotuberculosis IP 32953; identical to SEQ ID NO: 40596

SEQ ID NO: 61208 - DNA, 993 bp, Yersinia pseudotuberculosis IP 32953; identical to SEQ ID NO: 40597
  CDS (1)..(993): transl_table=11

SEQ ID NO: 61209 - protein, 330 aa, Yersinia pseudotuberculosis IP 32953; identical to SEQ ID NO: 40598

SEQ ID NO: 61210 - DNA, 1029 bp, Yersinia pseudotuberculosis IP 32953; identical to SEQ ID NO: 40599
  CDS (1)..(1029): transl_table=11

SEQ ID NO: 61211 - protein, 342 aa, Yersinia pseudotuberculosis IP 32953; identical to SEQ ID NO: 40600

SEQ ID NO: 61212 - DNA, 993 bp, Yersinia pseudotuberculosis IP 32953; identical to SEQ ID NO: 40601
  CDS (1)..(993): transl_table=11

SEQ ID NO: 61213 - protein, 330 aa, Yersinia pseudotuberculosis IP 32953; identical to SEQ ID NO: 40602

SEQ ID NO: 61214 - DNA, 1185 bp, Yersinia pseudotuberculosis IP 32953; identical to SEQ ID NO: 40603
  CDS (1)..(1185): transl_table=11

SEQ ID NO: 61215 - protein, 394 aa, Yersinia pseudotuberculosis IP 32953; identical to SEQ ID NO: 40604

SEQ ID NO: 61216 - DNA, 996 bp, Symbiobacterium thermophilum IAM 14863; identical to SEQ ID NO: 40605
  CDS (1)..(996): transl_table=11

SEQ ID NO: 61217 - protein, 331 aa, Symbiobacterium thermophilum IAM 14863; identical to SEQ ID NO: 40606

SEQ ID NO: 61218 - DNA, 1212 bp, Bacillus licheniformis ATCC 14580; identical to SEQ ID NO: 40607
  CDS (1)..(1212): transl_table=11

SEQ ID NO: 61219 - protein, 403 aa, Bacillus licheniformis ATCC 14580; identical to SEQ ID NO: 40608

SEQ ID NO: 61220 - DNA, 963 bp, Bacillus licheniformis ATCC 14580; identical to SEQ ID NO: 40609
  CDS (1)..(963): transl_table=11

SEQ ID NO: 61221 - protein, 320 aa, Bacillus licheniformis ATCC 14580; identical to SEQ ID NO: 40610

SEQ ID NO: 61222 - DNA, 936 bp, Bacillus cereus E33L; identical to SEQ ID NO: 40611
  CDS (1)..(936): transl_table=11

SEQ ID NO: 61223 - protein, 311 aa, Bacillus cereus E33L; identical to SEQ ID NO: 40612

SEQ ID NO: 61224 - DNA, 954 bp, Bacillus cereus E33L; identical to SEQ ID NO: 40613
  CDS (1)..(954): transl_table=11

SEQ ID NO: 61225 - protein, 317 aa, Bacillus cereus E33L; identical to SEQ ID NO: 40614

SEQ ID NO: 61226 - DNA, 975 bp, Mannheimia succiniciproducens MBEL55E; identical to SEQ ID NO: 40615
  CDS (1)..(975): transl_table=11

SEQ ID NO: 61227 - protein, 324 aa, Mannheimia succiniciproducens MBEL55E; identical to SEQ ID NO: 40616

SEQ ID NO: 61228 - DNA, 933 bp, Mannheimia succiniciproducens MBEL55E; identical to SEQ ID NO: 40617
  CDS (1)..(933): transl_table=11

SEQ ID NO: 61229 - protein, 310 aa, Mannheimia succiniciproducens MBEL55E; identical to SEQ ID NO: 40618

SEQ ID NO: 61230 - DNA, 1008 bp, Mannheimia succiniciproducens MBEL55E; identical to SEQ ID NO: 40619
  CDS (1)..(1008): transl_table=11

SEQ ID NO: 61231 - protein, 335 aa, Mannheimia succiniciproducens MBEL55E; identical to SEQ ID NO: 40620

SEQ ID NO: 61232 - DNA, 1029 bp, Mannheimia succiniciproducens MBEL55E; identical to SEQ ID NO: 40621
  CDS (1)..(1029): transl_table=11

SEQ ID NO: 61233 - protein, 342 aa, Mannheimia succiniciproducens MBEL55E; identical to SEQ ID NO: 40622

SEQ ID NO: 61234 - DNA, 1005 bp, Burkholderia mallei ATCC 23344; identical to SEQ ID NO: 40623
  CDS (1)..(1005): transl_table=11

SEQ ID NO: 61235 - protein, 334 aa, Burkholderia mallei ATCC 23344; identical to SEQ ID NO: 40624

SEQ ID NO: 61236 - DNA, 1005 bp, Burkholderia mallei ATCC 23344; identical to SEQ ID NO: 40625
  CDS (1)..(1005): transl_table=11

SEQ ID NO: 61237 - protein, 334 aa, Burkholderia mallei ATCC 23344; identical to SEQ ID NO: 40626

SEQ ID NO: 61238 - DNA, 1035 bp, Burkholderia pseudomallei K96243; identical to SEQ ID NO: 40627
  CDS (1)..(1035): transl_table=11

SEQ ID NO: 61239 - protein, 344 aa, Burkholderia pseudomallei K96243; identical to SEQ ID NO: 40628

SEQ ID NO: 61240 - DNA, 978 bp, Burkholderia pseudomallei K96243; identical to SEQ ID NO: 40629
  CDS (1)..(978): transl_table=11

SEQ ID NO: 61241 - protein, 325 aa, Burkholderia pseudomallei K96243; identical to SEQ ID NO: 40630

SEQ ID NO: 61242 - DNA, 1176 bp, Photobacterium profundum SS9; identical to SEQ ID NO: 40631
  CDS (1)..(1176): transl_table=11

SEQ ID NO: 61243 - protein, 391 aa, Photobacterium profundum SS9; identical to SEQ ID NO: 40632

SEQ ID NO: 61244 - DNA, 1017 bp, Photobacterium profundum SS9; identical to SEQ ID NO: 40633
  CDS (1)..(1017): transl_table=11

SEQ ID NO: 61245 - protein, 338 aa, Photobacterium profundum SS9; identical to SEQ ID NO: 40634

SEQ ID NO: 61246 - DNA, 999 bp, Photobacterium profundum SS9; identical to SEQ ID NO: 40635
  CDS (1)..(999): transl_table=11

SEQ ID NO: 61247 - protein, 332 aa, Photobacterium profundum SS9; identical to SEQ ID NO: 40636

SEQ ID NO: 61248 - DNA, 990 bp, Photobacterium profundum SS9; identical to SEQ ID NO: 40637
  CDS (1)..(990): transl_table=11

SEQ ID NO: 61249 - protein, 329 aa, Photobacterium profundum SS9; identical to SEQ ID NO: 40638

SEQ ID NO: 61250 - DNA, 1011 bp, Photobacterium profundum SS9; identical to SEQ ID NO: 40639
  CDS (1)..(1011): transl_table=11

SEQ ID NO: 61251 - protein, 336 aa, Photobacterium profundum SS9; identical to SEQ ID NO: 40640

SEQ ID NO: 61252 - DNA, 1014 bp, Geobacillus kaustophilus HTA426; identical to SEQ ID NO: 40641
  CDS (1)..(1014): transl_table=11

SEQ ID NO: 61253 - protein, 337 aa, Geobacillus kaustophilus HTA426; identical to SEQ ID NO: 40642

SEQ ID NO: 61254 - DNA, 1200 bp, Geobacillus kaustophilus HTA426; identical to SEQ ID NO: 40643
  CDS (1)..(1200): transl_table=11

SEQ ID NO: 61255 - protein, 399 aa, Geobacillus kaustophilus HTA426; identical to SEQ ID NO: 40644

SEQ ID NO: 61256 - DNA, 1005 bp, Geobacillus kaustophilus HTA426; identical to SEQ ID NO: 40645
  CDS (1)..(1005): transl_table=11

SEQ ID NO: 61257 - protein, 334 aa, Geobacillus kaustophilus HTA426; identical to SEQ ID NO: 40646

SEQ ID NO: 61258 - DNA, 1224 bp, Geobacillus kaustophilus HTA426; identical to SEQ ID NO: 40647
  CDS (1)..(1224): transl_table=11

SEQ ID NO: 61259 - protein, 407 aa, Geobacillus kaustophilus HTA426; identical to SEQ ID NO: 40648

SEQ ID NO: 61260 - DNA, 945 bp, Geobacillus kaustophilus HTA426; identical to SEQ ID NO: 40649
  CDS (1)..(945): transl_table=11

SEQ ID NO: 61261 - protein, 314 aa, Geobacillus kaustophilus HTA426; identical to SEQ ID NO: 40650

SEQ ID NO: 61262 - DNA, 1011 bp, Salmonella enterica subsp. enterica serovar Paratyphi A str. ATCC; identical to SEQ ID NO: 40651
  CDS (1)..(1011): transl_table=11

SEQ ID NO: 61263 - protein, 336 aa, Salmonella enterica subsp. enterica serovar Paratyphi A str. ATCC; identical to SEQ ID NO: 40652

SEQ ID NO: 61264 - DNA, 1044 bp, Salmonella enterica subsp. enterica serovar Paratyphi A str. ATCC; identical to SEQ ID NO: 40653
  CDS (1)..(1044): transl_table=11

SEQ ID NO: 61265 - protein, 347 aa, Salmonella enterica subsp. enterica serovar Paratyphi A str. ATCC; identical to SEQ ID NO: 40654

SEQ ID NO: 61266 - DNA, 1299 bp, Silicibacter pomeroyi DSS-3; identical to SEQ ID NO: 40655
  CDS (1)..(1299): transl_table=11

SEQ ID NO: 61267 - protein, 432 aa, Silicibacter pomeroyi DSS-3; identical to SEQ ID NO: 40656

SEQ ID NO: 61268 - DNA, 1161 bp, Bacillus clausii KSM-K16; identical to SEQ ID NO: 40657
  CDS (1)..(1161): transl_table=11

SEQ ID NO: 61269 - protein, 386 aa, Bacillus clausii KSM-K16; identical to SEQ ID NO: 40658

SEQ ID NO: 61270 - DNA, 945 bp, Bacillus clausii KSM-K16; identical to SEQ ID NO: 40659
  CDS (1)..(945): transl_table=11

SEQ ID NO: 61271 - protein, 314 aa, Bacillus clausii KSM-K16; identical to SEQ ID NO: 40660

SEQ ID NO: 61272 - DNA, 1023 bp, Gluconobacter oxydans 621H; identical to SEQ ID NO: 40661
  CDS (1)..(1023): transl_table=11

SEQ ID NO: 61273 - protein, 340 aa, Gluconobacter oxydans 621H; identical to SEQ ID NO: 40662

SEQ ID NO: 61274 - DNA, 858 bp, Lactobacillus acidophilus NCFM; identical to SEQ ID NO: 40663
  CDS (1)..(858): transl_table=11

SEQ ID NO: 61275 - protein, 285 aa, Lactobacillus acidophilus NCFM; identical to SEQ ID NO: 40664

SEQ ID NO: 61276 - DNA, 987 bp, Vibrio fischeri ES114; identical to SEQ ID NO: 40665
  CDS (1)..(987): transl_table=11

SEQ ID NO: 61277 - protein, 328 aa, Vibrio fischeri ES114; identical to SEQ ID NO: 40666

SEQ ID NO: 61278 - DNA, 1011 bp, Salmonella enterica subsp. enterica serovar Choleraesuis str; identical to SEQ ID NO: 40667
  CDS (1)..(1011): transl_table=11

SEQ ID NO: 61279 - protein, 336 aa, Salmonella enterica subsp. enterica serovar Choleraesuis str; identical to SEQ ID NO: 40668

SEQ ID NO: 61280 - DNA, 993 bp, Salmonella enterica subsp. enterica serovar Choleraesuis str; identical to SEQ ID NO: 40669
  CDS (1)..(993): transl_table=11

SEQ ID NO: 61281 - protein, 330 aa, Salmonella enterica subsp. enterica serovar Choleraesuis str; identical to SEQ ID NO: 40670

SEQ ID NO: 61282 - DNA, 1044 bp, Salmonella enterica subsp. enterica serovar Choleraesuis str; identical to SEQ ID NO: 40671
  CDS (1)..(1044): transl_table=11

SEQ ID NO: 61283 - protein, 347 aa, Salmonella enterica subsp. enterica serovar Choleraesuis str; identical to SEQ ID NO: 40672

SEQ ID NO: 61284 - DNA, 1005 bp, Brucella abortus biovar 1 str. 9-941; identical to SEQ ID NO: 40673
  CDS (1)..(1005): transl_table=11

SEQ ID NO: 61285 - protein, 334 aa, Brucella abortus biovar 1 str. 9-941; identical to SEQ ID NO: 40674

SEQ ID NO: 61286 - DNA, 1191 bp, Brucella abortus biovar 1 str. 9-941; identical to SEQ ID NO: 40675
  CDS (1)..(1191): transl_table=11

SEQ ID NO: 61287 - protein, 396 aa, Brucella abortus biovar 1 str. 9-941; identical to SEQ ID NO: 40676

SEQ ID NO: 61288 - DNA, 1041 bp, Brucella abortus biovar 1 str. 9-941; identical to SEQ ID NO: 40677
  CDS (1)..(1041): transl_table=11

SEQ ID NO: 61289 - protein, 346 aa, Brucella abortus biovar 1 str. 9-941; identical to SEQ ID NO: 40678

SEQ ID NO: 61290 - DNA, 1239 bp, Brucella abortus biovar 1 str. 9-941; identical to SEQ ID NO: 40679
  CDS (1)..(1239): transl_table=11

SEQ ID NO: 61291 - protein, 412 aa, Brucella abortus biovar 1 str. 9-941; identical to SEQ ID NO: 40680

SEQ ID NO: 61292 - DNA, 1170 bp, Brucella abortus biovar 1 str. 9-941; identical to SEQ ID NO: 40681
  CDS (1)..(1170): transl_table=11

SEQ ID NO: 61293 - protein, 389 aa, Brucella abortus biovar 1 str. 9-941; identical to SEQ ID NO: 40682

SEQ ID NO: 61294 - DNA, 975 bp, Corynebacterium glutamicum ATCC 13032; identical to SEQ ID NO: 40683
  CDS (1)..(975): transl_table=11

SEQ ID NO: 61295 - protein, 324 aa, Corynebacterium glutamicum ATCC 13032; identical to SEQ ID NO: 40684

SEQ ID NO: 61296 - DNA, 1020 bp, Pseudomonas syringae pv. syringae B728a; identical to SEQ ID NO: 40685
  CDS (1)..(1020): transl_table=11

SEQ ID NO: 61297 - protein, 339 aa, Pseudomonas syringae pv. syringae B728a; identical to SEQ ID NO: 40686

SEQ ID NO: 61298 - DNA, 990 bp, Pseudomonas syringae pv. syringae B728a; identical to SEQ ID NO: 40687
  CDS (1)..(990): transl_table=11

SEQ ID NO: 61299 - protein, 329 aa, Pseudomonas syringae pv. syringae B728a; identical to SEQ ID NO: 40688

SEQ ID NO: 61300 - DNA, 978 bp, Pseudomonas syringae pv. syringae B728a; identical to SEQ ID NO: 40689
  CDS (1)..(978): transl_table=11

SEQ ID NO: 61301 - protein, 325 aa, Pseudomonas syringae pv. syringae B728a; identical to SEQ ID NO: 40690

SEQ ID NO: 61302 - DNA, 1137 bp, Pseudomonas syringae pv. syringae B728a; identical to SEQ ID NO: 40691
  CDS (1)..(1137): transl_table=11

SEQ ID NO: 61303 - protein, 378 aa, Pseudomonas syringae pv. syringae B728a; identical to SEQ ID NO: 40692

SEQ ID NO: 61304 - DNA, 1026 bp, Pseudomonas syringae pv. syringae B728a; identical to SEQ ID NO: 40693
  CDS (1)..(1026): transl_table=11

SEQ ID NO: 61305 - protein, 341 aa, Pseudomonas syringae pv. syringae B728a; identical to SEQ ID NO: 40694

SEQ ID NO: 61306 - DNA, 972 bp, Haemophilus influenzae 86-028NP; identical to SEQ ID NO: 40695
  CDS (1)..(972): transl_table=11

SEQ ID NO: 61307 - protein, 323 aa, Haemophilus influenzae 86-028NP; identical to SEQ ID NO: 40696

SEQ ID NO: 61308 - DNA, 1011 bp, Haemophilus influenzae 86-028NP; identical to SEQ ID NO: 40697
  CDS (1)..(1011): transl_table=11

SEQ ID NO: 61309 - protein, 336 aa, Haemophilus influenzae 86-028NP; identical to SEQ ID NO: 40698

SEQ ID NO: 61310 - DNA, 939 bp, Staphylococcus haemolyticus JCSC1435; identical to SEQ ID NO: 40699
  CDS (1)..(939): transl_table=11

SEQ ID NO: 61311 - protein, 312 aa, Staphylococcus haemolyticus JCSC1435; identical to SEQ ID NO: 40700

SEQ ID NO: 61312 - DNA, 1023 bp, Pseudomonas fluorescens Pf-5; identical to SEQ ID NO: 40701
  CDS (1)..(1023): transl_table=11

SEQ ID NO: 61313 - protein, 340 aa, Pseudomonas fluorescens Pf-5; identical to SEQ ID NO: 40702

SEQ ID NO: 61314 - DNA, 1137 bp, Pseudomonas syringae pv. phaseolicola 1448A; identical to SEQ ID NO: 40703
  CDS (1)..(1137): transl_table=11

SEQ ID NO: 61315 - protein, 378 aa, Pseudomonas syringae pv. phaseolicola 1448A; identical to SEQ ID NO: 40704

SEQ ID NO: 61316 - DNA, 963 bp, Pseudomonas syringae pv. phaseolicola 1448A; identical to SEQ ID NO: 40705
  CDS (1)..(963): transl_table=11

SEQ ID NO: 61317 - protein, 320 aa, Pseudomonas syringae pv. phaseolicola 1448A; identical to SEQ ID NO: 40706

SEQ ID NO: 61318 - DNA, 1884 bp, Pseudomonas syringae pv. phaseolicola 1448A; identical to SEQ ID NO: 40707
  CDS (1)..(1884): transl_table=11

SEQ ID NO: 61319 - protein, 627 aa, Pseudomonas syringae pv. phaseolicola 1448A; identical to SEQ ID NO: 40708

SEQ ID NO: 61320 - DNA, 1026 bp, Pseudomonas syringae pv. phaseolicola 1448A; identical to SEQ ID NO: 40709
  CDS (1)..(1026): transl_table=11

SEQ ID NO: 61321 - protein, 341 aa, Pseudomonas syringae pv. phaseolicola 1448A; identical to SEQ ID NO: 40710

SEQ ID NO: 61322 - DNA, 1251 bp, Mycoplasma hyopneumoniae J; identical to SEQ ID NO: 40711
  CDS (1)..(1251): transl_table=4

SEQ ID NO: 61323 - protein, 416 aa, Mycoplasma hyopneumoniae J; identical to SEQ ID NO: 40712

SEQ ID NO: 61324 - DNA, 1251 bp, Mycoplasma hyopneumoniae 7448; identical to SEQ ID NO: 40713
  CDS (1)..(1251): transl_table=4

SEQ ID NO: 61325 - protein, 416 aa, Mycoplasma hyopneumoniae 7448; identical to SEQ ID NO: 40714

SEQ ID NO: 61326 - DNA, 1254 bp, Thermobifida fusca YX; identical to SEQ ID NO: 40715
  CDS (1)..(1254): transl_table=11

SEQ ID NO: 61327 - protein, 417 aa, Thermobifida fusca YX; identical to SEQ ID NO: 40716

SEQ ID NO: 61328 - DNA, 1023 bp, Ralstonia eutropha JMP134; identical to SEQ ID NO: 40717
  CDS (1)..(1023): transl_table=11

SEQ ID NO: 61329 - protein, 340 aa, Ralstonia eutropha JMP134; identical to SEQ ID NO: 40718

SEQ ID NO: 61330 - DNA, 966 bp, Ralstonia eutropha JMP134; identical to SEQ ID NO: 40719
  CDS (1)..(966): transl_table=11

SEQ ID NO: 61331 - protein, 321 aa, Ralstonia eutropha JMP134; identical to SEQ ID NO: 40720

SEQ ID NO: 61332 - DNA, 942 bp, Staphylococcus saprophyticus subsp. saprophyticus ATCC 15305; identical to SEQ ID NO: 40721
  CDS (1)..(942): transl_table=11

SEQ ID NO: 61333 - protein, 313 aa, Staphylococcus saprophyticus subsp. saprophyticus ATCC 15305; identical to SEQ ID NO: 40722

SEQ ID NO: 61334 - DNA, 990 bp, Shigella sonnei Ss046; identical to SEQ ID NO: 40723
  CDS (1)..(990): transl_table=11

SEQ ID NO: 61335 - protein, 329 aa, Shigella sonnei Ss046; identical to SEQ ID NO: 40724

SEQ ID NO: 61336 - DNA, 999 bp, Shigella sonnei Ss046; identical to SEQ ID NO: 40725
  CDS (1)..(999): transl_table=11

SEQ ID NO: 61337 - protein, 332 aa, Shigella sonnei Ss046; identical to SEQ ID NO: 40726

SEQ ID NO: 61338 - DNA, 1128 bp, Haemophilus somnus 129PT; identical to SEQ ID NO: 40727
  CDS (1)..(1128)

SEQ ID NO: 61339 - protein, 375 aa, Haemophilus somnus 129PT; identical to SEQ ID NO: 40728

SEQ ID NO: 61340 - DNA, 1128 bp, Actinobacillus pleuropneumoniae serovar 1 str. 4074; identical to SEQ ID NO: 40729
  CDS (1)..(1128)

SEQ ID NO: 61341 - protein, 375 aa, Actinobacillus pleuropneumoniae serovar 1 str. 4074; identical to SEQ ID NO: 40730

SEQ ID NO: 61342 - DNA, 1128 bp, Haemophilus influenzae R2866; identical to SEQ ID NO: 40731
  CDS (1)..(1128)

SEQ ID NO: 61343 - protein, 375 aa, Haemophilus influenzae R2866; identical to SEQ ID NO: 40732

SEQ ID NO: 61344 - DNA, 1137 bp, Pseudomonas fluorescens PfO-1; identical to SEQ ID NO: 40733
  CDS (1)..(1137)

SEQ ID NO: 61345 - protein, 378 aa, Pseudomonas fluorescens PfO-1; identical to SEQ ID NO: 40734

SEQ ID NO: 61346 - DNA, 1200 bp, Burkholderia fungorum LB400; identical to SEQ ID NO: 40735
  CDS (1)..(1200)

SEQ ID NO: 61347 - protein, 399 aa, Burkholderia fungorum LB400; identical to SEQ ID NO: 40736

SEQ ID NO: 61348 - DNA, 1200 bp, Burkholderia vietnamiensis G4; identical to SEQ ID NO: 40737
  CDS (1)..(1200): transl_table=11

SEQ ID NO: 61349 - protein, 399 aa, Burkholderia vietnamiensis G4; identical to SEQ ID NO: 40738

SEQ ID NO: 61350 - DNA, 1200 bp, Burkholderia cenocepacia AU 1054; identical to SEQ ID NO: 40739
  CDS (1)..(1200): transl_table=11

SEQ ID NO: 61351 - protein, 399 aa, Burkholderia cenocepacia AU 1054; identical to SEQ ID NO: 40740

SEQ ID NO: 61352 - DNA, 1152 bp, Chromohalobacter salexigens DSM 3043; identical to SEQ ID NO: 40741
  CDS (1)..(1152): transl_table=11

SEQ ID NO: 61353 - protein, 383 aa, Chromohalobacter salexigens DSM 3043; identical to SEQ ID NO: 40742

SEQ ID NO: 61354 - DNA, 1194 bp, Moorella thermoacetica ATCC 39073; identical to SEQ ID NO: 40743
  CDS (1)..(1194): transl_table=11

SEQ ID NO: 61355 - protein, 397 aa, Moorella thermoacetica ATCC 39073; identical to SEQ ID NO: 40744

SEQ ID NO: 61356 - DNA, 1200 bp, Burkholderia ambifaria AMMD; identical to SEQ ID NO: 40745
  CDS (1)..(1200): transl_table=11

SEQ ID NO: 61357 - protein, 399 aa, Burkholderia ambifaria AMMD; identical to SEQ ID NO: 40746

SEQ ID NO: 61358 - DNA, 1179 bp, Bacillus sp; identical to SEQ ID NO: 40747
  CDS (1)..(1179): transl_table=11

SEQ ID NO: 61359 - protein, 392 aa, Bacillus sp; identical to SEQ ID NO: 40748

SEQ ID NO: 61360 - DNA, 1734 bp, Mycobacterium leprae; identical to SEQ ID NO: 40749
  CDS (1)..(1734): transl_table=11

SEQ ID NO: 61361 - protein, 577 aa, Mycobacterium leprae; identical to SEQ ID NO: 40750

SEQ ID NO: 61362 - DNA, 1242 bp, Streptomyces kanamyceticus; identical to SEQ ID NO: 40751
  CDS (1)..(1242): transl_table=11

SEQ ID NO: 61363 - protein, 413 aa, Streptomyces kanamyceticus; identical to SEQ ID NO: 40752

SEQ ID NO: 61364 - DNA, 1167 bp, Thermoanaerobacter ethanolicus; identical to SEQ ID NO: 40753
  CDS (1)..(1167): transl_table=11

SEQ ID NO: 61365 - protein, 388 aa, Thermoanaerobacter ethanolicus; identical to SEQ ID NO: 40754

SEQ ID NO: 61366 - DNA, 981 bp, Rhizobium sp; identical to SEQ ID NO: 40755
  CDS (1)..(981): transl_table=11

SEQ ID NO: 61367 - protein, 326 aa, Rhizobium sp; identical to SEQ ID NO: 40756

SEQ ID NO: 61368 - DNA, 1146 bp, Streptomyces olivaceoviridis; identical to SEQ ID NO: 40757
  CDS (1)..(1146): transl_table=11

SEQ ID NO: 61369 - protein, 381 aa, Streptomyces olivaceoviridis; identical to SEQ ID NO: 40758

SEQ ID NO: 61370 - DNA, 1002 bp, Rhizobium leguminosarum bv; identical to SEQ ID NO: 40759
  CDS (1)..(1002): transl_table=11

SEQ ID NO: 61371 - protein, 333 aa, Rhizobium leguminosarum bv; identical to SEQ ID NO: 40760

SEQ ID NO: 61372 - DNA, 1224 bp, Bacillus stearothermophilus; identical to SEQ ID NO: 40761
  CDS (1)..(1224): transl_table=11

SEQ ID NO: 61373 - protein, 407 aa, Bacillus stearothermophilus; identical to SEQ ID NO: 40762

SEQ ID NO: 61374 - DNA, 990 bp, Escherichia coli; identical to SEQ ID NO: 40763
  CDS (1)..(990): transl_table=11

SEQ ID NO: 61375 - protein, 329 aa, Escherichia coli; identical to SEQ ID NO: 40764

SEQ ID NO: 61376 - DNA, 1011 bp, Escherichia coli; identical to SEQ ID NO: 40765
  CDS (1)..(1011): transl_table=11

SEQ ID NO: 61377 - protein, 336 aa, Escherichia coli; identical to SEQ ID NO: 40766

SEQ ID NO: 61378 - DNA, 1011 bp, Haemophilus influenzae; identical to SEQ ID NO: 40767
  CDS (1)..(1011): transl_table=11

SEQ ID NO: 61379 - protein, 336 aa, Haemophilus influenzae; identical to SEQ ID NO: 40768

SEQ ID NO: 61380 - DNA, 1011 bp, Salmonella typhimurium; identical to SEQ ID NO: 40769
  CDS (1)..(1011): transl_table=11

SEQ ID NO: 61381 - protein, 336 aa, Salmonella typhimurium; identical to SEQ ID NO: 40770

SEQ ID NO: 61382 - DNA, 969 bp, Bacillus subtilis; identical to SEQ ID NO: 40771
  CDS (1)..(969): transl_table=11

SEQ ID NO: 61383 - protein, 322 aa, Bacillus subtilis; identical to SEQ ID NO: 40772

SEQ ID NO: 61384 - DNA, 966 bp, Escherichia coli; identical to SEQ ID NO: 40773
  CDS (1)..(966): transl_table=11

SEQ ID NO: 61385 - protein, 321 aa, Escherichia coli; identical to SEQ ID NO: 40774

SEQ ID NO: 61386 - DNA, 972 bp, Haemophilus influenzae; identical to SEQ ID NO: 40775
  CDS (1)..(972): transl_table=11

SEQ ID NO: 61387 - protein, 323 aa, Haemophilus influenzae; identical to SEQ ID NO: 40776

SEQ ID NO: 61388 - DNA, 1128 bp, Haemophilus influenzae; identical to SEQ ID NO: 40777
  CDS (1)..(1128): n means a or g or c or t/u, s means g or c

SEQ ID NO: 61389 - protein, 375 aa, Haemophilus influenzae; identical to SEQ ID NO: 40778
  Xaa in position 51 is unknown

SEQ ID NO: 61390 - DNA, 1029 bp, Escherichia coli; identical to SEQ ID NO: 40779
  CDS (1)..(1029): transl_table=11

SEQ ID NO: 61391 - protein, 342 aa, Escherichia coli; identical to SEQ ID NO: 40780

SEQ ID NO: 61392 - DNA, 999 bp, Escherichia coli; identical to SEQ ID NO: 40781
  CDS (1)..(999): transl_table=11

SEQ ID NO: 61393 - protein, 332 aa, Escherichia coli; identical to SEQ ID NO: 40782

SEQ ID NO: 61394 - DNA, 22 bp, Artificial sequence
  (1)..(22): primer
atgtcgaaaagcaatccgtctg

SEQ ID NO: 61395 - DNA, 24 bp, Artificial sequence
  (1)..(24): primer
ttaagaacggcgtttggttgcgga

SEQ ID NO: 61396 - protein, 468 aa, Artificial sequence; identical to SEQ ID NO: 40785
  Variant (2)..(3): xaa in position 2 to 3 is any amino acid
  Variant (5)..(14): xaa in position 5 to 14 is any amino acid
  Variant (15)..(21): xaa in position 15 to 21 is any or no amino acid
  Variant (23)..(25): xaa in position 23 to 25 is any amino acid
  Variant (26)..(26): xaa in position 26 is any or no amino acid
  Variant (28)..(30): xaa in position 28 to 30 is any amino acid
  Variant (32)..(35): xaa in position 32 to 35 is any amino acid
  Variant (37)..(39): xaa in position 37 to 39 is any amino acid
  Variant (40)..(40): xaa in position 40 is any or no amino acid
  Variant (44)..(44): xaa in position 44 is any amino acid
  Variant (47)..(48): xaa in position 47 to 48 is any amino acid
  Variant (52)..(54): xaa in position 52 to 54 is any amino acid
  Variant (55)..(56): xaa in position 55 to 56 is any or no amino acid
  Variant (64)..(64): xaa in position 64 is any amino acid
  Variant (67)..(72): xaa in position 67 to 72 is any amino acid
  Variant (74)..(84): xaa in position 74 to 84 is any amino acid
  Variant (85)..(163): xaa in position 85 to 163 is any or no amino acid
  Variant (165)..(166): xaa in position 165 to 166 is any amino acid
  Variant (167)..(167): xaa in position 167 is any or no amino acid
  Variant (169)..(170): xaa in position 169 to 170 is any amino acid
  Variant (172)..(174): xaa in position 172 to 174 is any amino acid
  Variant (176)..(177): xaa in position 176 to 177 is any amino acid
  Variant (180)..(181): xaa in position 180 to 181 is any amino acid
  Variant (183)..(186): xaa in position 183 to 186 is any amino acid
  Variant (188)..(189): xaa in position 188 to 189 is any amino acid
  Variant (192)..(192): xaa in position 192 is any amino acid
  Variant (196)..(196): xaa in position 196 is any amino acid
  Variant (198)..(200): xaa in position 198 to 200 is any amino acid
  Variant (203)..(209): xaa in position 203 to 209 is any amino acid
  Variant (211)..(226): xaa in position 211 to 226 is any amino acid
  Variant (227)..(320): xaa in position 227 to 320 is any or no amino acid
  Variant (322)..(337): xaa in position 322 to 337 is any amino acid
  Variant (339)..(341): xaa in position 339 to 341 is any amino acid
  Variant (343)..(344): xaa in position 343 to 344 is any amino acid
  Variant (347)..(348): xaa in position 347 to 348 is any amino acid
  Variant (355)..(356): xaa in position 355 to 356 is any amino acid
  Variant (359)..(360): xaa in position 359 to 360 is any amino acid
  Variant (364)..(369): xaa in position 364 to 369 is any amino acid
  Variant (371)..(371): xaa in position 371 is any amino acid
  Variant (374)..(374): xaa in position 374 is any amino acid
  Variant (376)..(376): xaa in position 376 is any amino acid
  Variant (378)..(380): xaa in position 378 to 380 is any amino acid
  Variant (387)..(389): xaa in position 387 to 389 is any amino acid
  Variant (392)..(392): xaa in position 392 is any amino acid
  Variant (395)..(398): xaa in position 395 to 398 is any amino acid
  Variant (399)..(399): xaa in position 399 is any or no amino acid
  Variant (401)..(403): xaa in position 401 to 403 is any amino acid
  Variant (406)..(407): xaa in position 406 to 407 is any amino acid
  Variant (411)..(411): xaa in position 411 is any amino acid
  Variant (416)..(416): xaa in position 416 is any amino acid
  Variant (419)..(419): xaa in position 419 is any amino acid
  Variant (422)..(422): xaa in position 422 is any amino acid
  Variant (424)..(424): xaa in position 424 is any amino acid
  Variant (426)..(426): xaa in position 426 is any amino acid
  Variant (428)..(428): xaa in position 428 is any amino acid
  Variant (430)..(430): xaa in position 430 is any amino acid
  Variant (432)..(432): xaa in position 432 is any amino acid
  Variant (436)..(437): xaa in position 436 to 437 is any amino acid
  Variant (439)..(440): xaa in position 439 to 440 is any amino acid
  Variant (443)..(443): xaa in position 443 is any amino acid
  Variant (446)..(446): xaa in position 446 is any amino acid
  Variant (447)..(447): xaa in position 447 is any or no amino acid
  Variant (449)..(452): xaa in position 449 to 452 is any amino acid
  Variant (454)..(454): xaa in position 454 is any amino acid
  Variant (457)..(457): xaa in position 457 is any amino acid
  Variant (459)..(459): xaa in position 459 is any amino acid
  Variant (463)..(463): xaa in position 463 is any amino acid
  Variant (466)..(467): xaa in position 466 to 467 is any amino acid

SEQ ID NO: 61397 - protein, 44 aa, Artificial sequence; identical to SEQ ID NO: 40786
  Variant (2)..(9): xaa in position 2 to 9 is any amino acid
  Variant (10)..(10): xaa in position 10 is Ala, Gly, Ser, Thr or Val
  Variant (11)..(15): xaa in position 11 to 15 is any amino acid
  Variant (16)..(16): xaa in position 16 is Ala, Gly, Ser, Thr or Val
  Variant (17)..(17): xaa in position 17 is any amino acid
  Variant (18)..(18): xaa in position 18 is Ala, Gly or Thr
  Variant (19)..(22): xaa in position 19 to 22 is any amino acid
  Variant (23)..(23): xaa in position 23 is Phe, Ile, Leu, Met or Val
  Variant (24)..(28): xaa in position 24 to 28 is any amino acid
  Variant (29)..(29): xaa in position 29 is Asp or Glu
  Variant (32)..(32): xaa in position 32 is any amino acid
  Variant (33)..(39): xaa in position 33 to 39 is any or no amino acid
  Variant (41)..(43): xaa in position 41 to 43 is any amino acid
  Variant (44)..(44): xaa in position 44 is Ala, Cys, Gly, Ser or Val

SEQ ID NO: 61398 - protein, 32 aa, Artificial sequence; identical to SEQ ID NO: 40787
  Variant (2)..(3): xaa in position 2 to 3 is any amino acid
  Variant (4)..(4): xaa in position 4 is any or no amino acid
  Variant (6)..(8): xaa in position 6 to 8 is any amino acid
  Variant (10)..(16): xaa in position 10 to 16 is any amino acid
  Variant (17)..(17): xaa in position 17 is Ile, Leu, Met or Val
  Variant (18)..(18): xaa in position 18 is any amino acid
  Variant (19)..(19): xaa in position 19 is Ala, Asp, Pro or Ser
  Variant (20)..(20): xaa in position 20 is Phe, Ile, Leu or Val
  Variant (21)..(21): xaa in position 21 is Ala, Ile, Leu or Val
  Variant (22)..(22): xaa in position 22 is any amino acid
  Variant (25)..(25): xaa in position 25 is Ala, Gly, Ser, Thr or Val
  Variant (26)..(31): xaa in position 26 to 31 is any amino acid
  Variant (32)..(32): xaa in position 32 is Ala, Gly, Asn or Ser

SEQ ID NO: 61399 - protein, 36 aa, Artificial sequence; identical to SEQ ID NO: 40788
  Variant (2)..(2): xaa in position 2 is any amino acid
  Variant (4)..(4): xaa in position 4 is Asp, Gly or Ser
  Variant (6)..(7): xaa in position 6 to 7 is any amino acid
  Variant (8)..(8): xaa in position 8 is any or no amino acid
  Variant (10)..(12): xaa in position 10 to 12 is any amino acid
  Variant (13)..(13): xaa in position 13 is any or no amino acid
  Variant (15)..(15): xaa in position 15 is Ile, Leu or Val
  Variant (16)..(24): xaa in position 16 to 24 is any amino acid
  Variant (25)..(25): xaa in position 25 is Phe or Tyr
  Variant (26)..(28): xaa in position 26 to 28 is any amino acid
  Variant (30)..(32): xaa in position 30 to 32 is any amino acid
  Variant (33)..(33): xaa in position 33 is Ala, Gly or Ser
  Variant (34)..(34): xaa in position 34 is any amino acid
  Variant (35)..(35): xaa in position 35 is Ala, Gly, Ser, Thr or Val
  Variant (36)..(36): xaa in position 36 is Ala, Gly or Ser

SEQ ID NO: 61400 - protein, 61 aa, Artificial sequence; identical to SEQ ID NO: 40789
  Variant (2)..(2): xaa in position 2 is any amino acid
  Variant (3)..(4): xaa in position 3 to 4 is any or no amino acid
  Variant (6)..(6): xaa in position 6 is Phe, Leu or Met
  Variant (7)..(7): xaa in position 7 is any amino acid
  Variant (8)..(8): xaa in position 8 is Ala, Ile or Val
  Variant (10)..(11): xaa in position 10 to 11 is any amino acid
  Variant (12)..(12): xaa in position 12 is Ala, Cys, Ser, Thr or Val
  Variant (13)..(13): xaa in position 13 is any amino acid
  Variant (14)..(14): xaa in position 14 is Ile, Leu, Met or Val
  Variant (17)..(20): xaa in position 17 to 20 is any amino acid
  Variant (23)..(23): xaa in position 23 is any amino acid
  Variant (25)..(31): xaa in position 25 to 31 is any amino acid
  Variant (33)..(34): xaa in position 33 to 34 is any amino acid
  Variant (35)..(35): xaa in position 35 is Phe, Ile, Leu, Met or Val
  Variant (36)..(38): xaa in position 36 to 38 is any amino acid
  Variant (39)..(39): xaa in position 39 is Ile, Leu, Met or Val
  Variant (40)..(60): xaa in position 40 to 60 is any amino acid
  Variant (61)..(61): xaa in position 61 is Phe, Ile, Leu or Met

SEQ ID NO: 61401 - DNA, 1113 bp, Saccharomyces cerevisiae; identical to SEQ ID NO: 1363
  CDS (1)..(1113)

SEQ ID NO: 61402 - protein, 370 aa, Saccharomyces cerevisiae; identical to SEQ ID NO: 1364

SEQ ID NO: 61403 - DNA, 1086 bp, Deinococcus radiodurans; identical to SEQ ID NO: 1327
  CDS (1)..(1086)

SEQ ID NO: 61404 - protein, 361 aa, Deinococcus radiodurans; identical to SEQ ID NO: 1328

SEQ ID NO: 61405 - DNA, 1071 bp, Salmonella enterica subsp. enterica serovar Typhi; identical to SEQ ID NO: 2245
  CDS (1)..(1071)

SEQ ID NO: 61406 - protein, 356 aa, Salmonella enterica subsp. enterica serovar Typhi; identical to SEQ ID NO: 2246

SEQ ID NO: 61407 - DNA, 1071 bp, Yersinia pestis; identical to SEQ ID NO: 2247
  CDS (1)..(1071)

SEQ ID NO: 61408 - protein, 356 aa, Yersinia pestis; identical to SEQ ID NO: 2248

SEQ ID NO: 61409 - DNA, 1047 bp, Yersinia pestis; identical to SEQ ID NO: 1331
  CDS (1)..(1047)

SEQ ID NO: 61410 - protein, 348 aa, Yersinia pestis; identical to SEQ ID NO: 1332

SEQ ID NO: 61411 - DNA, 1053 bp, Escherichia coli; identical to SEQ ID NO: 2251
  CDS (1)..(1053)

SEQ ID NO: 61412 - protein, 350 aa, Escherichia coli; identical to SEQ ID NO: 1580

SEQ ID NO: 61413 - DNA, 1071 bp, Escherichia coli; identical to SEQ ID NO: 1333
  CDS (1)..(1071)

SEQ ID NO: 61414 - protein, 356 aa, Escherichia coli; identical to SEQ ID NO: 1334

SEQ ID NO: 61415 - DNA, 1131 bp, Nostoc sp. PCC 7120; identical to SEQ ID NO: 1335
  CDS (1)..(1131)

SEQ ID NO: 61416 - protein, 376 aa, Nostoc sp. PCC 7120; identical to SEQ ID NO: 1336

SEQ ID NO: 61417 - DNA, 1053 bp, Salmonella enterica subsp. enterica serovar Typhi; identical to SEQ ID NO: 1337
  CDS (1)..(1053)

SEQ ID NO: 61418 - protein, 350 aa, Salmonella enterica subsp. enterica serovar Typhi; identical to SEQ ID NO: 1338

SEQ ID NO: 61419 - DNA, 1077 bp, Pseudomonas aeruginosa; identical to SEQ ID NO: 1339
  CDS (1)..(1077)

SEQ ID NO: 61420 - protein, 358 aa, Pseudomonas aeruginosa; identical to SEQ ID NO: 1340

SEQ ID NO: 61421 - DNA, 1074 bp, Vibrio cholerae; identical to SEQ ID NO: 1343
  CDS (1)..(1074)

SEQ ID NO: 61422 - protein, 357 aa, Vibrio cholerae; identical to SEQ ID NO: 1344

SEQ ID NO: 61423 - DNA, 1038 bp, Lactococcus lactis subsp. lactis; identical to SEQ ID NO: 1345
  CDS (1)..(1038)

SEQ ID NO: 61424 - protein, 345 aa, Lactococcus lactis subsp. lactis; identical to SEQ ID NO: 1346

SEQ ID NO: 61425 - DNA, 1023 bp, Lactococcus lactis subsp. lactis; identical to SEQ ID NO: 1347
  CDS (1)..(1023)

SEQ ID NO: 61426 - protein, 340 aa, Lactococcus lactis subsp. lactis; identical to SEQ ID NO: 1348

SEQ ID NO: 61427 - DNA, 1032 bp, Streptococcus pneumoniae; identical to SEQ ID NO: 1349
  CDS (1)..(1032)

SEQ ID NO: 61428 - protein, 343 aa, Streptococcus pneumoniae; identical to SEQ ID NO: 1350

SEQ ID NO: 61429 - DNA, 1056 bp, Neisseria meningitidis; identical to SEQ ID NO: 2269
  CDS (1)..(1056)

SEQ ID NO: 61430 - protein, 351 aa, Neisseria meningitidis; identical to SEQ ID NO: 2270

SEQ ID NO: 61431 - DNA, 1095 bp, Pseudomonas aeruginosa; identical to SEQ ID NO: 1351
  CDS (1)..(1095)

SEQ ID NO: 61432 - protein, 364 aa, Pseudomonas aeruginosa; identical to SEQ ID NO: 1352

SEQ ID NO: 61433 - DNA, 1032 bp, Streptococcus pneumoniae; identical to SEQ ID NO: 1355
  CDS (1)..(1032)

SEQ ID NO: 61434 - protein, 343 aa, Streptococcus pneumoniae; identical to SEQ ID NO: 1356

SEQ ID NO: 61435 - DNA, 1143 bp, Xylella fastidiosa; identical to SEQ ID NO: 1603
  CDS (1)..(1143)

SEQ ID NO: 61436 - protein, 380 aa, Xylella fastidiosa; identical to SEQ ID NO: 1604

SEQ ID NO: 61437 - DNA, 1047 bp, Buchnera aphidicola; identical to SEQ ID NO: 1357
  CDS (1)..(1047)

SEQ ID NO: 61438 - protein, 348 aa, Buchnera aphidicola; identical to SEQ ID NO: 1358

SEQ ID NO: 61439 - DNA, 1104 bp, Corynebacterium glutamicum; identical to SEQ ID NO: 2279
  CDS (1)..(1104)

SEQ ID NO: 61440 - protein, 367 aa, Corynebacterium glutamicum; identical to SEQ ID NO: 2280

SEQ ID NO: 61441 - DNA, 1089 bp, Haemophilus influenzae; identical to SEQ ID NO: 1359
  CDS (1)..(1089)

SEQ ID NO: 61442 - protein, 362 aa, Haemophilus influenzae; identical to SEQ ID NO: 1360

SEQ ID NO: 61443 - DNA, 1502 bp, Candida albicans; identical to SEQ ID NO: 1361
  CDS (336)..(1442)

SEQ ID NO: 61444 - protein, 368 aa, Candida albicans; identical to SEQ ID NO: 1362

SEQ ID NO: 61445 - DNA, 2048 bp, Saccharomyces cerevisiae; identical to SEQ ID NO: 1365
  CDS (619)..(1731)

SEQ ID NO: 61446 - protein, 370 aa, Saccharomyces cerevisiae; identical to SEQ ID NO: 1366

SEQ ID NO: 61447 - DNA, 1107 bp, Schizosaccharomyces pombe; identical to SEQ ID NO: 1367
  CDS (1)..(1107)

SEQ ID NO: 61448 - protein, 368 aa, Schizosaccharomyces pombe; identical to SEQ ID NO: 1368

SEQ ID NO: 61449 - DNA, 1089 bp, Amycolatopsis orientalis; identical to SEQ ID NO: 1369
  CDS (1)..(1089)

SEQ ID NO: 61450 - protein, 362 aa, Amycolatopsis orientalis; identical to SEQ ID NO: 1370

SEQ ID NO: 61451 - DNA, 1119 bp, Schizosaccharomyces pombe; identical to SEQ ID NO: 1371
  CDS (1)..(1119)

SEQ ID NO: 61452 - protein, 372 aa, Schizosaccharomyces pombe; identical to SEQ ID NO: 1372

SEQ ID NO: 61453 - DNA, 1083 bp, Methylophilus methylotrophus; identical to SEQ ID NO: 1375
  CDS (1)..(1083)

SEQ ID NO: 61454 - protein, 360 aa, Methylophilus methylotrophus; identical to SEQ ID NO: 1376

SEQ ID NO: 61455 - DNA, 1770 bp, Debaryomyces hansenii; identical to SEQ ID NO: 2295
  CDS (1)..(1770)

SEQ ID NO: 61456 - protein, 589 aa, Debaryomyces hansenii; identical to SEQ ID NO: 2296

SEQ ID NO: 61457 - DNA, 1107 bp, Debaryomyces hansenii; identical to SEQ ID NO: 1377
  CDS (1)..(1107)

SEQ ID NO: 61458 - protein, 368 aa, Debaryomyces hansenii; identical to SEQ ID NO: 1378

SEQ ID NO: 61459 - DNA, 1074 bp, Yarrowia lipolytica; identical to SEQ ID NO: 1379
  CDS (1)..(1074)

SEQ ID NO: 61460 - protein, 357 aa, Yarrowia lipolytica; identical to SEQ ID NO: 1380

SEQ ID NO: 61461 - DNA, 1089 bp, Yarrowia lipolytica; identical to SEQ ID NO: 1381
  CDS (1)..(1089)

SEQ ID NO: 61462 - protein, 362 aa, Yarrowia lipolytica; identical to SEQ ID NO: 1382

SEQ ID NO: 61463 - DNA, 1119 bp, Kluyveromyces lactis; identical to SEQ ID NO: 1383
  CDS (1)..(1119)

SEQ ID NO: 61464 - protein, 372 aa, Kluyveromyces lactis; identical to SEQ ID NO: 1384

SEQ ID NO: 61465 - DNA, 1095 bp, Kluyveromyces lactis; identical to SEQ ID NO: 1385
  CDS (1)..(1095)

SEQ ID NO: 61466 - protein, 364 aa, Kluyveromyces lactis; identical to SEQ ID NO: 1386

SEQ ID NO: 61467 - DNA, 1074 bp, Erwinia carotovora subsp; identical to SEQ ID NO: 1387
  CDS (1)..(1074)

SEQ ID NO: 61468 - protein, 357 aa, Erwinia carotovora subsp; identical to SEQ ID NO: 1388

SEQ ID NO: 61469 - DNA, 1047 bp, Erwinia carotovora subsp; identical to SEQ ID NO: 1389
  CDS (1)..(1047)

SEQ ID NO: 61470 - protein, 348 aa, Erwinia carotovora subsp; identical to SEQ ID NO: 1390

SEQ ID NO: 61471 - DNA, 1056 bp, Erwinia carotovora subsp; identical to SEQ ID NO: 1391
  CDS (1)..(1056)

SEQ ID NO: 61472 - protein, 351 aa, Erwinia carotovora subsp; identical to SEQ ID NO: 1392

SEQ ID NO: 61473 - DNA, 1113 bp, Acinetobacter sp; identical to SEQ ID NO: 1393
  CDS (1)..(1113)

SEQ ID NO: 61474 - protein, 370 aa, Acinetobacter sp; identical to SEQ ID NO: 1394

SEQ ID NO: 61475 - DNA, 1056 bp, Acinetobacter sp; identical to SEQ ID NO: 1395
  CDS (1)..(1056)

SEQ ID NO: 61476 - protein, 351 aa, Acinetobacter sp; identical to SEQ ID NO: 1396

SEQ ID NO: 61477 - DNA, 1119 bp, Candida glabrata; identical to SEQ ID NO: 1397
  CDS (1)..(1119)

SEQ ID NO: 61478 - protein, 372 aa, Candida glabrata; identical to SEQ ID NO: 1398

SEQ ID NO: 61479 - DNA, 1071 bp, Candida glabrata; identical to SEQ ID NO: 1399
  CDS (1)..(1071)

SEQ ID NO: 61480 - protein, 356 aa, Candida glabrata; identical to SEQ ID NO: 1400

SEQ ID NO: 61481 - DNA, 1083 bp, Photobacterium profundum; identical to SEQ ID NO: 1401
  CDS (1)..(1083)

SEQ ID NO: 61482 - protein, 360 aa, Photobacterium profundum; identical to SEQ ID NO: 1402

SEQ ID NO: 61483 - DNA, 1053 bp, Photobacterium profundum; identical to SEQ ID NO: 1403
  CDS (1)..(1053)

SEQ ID NO: 61484 - protein, 350 aa, Photobacterium profundum; identical to SEQ ID NO: 1404

SEQ ID NO: 61485 - DNA, 1113 bp, Photobacterium profundum; identical to SEQ ID NO: 1405
  CDS (1)..(1113)

SEQ ID NO: 61486 - protein, 370 aa, Photobacterium profundum; identical to SEQ ID NO: 1406

SEQ ID NO: 61487 - DNA, 1056 bp, Photobacterium profundum; identical to SEQ ID NO: 1407
  CDS (1)..(1056)

SEQ ID NO: 61488 - protein, 351 aa, Photobacterium profundum; identical to SEQ ID NO: 1408

SEQ ID NO: 61489 - DNA, 1092 bp, Parachlamydia sp; identical to SEQ ID NO: 1409
  CDS (1)..(1092)

SEQ ID NO: 61490 - protein, 363 aa, Parachlamydia sp; identical to SEQ ID NO: 1410

SEQ ID NO: 61491 - DNA, 1095 bp, Rhodopseudomonas palustris; identical to SEQ ID NO: 1411
  CDS (1)..(1095)

SEQ ID NO: 61492 - protein, 364 aa, Rhodopseudomonas palustris; identical to SEQ ID NO: 1412

SEQ ID NO: 61493 - DNA, 1100 bp, Amycolatopsis methanolica; identical to SEQ ID NO: 1413
  CDS (1)..(1086)

SEQ ID NO: 61494 - protein, 361 aa, Amycolatopsis methanolica; identical to SEQ ID NO: 1414

SEQ ID NO: 61495 - DNA, 1071 bp, Treponema denticola; identical to SEQ ID NO: 1415
  CDS (1)..(1071)

SEQ ID NO: 61496 - protein, 356 aa, Treponema denticola; identical to SEQ ID NO: 1416

SEQ ID NO: 61497 - DNA, 1068 bp, Geobacter sulfurreducens; identical to SEQ ID NO: 1417
  CDS (1)..(1068)

SEQ ID NO: 61498 - protein, 355 aa, Geobacter sulfurreducens; identical to SEQ ID NO: 1418

SEQ ID NO: 61499 - DNA, 1095 bp, Ashbya gossypii; identical to SEQ ID NO: 1419
  CDS (1)..(1095)

SEQ ID NO: 61500 - protein, 364 aa, Ashbya gossypii; identical to SEQ ID NO: 1420

SEQ ID NO: 61501 - DNA, 1122 bp, Ashbya gossypii; identical to SEQ ID NO: 1421
  CDS (1)..(1122)

SEQ ID NO: 61502 - protein, 373 aa, Ashbya gossypii; identical to SEQ ID NO: 1422

SEQ ID NO: 61503 - DNA, 1098 bp, Amycolatopsis balhimycina; identical to SEQ ID NO: 1423
  CDS (1)..(1098)

SEQ ID NO: 61504 - protein, 365 aa, Amycolatopsis balhimycina; identical to SEQ ID NO: 1424

SEQ ID NO: 61505 - DNA, 1053 bp, Vibrio vulnificus; identical to SEQ ID NO: 2345
  CDS (1)..(1053)

SEQ ID NO: 61506 - protein, 350 aa, Vibrio vulnificus; identical to SEQ ID NO: 2346

SEQ ID NO: 61507 - DNA, 1047 bp, Photorhabdus luminescens; identical to SEQ ID NO: 1427
  CDS (1)..(1047)

SEQ ID NO: 61508 - protein, 348 aa, Photorhabdus luminescens; identical to SEQ ID NO: 1428

SEQ ID NO: 61509 - DNA, 1053 bp, Photorhabdus luminescens; identical to SEQ ID NO: 1429
  CDS (1)..(1053)

SEQ ID NO: 61510 - protein, 350 aa, Photorhabdus luminescens; identical to SEQ ID NO: 1430

SEQ ID NO: 61511 - DNA, 1095 bp, Photorhabdus luminescens; identical to SEQ ID NO: 1431
  CDS (1)..(1095)

SEQ ID NO: 61512 - protein, 364 aa, Photorhabdus luminescens; identical to SEQ ID NO: 1432

SEQ ID NO: 61513 - DNA, 1119 bp, Gloeobacter violaceus; identical to SEQ ID NO: 1433
  CDS (1)..(1119)

SEQ ID NO: 61514 - protein, 372 aa, Gloeobacter violaceus; identical to SEQ ID NO: 1434

SEQ ID NO: 61515 - DNA, 1107 bp, Chromobacterium violaceum; identical to SEQ ID NO: 1435
  CDS (1)..(1107)

SEQ ID NO: 61516 - protein, 368 aa, Chromobacterium violaceum; identical to SEQ ID NO: 1436

SEQ ID NO: 61517 - DNA, 1059 bp, Chromobacterium violaceum; identical to SEQ ID NO: 1437
  CDS (1)..(1059)

SEQ ID NO: 61518 - protein, 352 aa, Chromobacterium violaceum; identical to SEQ ID NO: 1438

SEQ ID NO: 61519 - DNA, 1140 bp, Neurospora crassa; identical to SEQ ID NO: 1439
  CDS (1)..(1140)

SEQ ID NO: 61520 - protein, 379 aa, Neurospora crassa; identical to SEQ ID NO: 1440

SEQ ID NO: 61521 - DNA, 1092 bp, Neurospora crassa; identical to SEQ ID NO: 1441
  CDS (1)..(1092)

SEQ ID NO: 61522 - protein, 363 aa, Neurospora crassa; identical to SEQ ID NO: 1442

SEQ ID NO: 61523 - DNA, 1068 bp, Synechococcus sp; identical to SEQ ID NO: 1443
  CDS (1)..(1068)

SEQ ID NO: 61524 - protein, 355 aa, Synechococcus sp; identical to SEQ ID NO: 1444

SEQ ID NO: 61525 - DNA, 1053 bp, Rhodopirellula baltica; identical to SEQ ID NO: 1445
  CDS (1)..(1053)

SEQ ID NO: 61526 - protein, 350 aa, Rhodopirellula baltica; identical to SEQ ID NO: 1446

SEQ ID NO: 61527 - DNA, 1068 bp, Prochlorococcus marinus subsp; identical to SEQ ID NO: 1447
  CDS (1)..(1068)

SEQ ID NO: 61528 - protein, 355 aa, Prochlorococcus marinus subsp; identical to SEQ ID NO: 1448

SEQ ID NO: 61529 - DNA, 1083 bp, Prochlorococcus marinus; identical to SEQ ID NO: 1449
  CDS (1)..(1083)

SEQ ID NO: 61530 - protein, 360 aa, Prochlorococcus marinus; identical to SEQ ID NO: 1450

SEQ ID NO: 61531 - DNA, 1074 bp, Prochlorococcus marinus; identical to SEQ ID NO: 1451
  CDS (1)..(1074)

SEQ ID NO: 61532 - protein, 357 aa, Prochlorococcus marinus; identical to SEQ ID NO: 1452

SEQ ID NO: 61533 - DNA, 1113 bp, Haemophilus ducreyi; identical to SEQ ID NO: 1453
  CDS (1)..(1113)

SEQ ID NO: 61534 - protein, 370 aa, Haemophilus ducreyi; identical to SEQ ID NO: 1454

SEQ ID NO: 61535 - DNA, 1080 bp, Haemophilus ducreyi; identical to SEQ ID NO: 1455
  CDS (1)..(1080)

SEQ ID NO: 61536 - protein, 359 aa, Haemophilus ducreyi; identical to SEQ ID NO: 1456

SEQ ID NO: 61537 - DNA, 1086 bp, Candidatus Blochmannia floridanus; identical to SEQ ID NO: 1457
  CDS (1)..(1086)

SEQ ID NO: 61538 - protein, 361 aa, Candidatus Blochmannia floridanus; identical to SEQ ID NO: 1458

SEQ ID NO: 61539 - DNA, 1074 bp, Bordetella pertussis; identical to SEQ ID NO: 2379
  CDS (1)..(1074)

SEQ ID NO: 61540 - protein, 357 aa, Bordetella pertussis; identical to SEQ ID NO: 1460

SEQ ID NO: 61541 - DNA, 1119 bp, Bordetella bronchiseptica; identical to SEQ ID NO: 1461
  CDS (1)..(1119)

SEQ ID NO: 61542 - protein, 372 aa, Bordetella bronchiseptica; identical to SEQ ID NO: 1462

SEQ ID NO: 61543 - DNA, 1179 bp, Nitrosomonas europaea; identical to SEQ ID NO: 1463
  CDS (1)..(1179)

SEQ ID NO: 61544 - protein, 392 aa, Nitrosomonas europaea; identical to SEQ ID NO: 1464

SEQ ID NO: 61545 - DNA, 1083 bp, Coxiella burnetii; identical to SEQ ID NO: 1465
  CDS (1)..(1083)

SEQ ID NO: 61546 - protein, 360 aa, Coxiella burnetii; identical to SEQ ID NO: 1466

SEQ ID NO: 61547 - DNA, 1053 bp, Vibrio parahaemolyticus; identical to SEQ ID NO: 1471
  CDS (1)..(1053)

SEQ ID NO: 61548 - protein, 350 aa, Vibrio parahaemolyticus; identical to SEQ ID NO: 1472

SEQ ID NO: 61549 - DNA, 1053 bp, Vibrio parahaemolyticus; identical to SEQ ID NO: 1473
  CDS (1)..(1053)

SEQ ID NO: 61550 - protein, 350 aa, Vibrio parahaemolyticus; identical to SEQ ID NO: 1474

SEQ ID NO: 61551 - DNA, 1074 bp, Vibrio parahaemolyticus; identical to SEQ ID NO: 1475
  CDS (1)..(1074)

SEQ ID NO: 61552 - protein, 357 aa, Vibrio parahaemolyticus; identical to SEQ ID NO: 1476

SEQ ID NO: 61553 - DNA, 1083 bp, Pseudomonas syringae; identical to SEQ ID NO: 1477
  CDS (1)..(1083)

SEQ ID NO: 61554 - protein, 360 aa, Pseudomonas syringae; identical to SEQ ID NO: 1478

SEQ ID NO: 61555 - DNA, 1077 bp, Pseudomonas syringae; identical to SEQ ID NO: 1479
  CDS (1)..(1077)

SEQ ID NO: 61556 - protein, 358 aa, Pseudomonas syringae; identical to SEQ ID NO: 1480

SEQ ID NO: 61557 - DNA, 1062 bp, Pseudomonas putida; identical to SEQ ID NO: 1481
  CDS (1)..(1062)

SEQ ID NO: 61558 - protein, 353 aa, Pseudomonas putida; identical to SEQ ID NO: 1482

SEQ ID NO: 61559 - DNA, 1113 bp, Pseudomonas putida; identical to SEQ ID NO: 1483
  CDS (1)..(1113)

SEQ ID NO: 61560 - protein, 370 aa, Pseudomonas putida; identical to SEQ ID NO: 1484

SEQ ID NO: 61561 - DNA, 1086 bp, Bradyrhizobium japonicum; identical to SEQ ID NO: 1485
  CDS (1)..(1086)

SEQ ID NO: 61562 - protein, 361 aa, Bradyrhizobium japonicum; identical to SEQ ID NO: 1486

SEQ ID NO: 61563 - DNA, 1053 bp, Yersinia pestis; identical to SEQ ID NO: 1487
  CDS (1)..(1053)

SEQ ID NO: 61564 - protein, 350 aa, Yersinia pestis; identical to SEQ ID NO: 1488

SEQ ID NO: 61565 - DNA, 1038 bp, Wigglesworthia glossinidia brevipalpis; identical to SEQ ID NO: 1491
  CDS (1)..(1038)

SEQ ID NO: 61566 - protein, 345 aa, Wigglesworthia glossinidia brevipalpis; identical to SEQ ID NO: 1492

SEQ ID NO: 61567 - DNA, 1071 bp, Vibrio vulnificus; identical to SEQ ID NO: 1739
  CDS (1)..(1071)

SEQ ID NO: 61568 - protein, 356 aa, Vibrio vulnificus; identical to SEQ ID NO: 1740

SEQ ID NO: 61569 - DNA, 1053 bp, Vibrio vulnificus; identical to SEQ ID NO: 1493
  CDS (1)..(1053)

SEQ ID NO: 61570 - protein, 350 aa, Vibrio vulnificus; identical to SEQ ID NO: 1494

SEQ ID NO: 61571 - DNA, 1071 bp, Vibrio vulnificus; identical to SEQ ID NO: 1497
  CDS (1)..(1071)

SEQ ID NO: 61572 - protein, 356 aa, Vibrio vulnificus; identical to SEQ ID NO: 1498

SEQ ID NO: 61573 - DNA, 1062 bp, Synechococcus elongatus; identical to SEQ ID NO: 1499
  CDS (1)..(1062)

SEQ ID NO: 61574 - protein, 353 aa, Synechococcus elongatus; identical to SEQ ID NO: 1500

SEQ ID NO: 61575 - DNA, 1032 bp, Streptococcus mutans; identical to SEQ ID NO: 1501
  CDS (1)..(1032)

SEQ ID NO: 61576 - protein, 343 aa, Streptococcus mutans; identical to SEQ ID NO: 1502

SEQ ID NO: 61577 - DNA, 1035 bp, Streptococcus mutans; identical to SEQ ID NO: 1503
  CDS (1)..(1035)

SEQ ID NO: 61578 - protein, 344 aa, Streptococcus mutans; identical to SEQ ID NO: 1504

SEQ ID NO: 61579 - DNA, 1008 bp, Streptococcus agalactiae; identical to SEQ ID NO: 1505
  CDS (1)..(1008)

SEQ ID NO: 61580 - protein, 335 aa, Streptococcus agalactiae; identical to SEQ ID NO: 1506

SEQ ID NO: 61581 - DNA, 1065 bp, Shewanella oneidensis; identical to SEQ ID NO: 1507
  CDS (1)..(1065)

SEQ ID NO: 61582 - protein, 354 aa, Shewanella oneidensis; identical to SEQ ID NO: 1508

SEQ ID NO: 61583 - DNA, 1092 bp, Shewanella oneidensis; identical to SEQ ID NO: 1509
  CDS (1)..(1092)

SEQ ID NO: 61584 - protein, 363 aa, Shewanella oneidensis; identical to SEQ ID NO: 1510

SEQ ID NO: 61585 - DNA, 1059 bp, Shewanella oneidensis; identical to SEQ ID NO: 1511
  CDS (1)..(1059)

SEQ ID NO: 61586 - protein, 352 aa, Shewanella oneidensis; identical to SEQ ID NO: 1512

SEQ ID NO: 61587 - DNA, 1170 bp, Corynebacterium efficiens; identical to SEQ ID NO: 1515
  CDS (1)..(1170)

SEQ ID NO: 61588 - protein, 389 aa, Corynebacterium efficiens; identical to SEQ ID NO: 1516

SEQ ID NO: 61589 - DNA, 1134 bp, Bifidobacterium longum; identical to SEQ ID NO: 1517
  CDS (1)..(1134)

SEQ ID NO: 61590 - protein, 377 aa, Bifidobacterium longum; identical to SEQ ID NO: 1518

SEQ ID NO: 61591 - DNA, 1233 bp, Bifidobacterium longum; identical to SEQ ID NO: 1519
  CDS (1)..(1233)

SEQ ID NO: 61592 - protein, 410 aa, Bifidobacterium longum; identical to SEQ ID NO: 1520

SEQ ID NO: 61593 - DNA, 1221 bp, Phytophthora infestans; identical to SEQ ID NO: 1521
  CDS (20)..(1153)

SEQ ID NO: 61594 - protein, 377 aa, Phytophthora infestans; identical to SEQ ID NO: 1522

SEQ ID NO: 61595 - DNA, 1062 bp, Chlorobium tepidum; identical to SEQ ID NO: 1523
  CDS (1)..(1062)

SEQ ID NO: 61596 - protein, 353 aa, Chlorobium tepidum; identical to SEQ ID NO: 1524

SEQ ID NO: 61597 - DNA, 1074 bp, Xanthomonas campestris; identical to SEQ ID NO: 1525
  CDS (1)..(1074)

SEQ ID NO: 61598 - protein, 357 aa, Xanthomonas campestris; identical to SEQ ID NO: 1526

SEQ ID NO: 61599 - DNA, 1074 bp, Xanthomonas axonopodis; identical to SEQ ID NO: 1527
  CDS (1)..(1074)

SEQ ID NO: 61600 - protein, 357 aa, Xanthomonas axonopodis; identical to SEQ ID NO: 1528

SEQ ID NO: 61601 - DNA, 1080 bp, Ralstonia solanacearum; identical to SEQ ID NO: 1529
  CDS (1)..(1080)

SEQ ID NO: 61602 - protein, 359 aa, Ralstonia solanacearum; identical to SEQ ID NO: 1530

SEQ ID NO: 61603 - DNA, 1179 bp, Ralstonia solanacearum; identical to SEQ ID NO: 1531
  CDS (1)..(1179)

SEQ ID NO: 61604 - protein, 392 aa, Ralstonia solanacearum; identical to SEQ ID NO: 1532

SEQ ID NO: 61605 - DNA, 1065 bp, Synechococcus sp; identical to SEQ ID NO: 1533
  CDS (1)..(1065)

SEQ ID NO: 61606 - protein, 354 aa, Synechococcus sp; identical to SEQ ID NO: 1534

SEQ ID NO: 61607 - DNA, 1035 bp, Escherichia coli; identical to SEQ ID NO: 1535
  CDS (1)..(1035)

SEQ ID NO: 61608 - protein, 344 aa, Escherichia coli; identical to SEQ ID NO: 1536

SEQ ID NO: 61609 - DNA, 1200 bp, Stigmatella aurantiaca; identical to SEQ ID NO: 1537
  CDS (62)..(1147)

SEQ ID NO: 61610 - protein, 361 aa, Stigmatella aurantiaca; identical to SEQ ID NO: 1538

SEQ ID NO: 61611 - DNA, 1083 bp, Amycolatopsis mediterranei; identical to SEQ ID NO: 1541
  CDS (1)..(1083)

SEQ ID NO: 61612 - protein, 360 aa, Amycolatopsis mediterranei; identical to SEQ ID NO: 1542

SEQ ID NO: 61613 - DNA, 1053 bp, Pasteurella multocida; identical to SEQ ID NO: 1543
  CDS (1)..(1053)

SEQ ID NO: 61614 - protein, 350 aa, Pasteurella multocida; identical to SEQ ID NO: 1544

SEQ ID NO: 61615 - DNA, 1086 bp, Pasteurella multocida; identical to SEQ ID NO: 1545
  CDS (1)..(1086)

SEQ ID NO: 61616 - protein, 361 aa, Pasteurella multocida; identical to SEQ ID NO: 1546

SEQ ID NO: 61617 - DNA, 1125 bp, Emericella nidulans; identical to SEQ ID NO: 1547
  CDS (1)..(1125)

SEQ ID NO: 61618 - protein, 374 aa, Emericella nidulans; identical to SEQ ID NO: 1548

SEQ ID NO: 61619 - DNA, 1089 bp, Emericella nidulans; identical to SEQ ID NO: 1549
  CDS (1)..(1089)

SEQ ID NO: 61620 - protein, 362 aa, Emericella nidulans; identical to SEQ ID NO: 1550

SEQ ID NO: 61621 - DNA, 1239 bp, Vibrio cholerae; identical to SEQ ID NO: 1551
  CDS (114)..(1175)

SEQ ID NO: 61622 - protein, 353 aa, Vibrio cholerae; identical to SEQ ID NO: 1552

SEQ ID NO: 61623 - DNA, 2184 bp, Candida albicans; identical to SEQ ID NO: 1553
  CDS (461)..(1573)

SEQ ID NO: 61624 - protein, 370 aa, Candida albicans; identical to SEQ ID NO: 1554

SEQ ID NO: 61625 - DNA, 1047 bp, Buchnera aphidicola; identical to SEQ ID NO: 1555
  CDS (1)..(1047)

SEQ ID NO: 61626 - protein, 348 aa, Buchnera aphidicola; identical to SEQ ID NO: 1556

SEQ ID NO: 61627 - DNA, 1047 bp, Buchnera aphidicola; identical to SEQ ID NO: 1557
  CDS (1)..(1047)

SEQ ID NO: 61628 - protein, 348 aa, Buchnera aphidicola; identical to SEQ ID NO: 1558

SEQ ID NO: 61629 - DNA, 1047 bp, Erwinia herbicola; identical to SEQ ID NO: 1559
  CDS (1)..(1047)

SEQ ID NO: 61630 - protein, 348 aa, Erwinia herbicola; identical to SEQ ID NO: 1560

SEQ ID NO: 61631 - DNA, 1047 bp, Salmonella typhimurium; identical to SEQ ID NO: 1561
  CDS (1)..(1047)

SEQ ID NO: 61632 - protein, 348 aa, Salmonella typhimurium; identical to SEQ ID NO: 1562

SEQ ID NO: 61633 - DNA, 1047 bp, Shigella flexneri; identical to SEQ ID NO: 2473
  CDS (1)..(1047)

SEQ ID NO: 61634 - protein, 348 aa, Shigella flexneri; identical to SEQ ID NO: 2474

SEQ ID NO: 61635 - DNA, 25 bp, Artificial sequence
  (1)..(25): primer
atgttcattaaaaacgatcacgccg

SEQ ID NO: 61636 - DNA, 25 bp, Artificial sequence
  (1)..(25): primer
ctattttttcaaggcctttcttctg

SEQ ID NO: 61637 - protein, 353 aa, Artificial sequence; identical to SEQ ID NO: 24922
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(37): xaa in position 37 is any amino acid
  Variant (39)..(46): xaa in position 39 to 46 is any amino acid
  Variant (51)..(51): xaa in position 51 is any amino acid
  Variant (54)..(56): xaa in position 54 to 56 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(130): xaa in position 121 to 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(168): xaa in position 166 to 168 is any amino acid
  Variant (171)..(171): xaa in position 171 is any amino acid
  Variant (174)..(174): xaa in position 174 is any amino acid
  Variant (176)..(176): xaa in position 176 is any amino acid
  Variant (181)..(181): xaa in position 181 is any amino acid
  Variant (183)..(183): xaa in position 183 is any amino acid
  Variant (185)..(188): xaa in position 185 to 188 is any amino acid
  Variant (190)..(191): xaa in position 190 to 191 is any amino acid
  Variant (193)..(195): xaa in position 193 to 195 is any amino acid
  Variant (197)..(199): xaa in position 197 to 199 is any amino acid
  Variant (201)..(201): xaa in position 201 is any amino acid
  Variant (203)..(208): xaa in position 203 to 208 is any amino acid
  Variant (210)..(215): xaa in position 210 to 215 is any amino acid
  Variant (217)..(217): xaa in position 217 is any amino acid
  Variant (220)..(222): xaa in position 220 to 222 is any amino acid
  Variant (224)..(225): xaa in position 224 to 225 is any amino acid
  Variant (230)..(238): xaa in position 230 to 238 is any amino acid
  Variant (241)..(269): xaa in position 241 to 269 is any amino acid
  Variant (271)..(271): xaa in position 271 is any amino acid
  Variant (274)..(274): xaa in position 274 is any amino acid
  Variant (277)..(277): xaa in position 277 is any amino acid
  Variant (279)..(282): xaa in position 279 to 282 is any amino acid
  Variant (284)..(285): xaa in position 284 to 285 is any amino acid
  Variant (287)..(292): xaa in position 287 to 292 is any amino acid
  Variant (294)..(296): xaa in position 294 to 296 is any amino acid
  Variant (298)..(305): xaa in position 298 to 305 is any amino acid
  Variant (307)..(307): xaa in position 307 is any amino acid
  Variant (309)..(309): xaa in position 309 is any amino acid
  Variant (312)..(315): xaa in position 312 to 315 is any amino acid
  Variant (317)..(317): xaa in position 317 is any amino acid
  Variant (319)..(334): xaa in position 319 to 334 is any amino acid
  Variant (337)..(337): xaa in position 337 is any amino acid
  Variant (339)..(339): xaa in position 339 is any amino acid
  Variant (342)..(342): xaa in position 342 is any amino acid
  Variant (344)..(345): xaa in position 344 to 345 is any amino acid
  Variant (347)..(348): xaa in position 347 to 348 is any amino acid
  Variant (350)..(352): xaa in position 350 to 352 is any amino acid

SEQ ID NO: 61638 - protein, 72 aa, Artificial sequence; identical to SEQ ID NO: 2906
  Variant (5)..(5): xaa in position 5 is Ile, Val, Ser or Leu
  Variant (6)..(6): xaa in position 6 is His or Asp
  Variant (7)..(7): xaa in position 7 is Asp or Asn
  Variant (8)..(10): xaa in position 8 to 10 is any amino acid
  Variant (11)..(11): xaa in position 11 is Ala, Val or Gly
  Variant (12)..(12): xaa in position 12 is any amino acid
  Variant (13)..(13): xaa in position 13 is Glu, Asp, Ala or Gln
  Variant (15)..(15): xaa in position 15 is Ala, Gly or Cys
  Variant (16)..(17): xaa in position 16 to 17 is any amino acid
  Variant (18)..(18): xaa in position 18 is Leu, Ile or Phe
  Variant (19)..(28): xaa in position 19 to 28 is any amino acid
  Variant (29)..(30): xaa in position 29 to 30 is any or no amino acid
  Variant (31)..(31): xaa in position 31 is Leu, Ile, Phe or Met
  Variant (32)..(32): xaa in position 32 is any amino acid
  Variant (33)..(33): xaa in position 33 is Ile, Val, Leu or Met
  Variant (34)..(34): xaa in position 34 is Val, Ile or Leu
  Variant (37)..(37): xaa in position 37 is Val, Ala or Thr
  Variant (39)..(39): xaa in position 39 is Phe, Leu, Thr or Val
  Variant (40)..(40): xaa in position 40 is Glu or Ala
  Variant (45)..(46): xaa in position 45 to 46 is any amino acid
  Variant (47)..(47): xaa in position 47 is any or no amino acid
  Variant (49)..(49): xaa in position 49 is Trp or Tyr
  Variant (50)..(50): xaa in position 50 is Lys or Arg
  Variant (52)..(52): xaa in position 52 is Leu, Phe, Met or Tyr
  Variant (53)..(53): xaa in position 53 is Ile, Val, Ala or Leu
  Variant (54)..(54): xaa in position 54 is any amino acid
  Variant (55)..(55): xaa in position 55 is Asp, Glu or Gln
  Variant (57)..(57): xaa in position 57 is any amino acid
  Variant (58)..(58): xaa in position 58 is Leu, Met, Ile, Val, Ala or Thr
  Variant (59)..(59): xaa in position 59 is Asp, Asn or Ser
  Variant (60)..(63): xaa in position 60 to 63 is any amino acid
  Variant (64)..(64): xaa in position 64 is Ile, Val, Leu or Met
  Variant (65)..(66): xaa in position 65 to 66 is any amino acid
  Variant (68)..(68): xaa in position 68 is Leu, Ile, Met or Val
  Variant (69)..(70): xaa in position 69 to 70 is any amino acid
  Variant (71)..(71): xaa in position 71 is Ala, Ser, Gly, Val or Thr

SEQ ID NO: 61639 - protein, 76 aa, Artificial sequence; identical to SEQ ID NO: 2907
  Variant (1)..(1): xaa in position 1 is Ala or Ser
  Variant (2)..(2): xaa in position 2 is Ile or Val
  Variant (6)..(6): xaa in position 6 is Thr, Ser or Asn
  Variant (7)..(7): xaa in position 7 is Thr, Val, Ala, Ser or Ile
  Variant (8)..(8): xaa in position 8 is Glu or Ala
  Variant (9)..(9): xaa in position 9 is Ser, Asp or Asn
  Variant (11)..(11): xaa in position 11 is any amino acid
  Variant (14)..(14): xaa in position 14 is Glu, Gln, Phe or Met
  Variant (15)..(15): xaa in position 15 is Leu, Met, Val, Phe or Ile
  Variant (16)..(16): xaa in position 16 is Ala, Ser, Thr, Cys or Val
  Variant (18)..(18): xaa in position 18 is Gly, Ala or Asn
  Variant (19)..(21): xaa in position 19 to 21 is any amino acid
  Variant (22)..(22): xaa in position 22 is Pro or Ala
  Variant (23)..(23): xaa in position 23 is Val, Ile, Thr or Leu
  Variant (25)..(25): xaa in position 25 is Phe, Met, Tyr or Ile
  Variant (28)..(28): xaa in position 28 is any amino acid
  Variant (29)..(29): xaa in position 29 is Thr, Ser or Arg
  Variant (30)..(30): xaa in position 30 is any amino acid
  Variant (32)..(35): xaa in position 32 to 35 is any amino acid
  Variant (36)..(36): xaa in position 36 is Ala or Met
  Variant (37)..(37): xaa in position 37 is any amino acid
  Variant (38)..(38): xaa in position 38 is Asp, Asn or Glu
  Variant (39)..(39): xaa in position 39 is Ala or Gly
  Variant (40)..(41): xaa in position 40 to 41 is any amino acid
  Variant (42)..(42): xaa in position 42 is Ala or Ser
  Variant (43)..(43): xaa in position 43 is Ala, Ser, Val or Thr
  Variant (44)..(46): xaa in position 44 to 46 is any amino acid
  Variant (47)..(47): xaa in position 47 is His or Gln
  Variant (48)..(48): xaa in position 48 is any amino acid
  Variant (49)..(49): xaa in position 49 is Phe, Tyr, His or Val
  Variant (50)..(51): xaa in position 50 to 51 is any amino acid
  Variant (52)..(55): xaa in position 52 to 55 is any or no amino acid
  Variant (57)..(60): xaa in position 57 to 60 is any amino acid
  Variant (61)..(62): xaa in position 61 to 62 is any or no amino acid
  Variant (63)..(63): xaa in position 63 is Thr or Ser
  Variant (64)..(64): xaa in position 64 is any amino acid
  Variant (67)..(69): xaa in position 67 to 69 is any amino acid
  Variant (70)..(70): xaa in position 70 is His or Phe
  Variant (71)..(71): xaa in position 71 is Val, Ile, Leu or Ala
  Variant (72)..(72): xaa in position 72 is Ile or Val
  Variant (73)..(73): xaa in position 73 is Leu or Met
  Variant (76)..(76): xaa in position 76 is Gly, Ala or Ser

SEQ ID NO: 61640 - protein, 83 aa, Artificial sequence; identical to SEQ ID NO: 2908
  Variant (1)..(1): xaa in position 1 is Leu, Ile or Val
  Variant (2)..(2): xaa in position 2 is Met, Val, Ile or Leu
  Variant (3)..(3): xaa in position 3 is Ile or Val
  Variant (5)..(5): xaa in position 5 is Cys, Phe, Ala, Thr or Tyr
  Variant (6)..(6): xaa in position 6 is Ser, Asn or Ala
  Variant (8)..(8): xaa in position 8 is Gly, Ala or Asp
  Variant (10)..(10): xaa in position 10 is Ser or Cys
  Variant (11)..(11): xaa in position 11 is any amino acid
  Variant (13)..(15): xaa in position 13 to 15 is any amino acid
  Variant (16)..(16): xaa in position 16 is Arg, Asn, Lys, Leu or Glu
  Variant (18)..(19): xaa in position 18 to 19 is any amino acid
  Variant (20)..(20): xaa in position 20 is Val or Ile
  Variant (21)..(26): xaa in position 21 to 26 is any amino acid
  Variant (27)..(27): xaa in position 27 is Gln, Asn or Arg
  Variant (28)..(28): xaa in position 28 is Ile, Leu, Val, Arg or Met
  Variant (29)..(30): xaa in position 29 to 30 is any amino acid
  Variant (31)..(31): xaa in position 31 is Gly, Asn or Asp
  Variant (32)..(32): xaa in position 32 is any amino acid
  Variant (33)..(37): xaa in position 33 to 37 is any or no amino acid
  Variant (38)..(38): xaa in position 38 is Ile, Val or Leu
  Variant (39)..(39): xaa in position 39 is any amino acid
  Variant (41)..(41): xaa in position 41 is any amino acid
  Variant (43)..(43): xaa in position 43 is Ile, Leu, Val, Ala or Met
  Variant (46)..(46): xaa in position 46 is His, Phe, Asn or Tyr
  Variant (47)..(47): xaa in position 47 is Leu or Ile
  Variant (48)..(49): xaa in position 48 to 49 is any amino acid
  Variant (51)..(51): xaa in position 51 is any amino acid
  Variant (53)..(57): xaa in position 53 to 57 is any amino acid
  Variant (58)..(69): xaa in position 58 to 69 is any or no amino acid
  Variant (71)..(71): xaa in position 71 is any amino acid
  Variant (73)..(73): xaa in position 73 is Ile or Val
  Variant (76)..(76): xaa in position 76 is any amino acid
  Variant (78)..(78): xaa in position 78 is Ile, Leu or Val
  Variant (79)..(79): xaa in position 79 is any amino acid
  Variant (80)..(80): xaa in position 80 is Trp, Ile, Leu or Phe
  Variant (81)..(82): xaa in position 81 to 82 is any amino acid
  Variant (83)..(83): xaa in position 83 is Thr or Ser

SEQ ID NO: 61641 - DNA, 3844 bp, Saccharomyces cerevisiae; identical to SEQ ID NO: 667
  CDS (1218)..(3269)

SEQ ID NO: 61642 - protein, 683 aa, Saccharomyces cerevisiae; identical to SEQ ID NO: 668

SEQ ID NO: 61643 - DNA, 1713 bp, Glycine max; identical to SEQ ID NO: 669
  CDS (1)..(1713)

SEQ ID NO: 61644 - protein, 570 aa, Glycine max; identical to SEQ ID NO: 670

SEQ ID NO: 61645 - DNA, 1644 bp, Glycine max; identical to SEQ ID NO: 671
  CDS (1)..(1644)

SEQ ID NO: 61646 - protein, 547 aa, Glycine max; identical to SEQ ID NO: 672

SEQ ID NO: 61647 - DNA, 1641 bp, Glycine max; identical to SEQ ID NO: 673
  CDS (1)..(1641)

SEQ ID NO: 61648 - protein, 546 aa, Glycine max; identical to SEQ ID NO: 674

SEQ ID NO: 61649 - DNA, 1668 bp, Zea mays; identical to SEQ ID NO: 675
  CDS (1)..(1668): n means a or g or c or t/u, s means g or c

SEQ ID NO: 61650 - protein, 555 aa, Zea mays; identical to SEQ ID NO: 676

SEQ ID NO: 61651 - DNA, 1659 bp, Brassica napus; identical to SEQ ID NO: 677
  CDS (1)..(1659)

SEQ ID NO: 61652 - protein, 552 aa, Brassica napus; identical to SEQ ID NO: 678

SEQ ID NO: 61653 - DNA, 1689 bp, Glycine max; identical to SEQ ID NO: 679
  CDS (1)..(1689)

SEQ ID NO: 61654 - protein, 562 aa, Glycine max; identical to SEQ ID NO: 680

SEQ ID NO: 61655 - DNA, 3359 bp, Methanothrix soehngenii; identical to SEQ ID NO: 681
  CDS (310)..(2328)

SEQ ID NO: 61656 - protein, 672 aa, Methanothrix soehngenii [sequence omitted]

SEQ ID NO: 61657 - DNA, 3802 bp, Alcaligenes eutrophus; identical to SEQ ID NO: 683
  CDS (722)..(2704)

SEQ ID NO: 61658 - protein, 660 aa, Alcaligenes eutrophus [sequence omitted]

SEQ ID NO: 61659 - DNA, 1845 bp, Phanerochaete chrysosporium; identical to SEQ ID NO: 685
  CDS (1)..(1845)

SEQ ID NO: 61660 - protein, 614 aa, Phanerochaete chrysosporium; identical to SEQ ID NO: 686

SEQ ID NO: 61661 - DNA, 1938 bp, Pseudomonas aeruginosa; identical to SEQ ID NO: 687
  CDS (1)..(1938)

SEQ ID NO: 61662 - protein, 645 aa, Pseudomonas aeruginosa [sequence omitted]

SEQ ID NO: 61663 - DNA, 1668 bp, Pseudomonas aeruginosa; identical to SEQ ID NO: 689
  CDS (1)..(1668)

SEQ ID NO: 61664 - protein, 555 aa, Pseudomonas aeruginosa; identical to SEQ ID NO: 690

SEQ ID NO: 61665 - DNA, 1947 bp, Bacillus halodurans; identical to SEQ ID NO: 691
  CDS (1)..(1947)

SEQ ID NO: 61666 - protein, 648 aa, Bacillus halodurans; identical to SEQ ID NO: 692

SEQ ID NO: 61667 - DNA, 1707 bp, Staphylococcus aureus; identical to SEQ ID NO: 693
  CDS (1)..(1707)

SEQ ID NO: 61668 - protein, 568 aa, Staphylococcus aureus; identical to SEQ ID NO: 694

SEQ ID NO: 61669 - DNA, 1887 bp, Salmonella enterica subsp. enterica serovar Typhi; identical to SEQ ID NO: 695
  CDS (1)..(1887)

SEQ ID NO: 61670 - protein, 628 aa, Salmonella enterica subsp. enterica serovar Typhi; identical to SEQ ID NO: 696

SEQ ID NO: 61671 - DNA, 1575 bp, Nostoc sp. PCC 7120; identical to SEQ ID NO: 697
  CDS (1)..(1575)

SEQ ID NO: 61672 - protein, 524 aa, Nostoc sp. PCC 7120; identical to SEQ ID NO: 698

SEQ ID NO: 61673 - DNA, 1992 bp, Brucella melitensis; identical to SEQ ID NO: 699
  CDS (1)..(1992)

SEQ ID NO: 61674 - protein, 663 aa, Brucella melitensis; identical to SEQ ID NO: 700

SEQ ID NO: 61675 - DNA, 1707 bp, Brucella melitensis; identical to SEQ ID NO: 701
  CDS (1)..(1707)

SEQ ID NO: 61676 - protein, 568 aa, Brucella melitensis; identical to SEQ ID NO: 702

SEQ ID NO: 61677 - DNA, 1959 bp, Yersinia pestis; identical to SEQ ID NO: 703
  CDS (1)..(1959)

SEQ ID NO: 61678 - protein, 652 aa, Yersinia pestis; identical to SEQ ID NO: 704

SEQ ID NO: 61679 - DNA, 1716 bp, Bacillus halodurans; identical to SEQ ID NO: 705
  CDS (1)..(1716)

SEQ ID NO: 61680 - protein, 571 aa, Bacillus halodurans; identical to SEQ ID NO: 706

SEQ ID NO: 61681 - DNA, 2004 bp, Halobacterium sp. NRC-1; identical to SEQ ID NO: 707
  CDS (1)..(2004)

SEQ ID NO: 61682 - protein, 667 aa, Halobacterium sp. NRC-1; identical to SEQ ID NO: 708

SEQ ID NO: 61683 - DNA, 1944 bp, Caulobacter crescentus; identical to SEQ ID NO: 709
  CDS (1)..(1944)

SEQ ID NO: 61684 - protein, 647 aa, Caulobacter crescentus [sequence omitted]

SEQ ID NO: 61685 - DNA, 1716 bp, Sulfolobus solfataricus; identical to SEQ ID NO: 711
  CDS (1)..(1716)

SEQ ID NO: 61686 - protein, 571 aa, Sulfolobus solfataricus; identical to SEQ ID NO: 712

SEQ ID NO: 61687 - DNA, 2001 bp, Sulfolobus solfataricus; identical to SEQ ID NO: 713
  CDS (1)..(2001)

SEQ ID NO: 61688 - protein, 666 aa, Sulfolobus solfataricus; identical to SEQ ID NO: 714

SEQ ID NO: 61689 - DNA, 1959 bp, Escherichia coli; identical to SEQ ID NO: 715
  CDS (1)..(1959)

SEQ ID NO: 61690 - protein, 652 aa, Escherichia coli; identical to SEQ ID NO: 716

SEQ ID NO: 61691 - DNA, 1533 bp, Aquifex aeolicus; identical to SEQ ID NO: 717
  CDS (1)..(1533)

SEQ ID NO: 61692 - protein, 510 aa, Aquifex aeolicus; identical to SEQ ID NO: 718

SEQ ID NO: 61693 - DNA, 1950 bp, Deinococcus radiodurans; identical to SEQ ID NO: 719
  CDS (1)..(1950)

SEQ ID NO: 61694 - protein, 649 aa, Deinococcus radiodurans [sequence omitted]

SEQ ID NO: 61695 - DNA, 1929 bp, Deinococcus radiodurans; identical to SEQ ID NO: 721
  CDS (1)..(1929)

SEQ ID NO: 61696 - protein, 642 aa, Deinococcus radiodurans; identical to SEQ ID NO: 722

SEQ ID NO: 61697 - DNA, 1899 bp, Vibrio cholerae; identical to SEQ ID NO: 723
  CDS (1)..(1899)

SEQ ID NO: 61698 - protein, 632 aa, Vibrio cholerae; identical to SEQ ID NO: 724

SEQ ID NO: 61699 - DNA, 1956 bp, Pseudomonas aeruginosa; identical to SEQ ID NO: 725
  CDS (1)..(1956)

SEQ ID NO: 61700 - protein, 651 aa, Pseudomonas aeruginosa [sequence omitted]

SEQ ID NO: 61701 - DNA, 1497 bp, Sulfolobus solfataricus; identical to SEQ ID NO: 727
  CDS (1)..(1497)

SEQ ID NO: 61702 - protein, 498 aa, Sulfolobus solfataricus; identical to SEQ ID NO: 728

SEQ ID NO: 61703 - DNA, 1869 bp, Sulfolobus solfataricus; identical to SEQ ID NO: 729
  CDS (1)..(1869)

SEQ ID NO: 61704 - protein, 622 aa, Sulfolobus solfataricus; identical to SEQ ID NO: 730

SEQ ID NO: 61705 - DNA, 1989 bp, Helicobacter pylori; identical to SEQ ID NO: 731
  CDS (1)..(1989)

SEQ ID NO: 61706 - protein, 662 aa, Helicobacter pylori [sequence omitted]

SEQ ID NO: 61707 - DNA, 1989 bp, Archaeoglobus fulgidus; identical to SEQ ID NO: 733
  CDS (1)..(1989)

SEQ ID NO: 61708 - protein, 662 aa, Archaeoglobus fulgidus; identical to SEQ ID NO: 734

SEQ ID NO: 61709 - DNA, 1932 bp, Archaeoglobus fulgidus; identical to SEQ ID NO: 735
  CDS (1)..(1932)

SEQ ID NO: 61710 - protein, 643 aa, Archaeoglobus fulgidus; identical to SEQ ID NO: 736

SEQ ID NO: 61711 - DNA, 1542 bp, Aeropyrum pernix; identical to SEQ ID NO: 737
  CDS (1)..(1542)

SEQ ID NO: 61712 - protein, 513 aa, Aeropyrum pernix; identical to SEQ ID NO: 738

SEQ ID NO: 61713 - DNA, 1944 bp, Xylella fastidiosa; identical to SEQ ID NO: 739
  CDS (1)..(1944)

SEQ ID NO: 61714 - protein, 647 aa, Xylella fastidiosa [sequence omitted]

SEQ ID NO: 61715 - DNA, 1827 bp, Sulfolobus solfataricus; identical to SEQ ID NO: 741
  CDS (1)..(1827)

SEQ ID NO: 61716 - protein, 608 aa, Sulfolobus solfataricus; identical to SEQ ID NO: 742

SEQ ID NO: 61717 - DNA, 1959 bp, Sulfolobus solfataricus; identical to SEQ ID NO: 743
  CDS (1)..(1959)

SEQ ID NO: 61718 - protein, 652 aa, Sulfolobus solfataricus; identical to SEQ ID NO: 744

SEQ ID NO: 61719 - DNA, 2046 bp, Archaeoglobus fulgidus; identical to SEQ ID NO: 745
  CDS (1)..(2046)

SEQ ID NO: 61720 - protein, 681 aa, Archaeoglobus fulgidus; identical to SEQ ID NO: 746

SEQ ID NO: 61721 - DNA, 1761 bp, Archaeoglobus fulgidus; identical to SEQ ID NO: 747
  CDS (1)..(1761)

SEQ ID NO: 61722 - protein, 586 aa, Archaeoglobus fulgidus; identical to SEQ ID NO: 748

SEQ ID NO: 61723 - DNA, 1983 bp, Aeropyrum pernix; identical to SEQ ID NO: 749
  CDS (1)..(1983)

SEQ ID NO: 61724 - protein, 660 aa, Aeropyrum pernix; identical to SEQ ID NO: 750

SEQ ID NO: 61725 - DNA, 1677 bp, Methanobacterium thermoautotrophicum; identical to SEQ ID NO: 751
  CDS (1)..(1677)

SEQ ID NO: 61726 - protein, 558 aa, Methanobacterium thermoautotrophicum; identical to SEQ ID NO: 752

SEQ ID NO: 61727 - DNA, 1929 bp, Archaeoglobus fulgidus; identical to SEQ ID NO: 753
  CDS (1)..(1929)

SEQ ID NO: 61728 - protein, 642 aa, Archaeoglobus fulgidus; identical to SEQ ID NO: 754

SEQ ID NO: 61729 - DNA, 1974 bp, Campylobacter jejuni; identical to SEQ ID NO: 755
  CDS (1)..(1974)

SEQ ID NO: 61730 - protein, 657 aa, Campylobacter jejuni [sequence omitted]

SEQ ID NO: 61731 - DNA, 1956 bp, Pseudomonas aeruginosa; identical to SEQ ID NO: 757
  CDS (1)..(1956)

SEQ ID NO: 61732 - protein, 651 aa, Pseudomonas aeruginosa; identical to SEQ ID NO: 758

SEQ ID NO: 61733 - DNA, 1887 bp, Pseudomonas aeruginosa; identical to SEQ ID NO: 759
  CDS (1)..(1887)

SEQ ID NO: 61734 - protein, 628 aa, Pseudomonas aeruginosa [sequence omitted]

SEQ ID NO: 61735 - DNA, 1971 bp, Halobacterium sp. NRC-1; identical to SEQ ID NO: 761
  CDS (1)..(1971)

SEQ ID NO: 61736 - protein, 656 aa, Halobacterium sp. NRC-1; identical to SEQ ID NO: 762

SEQ ID NO: 61737 - DNA, 1719 bp, Bacillus subtilis; identical to SEQ ID NO: 763
  CDS (1)..(1719)

SEQ ID NO: 61738 - protein, 572 aa, Bacillus subtilis; identical to SEQ ID NO: 764

SEQ ID NO: 61739 - DNA, 2019 bp, Phycomyces blakesleeanus; identical to SEQ ID NO: 765
  CDS (1)..(2019)

SEQ ID NO: 61740 - protein, 672 aa, Phycomyces blakesleeanus [sequence omitted]

SEQ ID NO: 61741 - DNA, 2674 bp, Drosophila melanogaster; identical to SEQ ID NO: 767
  CDS (419)..(2164)

SEQ ID NO: 61742 - protein, 581 aa, Drosophila melanogaster; identical to SEQ ID NO: 768

SEQ ID NO: 61743 - DNA, 1962 bp, Synechocystis sp; identical to SEQ ID NO: 769
  CDS (1)..(1962)

SEQ ID NO: 61744 - protein, 653 aa, Synechocystis sp [sequence omitted]

SEQ ID NO: 61745 - DNA, 2013 bp, Emericella nidulans, Aspergillus nidulans; identical to SEQ ID NO: 771
  CDS (1)..(2013)

SEQ ID NO: 61746 - protein, 670 aa, Emericella nidulans, Aspergillus nidulans [sequence omitted]

SEQ ID NO: 61747 - DNA, 1881 bp, Neurospora crassa; identical to SEQ ID NO: 773
  CDS (1)..(1881)

SEQ ID NO: 61748 - protein, 626 aa, Neurospora crassa [sequence omitted]

SEQ ID NO: 61749 - DNA, 1971 bp, Rhodobacter capsulatus; identical to SEQ ID NO: 775
  CDS (1)..(1971)

SEQ ID NO: 61750 - protein, 656 aa, Rhodobacter capsulatus [sequence omitted]

SEQ ID NO: 61751 - DNA, 2043 bp, Caenorhabditis elegans; identical to SEQ ID NO: 777
  CDS (1)..(2043)

SEQ ID NO: 61752 - protein, 680 aa, Caenorhabditis elegans; identical to SEQ ID NO: 778

SEQ ID NO: 61753 - DNA, 1956 bp, Streptomyces coelicolor; identical to SEQ ID NO: 779
  CDS (1)..(1956)

SEQ ID NO: 61754 - protein, 651 aa, Streptomyces coelicolor; identical to SEQ ID NO: 780

SEQ ID NO: 61755 - DNA, 1989 bp, Schizosaccharomyces pombe; identical to SEQ ID NO: 781
  CDS (1)..(1989)

SEQ ID NO: 61756 - protein, 662 aa, Schizosaccharomyces pombe [sequence omitted]

SEQ ID NO: 61757 - DNA, 2013 bp, Pyrobaculum aerophilum; identical to SEQ ID NO: 783
  CDS (1)..(2013)

SEQ ID NO: 61758 - protein, 670 aa, Pyrobaculum aerophilum [sequence omitted]

SEQ ID NO: 61759 - DNA, 2010 bp, Penicillium chrysogenum; identical to SEQ ID NO: 785
  CDS (1)..(2010)

SEQ ID NO: 61760 - protein, 669 aa, Penicillium chrysogenum; identical to SEQ ID NO: 786

SEQ ID NO: 61761 - DNA, 2323 bp, Homo sapiens; identical to SEQ ID NO: 787
  CDS (92)..(2152)

SEQ ID NO: 61762 - protein, 686 aa, Homo sapiens; identical to SEQ ID NO: 788

SEQ ID NO: 61763 - DNA, 1950 bp, Pseudomonas putida; identical to SEQ ID NO: 789
  CDS (1)..(1950)

SEQ ID NO: 61764 - protein, 649 aa, Pseudomonas putida; identical to SEQ ID NO: 790

SEQ ID NO: 61765 - DNA, 2444 bp, Lysobacter; identical to SEQ ID NO: 791
  CDS (337)..(2232)

SEQ ID NO: 61766 - protein, 631 aa, Lysobacter; identical to SEQ ID NO: 792

SEQ ID NO: 61767 - DNA, 2016 bp, Debaryomyces hansenii; identical to SEQ ID NO: 793
  CDS (1)..(2016)

SEQ ID NO: 61768 - protein, 671 aa, Debaryomyces hansenii; identical to SEQ ID NO: 794

SEQ ID NO: 61769 - DNA, 2040 bp, Debaryomyces hansenii; identical to SEQ ID NO: 795
  CDS (1)..(2040)

SEQ ID NO: 61770 - protein, 679 aa, Debaryomyces hansenii; identical to SEQ ID NO: 796

SEQ ID NO: 61771 - DNA, 1974 bp, Yarrowia lipolytica; identical to SEQ ID NO: 797
  CDS (1)..(1974)

SEQ ID NO: 61772 - protein, 657 aa, Yarrowia lipolytica; identical to SEQ ID NO: 798

SEQ ID NO: 61773 - DNA, 2124 bp, Kluyveromyces lactis; identical to SEQ ID NO: 799
  CDS (1)..(2124)

SEQ ID NO: 61774 - protein, 707 aa, Kluyveromyces lactis; identical to SEQ ID NO: 800

SEQ ID NO: 61775 - DNA, 1962 bp, Pseudomonas putida; identical to SEQ ID NO: 801
  CDS (1)..(1962)

SEQ ID NO: 61776 - protein, 653 aa, Pseudomonas putida; identical to SEQ ID NO: 802

SEQ ID NO: 61777 - DNA, 1644 bp, Acinetobacter sp; identical to SEQ ID NO: 803
  CDS (1)..(1644)

SEQ ID NO: 61778 - protein, 547 aa, Acinetobacter sp; identical to SEQ ID NO: 804

SEQ ID NO: 61779 - DNA, 1644 bp, Acinetobacter sp; identical to SEQ ID NO: 805
  CDS (1)..(1644)

SEQ ID NO: 61780 - protein, 547 aa, Acinetobacter sp; identical to SEQ ID NO: 806

SEQ ID NO: 61781 - DNA, 2115 bp, Candida glabrata; identical to SEQ ID NO: 807
  CDS (1)..(2115)

SEQ ID NO: 61782 - protein, 704 aa, Candida glabrata; identical to SEQ ID NO: 808

SEQ ID NO: 61783 - DNA, 2052 bp, Candida glabrata; identical to SEQ ID NO: 809
  CDS (1)..(2052)

SEQ ID NO: 61784 - protein, 683 aa, Candida glabrata; identical to SEQ ID NO: 810

SEQ ID NO: 61785 - DNA, 1959 bp, Bartonella quintana; identical to SEQ ID NO: 811
  CDS (1)..(1959)

SEQ ID NO: 61786 - protein, 652 aa, Bartonella quintana; identical to SEQ ID NO: 812

SEQ ID NO: 61787 - DNA, 1959 bp, Bartonella henselae; identical to SEQ ID NO: 813
  CDS (1)..(1959)

SEQ ID NO: 61788 - protein, 652 aa, Bartonella henselae; identical to SEQ ID NO: 814

SEQ ID NO: 61789 - DNA, 2763 bp, Oryza sativa; identical to SEQ ID NO: 815
  CDS (355)..(2472)

SEQ ID NO: 61790 - protein, 705 aa, Oryza sativa; identical to SEQ ID NO: 816

SEQ ID NO: 61791 - DNA, 1941 bp, Bacillus thuringiensis serovar konkukian str; identical to SEQ ID NO: 817
  CDS (1)..(1941)

SEQ ID NO: 61792 - protein, 646 aa, Bacillus thuringiensis serovar konkukian str; identical to SEQ ID NO: 818

SEQ ID NO: 61793 - DNA, 1953 bp, Picrophilus torridus; identical to SEQ ID NO: 819
  CDS (1)..(1953)

SEQ ID NO: 61794 - protein, 650 aa, Picrophilus torridus; identical to SEQ ID NO: 820

SEQ ID NO: 61795 - DNA, 2994 bp, Plasmodium falciparum; identical to SEQ ID NO: 821
  CDS (1)..(2994)

SEQ ID NO: 61796 - protein, 997 aa, Plasmodium falciparum; identical to SEQ ID NO: 822

SEQ ID NO: 61797 - DNA, 2007 bp, Photobacterium profundum; identical to SEQ ID NO: 823
  CDS (1)..(2007)

SEQ ID NO: 61798 - protein, 668 aa, Photobacterium profundum; identical to SEQ ID NO: 824

SEQ ID NO: 61799 - DNA, 1899 bp, Photobacterium profundum; identical to SEQ ID NO: 825
  CDS (1)..(1899)

SEQ ID NO: 61800 - protein, 632 aa, Photobacterium profundum; identical to SEQ ID NO: 826

SEQ ID NO: 61801 - DNA, 1950 bp, Photobacterium profundum; identical to SEQ ID NO: 827
  CDS (1)..(1950)

SEQ ID NO: 61802 - protein, 649 aa, Photobacterium profundum; identical to SEQ ID NO: 828

SEQ ID NO: 61803 - DNA, 1674 bp, Methanococcus maripaludis; identical to SEQ ID NO: 829
  CDS (1)..(1674)

SEQ ID NO: 61804 - protein, 557 aa, Methanococcus maripaludis; identical to SEQ ID NO: 830

SEQ ID NO: 61805 - DNA, 1911 bp, Methanococcus maripaludis; identical to SEQ ID NO: 831
  CDS (1)..(1911)

SEQ ID NO: 61806 - protein, 636 aa, Methanococcus maripaludis; identical to SEQ ID NO: 832

SEQ ID NO: 61807 - DNA, 1938 bp, Bdellovibrio bacteriovorus; identical to SEQ ID NO: 833
  CDS (1)..(1938)

SEQ ID NO: 61808 - protein, 645 aa, Bdellovibrio bacteriovorus; identical to SEQ ID NO: 834

SEQ ID NO: 61809 - DNA, 1911 bp, Rhodopseudomonas palustris; identical to SEQ ID NO: 835
  CDS (1)..(1911)

SEQ ID NO: 61810 - protein, 636 aa, Rhodopseudomonas palustris; identical to SEQ ID NO: 836

SEQ ID NO: 61811 - DNA, 1692 bp, Rhodopseudomonas palustris; identical to SEQ ID NO: 837
  CDS (1)..(1692)

SEQ ID NO: 61812 - protein, 563 aa, Rhodopseudomonas palustris; identical to SEQ ID NO: 838

SEQ ID NO: 61813 - DNA, 1953 bp, Rhodopseudomonas palustris; identical to SEQ ID NO: 839
  CDS (1)..(1953)

SEQ ID NO: 61814 - protein, 650 aa, Rhodopseudomonas palustris; identical to SEQ ID NO: 840

SEQ ID NO: 61815 - DNA, 1959 bp, uncultured bacterium 314; identical to SEQ ID NO: 841
  CDS (1)..(1959)

SEQ ID NO: 61816 - protein, 652 aa, uncultured bacterium 314; identical to SEQ ID NO: 842

SEQ ID NO: 61817 - DNA, 1938 bp, uncultured bacterium 311; identical to SEQ ID NO: 843
  CDS (1)..(1938)

SEQ ID NO: 61818 - protein, 645 aa, uncultured bacterium 311; identical to SEQ ID NO: 844

SEQ ID NO: 61819 - DNA, 1743 bp, Rattus norvegicus; identical to SEQ ID NO: 845
  CDS (1)..(1743)

SEQ ID NO: 61820 - protein, 580 aa, Rattus norvegicus; identical to SEQ ID NO: 846

SEQ ID NO: 61821 - DNA, 1740 bp, Klebsiella pneumoniae; identical to SEQ ID NO: 847
  CDS (1)..(1740)

SEQ ID NO: 61822 - protein, 579 aa, Klebsiella pneumoniae; identical to SEQ ID NO: 848

SEQ ID NO: 61823 - DNA, 1821 bp, Homo sapiens; identical to SEQ ID NO: 849
  CDS (1)..(1821)

SEQ ID NO: 61824 - protein, 606 aa, Homo sapiens; identical to SEQ ID NO: 850

SEQ ID NO: 61825 - DNA, 1716 bp, Thermoproteus tenax; identical to SEQ ID NO: 851
  CDS (1)..(1716)

SEQ ID NO: 61826 - protein, 571 aa, Thermoproteus tenax; identical to SEQ ID NO: 852

SEQ ID NO: 61827 - DNA, 2118 bp, Agrobacterium vitis; identical to SEQ ID NO: 853
  CDS (1)..(2118)

SEQ ID NO: 61828 - protein, 705 aa, Agrobacterium vitis; identical to SEQ ID NO: 854

SEQ ID NO: 61829 - DNA, 1578 bp, Listeria monocytogenes; identical to SEQ ID NO: 855
  CDS (1)..(1578)

SEQ ID NO: 61830 - protein, 525 aa, Listeria monocytogenes; identical to SEQ ID NO: 856

SEQ ID NO: 61831 - DNA, 1986 bp, Desulfovibrio vulgaris; identical to SEQ ID NO: 857
  CDS (1)..(1986)

SEQ ID NO: 61832 - protein, 661 aa, Desulfovibrio vulgaris; identical to SEQ ID NO: 858

SEQ ID NO: 61833 - DNA, 1656 bp, Desulfovibrio vulgaris; identical to SEQ ID NO: 859
  CDS (1)..(1656)

SEQ ID NO: 61834 - protein, 551 aa, Desulfovibrio vulgaris; identical to SEQ ID NO: 860

SEQ ID NO: 61835 - DNA, 1947 bp, Desulfovibrio vulgaris; identical to SEQ ID NO: 861
  CDS (1)..(1947)

SEQ ID NO: 61836 - protein, 648 aa, Desulfovibrio vulgaris; identical to SEQ ID NO: 862

SEQ ID NO: 61837 - DNA, 1890 bp, Thermus thermophilus; identical to SEQ ID NO: 863
  CDS (1)..(1890)

SEQ ID NO: 61838 - protein, 629 aa, Thermus thermophilus; identical to SEQ ID NO: 864

SEQ ID NO: 61839 - DNA, 1884 bp, Thermus thermophilus; identical to SEQ ID NO: 865
  CDS (1)..(1884)

SEQ ID NO: 61840 - protein, 627 aa, Thermus thermophilus; identical to SEQ ID NO: 866

SEQ ID NO: 61841 - DNA, 2538 bp, Thermus thermophilus; identical to SEQ ID NO: 867
  CDS (1)..(2538)

SEQ ID NO: 61842 - protein, 845 aa, Thermus thermophilus; identical to SEQ ID NO: 868

SEQ ID NO: 61843 - DNA, 1947 bp, Thermus thermophilus; identical to SEQ ID NO: 869
  CDS (1)..(1947)

SEQ ID NO: 61844 - protein, 648 aa, Thermus thermophilus; identical to SEQ ID NO: 870

SEQ ID NO: 61845 - DNA, 1719 bp, Bacillus cereus; identical to SEQ ID NO: 871
  CDS (1)..(1719)

SEQ ID NO: 61846 - protein, 572 aa, Bacillus cereus; identical to SEQ ID NO: 872

SEQ ID NO: 61847 - DNA, 1653 bp, Treponema denticola; identical to SEQ ID NO: 873
  CDS (1)..(1653)

SEQ ID NO: 61848 - protein, 550 aa, Treponema denticola; identical to SEQ ID NO: 874

SEQ ID NO: 61849 - DNA, 1953 bp, Mycobacterium paratuberculosis; identical to SEQ ID NO: 875
  CDS (1)..(1953)

SEQ ID NO: 61850 - protein, 650 aa, Mycobacterium paratuberculosis; identical to SEQ ID NO: 876

SEQ ID NO: 61851 - DNA, 2064 bp, Ashbya gossypii; identical to SEQ ID NO: 877
  CDS (1)..(2064)

SEQ ID NO: 61852 - protein, 687 aa, Ashbya gossypii; identical to SEQ ID NO: 878

SEQ ID NO: 61853 - DNA, 2085 bp, Ashbya gossypii; identical to SEQ ID NO: 879
  CDS (1)..(2085)

SEQ ID NO: 61854 - protein, 694 aa, Ashbya gossypii; identical to SEQ ID NO: 880

SEQ ID NO: 61855 - DNA, 1977 bp, Dictyostelium discoideum; identical to SEQ ID NO: 881
  CDS (1)..(1977)

SEQ ID NO: 61856 - protein, 658 aa, Dictyostelium discoideum; identical to SEQ ID NO: 882

SEQ ID NO: 61857 - DNA, 2046 bp, Dictyostelium discoideum; identical to SEQ ID NO: 883
  CDS (1)..(2046)

SEQ ID NO: 61858 - protein, 681 aa, Dictyostelium discoideum; identical to SEQ ID NO: 884

SEQ ID NO: 61859 - DNA, 2316 bp, Oryza sativa; identical to SEQ ID NO: 885
  CDS (1)..(2316)

SEQ ID NO: 61860 - protein, 771 aa, Oryza sativa; identical to SEQ ID NO: 886

SEQ ID NO: 61861 - DNA, 1965 bp, Wolinella succinogenes; identical to SEQ ID NO: 887
  CDS (1)..(1965)

SEQ ID NO: 61862 - protein, 654 aa, Wolinella succinogenes; identical to SEQ ID NO: 888

SEQ ID NO: 61863 - DNA, 1956 bp, Photorhabdus luminescens; identical to SEQ ID NO: 889
  CDS (1)..(1956)

SEQ ID NO: 61864 - protein, 651 aa, Photorhabdus luminescens; identical to SEQ ID NO: 890

SEQ ID NO: 61865 - DNA, 2043 bp, Vibrio vulnificus; identical to SEQ ID NO: 891
  CDS (1)..(2043)

SEQ ID NO: 61866 - protein, 680 aa, Vibrio vulnificus; identical to SEQ ID NO: 892

SEQ ID NO: 61867 - DNA, 2013 bp, Vibrio vulnificus; identical to SEQ ID NO: 893
  CDS (1)..(2013)

SEQ ID NO: 61868 - protein, 670 aa, Vibrio vulnificus; identical to SEQ ID NO: 894

SEQ ID NO: 61869 - DNA, 1887 bp, Photorhabdus luminescens; identical to SEQ ID NO: 895
  CDS (1)..(1887)

SEQ ID NO: 61870 - protein, 628 aa, Photorhabdus luminescens; identical to SEQ ID NO: 896

SEQ ID NO: 61871 - DNA, 1944 bp, Gloeobacter violaceus; identical to SEQ ID NO: 897
  CDS (1)..(1944)

SEQ ID NO: 61872 - protein, 647 aa, Gloeobacter violaceus; identical to SEQ ID NO: 898

SEQ ID NO: 61873 - DNA, 1965 bp, Chromobacterium violaceum; identical to SEQ ID NO: 899
  CDS (1)..(1965)

SEQ ID NO: 61874 - protein, 654 aa, Chromobacterium violaceum; identical to SEQ ID NO: 900

SEQ ID NO: 61875 - DNA, 1962 bp, Chromobacterium violaceum; identical to SEQ ID NO: 901
  CDS (1)..(1962)

SEQ ID NO: 61876 - protein, 653 aa, Chromobacterium violaceum; identical to SEQ ID NO: 902

SEQ ID NO: 61877 - DNA, 1713 bp, Anopheles gambiae str; identical to SEQ ID NO: 903
  CDS (1)..(1713)

SEQ ID NO: 61878 - protein, 570 aa, Anopheles gambiae str; identical to SEQ ID NO: 904

SEQ ID NO: 61879 - DNA, 2856 bp, Plasmodium yoelii yoelii; identical to SEQ ID NO: 905
  CDS (1)..(2856)

SEQ ID NO: 61880 - protein, 951 aa, Plasmodium yoelii yoelii; identical to SEQ ID NO: 906

SEQ ID NO: 61881 - DNA, 2130 bp, Neurospora crassa; identical to SEQ ID NO: 907
  CDS (1)..(2130)

SEQ ID NO: 61882 - protein, 709 aa, Neurospora crassa; identical to SEQ ID NO: 908

SEQ ID NO: 61883 - DNA, 2070 bp, Synechococcus sp; identical to SEQ ID NO: 909
  CDS (1)..(2070)

SEQ ID NO: 61884 - protein, 689 aa, Synechococcus sp; identical to SEQ ID NO: 910

SEQ ID NO: 61885 - DNA, 1983 bp, Prochlorococcus marinus subsp; identical to SEQ ID NO: 911
  CDS (1)..(1983)

SEQ ID NO: 61886 - protein, 660 aa, Prochlorococcus marinus subsp; identical to SEQ ID NO: 912

SEQ ID NO: 61887 - DNA, 1977 bp, Prochlorococcus marinus; identical to SEQ ID NO: 913
  CDS (1)..(1977)

SEQ ID NO: 61888 - protein, 658 aa, Prochlorococcus marinus; identical to SEQ ID NO: 914

SEQ ID NO: 61889 - DNA, 1977 bp, Prochlorococcus marinus; identical to SEQ ID NO: 915
  CDS (1)..(1977)

SEQ ID NO: 61890 - protein, 658 aa, Prochlorococcus marinus; identical to SEQ ID NO: 916

SEQ ID NO: 61891 - DNA, 1902 bp, Helicobacter hepaticus; identical to SEQ ID NO: 917
  CDS (1)..(1902)

SEQ ID NO: 61892 - protein, 633 aa, Helicobacter hepaticus; identical to SEQ ID NO: 918

SEQ ID NO: 61893 - DNA, 1890 bp, Bordetella parapertussis; identical to SEQ ID NO: 919
  CDS (1)..(1890)

SEQ ID NO: 61894 - protein, 629 aa, Bordetella parapertussis; identical to SEQ ID NO: 920

SEQ ID NO: 61895 - DNA, 2046 bp, Bordetella parapertussis; identical to SEQ ID NO: 921
  CDS (1)..(2046)

SEQ ID NO: 61896 - protein, 681 aa, Bordetella parapertussis; identical to SEQ ID NO: 922

SEQ ID NO: 61897 - DNA, 1950 bp, Bordetella bronchiseptica; identical to SEQ ID NO: 923
  CDS (1)..(1950)

SEQ ID NO: 61898 - protein, 649 aa, Bordetella bronchiseptica; identical to SEQ ID NO: 924

SEQ ID NO: 61899 - DNA, 3626 bp, Homo sapiens; identical to SEQ ID NO: 925
  CDS (6)..(2069)

SEQ ID NO: 61900 - protein, 687 aa, Homo sapiens [sequence omitted]

SEQ ID NO: 61901 - DNA, 1941 bp, Bacillus cereus; identical to SEQ ID NO: 927
  CDS (1)..(1941)

SEQ ID NO: 61902 - protein, 646 aa, Bacillus cereus; identical to SEQ ID NO: 928

SEQ ID NO: 61903 - DNA, 1968 bp, Streptomyces avermitilis; identical to SEQ ID NO: 929
  CDS (1)..(1968)

SEQ ID NO: 61904 - protein, 655 aa, Streptomyces avermitilis; identical to SEQ ID NO: 930

SEQ ID NO: 61905 - DNA, 2019 bp, Streptomyces avermitilis; identical to SEQ ID NO: 931
  CDS (1)..(2019)

SEQ ID NO: 61906 - protein, 672 aa, Streptomyces avermitilis; identical to SEQ ID NO: 932

SEQ ID NO: 61907 - DNA, 1953 bp, Coxiella burnetii; identical to SEQ ID NO: 933
  CDS (1)..(1953)

SEQ ID NO: 61908 - protein, 650 aa, Coxiella burnetii; identical to SEQ ID NO: 934

SEQ ID NO: 61909 - DNA, 1968 bp, Dictyostelium discoideum; identical to SEQ ID NO: 935
  CDS (1)..(1968)

SEQ ID NO: 61910 - protein, 655 aa, Dictyostelium discoideum; identical to SEQ ID NO: 936

SEQ ID NO: 61911 - DNA, 1956 bp, Dictyostelium discoideum; identical to SEQ ID NO: 937
  CDS (1)..(1956)

SEQ ID NO: 61912 - protein, 651 aa, Dictyostelium discoideum; identical to SEQ ID NO: 938

SEQ ID NO: 61913 - DNA, 1968 bp, Dictyostelium discoideum; identical to SEQ ID NO: 939
  CDS (1)..(1968)

SEQ ID NO: 61914 - protein, 655 aa, Dictyostelium discoideum; identical to SEQ ID NO: 940

SEQ ID NO: 61915 - DNA, 1944 bp, Dictyostelium discoideum; identical to SEQ ID NO: 941
  CDS (1)..(1944)

SEQ ID NO: 61916 - protein, 647 aa, Dictyostelium discoideum; identical to SEQ ID NO: 942

SEQ ID NO: 61917 - DNA, 1941 bp, Dictyostelium discoideum; identical to SEQ ID NO: 943
  CDS (1)..(1941)

SEQ ID NO: 61918 - protein, 646 aa, Dictyostelium discoideum; identical to SEQ ID NO: 944

SEQ ID NO: 61919 - DNA, 2085 bp, Neurospora crassa; identical to SEQ ID NO: 945
  CDS (1)..(2085)

SEQ ID NO: 61920 - protein, 694 aa, Neurospora crassa; identical to SEQ ID NO: 946

SEQ ID NO: 61921 - DNA, 2034 bp, Vibrio parahaemolyticus; identical to SEQ ID NO: 947
  CDS (1)..(2034)

SEQ ID NO: 61922 - protein, 677 aa, Vibrio parahaemolyticus; identical to SEQ ID NO: 948

SEQ ID NO: 61923 - DNA, 1971 bp, Vibrio parahaemolyticus; identical to SEQ ID NO: 949
  CDS (1)..(1971)

SEQ ID NO: 61924 - protein, 656 aa, Vibrio parahaemolyticus; identical to SEQ ID NO: 950

SEQ ID NO: 61925 - DNA, 1905 bp, Vibrio parahaemolyticus; identical to SEQ ID NO: 951
  CDS (1)..(1905)

SEQ ID NO: 61926 - protein, 634 aa, Vibrio parahaemolyticus; identical to SEQ ID NO: 952

SEQ ID NO: 61927 - DNA, 1953 bp, Pseudomonas putida; identical to SEQ ID NO: 953
  CDS (1)..(1953)

SEQ ID NO: 61928 - protein, 650 aa, Pseudomonas putida; identical to SEQ ID NO: 954

SEQ ID NO: 61929 - DNA, 1890 bp, Pseudomonas putida; identical to SEQ ID NO: 955
  CDS (1)..(1890)

SEQ ID NO: 61930 - protein, 629 aa, Pseudomonas putida; identical to SEQ ID NO: 956

SEQ ID NO: 61931 - DNA, 1686 bp, Pseudomonas putida; identical to SEQ ID NO: 957
  CDS (1)..(1686)

SEQ ID NO: 61932 - protein, 561 aa, Pseudomonas putida; identical to SEQ ID NO: 958

SEQ ID NO: 61933 - DNA, 1689 bp, Bradyrhizobium japonicum; identical to SEQ ID NO: 959
  CDS (1)..(1689)

SEQ ID NO: 61934 - protein, 562 aa, Bradyrhizobium japonicum; identical to SEQ ID NO: 960

SEQ ID NO: 61935 - DNA, 2049 bp, Bradyrhizobium japonicum; identical to SEQ ID NO: 961
  CDS (1)..(2049)

SEQ ID NO: 61936 - protein, 682 aa, Bradyrhizobium japonicum; identical to SEQ ID NO: 962

SEQ ID NO: 61937 - DNA, 1911 bp, Bradyrhizobium japonicum; identical to SEQ ID NO: 963
  CDS (1)..(1911)

SEQ ID NO: 61938 - protein, 636 aa, Bradyrhizobium japonicum; identical to SEQ ID NO: 964

SEQ ID NO: 61939 - DNA, 1656 bp, Bacteroides thetaiotaomicron; identical to SEQ ID NO: 965
  CDS (1)..(1656)

SEQ ID NO: 61940 - protein, 551 aa, Bacteroides thetaiotaomicron; identical to SEQ ID NO: 966

SEQ ID NO: 61941 - DNA, 2495 bp, Mus musculus; identical to SEQ ID NO: 967
  CDS (87)..(1580)

SEQ ID NO: 61942 - protein, 497 aa, Mus musculus; identical to SEQ ID NO: 968

SEQ ID NO: 61943 - DNA, 1881 bp, Vibrio vulnificus; identical to SEQ ID NO: 969
  CDS (1)..(1881)

SEQ ID NO: 61944 - protein, 626 aa, Vibrio vulnificus; identical to SEQ ID NO: 970

SEQ ID NO: 61945 - DNA, 1986 bp, Oceanobacillus iheyensis; identical to SEQ ID NO: 971
  CDS (1)..(1986)

SEQ ID NO: 61946 - protein, 661 aa, Oceanobacillus iheyensis; identical to SEQ ID NO: 972

SEQ ID NO: 61947 - DNA, 1716 bp, Oceanobacillus iheyensis; identical to SEQ ID NO: 973
  CDS (1)..(1716)

SEQ ID NO: 61948 - protein, 571 aa, Oceanobacillus iheyensis; identical to SEQ ID NO: 974

SEQ ID NO: 61949 - DNA, 1887 bp, Escherichia coli O6; identical to SEQ ID NO: 975
  CDS (1)..(1887)

SEQ ID NO: 61950 - protein, 628 aa, Escherichia coli O6; identical to SEQ ID NO: 976

SEQ ID NO: 61951 - DNA, 1671 bp, Brucella suis; identical to SEQ ID NO: 977
  CDS (1)..(1671)

SEQ ID NO: 61952 - protein, 556 aa, Brucella suis; identical to SEQ ID NO: 978

SEQ ID NO: 61953 - DNA, 1989 bp, Brucella suis; identical to SEQ ID NO: 979
  CDS (1)..(1989)

SEQ ID NO: 61954 - protein, 662 aa, Brucella suis; identical to SEQ ID NO: 980

SEQ ID NO: 61955 - DNA, 2924 bp, Homo sapiens; identical to SEQ ID NO: 981
  CDS (34)..(2178)

SEQ ID NO: 61956 - protein, 714 aa, Homo sapiens [sequence omitted]

SEQ ID NO: 61957 - DNA, 1899 bp, Encephalitozoon cuniculi; identical to SEQ ID NO: 983
  CDS (1)..(1899)

SEQ ID NO: 61958 - protein, 632 aa, Encephalitozoon cuniculi; identical to SEQ ID NO: 984

SEQ ID NO: 61959 - DNA, 2004 bp, Neurospora crassa; identical to SEQ ID NO: 985
  CDS (1)..(2004)

SEQ ID NO: 61960 - protein, 667 aa, Neurospora crassa; identical to SEQ ID NO: 986

SEQ ID NO: 61961 - DNA, 1899 bp, Ralstonia solanacearum; identical to SEQ ID NO: 987
  CDS (1)..(1899)

SEQ ID NO: 61962 - protein, 632 aa, Ralstonia solanacearum; identical to SEQ ID NO: 988

SEQ ID NO: 61963 - DNA, 1956 bp, Pyrobaculum aerophilum; identical to SEQ ID NO: 989
  CDS (1)..(1956)

SEQ ID NO: 61964 - protein, 651 aa, Pyrobaculum aerophilum; identical to SEQ ID NO: 990

SEQ ID NO: 61965 - DNA, 1881 bp, Pyrobaculum aerophilum; identical to SEQ ID NO: 991
  CDS (1)..(1881)

SEQ ID NO: 61966 - protein, 626 aa, Pyrobaculum aerophilum; identical to SEQ ID NO: 992

SEQ ID NO: 61967 - DNA, 1848 bp, Pyrobaculum aerophilum; identical to SEQ ID NO: 993
  CDS (1)..(1848)

SEQ ID NO: 61968 - protein, 615 aa, Pyrobaculum aerophilum; identical to SEQ ID NO: 994

SEQ ID NO: 61969 - DNA, 1908 bp, Rhizobium meliloti; identical to SEQ ID NO: 995
  CDS (1)..(1908)

SEQ ID NO: 61970 - protein, 635 aa, Rhizobium meliloti; identical to SEQ ID NO: 996

SEQ ID NO: 61971 - DNA, 1647 bp, Rhizobium meliloti; identical to SEQ ID NO: 997
  CDS (1)..(1647)

SEQ ID NO: 61972 - protein, 548 aa, Rhizobium meliloti; identical to SEQ ID NO: 998

SEQ ID NO: 61973 - DNA, 2028 bp, Zygosaccharomyces bailii; identical to SEQ ID NO: 999
  CDS (1)..(2028)

SEQ ID NO: 61974 - protein, 675 aa, Zygosaccharomyces bailii; identical to SEQ ID NO: 1000

SEQ ID NO: 61975 - DNA, 1635 bp, Sulfolobus tokodaii; identical to SEQ ID NO: 1001
  CDS (1)..(1635)

SEQ ID NO: 61976 - protein, 544 aa, Sulfolobus tokodaii; identical to SEQ ID NO: 1002

SEQ ID NO: 61977 - DNA, 1731 bp, Sulfolobus tokodaii; identical to SEQ ID NO: 1003
  CDS (1)..(1731)

SEQ ID NO: 61978 - protein, 576 aa, Sulfolobus tokodaii; identical to SEQ ID NO: 1004

SEQ ID NO: 61979 - DNA, 1986 bp, Sulfolobus tokodaii; identical to SEQ ID NO: 1005
  CDS (1)..(1986)

SEQ ID NO: 61980 - protein, 661 aa, Sulfolobus tokodaii; identical to SEQ ID NO: 1006

SEQ ID NO: 61981 - DNA, 1866 bp, Sulfolobus tokodaii; identical to SEQ ID NO: 1007
  CDS (1)..(1866)

SEQ ID NO: 61982 - protein, 621 aa, Sulfolobus tokodaii; identical to SEQ ID NO: 1008

SEQ ID NO: 61983 - DNA, 1494 bp, Sulfolobus tokodaii; identical to SEQ ID NO: 1009
  CDS (1)..(1494)

SEQ ID NO: 61984 - protein, 497 aa, Sulfolobus tokodaii; identical to SEQ ID NO: 1010

SEQ ID NO: 61985 - DNA, 1980 bp, Sulfolobus tokodaii; identical to SEQ ID NO: 1011
  CDS (1)..(1980)

SEQ ID NO: 61986 - protein, 659 aa, Sulfolobus tokodaii; identical to SEQ ID NO: 1012

SEQ ID NO: 61987 - DNA, 1989 bp, Sulfolobus tokodaii; identical to SEQ ID NO: 1013
  CDS (1)..(1989)

SEQ ID NO: 61988 - protein, 662 aa, Sulfolobus tokodaii; identical to SEQ ID NO: 1014

SEQ ID NO: 61989 - DNA, 1689 bp, Sulfolobus tokodaii; identical to SEQ ID NO: 1015
  CDS (1)..(1689)

SEQ ID NO: 61990 - protein, 562 aa, Sulfolobus tokodaii; identical to SEQ ID NO: 1016

SEQ ID NO: 61991 - DNA, 1860 bp, Thermoplasma volcanium; identical to SEQ ID NO: 1017
  CDS (1)..(1860)

SEQ ID NO: 61992 - protein, 619 aa, Thermoplasma volcanium; identical to SEQ ID NO: 1018

SEQ ID NO: 61993 - DNA, 1926 bp, Thermoplasma volcanium; identical to SEQ ID NO: 1019
  CDS (1)..(1926)

SEQ ID NO: 61994 - protein, 641 aa, Thermoplasma volcanium; identical to SEQ ID NO: 1020

SEQ ID NO: 61995 - DNA, 1953 bp, Thermoplasma volcanium; identical to SEQ ID NO: 1021
  CDS (1)..(1953)

SEQ ID NO: 61996 - protein, 650 aa, Thermoplasma volcanium; identical to SEQ ID NO: 1022

SEQ ID NO: 61997 - DNA, 1959 bp, Rhizobium loti; identical to SEQ ID NO: 1023
  CDS (1)..(1959)

SEQ ID NO: 61998 - protein, 652 aa, Rhizobium loti; identical to SEQ ID NO: 1024

SEQ ID NO: 61999 - DNA, 1689 bp, Rhizobium loti; identical to SEQ ID NO: 1025
  CDS (1)..(1689)

SEQ ID NO: 62000 - protein, 562 aa, Rhizobium loti; identical to SEQ ID NO: 1026

SEQ ID NO: 62001 - DNA, 1929 bp, Rhizobium loti; identical to SEQ ID NO: 1027
  CDS (1)..(1929)

SEQ ID NO: 62002 - protein, 642 aa, Rhizobium loti; identical to SEQ ID NO: 1028

SEQ ID NO: 62003 - DNA, 1680 bp, Rhizobium loti; identical to SEQ ID NO: 1029
  CDS (1)..(1680)

SEQ ID NO: 62004 - protein, 559 aa, Rhizobium loti; identical to SEQ ID NO: 1030

SEQ ID NO: 62005 - DNA, 1686 bp, Pseudomonas putida; identical to SEQ ID NO: 1031
  CDS (1)..(1686)

SEQ ID NO: 62006 - protein, 561 aa, Pseudomonas putida; identical to SEQ ID NO: 1032

SEQ ID NO: 62007 - DNA, 2582 bp, Bos taurus; identical to SEQ ID NO: 1033
  CDS (1)..(2028)

SEQ ID NO: 62008 - protein, 675 aa, Bos taurus; identical to SEQ ID NO: 1034

SEQ ID NO: 62009 - DNA, 1800 bp, Thermoplasma acidophilum; identical to SEQ ID NO: 1035
  CDS (1)..(1800)

SEQ ID NO: 62010 - protein, 599 aa, Thermoplasma acidophilum; identical to SEQ ID NO: 1036

SEQ ID NO: 62011 - DNA, 1944 bp, Thermoplasma acidophilum; identical to SEQ ID NO: 1037
  CDS (1)..(1944)

SEQ ID NO: 62012 - protein, 647 aa, Thermoplasma acidophilum; identical to SEQ ID NO: 1038

SEQ ID NO: 62013 - DNA, 1860 bp, Thermoplasma acidophilum; identical to SEQ ID NO: 1039
  CDS (1)..(1860)

SEQ ID NO: 62014 - protein, 619 aa, Thermoplasma acidophilum; identical to SEQ ID NO: 1040

SEQ ID NO: 62015 - DNA, 1977 bp, Streptomyces coelicolor; identical to SEQ ID NO: 1041
  CDS (1)..(1977)

SEQ ID NO: 62016 - protein, 658 aa, Streptomyces coelicolor; identical to SEQ ID NO: 1042

SEQ ID NO: 62017 - DNA, 2113 bp, Arabidopsis thaliana; identical to SEQ ID NO: 1043
  CDS (1)..(2082)

SEQ ID NO: 62018 - protein, 693 aa, Arabidopsis thaliana; identical to SEQ ID NO: 1044

SEQ ID NO: 62019 - DNA, 2088 bp, Leishmania major; identical to SEQ ID NO: 1045
  CDS (1)..(2088)

SEQ ID NO: 62020 - protein, 695 aa, Leishmania major; identical to SEQ ID NO: 1046

SEQ ID NO: 62021 - DNA, 1956 bp, Tetrahymena pyriformis; identical to SEQ ID NO: 1047
  CDS (1)..(978)

SEQ ID NO: 62022 - protein, 325 aa, Tetrahymena pyriformis; identical to SEQ ID NO: 1048

SEQ ID NO: 62023 - DNA, 2267 bp, Drosophila melanogaster; identical to SEQ ID NO: 1049
  CDS (113)..(2137)

SEQ ID NO: 62024 - protein, 674 aa, Drosophila melanogaster; identical to SEQ ID NO: 1050

SEQ ID NO: 62025 - DNA, 2383 bp, Solanum tuberosum; identical to SEQ ID NO: 1051
  CDS (271)..(2166)

SEQ ID NO: 62026 - protein, 631 aa, Solanum tuberosum; identical to SEQ ID NO: 1052

SEQ ID NO: 62027 - DNA, 3584 bp, Mus musculus; identical to SEQ ID NO: 1053
  CDS (33)..(2081)

SEQ ID NO: 62028 - protein, 682 aa, Mus musculus; identical to SEQ ID NO: 1054

SEQ ID NO: 62029 - DNA, 2052 bp, Kluyveromyces lactis; identical to SEQ ID NO: 1055
  CDS (1)..(2052)

SEQ ID NO: 62030 - protein, 683 aa, Kluyveromyces lactis [sequence omitted]

SEQ ID NO: 62031 - DNA, 2492 bp, Saccharomyces cerevisiae; identical to SEQ ID NO: 1057
  CDS (162)..(2303)

SEQ ID NO: 62032 - protein, 713 aa, Saccharomyces cerevisiae [sequence omitted]

SEQ ID NO: 62033 - DNA, 3543 bp, Kluyveromyces lactis; identical to SEQ ID NO: 1059
  CDS (817)..(2871)

SEQ ID NO: 62034 - protein, 684 aa, Kluyveromyces lactis; identical to SEQ ID NO: 1060

SEQ ID NO: 62035 - DNA, 1935 bp, Pseudomonas putida; identical to SEQ ID NO: 1061
  CDS (1)..(1935)

SEQ ID NO: 62036 - protein, 644 aa, Pseudomonas putida [sequence omitted]

SEQ ID NO: 62037 - DNA, 1950 bp, Rhizobium meliloti; identical to SEQ ID NO: 1063
  CDS (1)..(1950)

SEQ ID NO: 62038 - protein, 649 aa, Rhizobium meliloti [sequence omitted]

SEQ ID NO: 62039 - DNA, 1959 bp, Agrobacterium rhizogenes; identical to SEQ ID NO: 1065
  CDS (1)..(1959)

SEQ ID NO: 62040 - protein, 652 aa, Agrobacterium rhizogenes; identical to SEQ ID NO: 1066

SEQ ID NO: 62041 - DNA, 1956 bp, Agrobacterium tumefaciens; identical to SEQ ID NO: 1067
  CDS (1)..(1956)

SEQ ID NO: 62042 - protein, 651 aa, Agrobacterium tumefaciens; identical to SEQ ID NO: 1068

SEQ ID NO: 62043 - DNA, 1947 bp, Bradyrhizobium japonicum; identical to SEQ ID NO: 1069
  CDS (1)..(1947)

SEQ ID NO: 62044 - protein, 648 aa, Bradyrhizobium japonicum [sequence omitted]

SEQ ID NO: 62045 - DNA, 1956 bp, Brucella suis; identical to SEQ ID NO: 1071
  CDS (1)..(1956)

SEQ ID NO: 62046 - protein, 651 aa, Brucella suis; identical to SEQ ID NO: 1072

SEQ ID NO: 62047 - DNA, 2028 bp, Candida albicans; identical to SEQ ID NO: 1073
  CDS (1)..(2028)

SEQ ID NO: 62048 - protein, 675 aa, Candida albicans [sequence omitted]

SEQ ID NO: 62049 - DNA, 1980 bp, Chlorobium tepidum; identical to SEQ ID NO: 1075
  CDS (1)..(1980)

SEQ ID NO: 62050 - protein, 659 aa, Chlorobium tepidum [sequence omitted]

SEQ ID NO: 62051 - DNA, 2041 bp, Coprinus cinereus; identical to SEQ ID NO: 1077
  CDS (20)..(2005)

SEQ ID NO: 62052 - protein, 661 aa, Coprinus cinereus [sequence omitted]

SEQ ID NO: 62053 - DNA, 2222 bp, Cryptosporidium parvum; identical to SEQ ID NO: 1079
  CDS (70)..(2154)

SEQ ID NO: 62054 - protein, 694 aa, Cryptosporidium parvum [sequence omitted]

SEQ ID NO: 62055 - DNA, 2874 bp, Drosophila melanogaster; identical to SEQ ID NO: 1081
  CDS (451)..(2463)

SEQ ID NO: 62056 - protein, 670 aa, Drosophila melanogaster [sequence omitted]

SEQ ID NO: 62057 - DNA, 1986 bp, Leptospira interrogans; identical to SEQ ID NO: 1083
  CDS (1)..(1986)

SEQ ID NO: 62058 - protein, 661 aa, Leptospira interrogans [sequence omitted]

SEQ ID NO: 62059 - DNA, 2535 bp, Mus musculus; identical to SEQ ID NO: 1085
  CDS (15)..(2120)

SEQ ID NO: 62060 - protein, 701 aa, Mus musculus; identical to SEQ ID NO: 1086

SEQ ID NO: 62061 - DNA, 1956 bp, Mycobacterium bovis; identical to SEQ ID NO: 1087
  CDS (1)..(1956)

SEQ ID NO: 62062 - protein, 651 aa, Mycobacterium bovis [sequence omitted]

SEQ ID NO: 62063 - DNA, 1968 bp, Nitrosomonas europaea; identical to SEQ ID NO: 1089
  CDS (1)..(1968)

SEQ ID NO: 62064 - protein, 655 aa, Nitrosomonas europaea [sequence omitted]

SEQ ID NO: 62065 - DNA, 1962 bp, Pasteurella multocida; identical to SEQ ID NO: 1091
  CDS (1)..(1962)

SEQ ID NO: 62066 - protein, 653 aa, Pasteurella multocida [sequence omitted]

SEQ ID NO: 62067 - DNA, 1926 bp, Gamma; identical to SEQ ID NO: 1093
  CDS (1)..(1926)

SEQ ID NO: 62068 - protein, 641 aa, Gamma [sequence omitted]

SEQ ID NO: 62069 - DNA, 1983 bp, Ralstonia solanacearum; identical to SEQ ID NO: 1095
  CDS (1)..(1983)

SEQ ID NO: 62070 - protein, 660 aa, Ralstonia solanacearum; identical to SEQ ID NO: 1096

SEQ ID NO: 62071 - DNA, 1956 bp, Rhizobium loti; identical to SEQ ID NO: 1097
  CDS (1)..(1956)

SEQ ID NO: 62072 - protein, 651 aa, Rhizobium loti; identical to SEQ ID NO: 1098

SEQ ID NO: 62073 - DNA, 2016 bp, Rhodopirellula baltica; identical to SEQ ID NO: 1099
  CDS (1)..(2016)

SEQ ID NO: 62074 - protein, 671 aa, Rhodopirellula baltica [sequence omitted]

SEQ ID NO: 62075 - DNA, 1959 bp, Salmonella typhimurium; identical to SEQ ID NO: 1101
  CDS (1)..(1959)

SEQ ID NO: 62076 - protein, 652 aa, Salmonella typhimurium; identical to SEQ ID NO: 1102

SEQ ID NO: 62077 - DNA, 1953 bp, Shewanella oneidensis; identical to SEQ ID NO: 1103
  CDS (1)..(1953)

SEQ ID NO: 62078 - protein, 650 aa, Shewanella oneidensis [sequence omitted]

SEQ ID NO: 62079 - DNA, 1959 bp, Streptomyces avermitilis; identical to SEQ ID NO: 1105
  CDS (1)..(1959)

SEQ ID NO: 62080 - protein, 652 aa, Streptomyces avermitilis [sequence omitted]

SEQ ID NO: 62081 - DNA, 1971 bp, Synechococcus elongatus; identical to SEQ ID NO: 1107
  CDS (1)..(1971)

SEQ ID NO: 62082 - protein, 656 aa, Synechococcus elongatus [sequence omitted]

SEQ ID NO: 62083 - DNA, 1950 bp, Vibrio cholerae; identical to SEQ ID NO: 1109
  CDS (1)..(1950)

SEQ ID NO: 62084 - protein, 649 aa, Vibrio cholerae [sequence omitted]

SEQ ID NO: 62085 - DNA, 1953 bp, Vibrio parahaemolyticus; identical to SEQ ID NO: 1111
  CDS (1)..(1953)

SEQ ID NO: 62086 - protein, 650 aa, Vibrio parahaemolyticus; identical to SEQ ID NO: 1112

SEQ ID NO: 62087 - DNA, 1944 bp, Xanthomonas axonopodis; identical to SEQ ID NO: 1113
  CDS (1)..(1944)

SEQ ID NO: 62088 - protein, 647 aa, Xanthomonas axonopodis [sequence omitted]

SEQ ID NO: 62089 - DNA, 1944 bp, Xanthomonas campestris; identical to SEQ ID NO: 1115
  CDS (1)..(1944)

SEQ ID NO: 62090 - protein, 647 aa, Xanthomonas campestris; identical to SEQ ID NO: 1116

SEQ ID NO: 62091 - DNA, 1944 bp, Xylella fastidiosa; identical to SEQ ID NO: 1117
  CDS (1)..(1944)

SEQ ID NO: 62092 - protein, 647 aa, Xylella fastidiosa; identical to SEQ ID NO: 1118

SEQ ID NO: 62093 - DNA, 26 bp, Artificial sequence
  (1)..(26): primer
atgacaatcaaggaacataaagtagt

SEQ ID NO: 62094 - DNA, 28 bp, Artificial sequence
  (1)..(28): primer
ttatttctttttttgagagaaaaattgg

SEQ ID NO: 62095 - protein, 695 aa, Artificial sequence; identical to SEQ ID NO: 59486
  Variant (2)..(7): xaa in position 2 to 7 is any amino acid
  Variant (9)..(29): xaa in position 9 to 29 is any amino acid
  Variant (31)..(54): xaa in position 31 to 54 is any amino acid
  Variant (56)..(65): xaa in position 56 to 65 is any amino acid
  Variant (67)..(74): xaa in position 67 to 74 is any amino acid
  Variant (76)..(78): xaa in position 76 to 78 is any amino acid
  Variant (81)..(81): xaa in position 81 is any amino acid
  Variant (83)..(86): xaa in position 83 to 86 is any amino acid
  Variant (88)..(96): xaa in position 88 to 96 is any amino acid
  Variant (99)..(102): xaa in position 99 to 102 is any amino acid
  Variant (105)..(109): xaa in position 105 to 109 is any amino acid
  Variant (111)..(112): xaa in position 111 to 112 is any amino acid
  Variant (114)..(120): xaa in position 114 to 120 is any amino acid
  Variant (122)..(255): xaa in position 122 to 255 is any amino acid
  Variant (260)..(260): xaa in position 260 is any amino acid
  Variant (263)..(263): xaa in position 263 is any amino acid
  Variant (267)..(306): xaa in position 267 to 306 is any amino acid
  Variant (308)..(308): xaa in position 308 is any amino acid
  Variant (311)..(321): xaa in position 311 to 321 is any amino acid
  Variant (323)..(324): xaa in position 323 to 324 is any amino acid
  Variant (326)..(332): xaa in position 326 to 332 is any amino acid
  Variant (334)..(362): xaa in position 334 to 362 is any amino acid
  Variant (365)..(366): xaa in position 365 to 366 is any amino acid
  Variant (368)..(390): xaa in position 368 to 390 is any amino acid
  Variant (392)..(397): xaa in position 392 to 397 is any amino acid
  Variant (400)..(407): xaa in position 400 to 407 is any amino acid
  Variant (409)..(431): xaa in position 409 to 431 is any amino acid
  Variant (434)..(468): xaa in position 434 to 468 is any amino acid
  Variant (470)..(478): xaa in position 470 to 478 is any amino acid
  Variant (480)..(506): xaa in position 480 to 506 is any amino acid
  Variant (508)..(517): xaa in position 508 to 517 is any amino acid
  Variant (519)..(558): xaa in position 519 to 558 is any amino acid
  Variant (561)..(564): xaa in position 561 to 564 is any amino acid
  Variant (566)..(568): xaa in position 566 to 568 is any amino acid
  Variant (570)..(574): xaa in position 570 to 574 is any amino acid
  Variant (577)..(577): xaa in position 577 is any amino acid
  Variant (580)..(584): xaa in position 580 to 584 is any amino acid
  Variant (586)..(586): xaa in position 586 is any amino acid
  Variant (588)..(591): xaa in position 588 to 591 is any amino acid
  Variant (593)..(593): xaa in position 593 is any amino acid
  Variant (595)..(604): xaa in position 595 to 604 is any amino acid
  Variant (606)..(606): xaa in position 606 is any amino acid
  Variant (608)..(609): xaa in position 608 to 609 is any amino acid
  Variant (611)..(616): xaa in position 611 to 616 is any amino acid
  Variant (618)..(625): xaa in position 618 to 625 is any amino acid
  Variant (627)..(684): xaa in position 627 to 684 is any amino acid
  Variant (689)..(689): xaa in position 689 is any amino acid
  Variant (694)..(694): xaa in position 694 is any amino acid

SEQ ID NO: 62096 - protein, 43 aa, Artificial sequence; identical to SEQ ID NO: 1308
  Variant (1)..(1): xaa in position 1 is Gly, Asn or Asp
  Variant (2)..(2): xaa in position 2 is Asp, Glu or Gln
  Variant (3)..(3): xaa in position 3 is any amino acid
  Variant (4)..(4): xaa in position 4 is Val or Ile
  Variant (5)..(7): xaa in position 5 to 7 is any amino acid
  Variant (8)..(8): xaa in position 8 is Met, Leu, Ile or Ala
  Variant (9)..(18): xaa in position 9 to 18 is any amino acid
  Variant (19)..(19): xaa in position 19 is Leu, Met, Gln, Phe or Tyr
  Variant (20)..(20): xaa in position 20 is Ala, Gly or Ser
  Variant (21)..(23): xaa in position 21 to 23 is any amino acid
  Variant (24)..(24): xaa in position 24 is Ile, Leu, Val or Ala
  Variant (26)..(26): xaa in position 26 is Ala, Gly, Val or no amino acid
  Variant (27)..(34): xaa in position 27 to 34 is any amino acid
  Variant (35)..(35): xaa in position 35 is Phe, Tyr or Leu
  Variant (36)..(39): xaa in position 36 to 39 is any amino acid
  Variant (40)..(40): xaa in position 40 is Leu, Ile or Val
  Variant (41)..(42): xaa in position 41 to 42 is any amino acid
  Variant (43)..(43): xaa in position 43 is Arg or Gln

SEQ ID NO: 62097 - protein, 14 aa, Artificial sequence
  Variant (1)..(1): xaa in position 1 is Ile, Leu, Met or Val
  Variant (2)..(2): xaa in position 2 is any amino acid
  Variant (3)..(3): xaa in position 3 is Tyr, Phe or Ser
  Variant (4)..(4): xaa in position 4 is Thr or Ser
  Variant (7)..(7): xaa in position 7 is Thr or Ser
  Variant (10)..(10): xaa in position 10 is any amino acid
  Variant (11)..(11): xaa in position 11 is Pro, Ala or Ser
  Variant (13)..(13): xaa in position 13 is any amino acid
  Variant (14)..(14): xaa in position 14 is Val, Ile, Leu, Ala or Thr
XXXXSGXTGXXKXX

SEQ ID NO: 62098 - protein, 55 aa, Artificial sequence; identical to SEQ ID NO: 1310
  Variant (1)..(1): xaa in position 1 is Tyr, Trp, Phe, Leu or His
  Variant (2)..(3): xaa in position 2 to 3 is any amino acid
  Variant (4)..(4): xaa in position 4 is Gly, Ala or Phe
  Variant (6)..(12): xaa in position 6 to 12 is any amino acid
  Variant (13)..(13): xaa in position 13 is any or no amino acid
  Variant (14)..(14): xaa in position 14 is Gly, Asp or no amino acid
  Variant (15)..(19): xaa in position 15 to 19 is any amino acid
  Variant (20)..(20): xaa in position 20 is Gly, Ser, Ala or Asp
  Variant (22)..(22): xaa in position 22 is any amino acid
  Variant (23)..(23): xaa in position 23 is Asp or Lys
  Variant (24)..(24): xaa in position 24 is Asp, Glu, Ser, Ala or Thr
  Variant (25)..(25): xaa in position 25 is any amino acid
  Variant (26)..(26): xaa in position 26 is Ile, Leu, Met or Val
  Variant (27)..(29): xaa in position 27 to 29 is any amino acid
  Variant (31)..(31): xaa in position 31 is any amino acid
  Variant (32)..(32): xaa in position 32 is Arg, Lys, Gln or Leu
  Variant (33)..(33): xaa in position 33 is Leu, Ile, Val or Met
  Variant (34)..(36): xaa in position 34 to 36 is any amino acid
  Variant (37)..(37): xaa in position 37 is Glu, Asp, Thr or Ala
  Variant (38)..(38): xaa in position 38 is Ile, Val, Met or Leu
  Variant (39)..(39): xaa in position 39 is Glu, Tyr or Asp
  Variant (40)..(41): xaa in position 40 to 41 is any amino acid
  Variant (42)..(42): xaa in position 42 is Leu, Ile, Val or Met
  Variant (43)..(47): xaa in position 43 to 47 is any amino acid
  Variant (48)..(48): xaa in position 48 is Val or Ile
  Variant (49)..(49): xaa in position 49 is any amino acid
  Variant (50)..(50): xaa in position 50 is Glu or Asp
  Variant (51)..(51): xaa in position 51 is Ala, Cys, Ser, Val or Thr
  Variant (52)..(53): xaa in position 52 to 53 is any amino acid
  Variant (54)..(54): xaa in position 54 is Val, Ile, Leu, Thr or Phe
  Variant (55)..(55): xaa in position 55 is Gly, Ala, Ser or Pro

SEQ ID NO: 62099 - protein, 14 aa, Artificial sequence
  Variant (1)..(1): xaa in position 1 is Leu, Ile or Met
  Variant (3)..(3): xaa in position 3 is Lys, Arg, Met or His
  Variant (4)..(4): xaa in position 4 is Thr or Ser
  Variant (5)..(5): xaa in position 5 is any amino acid
  Variant (6)..(6): xaa in position 6 is Ser, Thr, Asn or Val
  Variant (7)..(7): xaa in position 7 is Gly, Ala or Ser
  Variant (9)..(9): xaa in position 9 is Ile, Val, Leu, Met, Lys or Arg
  Variant (10)..(10): xaa in position 10 is any amino acid
  Variant (11)..(11): xaa in position 11 is Arg or Glu
  Variant (12)..(13): xaa in position 12 to 13 is any amino acid
  Variant (14)..(14): xaa in position 14 is Leu, Ile, Val or Met
XPXXXXXKXXXXXX

SEQ ID NO: 62100 - DNA, 612 bp, Escherichia coli; identical to SEQ ID NO: 15395
  CDS (1)..(612)

SEQ ID NO: 62101 - protein, 203 aa, Escherichia coli; identical to SEQ ID NO: 15396

SEQ ID NO: 62102 - DNA, 558 bp, Mesorhizobium loti MAFF303099; identical to SEQ ID NO: 15397
  CDS (1)..(558): transl_table=11

SEQ ID NO: 62103 - protein, 185 aa, Mesorhizobium loti MAFF303099; identical to SEQ ID NO: 15398

SEQ ID NO: 62104 - DNA, 591 bp, Mesorhizobium loti MAFF303099; identical to SEQ ID NO: 15399
  CDS (1)..(591): transl_table=11

SEQ ID NO: 62105 - protein, 196 aa, Mesorhizobium loti MAFF303099; identical to SEQ ID NO: 15400

SEQ ID NO: 62106 - DNA, 558 bp, Mesorhizobium loti MAFF303099; identical to SEQ ID NO: 15401
  CDS (1)..(558): transl_table=11

SEQ ID NO: 62107 - protein, 185 aa, Mesorhizobium loti MAFF303099; identical to SEQ ID NO: 15402

SEQ ID NO: 62108 - DNA, 579 bp, Vibrio cholerae O1 biovar eltor str. N16961; identical to SEQ ID NO: 15403
  CDS (1)..(579): transl_table=11

SEQ ID NO: 62109 - protein, 192 aa, Vibrio cholerae O1 biovar eltor str. N16961; identical to SEQ ID NO: 15404

SEQ ID NO: 62110 - DNA, 561 bp, Bacillus halodurans C-125; identical to SEQ ID NO: 15405
  CDS (1)..(561): transl_table=11

SEQ ID NO: 62111 - protein, 186 aa, Bacillus halodurans C-125; identical to SEQ ID NO: 15406

SEQ ID NO: 62112 - DNA, 612 bp, Pasteurella multocida subsp. multocida str. Pm70; identical to SEQ ID NO: 15407
  CDS (1)..(612): transl_table=11

SEQ ID NO: 62113 - protein, 203 aa, Pasteurella multocida subsp. multocida str. Pm70; identical to SEQ ID NO: 15408

SEQ ID NO: 62114 - DNA, 771 bp, Lactococcus lactis subsp. lactis Il1403; identical to SEQ ID NO: 15409
  CDS (1)..(771): transl_table=11

SEQ ID NO: 62115 - protein, 256 aa, Lactococcus lactis subsp. lactis Il1403; identical to SEQ ID NO: 15410

SEQ ID NO: 62116 - DNA, 612 bp, Lactococcus lactis subsp. lactis Il1403; identical to SEQ ID NO: 15411
  CDS (1)..(612): transl_table=11

SEQ ID NO: 62117 - protein, 203 aa, Lactococcus lactis subsp. lactis Il1403; identical to SEQ ID NO: 15412

SEQ ID NO: 62118 - DNA, 603 bp, Lactococcus lactis subsp. lactis Il1403; identical to SEQ ID NO: 15413
  CDS (1)..(603): transl_table=11

SEQ ID NO: 62119 - protein, 200 aa, Lactococcus lactis subsp. lactis Il1403; identical to SEQ ID NO: 15414

SEQ ID NO: 62120 - DNA, 612 bp, Lactococcus lactis subsp. lactis Il1403; identical to SEQ ID NO: 15415
  CDS (1)..(612): transl_table=11

SEQ ID NO: 62121 - protein, 203 aa, Lactococcus lactis subsp. lactis Il1403; identical to SEQ ID NO: 15416

SEQ ID NO: 62122 - DNA, 462 bp, Lactococcus lactis subsp. lactis Il1403; identical to SEQ ID NO: 15417
  CDS (1)..(462): transl_table=11

SEQ ID NO: 62123 - protein, 153 aa, Lactococcus lactis subsp. lactis Il1403; identical to SEQ ID NO: 15418

SEQ ID NO: 62124 - DNA, 567 bp, Streptococcus pyogenes M1 GAS; identical to SEQ ID NO: 15419
  CDS (1)..(567): transl_table=11

SEQ ID NO: 62125 - protein, 188 aa, Streptococcus pyogenes M1 GAS; identical to SEQ ID NO: 15420

SEQ ID NO: 62126 - DNA, 513 bp, Neisseria meningitidis Z2491; identical to SEQ ID NO: 15421
  CDS (1)..(513): transl_table=11

SEQ ID NO: 62127 - protein, 170 aa, Neisseria meningitidis Z2491; identical to SEQ ID NO: 15422

SEQ ID NO: 62128 - DNA, 549 bp, Escherichia coli O157:H7; identical to SEQ ID NO: 15423
  CDS (1)..(549): transl_table=11

SEQ ID NO: 62129 - protein, 182 aa, Escherichia coli O157:H7; identical to SEQ ID NO: 15424

SEQ ID NO: 62130 - DNA, 558 bp, Streptococcus pneumoniae TIGR4; identical to SEQ ID NO: 15425
  CDS (1)..(558): transl_table=11

SEQ ID NO: 62131 - protein, 185 aa, Streptococcus pneumoniae TIGR4; identical to SEQ ID NO: 15426

SEQ ID NO: 62132 - DNA, 561 bp, Clostridium acetobutylicum ATCC 824; identical to SEQ ID NO: 15427
  CDS (1)..(561): transl_table=11

SEQ ID NO: 62133 - protein, 186 aa, Clostridium acetobutylicum ATCC 824; identical to SEQ ID NO: 15428

SEQ ID NO: 62134 - DNA, 615 bp, Clostridium acetobutylicum ATCC 824; identical to SEQ ID NO: 15429
  CDS (1)..(615): transl_table=11

SEQ ID NO: 62135 - protein, 204 aa, Clostridium acetobutylicum ATCC 824; identical to SEQ ID NO: 15430

SEQ ID NO: 62136 - DNA, 600 bp, Staphylococcus aureus subsp. aureus Mu50; identical to SEQ ID NO: 15431
  CDS (1)..(600): transl_table=11

SEQ ID NO: 62137 - protein, 199 aa, Staphylococcus aureus subsp. aureus Mu50; identical to SEQ ID NO: 15432

SEQ ID NO: 62138 - DNA, 552 bp, Escherichia coli K12; identical to SEQ ID NO: 15433
  CDS (1)..(552): transl_table=11

SEQ ID NO: 62139 - protein, 183 aa, Escherichia coli K12; identical to SEQ ID NO: 15434

SEQ ID NO: 62140 - DNA, 615 bp, Sinorhizobium meliloti 1021; identical to SEQ ID NO: 15435
  CDS (1)..(615): transl_table=11

SEQ ID NO: 62141 - protein, 204 aa, Sinorhizobium meliloti 1021; identical to SEQ ID NO: 15436

SEQ ID NO: 62142 - DNA, 552 bp, Salmonella typhimurium LT2; identical to SEQ ID NO: 15437
  CDS (1)..(552): transl_table=11

SEQ ID NO: 62143 - protein, 183 aa, Salmonella typhimurium LT2; identical to SEQ ID NO: 15438

SEQ ID NO: 62144 - DNA, 564 bp, Listeria monocytogenes EGD-e; identical to SEQ ID NO: 15439
  CDS (1)..(564): transl_table=11

SEQ ID NO: 62145 - protein, 187 aa, Listeria monocytogenes EGD-e; identical to SEQ ID NO: 15440

SEQ ID NO: 62146 - DNA, 570 bp, Listeria innocua Clip11262; identical to SEQ ID NO: 15441
  CDS (1)..(570): transl_table=11

SEQ ID NO: 62147 - protein, 189 aa, Listeria innocua Clip11262; identical to SEQ ID NO: 15442

SEQ ID NO: 62148 - DNA, 564 bp, Listeria innocua Clip11262; identical to SEQ ID NO: 15443
  CDS (1)..(564): transl_table=11

SEQ ID NO: 62149 - protein, 187 aa, Listeria innocua Clip11262; identical to SEQ ID NO: 15444

SEQ ID NO: 62150 - DNA, 579 bp, Nostoc sp. PCC 7120; identical to SEQ ID NO: 15445
  CDS (1)..(579): transl_table=11

SEQ ID NO: 62151 - protein, 192 aa, Nostoc sp. PCC 7120; identical to SEQ ID NO: 15446

SEQ ID NO: 62152 - DNA, 828 bp, Nostoc sp. PCC 7120; identical to SEQ ID NO: 15447
  CDS (1)..(828): transl_table=11

SEQ ID NO: 62153 - protein, 275 aa, Nostoc sp. PCC 7120; identical to SEQ ID NO: 15448

SEQ ID NO: 62154 - DNA, 513 bp, Ralstonia solanacearum GMI1000; identical to SEQ ID NO: 15449
  CDS (1)..(513): transl_table=11

SEQ ID NO: 62155 - protein, 170 aa, Ralstonia solanacearum GMI1000; identical to SEQ ID NO: 15450

SEQ ID NO: 62156 - DNA, 618 bp, Agrobacterium tumefaciens str. C58; identical to SEQ ID NO: 15451
  CDS (1)..(618): transl_table=11

SEQ ID NO: 62157 - protein, 205 aa, Agrobacterium tumefaciens str. C58; identical to SEQ ID NO: 15452

SEQ ID NO: 62158 - DNA, 561 bp, Agrobacterium tumefaciens str. C58; identical to SEQ ID NO: 15453
  CDS (1)..(561): transl_table=11

SEQ ID NO: 62159 - protein, 186 aa, Agrobacterium tumefaciens str. C58; identical to SEQ ID NO: 15454

SEQ ID NO: 62160 - DNA, 633 bp, Agrobacterium tumefaciens str. C58; identical to SEQ ID NO: 15455
  CDS (1)..(633): transl_table=11

SEQ ID NO: 62161 - protein, 210 aa, Agrobacterium tumefaciens str. C58; identical to SEQ ID NO: 15456

SEQ ID NO: 62162 - DNA, 687 bp, Brucella melitensis 16M; identical to SEQ ID NO: 15457
  CDS (1)..(687): transl_table=11

SEQ ID NO: 62163 - protein, 228 aa, Brucella melitensis 16M; identical to SEQ ID NO: 15458

SEQ ID NO: 62164 - DNA, 681 bp, Pyrobaculum aerophilum str. IM2; identical to SEQ ID NO: 15459
  CDS (1)..(681): transl_table=11

SEQ ID NO: 62165 - protein, 226 aa, Pyrobaculum aerophilum str. IM2; identical to SEQ ID NO: 15460

SEQ ID NO: 62166 - DNA, 585 bp, Clostridium perfringens str. 13; identical to SEQ ID NO: 15461
  CDS (1)..(585): transl_table=11

SEQ ID NO: 62167 - protein, 194 aa, Clostridium perfringens str. 13; identical to SEQ ID NO: 15462

SEQ ID NO: 62168 - DNA, 501 bp, Pyrococcus furiosus DSM 3638; identical to SEQ ID NO: 15463
  CDS (1)..(501): transl_table=11

SEQ ID NO: 62169 - protein, 166 aa, Pyrococcus furiosus DSM 3638; identical to SEQ ID NO: 15464

SEQ ID NO: 62170 - DNA, 687 bp, Corynebacterium glutamicum ATCC 13032; identical to SEQ ID NO: 15465
  CDS (1)..(687): transl_table=11

SEQ ID NO: 62171 - protein, 228 aa, Corynebacterium glutamicum ATCC 13032; identical to SEQ ID NO: 15466

SEQ ID NO: 62172 - DNA, 576 bp, Methanosarcina acetivorans C2A; identical to SEQ ID NO: 15467
  CDS (1)..(576): transl_table=11

SEQ ID NO: 62173 - protein, 191 aa, Methanosarcina acetivorans C2A; identical to SEQ ID NO: 15468

SEQ ID NO: 62174 - DNA, 600 bp, Methanosarcina acetivorans C2A; identical to SEQ ID NO: 15469
  CDS (1)..(600): transl_table=11

SEQ ID NO: 62175 - protein, 199 aa, Methanosarcina acetivorans C2A; identical to SEQ ID NO: 15470

SEQ ID NO: 62176 - DNA, 525 bp, Methanosarcina acetivorans C2A; identical to SEQ ID NO: 15471
  CDS (1)..(525): transl_table=11

SEQ ID NO: 62177 - protein, 174 aa, Methanosarcina acetivorans C2A; identical to SEQ ID NO: 15472

SEQ ID NO: 62178 - DNA, 555 bp, Methanosarcina acetivorans C2A; identical to SEQ ID NO: 15473
  CDS (1)..(555): transl_table=11

SEQ ID NO: 62179 - protein, 184 aa, Methanosarcina acetivorans C2A; identical to SEQ ID NO: 15474

SEQ ID NO: 62180 - DNA, 663 bp, Thermoanaerobacter tengcongensis MB4; identical to SEQ ID NO: 15475
  CDS (1)..(663): transl_table=11

SEQ ID NO: 62181 - protein, 220 aa, Thermoanaerobacter tengcongensis MB4; identical to SEQ ID NO: 15476

SEQ ID NO: 62182 - DNA, 528 bp, Streptomyces coelicolor A3(2); identical to SEQ ID NO: 15477
  CDS (1)..(528)

SEQ ID NO: 62183 - protein, 175 aa, Streptomyces coelicolor A3(2); identical to SEQ ID NO: 15478

SEQ ID NO: 62184 - DNA, 804 bp, Streptomyces coelicolor A3(2); identical to SEQ ID NO: 15479
  CDS (1)..(804)

SEQ ID NO: 62185 - protein, 267 aa, Streptomyces coelicolor A3(2); identical to SEQ ID NO: 15480

SEQ ID NO: 62186 - DNA, 582 bp, Streptomyces coelicolor A3(2); identical to SEQ ID NO: 15481
  CDS (1)..(582)

SEQ ID NO: 62187 - protein, 193 aa, Streptomyces coelicolor A3(2); identical to SEQ ID NO: 15482

SEQ ID NO: 62188 - DNA, 564 bp, Methanosarcina mazei Go1; identical to SEQ ID NO: 15483
  CDS (1)..(564): transl_table=11

SEQ ID NO: 62189 - protein, 187 aa, Methanosarcina mazei Go1; identical to SEQ ID NO: 15484

SEQ ID NO: 62190 - DNA, 702 bp, Methanosarcina mazei Go1; identical to SEQ ID NO: 15485
  CDS (1)..(702): transl_table=11

SEQ ID NO: 62191 - protein, 233 aa, Methanosarcina mazei Go1; identical to SEQ ID NO: 15486

SEQ ID NO: 62192 - DNA, 579 bp, Xanthomonas campestris pv. campestris str. ATCC 33913; identical to SEQ ID NO: 15487
  CDS (1)..(579): transl_table=11

SEQ ID NO: 62193 - protein, 192 aa, Xanthomonas campestris pv. campestris str. ATCC 33913; identical to SEQ ID NO: 15488

SEQ ID NO: 62194 - DNA, 579 bp, Xanthomonas axonopodis pv. citri str. 306; identical to SEQ ID NO: 15489
  CDS (1)..(579): transl_table=11

SEQ ID NO: 62195 - protein, 192 aa, Xanthomonas axonopodis pv. citri str. 306; identical to SEQ ID NO: 15490

SEQ ID NO: 62196 - DNA, 639 bp, Streptococcus agalactiae 2603V/R; identical to SEQ ID NO: 15491
  CDS (1)..(639): transl_table=11

SEQ ID NO: 62197 - protein, 212 aa, Streptococcus agalactiae 2603V/R; identical to SEQ ID NO: 15492

SEQ ID NO: 62198 - DNA, 549 bp, Streptococcus agalactiae 2603V/R; identical to SEQ ID NO: 15493
  CDS (1)..(549): transl_table=11

SEQ ID NO: 62199 - protein, 182 aa, Streptococcus agalactiae 2603V/R; identical to SEQ ID NO: 15494

SEQ ID NO: 62200 - DNA, 540 bp, Oceanobacillus iheyensis HTE831; identical to SEQ ID NO: 15495
  CDS (1)..(540): transl_table=11

SEQ ID NO: 62201 - protein, 179 aa, Oceanobacillus iheyensis HTE831; identical to SEQ ID NO: 15496

SEQ ID NO: 62202 - DNA, 675 bp, Bifidobacterium longum NCC2705; identical to SEQ ID NO: 15497
  CDS (1)..(675): transl_table=11

SEQ ID NO: 62203 - protein, 224 aa, Bifidobacterium longum NCC2705; identical to SEQ ID NO: 15498

SEQ ID NO: 62204 - DNA, 678 bp, Bifidobacterium longum NCC2705; identical to SEQ ID NO: 15499
  CDS (1)..(678): transl_table=11

SEQ ID NO: 62205 - protein, 225 aa, Bifidobacterium longum NCC2705; identical to SEQ ID NO: 15500

SEQ ID NO: 62206 - DNA, 597 bp, Leptospira interrogans serovar Lai str. 56601; identical to SEQ ID NO: 15501
  CDS (1)..(597): transl_table=11

SEQ ID NO: 62207 - protein, 198 aa, Leptospira interrogans serovar Lai str. 56601; identical to SEQ ID NO: 15502

SEQ ID NO: 62208 - DNA, 579 bp, Shewanella oneidensis MR-1; identical to SEQ ID NO: 15503
  CDS (1)..(579): transl_table=11

SEQ ID NO: 62209 - protein, 192 aa, Shewanella oneidensis MR-1; identical to SEQ ID NO: 15504

SEQ ID NO: 62210 - DNA, 630 bp, Shewanella oneidensis MR-1; identical to SEQ ID NO: 15505
  CDS (1)..(630): transl_table=11

SEQ ID NO: 62211 - protein, 209 aa, Shewanella oneidensis MR-1; identical to SEQ ID NO: 15506

SEQ ID NO: 62212 - DNA, 699 bp, Streptococcus mutans UA159; identical to SEQ ID NO: 15507
  CDS (1)..(699): transl_table=11

SEQ ID NO: 62213 - protein, 232 aa, Streptococcus mutans UA159; identical to SEQ ID NO: 15508

SEQ ID NO: 62214 - DNA, 648 bp, Streptomyces coelicolor A3(2); identical to SEQ ID NO: 15509
  CDS (1)..(648)

SEQ ID NO: 62215 - protein, 215 aa, Streptomyces coelicolor A3(2); identical to SEQ ID NO: 15510

SEQ ID NO: 62216 - DNA, 567 bp, Pseudomonas putida KT2440; identical to SEQ ID NO: 15511
  CDS (1)..(567): transl_table=11

SEQ ID NO: 62217 - protein, 188 aa, Pseudomonas putida KT2440; identical to SEQ ID NO: 15512

SEQ ID NO: 62218 - DNA, 552 bp, Escherichia coli CFT073; identical to SEQ ID NO: 15513
  CDS (1)..(552): transl_table=11

SEQ ID NO: 62219 - protein, 183 aa, Escherichia coli CFT073; identical to SEQ ID NO: 15514

SEQ ID NO: 62220 - DNA, 549 bp, Escherichia coli CFT073; identical to SEQ ID NO: 15515
  CDS (1)..(549): transl_table=11

SEQ ID NO: 62221 - protein, 182 aa, Escherichia coli CFT073; identical to SEQ ID NO: 15516

SEQ ID NO: 62222 - DNA, 588 bp, Mycoplasma penetrans HF-2; identical to SEQ ID NO: 15517
  CDS (1)..(588): transl_table=4

SEQ ID NO: 62223 - protein, 195 aa, Mycoplasma penetrans HF-2; identical to SEQ ID NO: 15518

SEQ ID NO: 62224 - DNA, 771 bp, Vibrio vulnificus CMCP6; identical to SEQ ID NO: 15519
  CDS (1)..(771): transl_table=11

SEQ ID NO: 62225 - protein, 256 aa, Vibrio vulnificus CMCP6; identical to SEQ ID NO: 15520

SEQ ID NO: 62226 - DNA, 594 bp, Vibrio vulnificus CMCP6; identical to SEQ ID NO: 15521
  CDS (1)..(594): transl_table=11

SEQ ID NO: 62227 - protein, 197 aa, Vibrio vulnificus CMCP6; identical to SEQ ID NO: 15522

SEQ ID NO: 62228 - DNA, 549 bp, Vibrio vulnificus CMCP6; identical to SEQ ID NO: 15523
  CDS (1)..(549): transl_table=11

SEQ ID NO: 62229 - protein, 182 aa, Vibrio vulnificus CMCP6; identical to SEQ ID NO: 15524

SEQ ID NO: 62230 - DNA, 621 bp, Bradyrhizobium japonicum USDA 110; identical to SEQ ID NO: 15525
  CDS (1)..(621)

SEQ ID NO: 62231 - protein, 206 aa, Bradyrhizobium japonicum USDA 110; identical to SEQ ID NO: 15526

SEQ ID NO: 62232 - DNA, 564 bp, Clostridium tetani E88; identical to SEQ ID NO: 15527
  CDS (1)..(564): transl_table=11

SEQ ID NO: 62233 - protein, 187 aa, Clostridium tetani E88; identical to SEQ ID NO: 15528

SEQ ID NO: 62234 - DNA, 618 bp, Lactobacillus plantarum WCFS1; identical to SEQ ID NO: 15529
  CDS (1)..(618): transl_table=11

SEQ ID NO: 62235 - protein, 205 aa, Lactobacillus plantarum WCFS1; identical to SEQ ID NO: 15530

SEQ ID NO: 62236 - DNA, 609 bp, Lactobacillus plantarum WCFS1; identical to SEQ ID NO: 15531
  CDS (1)..(609): transl_table=11

SEQ ID NO: 62237 - protein, 202 aa, Lactobacillus plantarum WCFS1; identical to SEQ ID NO: 15532

SEQ ID NO: 62238 - DNA, 555 bp, Lactobacillus plantarum WCFS1; identical to SEQ ID NO: 15533
  CDS (1)..(555): transl_table=11

SEQ ID NO: 62239 - protein, 184 aa, Lactobacillus plantarum WCFS1; identical to SEQ ID NO: 15534

SEQ ID NO: 62240 - DNA, 603 bp, Lactobacillus plantarum WCFS1; identical to SEQ ID NO: 15535
  CDS (1)..(603): transl_table=11

SEQ ID NO: 62241 - protein, 200 aa, Lactobacillus plantarum WCFS1; identical to SEQ ID NO: 15536

SEQ ID NO: 62242 - DNA, 621 bp, Lactobacillus plantarum WCFS1; identical to SEQ ID NO: 15537
  CDS (1)..(621): transl_table=11

SEQ ID NO: 62243 - protein, 206 aa, Lactobacillus plantarum WCFS1; identical to SEQ ID NO: 15538

SEQ ID NO: 62244 - DNA, 570 bp, Lactobacillus plantarum WCFS1; identical to SEQ ID NO: 15539
  CDS (1)..(570): transl_table=11

SEQ ID NO: 62245 - protein, 189 aa, Lactobacillus plantarum WCFS1; identical to SEQ ID NO: 15540

SEQ ID NO: 62246 - DNA, 561 bp, Lactobacillus plantarum WCFS1; identical to SEQ ID NO: 15541
  CDS (1)..(561): transl_table=11

SEQ ID NO: 62247 - protein, 186 aa, Lactobacillus plantarum WCFS1; identical to SEQ ID NO: 15542

SEQ ID NO: 62248 - DNA, 555 bp, Vibrio parahaemolyticus RIMD 2210633; identical to SEQ ID NO: 15543
  CDS (1)..(555): transl_table=11

SEQ ID NO: 62249 - protein, 184 aa, Vibrio parahaemolyticus RIMD 2210633; identical to SEQ ID NO: 15544

SEQ ID NO: 62250 - DNA, 549 bp, Vibrio parahaemolyticus RIMD 2210633; identical to SEQ ID NO: 15545
  CDS (1)..(549): transl_table=11

SEQ ID NO: 62251 - protein, 182 aa, Vibrio parahaemolyticus RIMD 2210633; identical to SEQ ID NO: 15546

SEQ ID NO: 62252 - DNA, 552 bp, Salmonella enterica subsp. enterica serovar Typhi Ty2; identical to SEQ ID NO: 15547
  CDS (1)..(552): transl_table=11

SEQ ID NO: 62253 - protein, 183 aa, Salmonella enterica subsp. enterica serovar Typhi Ty2; identical to SEQ ID NO: 15548

SEQ ID NO: 62254 - DNA, 759 bp, Bacteroides thetaiotaomicron VPI-5482; identical to SEQ ID NO: 15549
  CDS (1)..(759): transl_table=11

SEQ ID NO: 62255 - protein, 252 aa, Bacteroides thetaiotaomicron VPI-5482; identical to SEQ ID NO: 15550

SEQ ID NO: 62256 - DNA, 624 bp, Bacteroides thetaiotaomicron VPI-5482; identical to SEQ ID NO: 15551
  CDS (1)..(624): transl_table=11

SEQ ID NO: 62257 - protein, 207 aa, Bacteroides thetaiotaomicron VPI-5482; identical to SEQ ID NO: 15552

SEQ ID NO: 62258 - DNA, 564 bp, Bacteroides thetaiotaomicron VPI-5482; identical to SEQ ID NO: 15553
  CDS (1)..(564): transl_table=11

SEQ ID NO: 62259 - protein, 187 aa, Bacteroides thetaiotaomicron VPI-5482; identical to SEQ ID NO: 15554

SEQ ID NO: 62260 - DNA, 606 bp, Bacteroides thetaiotaomicron VPI-5482; identical to SEQ ID NO: 15555
  CDS (1)..(606): transl_table=11

SEQ ID NO: 62261 - protein, 201 aa, Bacteroides thetaiotaomicron VPI-5482; identical to SEQ ID NO: 15556

SEQ ID NO: 62262 - DNA, 552 bp, Bacteroides thetaiotaomicron VPI-5482; identical to SEQ ID NO: 15557
  CDS (1)..(552): transl_table=11

SEQ ID NO: 62263 - protein, 183 aa, Bacteroides thetaiotaomicron VPI-5482; identical to SEQ ID NO: 15558

SEQ ID NO: 62264 - DNA, 846 bp, Enterococcus faecalis V583; identical to SEQ ID NO: 15559
  CDS (1)..(846): transl_table=11

SEQ ID NO: 62265 - protein, 281 aa, Enterococcus faecalis V583; identical to SEQ ID NO: 15560

SEQ ID NO: 62266 - DNA, 639 bp, Enterococcus faecalis V583; identical to SEQ ID NO: 15561
  CDS (1)..(639): transl_table=11

SEQ ID NO: 62267 - protein, 212 aa, Enterococcus faecalis V583; identical to SEQ ID NO: 15562

SEQ ID NO: 62268 - DNA, 582 bp, Enterococcus faecalis V583; identical to SEQ ID NO: 15563
  CDS (1)..(582): transl_table=11

SEQ ID NO: 62269 - protein, 193 aa, Enterococcus faecalis V583; identical to SEQ ID NO: 15564

SEQ ID NO: 62270 - DNA, 723 bp, Bacillus cereus ATCC 14579; identical to SEQ ID NO: 15565
  CDS (1)..(723): transl_table=11

SEQ ID NO: 62271 - protein, 240 aa, Bacillus cereus ATCC 14579; identical to SEQ ID NO: 15566

SEQ ID NO: 62272 - DNA, 561 bp, Bacillus cereus ATCC 14579; identical to SEQ ID NO: 15567
  CDS (1)..(561): transl_table=11

SEQ ID NO: 62273 - protein, 186 aa, Bacillus cereus ATCC 14579; identical to SEQ ID NO: 15568

SEQ ID NO: 62274 - DNA, 666 bp, Bacillus anthracis str. Ames; identical to SEQ ID NO: 15569
  CDS (1)..(666): transl_table=11

SEQ ID NO: 62275 - protein, 221 aa, Bacillus anthracis str. Ames; identical to SEQ ID NO: 15570

SEQ ID NO: 62276 - DNA, 564 bp, Bacillus anthracis str. Ames; identical to SEQ ID NO: 15571
  CDS (1)..(564): transl_table=11

SEQ ID NO: 62277 - protein, 187 aa, Bacillus anthracis str. Ames; identical to SEQ ID NO: 15572

SEQ ID NO: 62278 - DNA, 723 bp, Bacillus anthracis str. Ames; identical to SEQ ID NO: 15573
  CDS (1)..(723): transl_table=11

SEQ ID NO: 62279 - protein, 240 aa, Bacillus anthracis str. Ames; identical to SEQ ID NO: 15574

SEQ ID NO: 62280 - DNA, 618 bp, Helicobacter hepaticus ATCC 51449; identical to SEQ ID NO: 15575
  CDS (1)..(618): transl_table=11

SEQ ID NO: 62281 - protein, 205 aa, Helicobacter hepaticus ATCC 51449; identical to SEQ ID NO: 15576

SEQ ID NO: 62282 - DNA, 555 bp, Rhodopirellula baltica SH 1; identical to SEQ ID NO: 15577
  CDS (1)..(555): transl_table=11

SEQ ID NO: 62283 - protein, 184 aa, Rhodopirellula baltica SH 1; identical to SEQ ID NO: 15578

SEQ ID NO: 62284 - DNA, 522 bp, Chromobacterium violaceum ATCC 12472; identical to SEQ ID NO: 15579
  CDS (1)..(522): transl_table=11

SEQ ID NO: 62285 - protein, 173 aa, Chromobacterium violaceum ATCC 12472; identical to SEQ ID NO: 15580

SEQ ID NO: 62286 - DNA, 561 bp, Gloeobacter violaceus PCC 7421; identical to SEQ ID NO: 15581
  CDS (1)..(561): transl_table=11

SEQ ID NO: 62287 - protein, 186 aa, Gloeobacter violaceus PCC 7421; identical to SEQ ID NO: 15582

SEQ ID NO: 62288 - DNA, 771 bp, Vibrio vulnificus YJ016; identical to SEQ ID NO: 15583
  CDS (1)..(771): transl_table=11

SEQ ID NO: 62289 - protein, 256 aa, Vibrio vulnificus YJ016; identical to SEQ ID NO: 15584

SEQ ID NO: 62290 - DNA, 558 bp, Vibrio vulnificus YJ016; identical to SEQ ID NO: 15585
  CDS (1)..(558): transl_table=11

SEQ ID NO: 62291 - protein, 185 aa, Vibrio vulnificus YJ016; identical to SEQ ID NO: 15586

SEQ ID NO: 62292 - DNA, 657 bp, Vibrio vulnificus YJ016; identical to SEQ ID NO: 15587
  CDS (1)..(657): transl_table=11

SEQ ID NO: 62293 - protein, 218 aa, Vibrio vulnificus YJ016; identical to SEQ ID NO: 15588

SEQ ID NO: 62294 - DNA, 621 bp, Vibrio vulnificus YJ016; identical to SEQ ID NO: 15589
  CDS (1)..(621): transl_table=11

SEQ ID NO: 62295 - protein, 206 aa, Vibrio vulnificus YJ016; identical to SEQ ID NO: 15590

SEQ ID NO: 62296 - DNA, 570 bp, Corynebacterium diphtheriae NCTC 13129; identical to SEQ ID NO: 15591
  CDS (1)..(570): transl_table=11

SEQ ID NO: 62297 - protein, 189 aa, Corynebacterium diphtheriae NCTC 13129; identical to SEQ ID NO: 15592

SEQ ID NO: 62298 - DNA, 573 bp, Rhodopseudomonas palustris CGA009; identical to SEQ ID NO: 15593
  CDS (1)..(573): transl_table=11

SEQ ID NO: 62299 - protein, 190 aa, Rhodopseudomonas palustris CGA009; identical to SEQ ID NO: 15594

SEQ ID NO: 62300 - DNA, 615 bp, Lactobacillus johnsonii NCC 533; identical to SEQ ID NO: 15595
  CDS (1)..(615): transl_table=11

SEQ ID NO: 62301 - protein, 204 aa, Lactobacillus johnsonii NCC 533; identical to SEQ ID NO: 15596

SEQ ID NO: 62302 - DNA, 564 bp, Bacillus cereus ATCC 10987; identical to SEQ ID NO: 15597
  CDS (1)..(564): transl_table=11

SEQ ID NO: 62303 - protein, 187 aa, Bacillus cereus ATCC 10987; identical to SEQ ID NO: 15598

SEQ ID NO: 62304 - DNA, 2154 bp, Neurospora crassa; identical to SEQ ID NO: 15599
  CDS (1)..(2154)

SEQ ID NO: 62305 - protein, 717 aa, Neurospora crassa; identical to SEQ ID NO: 15600

SEQ ID NO: 62306 - DNA, 660 bp, Magnaporthe grisea 70-15; identical to SEQ ID NO: 15601
  CDS (1)..(660)

SEQ ID NO: 62307 - protein, 219 aa, Magnaporthe grisea 70-15; identical to SEQ ID NO: 15602

SEQ ID NO: 62308 - DNA, 699 bp, Gibberella zeae PH-1; identical to SEQ ID NO: 15603
  CDS (1)..(699)

SEQ ID NO: 62309 - protein, 232 aa, Gibberella zeae PH-1; identical to SEQ ID NO: 15604

SEQ ID NO: 62310 - DNA, 699 bp, Gibberella zeae PH-1; identical to SEQ ID NO: 15605
  CDS (1)..(699)

SEQ ID NO: 62311 - protein, 232 aa, Gibberella zeae PH-1; identical to SEQ ID NO: 15606

SEQ ID NO: 62312 - DNA, 690 bp, Ustilago maydis 521; identical to SEQ ID NO: 15607
  CDS (1)..(690)

SEQ ID NO: 62313 - protein, 229 aa, Ustilago maydis 521; identical to SEQ ID NO: 15608

SEQ ID NO: 62314 - DNA, 702 bp, Aspergillus nidulans FGSC A4; identical to SEQ ID NO: 15609
  CDS (1)..(702)

SEQ ID NO: 62315 - protein, 233 aa, Aspergillus nidulans FGSC A4; identical to SEQ ID NO: 15610

SEQ ID NO: 62316 - DNA, 618 bp, Aspergillus nidulans FGSC A4; identical to SEQ ID NO: 15611
  CDS (1)..(618)

SEQ ID NO: 62317 - protein, 205 aa, Aspergillus nidulans FGSC A4; identical to SEQ ID NO: 15612

SEQ ID NO: 62318 - DNA, 573 bp, Candida glabrata CBS138; identical to SEQ ID NO: 15613
  CDS (1)..(573)

SEQ ID NO: 62319 - protein, 190 aa, Candida glabrata CBS138; identical to SEQ ID NO: 15614

SEQ ID NO: 62320 - DNA, 570 bp, Kluyveromyces lactis NRRL Y-1140; identical to SEQ ID NO: 15615
  CDS (1)..(570)

SEQ ID NO: 62321 - protein, 189 aa, Kluyveromyces lactis NRRL Y-1140; identical to SEQ ID NO: 15616

SEQ ID NO: 62322 - DNA, 693 bp, Debaryomyces hansenii CBS767; identical to SEQ ID NO: 15617
  CDS (1)..(693)

SEQ ID NO: 62323 - protein, 230 aa, Debaryomyces hansenii CBS767; identical to SEQ ID NO: 15618

SEQ ID NO: 62324 - DNA, 690 bp, Debaryomyces hansenii CBS767; identical to SEQ ID NO: 15619
  CDS (1)..(690)

SEQ ID NO: 62325 - protein, 229 aa, Debaryomyces hansenii CBS767; identical to SEQ ID NO: 15620

SEQ ID NO: 62326 - DNA, 666 bp, Yarrowia lipolytica CLIB99; identical to SEQ ID NO: 15621
  CDS (1)..(666)

SEQ ID NO: 62327 - protein, 221 aa, Yarrowia lipolytica CLIB99; identical to SEQ ID NO: 15622

SEQ ID NO: 62328 - DNA, 840 bp, Yarrowia lipolytica CLIB99; identical to SEQ ID NO: 15623
  CDS (1)..(840)

SEQ ID NO: 62329 - protein, 279 aa, Yarrowia lipolytica CLIB99; identical to SEQ ID NO: 15624

SEQ ID NO: 62330 - DNA, 642 bp, Cryptococcus neoformans var. neoformans JEC21; identical to SEQ ID NO: 15625
  CDS (1)..(642)

SEQ ID NO: 62331 - protein, 213 aa, Cryptococcus neoformans var. neoformans JEC21; identical to SEQ ID NO: 15626

SEQ ID NO: 62332 - DNA, 546 bp, Dictyostelium discoideum; identical to SEQ ID NO: 15627
  CDS (1)..(546)

SEQ ID NO: 62333 - protein, 181 aa, Dictyostelium discoideum; identical to SEQ ID NO: 15628

SEQ ID NO: 62334 - DNA, 576 bp, Dictyostelium discoideum; identical to SEQ ID NO: 15629
  CDS (1)..(576)

SEQ ID NO: 62335 - protein, 191 aa, Dictyostelium discoideum; identical to SEQ ID NO: 15630

SEQ ID NO: 62336 - DNA, 591 bp, Dictyostelium discoideum; identical to SEQ ID NO: 15631
  CDS (1)..(591)

SEQ ID NO: 62337 - protein, 196 aa, Dictyostelium discoideum; identical to SEQ ID NO: 15632

SEQ ID NO: 62338 - DNA, 573 bp, Dictyostelium discoideum; identical to SEQ ID NO: 15633
  CDS (1)..(573)

SEQ ID NO: 62339 - protein, 190 aa, Dictyostelium discoideum; identical to SEQ ID NO: 15634

SEQ ID NO: 62340 - DNA, 459 bp, Entamoeba histolytica HM-1:IMSS; identical to SEQ ID NO: 15635
  CDS (1)..(459)

SEQ ID NO: 62341 - protein, 152 aa, Entamoeba histolytica HM-1:IMSS; identical to SEQ ID NO: 15636

SEQ ID NO: 62342 - DNA, 609 bp, Entamoeba histolytica HM-1:IMSS; identical to SEQ ID NO: 15637
  CDS (1)..(609)

SEQ ID NO: 62343 - protein, 202 aa, Entamoeba histolytica HM-1:IMSS; identical to SEQ ID NO: 15638

SEQ ID NO: 62344 - DNA, 609 bp, Entamoeba histolytica HM-1:IMSS; identical to SEQ ID NO: 15639
  CDS (1)..(609)

SEQ ID NO: 62345 - protein, 202 aa, Entamoeba histolytica HM-1:IMSS; identical to SEQ ID NO: 15640

SEQ ID NO: 62346 - DNA, 549 bp, Entamoeba histolytica HM-1:IMSS; identical to SEQ ID NO: 15641
  CDS (1)..(549)

SEQ ID NO: 62347 - protein, 182 aa, Entamoeba histolytica HM-1:IMSS; identical to SEQ ID NO: 15642

SEQ ID NO: 62348 - DNA, 612 bp, Entamoeba histolytica HM-1:IMSS; identical to SEQ ID NO: 15643
  CDS (1)..(612)

SEQ ID NO: 62349 - protein, 203 aa, Entamoeba histolytica HM-1:IMSS; identical to SEQ ID NO: 15644

SEQ ID NO: 62350 - DNA, 615 bp, Entamoeba histolytica HM-1:IMSS; identical to SEQ ID NO: 15645
  CDS (1)..(615)

SEQ ID NO: 62351 - protein, 204 aa, Entamoeba histolytica HM-1:IMSS; identical to SEQ ID NO: 15646

SEQ ID NO: 62352 - DNA, 924 bp, Candida albicans SC5314; identical to SEQ ID NO: 15647
  CDS (1)..(924): transl_table=12

SEQ ID NO: 62353 - protein, 307 aa, Candida albicans SC5314; identical to SEQ ID NO: 15648

SEQ ID NO: 62354 - DNA, 888 bp, Thermus thermophilus HB27; identical to SEQ ID NO: 15649
  CDS (1)..(888): transl_table=11

SEQ ID NO: 62355 - protein, 295 aa, Thermus thermophilus HB27; identical to SEQ ID NO: 15650

SEQ ID NO: 62356 - DNA, 594 bp, Desulfovibrio vulgaris subsp. vulgaris str. Hildenborough; identical to SEQ ID NO: 15651
  CDS (1)..(594): transl_table=11

SEQ ID NO: 62357 - protein, 197 aa, Desulfovibrio vulgaris subsp. vulgaris str. Hildenborough; identical to SEQ ID NO: 15652

SEQ ID NO: 62358 - DNA, 570 bp, Listeria monocytogenes str. 4b F2365; identical to SEQ ID NO: 15653
  CDS (1)..(570): transl_table=11

SEQ ID NO: 62359 - protein, 189 aa, Listeria monocytogenes str. 4b F2365; identical to SEQ ID NO: 15654

SEQ ID NO: 62360 - DNA, 564 bp, Listeria monocytogenes str. 4b F2365; identical to SEQ ID NO: 15655
  CDS (1)..(564): transl_table=11

SEQ ID NO: 62361 - protein, 187 aa, Listeria monocytogenes str. 4b F2365; identical to SEQ ID NO: 15656

SEQ ID NO: 62362 - DNA, 564 bp, Bacillus thuringiensis serovar konkukian str. 97-27; identical to SEQ ID NO: 15657
  CDS (1)..(564): transl_table=11

SEQ ID NO: 62363 - protein, 187 aa, Bacillus thuringiensis serovar konkukian str. 97-27; identical to SEQ ID NO: 15658

SEQ ID NO: 62364 - DNA, 486 bp, Staphylococcus aureus subsp. aureus MRSA252; identical to SEQ ID NO: 15659
  CDS (1)..(486): transl_table=11

SEQ ID NO: 62365 - protein, 161 aa, Staphylococcus aureus subsp. aureus MRSA252; identical to SEQ ID NO: 15660

SEQ ID NO: 62366 - DNA, 600 bp, Staphylococcus aureus subsp. aureus MRSA252; identical to SEQ ID NO: 15661
  CDS (1)..(600): transl_table=11

SEQ ID NO: 62367 - protein, 199 aa, Staphylococcus aureus subsp. aureus MRSA252; identical to SEQ ID NO: 15662

SEQ ID NO: 62368 - DNA, 627 bp, Erwinia carotovora subsp. atroseptica SCRI1043; identical to SEQ ID NO: 15663
  CDS (1)..(627)

SEQ ID NO: 62369 - protein, 208 aa, Erwinia carotovora subsp. atroseptica SCRI1043; identical to SEQ ID NO: 15664

SEQ ID NO: 62370 - DNA, 573 bp, Propionibacterium acnes KPA171202; identical to SEQ ID NO: 15665
  CDS (1)..(573): transl_table=11

SEQ ID NO: 62371 - protein, 190 aa, Propionibacterium acnes KPA171202; identical to SEQ ID NO: 15666

SEQ ID NO: 62372 - DNA, 510 bp, Desulfotalea psychrophila LSv54; identical to SEQ ID NO: 15667
  CDS (1)..(510): transl_table=11

SEQ ID NO: 62373 - protein, 169 aa, Desulfotalea psychrophila LSv54; identical to SEQ ID NO: 15668

SEQ ID NO: 62374 - DNA, 579 bp, Bacillus licheniformis ATCC 14580; identical to SEQ ID NO: 15669
  CDS (1)..(579): transl_table=11

SEQ ID NO: 62375 - protein, 192 aa, Bacillus licheniformis ATCC 14580; identical to SEQ ID NO: 15670

SEQ ID NO: 62376 - DNA, 564 bp, Bacillus cereus E33L; identical to SEQ ID NO: 15671
  CDS (1)..(564): transl_table=11

SEQ ID NO: 62377 - protein, 187 aa, Bacillus cereus E33L; identical to SEQ ID NO: 15672

SEQ ID NO: 62378 - DNA, 603 bp, Mannheimia succiniciproducens MBEL55E; identical to SEQ ID NO: 15673
  CDS (1)..(603): transl_table=11

SEQ ID NO: 62379 - protein, 200 aa, Mannheimia succiniciproducens MBEL55E; identical to SEQ ID NO: 15674

SEQ ID NO: 62380 - DNA, 597 bp, Mannheimia succiniciproducens MBEL55E; identical to SEQ ID NO: 15675
  CDS (1)..(597): transl_table=11

SEQ ID NO: 62381 - protein, 198 aa, Mannheimia succiniciproducens MBEL55E; identical to SEQ ID NO: 15676

SEQ ID NO: 62382 - DNA, 606 bp, Bacteroides fragilis YCH46; identical to SEQ ID NO: 15677
  CDS (1)..(606): transl_table=11

SEQ ID NO: 62383 - protein, 201 aa, Bacteroides fragilis YCH46; identical to SEQ ID NO: 15678

SEQ ID NO: 62384 - DNA, 630 bp, Bacteroides fragilis YCH46; identical to SEQ ID NO: 15679
  CDS (1)..(630): transl_table=11

SEQ ID NO: 62385 - protein, 209 aa, Bacteroides fragilis YCH46; identical to SEQ ID NO: 15680

SEQ ID NO: 62386 - DNA, 627 bp, Bacteroides fragilis YCH46; identical to SEQ ID NO: 15681
  CDS (1)..(627): transl_table=11

SEQ ID NO: 62387 - protein, 208 aa, Bacteroides fragilis YCH46; identical to SEQ ID NO: 15682

SEQ ID NO: 62388 - DNA, 591 bp, Methylococcus capsulatus str. Bath; identical to SEQ ID NO: 15683
  CDS (1)..(591): transl_table=11

SEQ ID NO: 62389 - protein, 196 aa, Methylococcus capsulatus str. Bath; identical to SEQ ID NO: 15684

SEQ ID NO: 62390 - DNA, 648 bp, Photobacterium profundum SS9; identical to SEQ ID NO: 15685
  CDS (1)..(648): transl_table=11

SEQ ID NO: 62391 - protein, 215 aa, Photobacterium profundum SS9; identical to SEQ ID NO: 15686

SEQ ID NO: 62392 - DNA, 549 bp, Photobacterium profundum SS9; identical to SEQ ID NO: 15687
  CDS (1)..(549): transl_table=11

SEQ ID NO: 62393 - protein, 182 aa, Photobacterium profundum SS9; identical to SEQ ID NO: 15688

SEQ ID NO: 62394 - DNA, 564 bp, Photobacterium profundum SS9; identical to SEQ ID NO: 15689
  CDS (1)..(564): transl_table=11

SEQ ID NO: 62395 - protein, 187 aa, Photobacterium profundum SS9; identical to SEQ ID NO: 15690

SEQ ID NO: 62396 - DNA, 561 bp, Haloarcula marismortui ATCC 43049; identical to SEQ ID NO: 15691
  CDS (1)..(561): transl_table=11

SEQ ID NO: 62397 - protein, 186 aa, Haloarcula marismortui ATCC 43049; identical to SEQ ID NO: 15692

SEQ ID NO: 62398 - DNA, 675 bp, Geobacillus kaustophilus HTA426; identical to SEQ ID NO: 15693
  CDS (1)..(675): transl_table=11

SEQ ID NO: 62399 - protein, 224 aa, Geobacillus kaustophilus HTA426; identical to SEQ ID NO: 15694

SEQ ID NO: 62400 - DNA, 558 bp, Geobacillus kaustophilus HTA426; identical to SEQ ID NO: 15695
  CDS (1)..(558): transl_table=11

SEQ ID NO: 62401 - protein, 185 aa, Geobacillus kaustophilus HTA426; identical to SEQ ID NO: 15696

SEQ ID NO: 62402 - DNA, 552 bp, Azoarcus sp. EbN1; identical to SEQ ID NO: 15697
  CDS (1)..(552): transl_table=11

SEQ ID NO: 62403 - protein, 183 aa, Azoarcus sp. EbN1; identical to SEQ ID NO: 15698

SEQ ID NO: 62404 - DNA, 600 bp, Zymomonas mobilis subsp. mobilis ZM4; identical to SEQ ID NO: 15699
  CDS (1)..(600): transl_table=11

SEQ ID NO: 62405 - protein, 199 aa, Zymomonas mobilis subsp. mobilis ZM4; identical to SEQ ID NO: 15700

SEQ ID NO: 62406 - DNA, 693 bp, Dehalococcoides ethenogenes 195; identical to SEQ ID NO: 15701
  CDS (1)..(693): transl_table=11

SEQ ID NO: 62407 - protein, 230 aa, Dehalococcoides ethenogenes 195; identical to SEQ ID NO: 15702

SEQ ID NO: 62408 - DNA, 486 bp, Staphylococcus aureus subsp. aureus COL; identical to SEQ ID NO: 15703
  CDS (1)..(486): transl_table=11

SEQ ID NO: 62409 - protein, 161 aa, Staphylococcus aureus subsp. aureus COL; identical to SEQ ID NO: 15704

SEQ ID NO: 62410 - DNA, 600 bp, Staphylococcus aureus subsp. aureus COL; identical to SEQ ID NO: 15705
  CDS (1)..(600): transl_table=11

SEQ ID NO: 62411 - protein, 199 aa, Staphylococcus aureus subsp. aureus COL; identical to SEQ ID NO: 15706

SEQ ID NO: 62412 - DNA, 615 bp, Lactobacillus acidophilus NCFM; identical to SEQ ID NO: 15707
  CDS (1)..(615): transl_table=11

SEQ ID NO: 62413 - protein, 204 aa, Lactobacillus acidophilus NCFM; identical to SEQ ID NO: 15708

SEQ ID NO: 62414 - DNA, 600 bp, Vibrio fischeri ES114; identical to SEQ ID NO: 15709
  CDS (1)..(600): transl_table=11

SEQ ID NO: 62415 - protein, 199 aa, Vibrio fischeri ES114; identical to SEQ ID NO: 15710

SEQ ID NO: 62416 - DNA, 546 bp, Vibrio fischeri ES114; identical to SEQ ID NO: 15711
  CDS (1)..(546): transl_table=11

SEQ ID NO: 62417 - protein, 181 aa, Vibrio fischeri ES114; identical to SEQ ID NO: 15712

SEQ ID NO: 62418 - DNA, 552 bp, Vibrio fischeri ES114; identical to SEQ ID NO: 15713
  CDS (1)..(552): transl_table=11

SEQ ID NO: 62419 - protein, 183 aa, Vibrio fischeri ES114; identical to SEQ ID NO: 15714

SEQ ID NO: 62420 - DNA, 756 bp, Vibrio fischeri ES114; identical to SEQ ID NO: 15715
  CDS (1)..(756): transl_table=11

SEQ ID NO: 62421 - protein, 251 aa, Vibrio fischeri ES114; identical to SEQ ID NO: 15716

SEQ ID NO: 62422 - DNA, 522 bp, Bacteroides fragilis NCTC 9343; identical to SEQ ID NO: 15717
  CDS (1)..(522): transl_table=11

SEQ ID NO: 62423 - protein, 173 aa, Bacteroides fragilis NCTC 9343; identical to SEQ ID NO: 15718

SEQ ID NO: 62424 - DNA, 600 bp, Bacteroides fragilis NCTC 9343; identical to SEQ ID NO: 15719
  CDS (1)..(600): transl_table=11

SEQ ID NO: 62425 - protein, 199 aa, Bacteroides fragilis NCTC 9343; identical to SEQ ID NO: 15720

SEQ ID NO: 62426 - DNA, 630 bp, Bacteroides fragilis NCTC 9343; identical to SEQ ID NO: 15721
  CDS (1)..(630): transl_table=11

SEQ ID NO: 62427 - protein, 209 aa, Bacteroides fragilis NCTC 9343; identical to SEQ ID NO: 15722

SEQ ID NO: 62428 - DNA, 624 bp, Bacteroides fragilis NCTC 9343; identical to SEQ ID NO: 15723
  CDS (1)..(624): transl_table=11

SEQ ID NO: 62429 - protein, 207 aa, Bacteroides fragilis NCTC 9343; identical to SEQ ID NO: 15724

SEQ ID NO: 62430 - DNA, 552 bp, Bacteroides fragilis NCTC 9343; identical to SEQ ID NO: 15725
  CDS (1)..(552): transl_table=11

SEQ ID NO: 62431 - protein, 183 aa, Bacteroides fragilis NCTC 9343; identical to SEQ ID NO: 15726

SEQ ID NO: 62432 - DNA, 588 bp, Bacteroides fragilis NCTC 9343; identical to SEQ ID NO: 15727
  CDS (1)..(588): transl_table=11

SEQ ID NO: 62433 - protein, 195 aa, Bacteroides fragilis NCTC 9343; identical to SEQ ID NO: 15728

SEQ ID NO: 62434 - DNA, 690 bp, Brucella abortus biovar 1 str. 9-941; identical to SEQ ID NO: 15729
  CDS (1)..(690): transl_table=11

SEQ ID NO: 62435 - protein, 229 aa, Brucella abortus biovar 1 str. 9-941; identical to SEQ ID NO: 15730

SEQ ID NO: 62436 - DNA, 690 bp, Chloroflexus aurantiacus; identical to SEQ ID NO: 15731
  CDS (1)..(690)

SEQ ID NO: 62437 - protein, 229 aa, Chloroflexus aurantiacus; identical to SEQ ID NO: 15732

SEQ ID NO: 62438 - DNA, 564 bp, Chloroflexus aurantiacus; identical to SEQ ID NO: 15733
  CDS (1)..(564)

SEQ ID NO: 62439 - protein, 187 aa, Chloroflexus aurantiacus; identical to SEQ ID NO: 15734

SEQ ID NO: 62440 - DNA, 615 bp, Lactobacillus gasseri; identical to SEQ ID NO: 15735
  CDS (1)..(615)

SEQ ID NO: 62441 - protein, 204 aa, Lactobacillus gasseri; identical to SEQ ID NO: 15736

SEQ ID NO: 62442 - DNA, 606 bp, Magnetospirillum magnetotacticum MS-1; identical to SEQ ID NO: 15737
  CDS (1)..(606)

SEQ ID NO: 62443 - protein, 201 aa, Magnetospirillum magnetotacticum MS-1; identical to SEQ ID NO: 15738

SEQ ID NO: 62444 - DNA, 702 bp, Leuconostoc mesenteroides subsp. mesenteroides ATCC 8293; identical to SEQ ID NO: 15739
  CDS (1)..(702)

SEQ ID NO: 62445 - protein, 233 aa, Leuconostoc mesenteroides subsp. mesenteroides ATCC 8293; identical to SEQ ID NO: 15740

SEQ ID NO: 62446 - DNA, 561 bp, Nostoc punctiforme PCC 73102; identical to SEQ ID NO: 15741
  CDS (1)..(561)

SEQ ID NO: 62447 - protein, 186 aa, Nostoc punctiforme PCC 73102; identical to SEQ ID NO: 15742

SEQ ID NO: 62448 - DNA, 594 bp, Nostoc punctiforme PCC 73102; identical to SEQ ID NO: 15743
  CDS (1)..(594)

SEQ ID NO: 62449 - protein, 197 aa, Nostoc punctiforme PCC 73102; identical to SEQ ID NO: 15744

SEQ ID NO: 62450 - DNA, 702 bp, Nostoc punctiforme PCC 73102; identical to SEQ ID NO: 15745
  CDS (1)..(702)

SEQ ID NO: 62451 - protein, 233 aa, Nostoc punctiforme PCC 73102; identical to SEQ ID NO: 15746

SEQ ID NO: 62452 - DNA, 675 bp, Bifidobacterium longum DJO10A; identical to SEQ ID NO: 15747
  CDS (1)..(675)

SEQ ID NO: 62453 - protein, 224 aa, Bifidobacterium longum DJO10A; identical to SEQ ID NO: 15748

SEQ ID NO: 62454 - DNA, 633 bp, Bifidobacterium longum DJO10A; identical to SEQ ID NO: 15749
  CDS (1)..(633)

SEQ ID NO: 62455 - protein, 210 aa, Bifidobacterium longum DJO10A; identical to SEQ ID NO: 15750

SEQ ID NO: 62456 - DNA, 609 bp, Desulfovibrio desulfuricans G20; identical to SEQ ID NO: 15751
  CDS (1)..(609)

SEQ ID NO: 62457 - protein, 202 aa, Desulfovibrio desulfuricans G20; identical to SEQ ID NO: 15752

SEQ ID NO: 62458 - DNA, 558 bp, Desulfovibrio desulfuricans G20; identical to SEQ ID NO: 15753
  CDS (1)..(558)

SEQ ID NO: 62459 - protein, 185 aa, Desulfovibrio desulfuricans G20; identical to SEQ ID NO: 15754

SEQ ID NO: 62460 - DNA, 576 bp, Anabaena variabilis ATCC 29413; identical to SEQ ID NO: 15755
  CDS (1)..(576)

SEQ ID NO: 62461 - protein, 191 aa, Anabaena variabilis ATCC 29413; identical to SEQ ID NO: 15756

SEQ ID NO: 62462 - DNA, 561 bp, Anabaena variabilis ATCC 29413; identical to SEQ ID NO: 15757
  CDS (1)..(561)

SEQ ID NO: 62463 - protein, 186 aa, Anabaena variabilis ATCC 29413; identical to SEQ ID NO: 15758

SEQ ID NO: 62464 - DNA, 576 bp, Actinobacillus pleuropneumoniae serovar 1 str. 4074; identical to SEQ ID NO: 15759
  CDS (1)..(576)

SEQ ID NO: 62465 - protein, 191 aa, Actinobacillus pleuropneumoniae serovar 1 str. 4074; identical to SEQ ID NO: 15760

SEQ ID NO: 62466 - DNA, 501 bp, Burkholderia cepacia R18194; identical to SEQ ID NO: 15761
  CDS (1)..(501)

SEQ ID NO: 62467 - protein, 166 aa, Burkholderia cepacia R18194; identical to SEQ ID NO: 15762

SEQ ID NO: 62468 - DNA, 609 bp, Burkholderia cepacia R18194; identical to SEQ ID NO: 15763
  CDS (1)..(609)

SEQ ID NO: 62469 - protein, 202 aa, Burkholderia cepacia R18194; identical to SEQ ID NO: 15764

SEQ ID NO: 62470 - DNA, 528 bp, Listeria monocytogenes str. 4b H7858; identical to SEQ ID NO: 15765
  CDS (1)..(528): transl_table=11

SEQ ID NO: 62471 - protein, 175 aa, Listeria monocytogenes str. 4b H7858; identical to SEQ ID NO: 15766

SEQ ID NO: 62472 - DNA, 570 bp, Listeria monocytogenes str. 4b H7858; identical to SEQ ID NO: 15767
  CDS (1)..(570): transl_table=11

SEQ ID NO: 62473 - protein, 189 aa, Listeria monocytogenes str. 4b H7858; identical to SEQ ID NO: 15768

SEQ ID NO: 62474 - DNA, 564 bp, Bacillus cereus G9241; identical to SEQ ID NO: 15769
  CDS (1)..(564): transl_table=11

SEQ ID NO: 62475 - protein, 187 aa, Bacillus cereus G9241; identical to SEQ ID NO: 15770

SEQ ID NO: 62476 - DNA, 558 bp, Bacillus cereus G9241; identical to SEQ ID NO: 15771
  CDS (1)..(558): transl_table=11

SEQ ID NO: 62477 - protein, 185 aa, Bacillus cereus G9241; identical to SEQ ID NO: 15772

SEQ ID NO: 62478 - DNA, 588 bp, Burkholderia fungorum LB400; identical to SEQ ID NO: 15773
  CDS (1)..(588)

SEQ ID NO: 62479 - protein, 195 aa, Burkholderia fungorum LB400; identical to SEQ ID NO: 15774

SEQ ID NO: 62480 - DNA, 555 bp, Thermobifida fusca; identical to SEQ ID NO: 15775
  CDS (1)..(555)

SEQ ID NO: 62481 - protein, 184 aa, Thermobifida fusca; identical to SEQ ID NO: 15776

SEQ ID NO: 62482 - DNA, 513 bp, Cytophaga hutchinsonii; identical to SEQ ID NO: 15777
  CDS (1)..(513)

SEQ ID NO: 62483 - protein, 170 aa, Cytophaga hutchinsonii; identical to SEQ ID NO: 15778

SEQ ID NO: 62484 - DNA, 654 bp, Cytophaga hutchinsonii; identical to SEQ ID NO: 15779
  CDS (1)..(654)

SEQ ID NO: 62485 - protein, 217 aa, Cytophaga hutchinsonii; identical to SEQ ID NO: 15780

SEQ ID NO: 62486 - DNA, 744 bp, Microbulbifer degradans 2-40; identical to SEQ ID NO: 15781
  CDS (1)..(744)

SEQ ID NO: 62487 - protein, 247 aa, Microbulbifer degradans 2-40; identical to SEQ ID NO: 15782

SEQ ID NO: 62488 - DNA, 549 bp, Microbulbifer degradans 2-40; identical to SEQ ID NO: 15783
  CDS (1)..(549)

SEQ ID NO: 62489 - protein, 182 aa, Microbulbifer degradans 2-40; identical to SEQ ID NO: 15784

SEQ ID NO: 62490 - DNA, 417 bp, Oenococcus oeni PSU-1; identical to SEQ ID NO: 15785
  CDS (1)..(417)

SEQ ID NO: 62491 - protein, 138 aa, Oenococcus oeni PSU-1; identical to SEQ ID NO: 15786

SEQ ID NO: 62492 - DNA, 567 bp, Pediococcus pentosaceus ATCC 25745; identical to SEQ ID NO: 15787
  CDS (1)..(567)

SEQ ID NO: 62493 - protein, 188 aa, Pediococcus pentosaceus ATCC 25745; identical to SEQ ID NO: 15788

SEQ ID NO: 62494 - DNA, 555 bp, Pediococcus pentosaceus ATCC 25745; identical to SEQ ID NO: 15789
  CDS (1)..(555)

SEQ ID NO: 62495 - protein, 184 aa, Pediococcus pentosaceus ATCC 25745; identical to SEQ ID NO: 15790

SEQ ID NO: 62496 - DNA, 552 bp, Pediococcus pentosaceus ATCC 25745; identical to SEQ ID NO: 15791
  CDS (1)..(552)

SEQ ID NO: 62497 - protein, 183 aa, Pediococcus pentosaceus ATCC 25745; identical to SEQ ID NO: 15792

SEQ ID NO: 62498 - DNA, 465 bp, Streptococcus suis 89/1591; identical to SEQ ID NO: 15793
  CDS (1)..(465)

SEQ ID NO: 62499 - protein, 154 aa, Streptococcus suis 89/1591; identical to SEQ ID NO: 15794

SEQ ID NO: 62500 - DNA, 606 bp, Desulfovibrio desulfuricans G20; identical to SEQ ID NO: 15795
  CDS (1)..(606)

SEQ ID NO: 62501 - protein, 201 aa, Desulfovibrio desulfuricans G20; identical to SEQ ID NO: 15796

SEQ ID NO: 62502 - DNA, 543 bp, Chloroflexus aurantiacus; identical to SEQ ID NO: 15797
  CDS (1)..(543)

SEQ ID NO: 62503 - protein, 180 aa, Chloroflexus aurantiacus; identical to SEQ ID NO: 15798

SEQ ID NO: 62504 - DNA, 186 bp, Brevibacterium linens BL2; identical to SEQ ID NO: 15799
  CDS (1)..(186)

SEQ ID NO: 62505 - protein, 61 aa, Brevibacterium linens BL2; identical to SEQ ID NO: 15800

SEQ ID NO: 62506 - DNA, 612 bp, Lactococcus lactis subsp. cremoris SK11; identical to SEQ ID NO: 15801
  CDS (1)..(612)

SEQ ID NO: 62507 - protein, 203 aa, Lactococcus lactis subsp. cremoris SK11; identical to SEQ ID NO: 15802

SEQ ID NO: 62508 - DNA, 588 bp, Lactococcus lactis subsp. cremoris SK11; identical to SEQ ID NO: 15803
  CDS (1)..(588)

SEQ ID NO: 62509 - protein, 195 aa, Lactococcus lactis subsp. cremoris SK11; identical to SEQ ID NO: 15804

SEQ ID NO: 62510 - DNA, 597 bp, Lactobacillus casei ATCC 334; identical to SEQ ID NO: 15805
  CDS (1)..(597)

SEQ ID NO: 62511 - protein, 198 aa, Lactobacillus casei ATCC 334; identical to SEQ ID NO: 15806

SEQ ID NO: 62512 - DNA, 705 bp, Lactobacillus casei ATCC 334; identical to SEQ ID NO: 15807
  CDS (1)..(705)

SEQ ID NO: 62513 - protein, 234 aa, Lactobacillus casei ATCC 334; identical to SEQ ID NO: 15808

SEQ ID NO: 62514 - DNA, 591 bp, Lactobacillus delbrueckii subsp. bulgaricus ATCC BAA-365; identical to SEQ ID NO: 15809
  CDS (1)..(591)

SEQ ID NO: 62515 - protein, 196 aa, Lactobacillus delbrueckii subsp. bulgaricus ATCC BAA-365; identical to SEQ ID NO: 15810

SEQ ID NO: 62516 - DNA, 609 bp, Bacillus anthracis str. A2012; identical to SEQ ID NO: 15811
  CDS (1)..(609): n means a or g or c or t/u, s means g or c

SEQ ID NO: 62517 - protein, 202 aa, Bacillus anthracis str. A2012; identical to SEQ ID NO: 15812
  Xaa in position 136 is unknown

SEQ ID NO: 62518 - DNA, 534 bp, Anaeromyxobacter dehalogenans 2CP-C; identical to SEQ ID NO: 15813
  CDS (1)..(534): transl_table=11

SEQ ID NO: 62519 - protein, 177 aa, Anaeromyxobacter dehalogenans 2CP-C; identical to SEQ ID NO: 15814

SEQ ID NO: 62520 - DNA, 663 bp, Streptococcus pneumoniae TIGR4; identical to SEQ ID NO: 15815
  CDS (1)..(663)

SEQ ID NO: 62521 - protein, 220 aa, Streptococcus pneumoniae TIGR4; identical to SEQ ID NO: 15816

SEQ ID NO: 62522 - DNA, 558 bp, Burkholderia vietnamiensis G4; identical to SEQ ID NO: 15817
  CDS (1)..(558): transl_table=11

SEQ ID NO: 62523 - protein, 185 aa, Burkholderia vietnamiensis G4; identical to SEQ ID NO: 15818

SEQ ID NO: 62524 - DNA, 576 bp, Crocosphaera watsonii WH 8501; identical to SEQ ID NO: 15819
  CDS (1)..(576): transl_table=11

SEQ ID NO: 62525 - protein, 191 aa, Crocosphaera watsonii WH 8501; identical to SEQ ID NO: 15820

SEQ ID NO: 62526 - DNA, 555 bp, Chlorobium phaeobacteroides DSM 266; identical to SEQ ID NO: 15821
  CDS (1)..(555): transl_table=11

SEQ ID NO: 62527 - protein, 184 aa, Chlorobium phaeobacteroides DSM 266; identical to SEQ ID NO: 15822

SEQ ID NO: 62528 - DNA, 618 bp, Chlorobium phaeobacteroides BS1; identical to SEQ ID NO: 15823
  CDS (1)..(618): transl_table=11

SEQ ID NO: 62529 - protein, 205 aa, Chlorobium phaeobacteroides BS1; identical to SEQ ID NO: 15824

SEQ ID NO: 62530 - DNA, 576 bp, Exiguobacterium sp. 255-15; identical to SEQ ID NO: 15825
  CDS (1)..(576): transl_table=11

SEQ ID NO: 62531 - protein, 191 aa, Exiguobacterium sp. 255-15; identical to SEQ ID NO: 15826

SEQ ID NO: 62532 - DNA, 552 bp, Exiguobacterium sp. 255-15; identical to SEQ ID NO: 15827
  CDS (1)..(552): transl_table=11

SEQ ID NO: 62533 - protein, 183 aa, Exiguobacterium sp. 255-15; identical to SEQ ID NO: 15828

SEQ ID NO: 62534 - DNA, 702 bp, Exiguobacterium sp. 255-15; identical to SEQ ID NO: 15829
  CDS (1)..(702): transl_table=11

SEQ ID NO: 62535 - protein, 233 aa, Exiguobacterium sp. 255-15; identical to SEQ ID NO: 15830

SEQ ID NO: 62536 - DNA, 642 bp, Methanosarcina barkeri str. fusaro; identical to SEQ ID NO: 15831
  CDS (1)..(642): transl_table=11

SEQ ID NO: 62537 - protein, 213 aa, Methanosarcina barkeri str. fusaro; identical to SEQ ID NO: 15832

SEQ ID NO: 62538 - DNA, 600 bp, Methanosarcina barkeri str. fusaro; identical to SEQ ID NO: 15833
  CDS (1)..(600): transl_table=11

SEQ ID NO: 62539 - protein, 199 aa, Methanosarcina barkeri str. fusaro; identical to SEQ ID NO: 15834

SEQ ID NO: 62540 - DNA, 549 bp, Methanosarcina barkeri str. fusaro; identical to SEQ ID NO: 15835
  CDS (1)..(549): transl_table=11

SEQ ID NO: 62541 - protein, 182 aa, Methanosarcina barkeri str. fusaro; identical to SEQ ID NO: 15836

SEQ ID NO: 62542 - DNA, 609 bp, Methanosarcina barkeri str. fusaro; identical to SEQ ID NO: 15837
  CDS (1)..(609): transl_table=11

SEQ ID NO: 62543 - protein, 202 aa, Methanosarcina barkeri str. fusaro; identical to SEQ ID NO: 15838

SEQ ID NO: 62544 - DNA, 531 bp, Desulfuromonas acetoxidans DSM 684; identical to SEQ ID NO: 15839
  CDS (1)..(531): transl_table=11

SEQ ID NO: 62545 - protein, 176 aa, Desulfuromonas acetoxidans DSM 684; identical to SEQ ID NO: 15840

SEQ ID NO: 62546 - DNA, 555 bp, Jannaschia sp. CCS1; identical to SEQ ID NO: 15841
  CDS (1)..(555): transl_table=11

SEQ ID NO: 62547 - protein, 184 aa, Jannaschia sp. CCS1; identical to SEQ ID NO: 15842

SEQ ID NO: 62548 - DNA, 630 bp, Frankia sp. EAN1pec; identical to SEQ ID NO: 15843
  CDS (1)..(630): transl_table=11

SEQ ID NO: 62549 - protein, 209 aa, Frankia sp. EAN1pec; identical to SEQ ID NO: 15844

SEQ ID NO: 62550 - DNA, 555 bp, Shewanella baltica OS155; identical to SEQ ID NO: 15845
  CDS (1)..(555): transl_table=11

SEQ ID NO: 62551 - protein, 184 aa, Shewanella baltica OS155; identical to SEQ ID NO: 15846

SEQ ID NO: 62552 - DNA, 585 bp, Shewanella baltica OS155; identical to SEQ ID NO: 15847
  CDS (1)..(585): transl_table=11

SEQ ID NO: 62553 - protein, 194 aa, Shewanella baltica OS155; identical to SEQ ID NO: 15848

SEQ ID NO: 62554 - DNA, 726 bp, Ralstonia metallidurans CH34; identical to SEQ ID NO: 15849
  CDS (1)..(726): transl_table=11

SEQ ID NO: 62555 - protein, 241 aa, Ralstonia metallidurans CH34; identical to SEQ ID NO: 15850

SEQ ID NO: 62556 - DNA, 549 bp, Paracoccus denitrificans PD1222; identical to SEQ ID NO: 15851
  CDS (1)..(549): transl_table=11

SEQ ID NO: 62557 - protein, 182 aa, Paracoccus denitrificans PD1222; identical to SEQ ID NO: 15852

SEQ ID NO: 62558 - DNA, 615 bp, Shewanella frigidimarina NCIMB 400; identical to SEQ ID NO: 15853
  CDS (1)..(615): transl_table=11

SEQ ID NO: 62559 - protein, 204 aa, Shewanella frigidimarina NCIMB 400; identical to SEQ ID NO: 15854

SEQ ID NO: 62560 - DNA, 777 bp, Escherichia coli; identical to SEQ ID NO: 15855
  CDS (1)..(777): transl_table=11

SEQ ID NO: 62561 - protein, 258 aa, Escherichia coli; identical to SEQ ID NO: 15856

SEQ ID NO: 62562 - DNA, 651 bp, Pseudomonas fluorescens; identical to SEQ ID NO: 15857
  CDS (1)..(651): transl_table=11

SEQ ID NO: 62563 - protein, 216 aa, Pseudomonas fluorescens; identical to SEQ ID NO: 15858

SEQ ID NO: 62564 - DNA, 579 bp, Staphylococcus haemolyticus; identical to SEQ ID NO: 15859
  CDS (1)..(579): transl_table=11

SEQ ID NO: 62565 - protein, 192 aa, Staphylococcus haemolyticus; identical to SEQ ID NO: 15860

SEQ ID NO: 62566 - DNA, 648 bp, Aspergillus fumigatus Af293; identical to SEQ ID NO: 15861
  CDS (1)..(648)

SEQ ID NO: 62567 - protein, 215 aa, Aspergillus fumigatus Af293; identical to SEQ ID NO: 15862

SEQ ID NO: 62568 - DNA, 747 bp, Aspergillus fumigatus Af293; identical to SEQ ID NO: 15863
  CDS (1)..(747)

SEQ ID NO: 62569 - protein, 248 aa, Aspergillus fumigatus Af293; identical to SEQ ID NO: 15864

SEQ ID NO: 62570 - DNA, 687 bp, Aspergillus fumigatus Af293; identical to SEQ ID NO: 15865
  CDS (1)..(687)

SEQ ID NO: 62571 - protein, 228 aa, Aspergillus fumigatus Af293; identical to SEQ ID NO: 15866

SEQ ID NO: 62572 - DNA, 603 bp, Lactobacillus crispatus; identical to SEQ ID NO: 15867
  CDS (1)..(603): transl_table=11

SEQ ID NO: 62573 - protein, 200 aa, Lactobacillus crispatus; identical to SEQ ID NO: 15868

SEQ ID NO: 62574 - DNA, 642 bp, Cryptococcus neoformans var; identical to SEQ ID NO: 15869
  CDS (1)..(642)

SEQ ID NO: 62575 - protein, 213 aa, Cryptococcus neoformans var; identical to SEQ ID NO: 15870

SEQ ID NO: 62576 - DNA, 513 bp, Klebsiella pneumoniae; identical to SEQ ID NO: 15871
  CDS (1)..(513): transl_table=11

SEQ ID NO: 62577 - protein, 170 aa, Klebsiella pneumoniae; identical to SEQ ID NO: 15872

SEQ ID NO: 62578 - DNA, 555 bp, Vibrio cholerae non; identical to SEQ ID NO: 15873
  CDS (1)..(555): transl_table=11

SEQ ID NO: 62579 - protein, 184 aa, Vibrio cholerae non; identical to SEQ ID NO: 15874

SEQ ID NO: 62580 - DNA, 645 bp, Rhizobium etli; identical to SEQ ID NO: 15875
  CDS (1)..(645): transl_table=11

SEQ ID NO: 62581 - protein, 214 aa, Rhizobium etli; identical to SEQ ID NO: 15876

SEQ ID NO: 62582 - DNA, 558 bp, Bacillus stearothermophilus; identical to SEQ ID NO: 15877
  CDS (1)..(558): transl_table=11

SEQ ID NO: 62583 - protein, 185 aa, Bacillus stearothermophilus; identical to SEQ ID NO: 15878

SEQ ID NO: 62584 - DNA, 594 bp, Rhizobium leguminosarum bv; identical to SEQ ID NO: 15879
  CDS (1)..(594): transl_table=11

SEQ ID NO: 62585 - protein, 197 aa, Rhizobium leguminosarum bv; identical to SEQ ID NO: 15880

SEQ ID NO: 62586 - DNA, 573 bp, Dictyostelium discoideum; identical to SEQ ID NO: 15881
  CDS (1)..(573)

SEQ ID NO: 62587 - protein, 190 aa, Dictyostelium discoideum; identical to SEQ ID NO: 15882

SEQ ID NO: 62588 - DNA, 657 bp, Physcomitrella patens; identical to SEQ ID NO: 15883
  CDS (1)..(657)

SEQ ID NO: 62589 - protein, 218 aa, Physcomitrella patens; identical to SEQ ID NO: 15884

SEQ ID NO: 62590 - DNA, 636 bp, Aeromonas hydrophila; identical to SEQ ID NO: 15885
  CDS (1)..(636): transl_table=11

SEQ ID NO: 62591 - protein, 211 aa, Aeromonas hydrophila; identical to SEQ ID NO: 15886

SEQ ID NO: 62592 - DNA, 600 bp, Aeromonas hydrophila; identical to SEQ ID NO: 15887
  CDS (1)..(600): transl_table=11

SEQ ID NO: 62593 - protein, 199 aa, Aeromonas hydrophila; identical to SEQ ID NO: 15888

SEQ ID NO: 62594 - DNA, 678 bp, Corynebacterium glutamicum; identical to SEQ ID NO: 15889
  CDS (1)..(678): transl_table=11

SEQ ID NO: 62595 - protein, 225 aa, Corynebacterium glutamicum; identical to SEQ ID NO: 15890

SEQ ID NO: 62596 - DNA, 624 bp, Lactococcus lactis; identical to SEQ ID NO: 15891
  CDS (1)..(624): transl_table=11

SEQ ID NO: 62597 - protein, 207 aa, Lactococcus lactis; identical to SEQ ID NO: 15892

SEQ ID NO: 62598 - DNA, 621 bp, Candida albicans; identical to SEQ ID NO: 15893
  CDS (1)..(621): transl_table=12

SEQ ID NO: 62599 - protein, 206 aa, Candida albicans; identical to SEQ ID NO: 15894

SEQ ID NO: 62600 - DNA, 519 bp, Staphylococcus aureus; identical to SEQ ID NO: 15895
  CDS (1)..(519): transl_table=11

SEQ ID NO: 62601 - protein, 172 aa, Staphylococcus aureus; identical to SEQ ID NO: 15896

SEQ ID NO: 62602 - DNA, 555 bp, Bacillus subtilis; identical to SEQ ID NO: 15897
  CDS (1)..(555): transl_table=11

SEQ ID NO: 62603 - protein, 184 aa, Bacillus subtilis; identical to SEQ ID NO: 15898

SEQ ID NO: 62604 - DNA, 552 bp, Escherichia coli; identical to SEQ ID NO: 15433
  CDS (1)..(552)

SEQ ID NO: 62605 - protein, 183 aa, Escherichia coli; identical to SEQ ID NO: 15434

SEQ ID NO: 62606 - DNA, 573 bp, Rhizobium leguminosarum bv; identical to SEQ ID NO: 15901
  CDS (1)..(573): transl_table=11

SEQ ID NO: 62607 - protein, 190 aa, Rhizobium leguminosarum bv; identical to SEQ ID NO: 15902

SEQ ID NO: 62608 - DNA, 552 bp, Rhizobium meliloti; identical to SEQ ID NO: 15903
  CDS (1)..(552): transl_table=11

SEQ ID NO: 62609 - protein, 183 aa, Rhizobium meliloti; identical to SEQ ID NO: 15904

SEQ ID NO: 62610 - DNA, 624 bp, Lactococcus lactis subsp; identical to SEQ ID NO: 15905
  CDS (1)..(624): transl_table=11

SEQ ID NO: 62611 - protein, 207 aa, Lactococcus lactis subsp; identical to SEQ ID NO: 15906

SEQ ID NO: 62612 - DNA, 645 bp, Methanococcus jannaschii; identical to SEQ ID NO: 15907
  CDS (1)..(645): transl_table=11

SEQ ID NO: 62613 - protein, 214 aa, Methanococcus jannaschii; identical to SEQ ID NO: 15908

SEQ ID NO: 62614 - DNA, 624 bp, Schizosaccharomyces pombe; identical to SEQ ID NO: 15909
  CDS (1)..(624)

SEQ ID NO: 62615 - protein, 207 aa, Schizosaccharomyces pombe; identical to SEQ ID NO: 15910

SEQ ID NO: 62616 - DNA, 591 bp, Saccharomyces cerevisiae; identical to SEQ ID NO: 15911
  CDS (1)..(591)

SEQ ID NO: 62617 - protein, 196 aa, Saccharomyces cerevisiae; identical to SEQ ID NO: 15912

SEQ ID NO: 62618 - DNA, 25 bp, Artificial sequence
  (1)..(25): primer
atgaacatgccaatgaccgaaagaa

SEQ ID NO: 62619 - DNA, 28 bp, Artificial sequence
  (1)..(28): primer
ttaaactgacgattcaactttataatct

SEQ ID NO: 62620 - protein, 204 aa, Artificial sequence; identical to SEQ ID NO: 15915
  Variant (2)..(4): xaa in position 2 to 4 is any amino acid
  Variant (5)..(9): xaa in position 5 to 9 is any or no amino acid
  Variant (11)..(26): xaa in position 11 to 26 is any or no amino acid
  Variant (28)..(28): xaa in position 28 is any amino acid
  Variant (31)..(41): xaa in position 31 to 41 is any amino acid
  Variant (42)..(92): xaa in position 42 to 92 is any or no amino acid
  Variant (94)..(94): xaa in position 94 is any or no amino acid
  Variant (97)..(97): xaa in position 97 is any amino acid
  Variant (98)..(101): xaa in position 98 to 101 is any or no amino acid
  Variant (103)..(106): xaa in position 103 to 106 is any amino acid
  Variant (108)..(109): xaa in position 108 to 109 is any amino acid
  Variant (110)..(112): xaa in position 110 to 112 is any or no amino acid
  Variant (114)..(119): xaa in position 114 to 119 is any amino acid
  Variant (120)..(152): xaa in position 120 to 152 is any or no amino acid
  Variant (154)..(154): xaa in position 154 is any amino acid
  Variant (156)..(159): xaa in position 156 to 159 is any amino acid
  Variant (163)..(166): xaa in position 163 to 166 is any or no amino acid
  Variant (168)..(169): xaa in position 168 to 169 is any or no amino acid
  Variant (172)..(172): xaa in position 172 is any or no amino acid
  Variant (175)..(177): xaa in position 175 to 177 is any or no amino acid
  Variant (188)..(188): xaa in position 188 is any amino acid
  Variant (191)..(193): xaa in position 191 to 193 is any amino acid
  Variant (195)..(196): xaa in position 195 to 196 is any amino acid
  Variant (198)..(198): xaa in position 198 is any amino acid
  Variant (200)..(200): xaa in position 200 is any amino acid

SEQ ID NO: 62621 - protein, 12 aa, Artificial sequence
  Variant (2)..(2): xaa in position 2 is any or no amino acid
  Variant (4)..(5): xaa in position 4 to 5 is any amino acid
  Variant (6)..(6): xaa in position 6 is Ala, Cys, Thr or Val
  Variant (7)..(7): xaa in position 7 is any amino acid
  Variant (8)..(8): xaa in position 8 is Phe, Ile, Leu, Met or Val
  Variant (9)..(11): xaa in position 9 to 11 is any amino acid
  Variant (12)..(12): xaa in position 12 is Ala, Cys, Asp, Gly, Asn, Ser, Thr or Val
IXGXXXXXXXXX

SEQ ID NO: 62622 - protein, 43 aa, Artificial sequence; identical to SEQ ID NO: 15917
  Variant (2)..(2): xaa in position 2 is any amino acid
  Variant (3)..(4): xaa in position 3 to 4 is any or no amino acid
  Variant (6)..(10): xaa in position 6 to 10 is any amino acid
  Variant (11)..(12): xaa in position 11 to 12 is any or no amino acid
  Variant (14)..(14): xaa in position 14 is Ala, Ile or Val
  Variant (15)..(15): xaa in position 15 is any amino acid
  Variant (16)..(16): xaa in position 16 is Ile, Leu or Val
  Variant (17)..(17): xaa in position 17 is Asp, Gly or Thr
  Variant (18)..(19): xaa in position 18 to 19 is any amino acid
  Variant (20)..(20): xaa in position 20 is Ala, Cys, Gly, Ser, Thr or Val
  Variant (21)..(21): xaa in position 21 is any amino acid
  Variant (22)..(22): xaa in position 22 is Ala, Ile, Leu or Val
  Variant (23)..(23): xaa in position 23 is Ala, Gly or Ser
  Variant (24)..(25): xaa in position 24 to 25 is any amino acid
  Variant (26)..(26): xaa in position 26 is Ala, Cys, Ser or Thr
  Variant (27)..(27): xaa in position 27 is any amino acid
  Variant (28)..(28): xaa in position 28 is Ala, Ile or Val
  Variant (29)..(31): xaa in position 29 to 31 is any amino acid
  Variant (32)..(32): xaa in position 32 is Phe, Ile, Leu, Met or Val
  Variant (33)..(39): xaa in position 33 to 39 is any amino acid
  Variant (41)..(41): xaa in position 41 is any amino acid
  Variant (43)..(43): xaa in position 43 is Ala, Cys or Gly

SEQ ID NO: 62623 - DNA, 1392 bp, Escherichia coli K12; identical to SEQ ID NO: 28298
  CDS (1)..(1392): transl_table=11

SEQ ID NO: 62624 - protein, 463 aa, Escherichia coli K12; identical to SEQ ID NO: 28299

SEQ ID NO: 62625 - DNA, 1428 bp, Aquifex aeolicus VF5; identical to SEQ ID NO: 28300
  CDS (1)..(1428): transl_table=11

SEQ ID NO: 62626 - protein, 475 aa, Aquifex aeolicus VF5; identical to SEQ ID NO: 28301

SEQ ID NO: 62627 - DNA, 1212 bp, Pseudomonas aeruginosa PAO1; identical to SEQ ID NO: 28302
  CDS (1)..(1212): transl_table=11

SEQ ID NO: 62628 - protein, 403 aa, Pseudomonas aeruginosa PAO1; identical to SEQ ID NO: 28303

SEQ ID NO: 62629 - DNA, 1407 bp, Pseudomonas aeruginosa PAO1; identical to SEQ ID NO: 28304
  CDS (1)..(1407): transl_table=11

SEQ ID NO: 62630 - protein, 468 aa, Pseudomonas aeruginosa PAO1; identical to SEQ ID NO: 28305

SEQ ID NO: 62631 - DNA, 1296 bp, Pseudomonas aeruginosa PAO1; identical to SEQ ID NO: 28306
  CDS (1)..(1296): transl_table=11

SEQ ID NO: 62632 - protein, 431 aa, Pseudomonas aeruginosa PAO1; identical to SEQ ID NO: 28307

SEQ ID NO: 62633 - DNA, 1554 bp, Mycobacterium leprae TN; identical to SEQ ID NO: 28308
  CDS (1)..(1554): transl_table=11

SEQ ID NO: 62634 - protein, 517 aa, Mycobacterium leprae TN; identical to SEQ ID NO: 28309

SEQ ID NO: 62635 - DNA, 1389 bp, Escherichia coli O157:H7; identical to SEQ ID NO: 28310
  CDS (1)..(1389): transl_table=11

SEQ ID NO: 62636 - protein, 462 aa, Escherichia coli O157:H7; identical to SEQ ID NO: 28311

SEQ ID NO: 62637 - DNA, 1410 bp, Mycobacterium tuberculosis CDC1551; identical to SEQ ID NO: 28312
  CDS (1)..(1410): transl_table=11

SEQ ID NO: 62638 - protein, 469 aa, Mycobacterium tuberculosis CDC1551; identical to SEQ ID NO: 28313

SEQ ID NO: 62639 - DNA, 1392 bp, Mycobacterium tuberculosis CDC1551; identical to SEQ ID NO: 28314
  CDS (1)..(1392): transl_table=11

SEQ ID NO: 62640 - protein, 463 aa, Mycobacterium tuberculosis CDC1551; identical to SEQ ID NO: 28315

SEQ ID NO: 62641 - DNA, 1188 bp, Mycobacterium tuberculosis CDC1551; identical to SEQ ID NO: 28316
  CDS (1)..(1188): transl_table=11

SEQ ID NO: 62642 - protein, 395 aa, Mycobacterium tuberculosis CDC1551; identical to SEQ ID NO: 28317

SEQ ID NO: 62643 - DNA, 1548 bp, Mycobacterium tuberculosis CDC1551; identical to SEQ ID NO: 28318
  CDS (1)..(1548): transl_table=11

SEQ ID NO: 62644 - protein, 515 aa, Mycobacterium tuberculosis CDC1551; identical to SEQ ID NO: 28319

SEQ ID NO: 62645 - DNA, 1170 bp, Staphylococcus aureus subsp. aureus Mu50; identical to SEQ ID NO: 28320
  CDS (1)..(1170): transl_table=11

SEQ ID NO: 62646 - protein, 389 aa, Staphylococcus aureus subsp. aureus Mu50; identical to SEQ ID NO: 28321

SEQ ID NO: 62647 - DNA, 1422 bp, Caulobacter crescentus CB15; identical to SEQ ID NO: 28322
  CDS (1)..(1422): transl_table=11

SEQ ID NO: 62648 - protein, 473 aa, Caulobacter crescentus CB15; identical to SEQ ID NO: 28323

SEQ ID NO: 62649 - DNA, 1275 bp, Sinorhizobium meliloti 1021; identical to SEQ ID NO: 28324
  CDS (1)..(1275): transl_table=11

SEQ ID NO: 62650 - protein, 424 aa, Sinorhizobium meliloti 1021; identical to SEQ ID NO: 28325

SEQ ID NO: 62651 - DNA, 1398 bp, Salmonella typhimurium LT2; identical to SEQ ID NO: 28326
  CDS (1)..(1398): transl_table=11

SEQ ID NO: 62652 - protein, 465 aa, Salmonella typhimurium LT2; identical to SEQ ID NO: 28327

SEQ ID NO: 62653 - DNA, 1314 bp, Ralstonia solanacearum GMI1000; identical to SEQ ID NO: 28328
  CDS (1)..(1314): transl_table=11

SEQ ID NO: 62654 - protein, 437 aa, Ralstonia solanacearum GMI1000; identical to SEQ ID NO: 28329

SEQ ID NO: 62655 - DNA, 1386 bp, Ralstonia solanacearum GMI1000; identical to SEQ ID NO: 28330
  CDS (1)..(1386): transl_table=11

SEQ ID NO: 62656 - protein, 461 aa, Ralstonia solanacearum GMI1000; identical to SEQ ID NO: 28331

SEQ ID NO: 62657 - DNA, 2856 bp, Brucella melitensis 16M; identical to SEQ ID NO: 28332
  CDS (1)..(2856): transl_table=11

SEQ ID NO: 62658 - protein, 951 aa, Brucella melitensis 16M; identical to SEQ ID NO: 28333

SEQ ID NO: 62659 - DNA, 1293 bp, Clostridium perfringens str. 13; identical to SEQ ID NO: 28334
  CDS (1)..(1293): transl_table=11

SEQ ID NO: 62660 - protein, 430 aa, Clostridium perfringens str. 13; identical to SEQ ID NO: 28335

SEQ ID NO: 62661 - DNA, 1338 bp, Corynebacterium glutamicum ATCC 13032; identical to SEQ ID NO: 28336
  CDS (1)..(1338): transl_table=11

SEQ ID NO: 62662 - protein, 445 aa, Corynebacterium glutamicum ATCC 13032; identical to SEQ ID NO: 28337

SEQ ID NO: 62663 - DNA, 1239 bp, Streptomyces coelicolor A3(2); identical to SEQ ID NO: 28338
  CDS (1)..(1239): transl_table=11

SEQ ID NO: 62664 - protein, 412 aa, Streptomyces coelicolor A3(2); identical to SEQ ID NO: 28339

SEQ ID NO: 62665 - DNA, 1359 bp, Streptomyces coelicolor A3(2); identical to SEQ ID NO: 28340
  CDS (1)..(1359): transl_table=11

SEQ ID NO: 62666 - protein, 452 aa, Streptomyces coelicolor A3(2); identical to SEQ ID NO: 28341

SEQ ID NO: 62667 - DNA, 1236 bp, Xanthomonas campestris pv. campestris str. ATCC 33913; identical to SEQ ID NO: 28342
  CDS (1)..(1236): transl_table=11

SEQ ID NO: 62668 - protein, 411 aa, Xanthomonas campestris pv. campestris str. ATCC 33913; identical to SEQ ID NO: 28343

SEQ ID NO: 62669 - DNA, 2688 bp, Brucella suis 1330; identical to SEQ ID NO: 28344
  CDS (1)..(2688): transl_table=11

SEQ ID NO: 62670 - protein, 895 aa, Brucella suis 1330; identical to SEQ ID NO: 28345

SEQ ID NO: 62671 - DNA, 1389 bp, Shigella flexneri 2a str. 301; identical to SEQ ID NO: 28346
  CDS (1)..(1389): transl_table=11

SEQ ID NO: 62672 - protein, 462 aa, Shigella flexneri 2a str. 301; identical to SEQ ID NO: 28347

SEQ ID NO: 62673 - DNA, 1434 bp, Corynebacterium efficiens YS-314; identical to SEQ ID NO: 28348
  CDS (1)..(1434): transl_table=11

SEQ ID NO: 62674 - protein, 477 aa, Corynebacterium efficiens YS-314; identical to SEQ ID NO: 28349

SEQ ID NO: 62675 - DNA, 1302 bp, Corynebacterium efficiens YS-314; identical to SEQ ID NO: 28350
  CDS (1)..(1302): transl_table=11

SEQ ID NO: 62676 - protein, 433 aa, Corynebacterium efficiens YS-314; identical to SEQ ID NO: 28351

SEQ ID NO: 62677 - DNA, 1236 bp, Pseudomonas putida KT2440; identical to SEQ ID NO: 28352
  CDS (1)..(1236): transl_table=11

SEQ ID NO: 62678 - protein, 411 aa, Pseudomonas putida KT2440; identical to SEQ ID NO: 28353

SEQ ID NO: 62679 - DNA, 1164 bp, Staphylococcus epidermidis ATCC 12228; identical to SEQ ID NO: 28354
  CDS (1)..(1164): transl_table=11

SEQ ID NO: 62680 - protein, 387 aa, Staphylococcus epidermidis ATCC 12228; identical to SEQ ID NO: 28355

SEQ ID NO: 62681 - DNA, 1380 bp, Bradyrhizobium japonicum USDA 110; identical to SEQ ID NO: 28356
  CDS (1)..(1380): transl_table=11

SEQ ID NO: 62682 - protein, 459 aa, Bradyrhizobium japonicum USDA 110; identical to SEQ ID NO: 28357

SEQ ID NO: 62683 - DNA, 1191 bp, Lactobacillus plantarum WCFS1; identical to SEQ ID NO: 28358
  CDS (1)..(1191): transl_table=11

SEQ ID NO: 62684 - protein, 396 aa, Lactobacillus plantarum WCFS1; identical to SEQ ID NO: 28359

SEQ ID NO: 62685 - DNA, 1212 bp, Pseudomonas syringae pv. tomato str. DC3000; identical to SEQ ID NO: 28360
  CDS (1)..(1212): transl_table=11

SEQ ID NO: 62686 - protein, 403 aa, Pseudomonas syringae pv. tomato str. DC3000; identical to SEQ ID NO: 28361

SEQ ID NO: 62687 - DNA, 1389 bp, Salmonella enterica subsp. enterica serovar Typhi Ty2; identical to SEQ ID NO: 28362
  CDS (1)..(1389): transl_table=11

SEQ ID NO: 62688 - protein, 462 aa, Salmonella enterica subsp. enterica serovar Typhi Ty2; identical to SEQ ID NO: 28363

SEQ ID NO: 62689 - DNA, 1392 bp, Streptomyces avermitilis MA-4680; identical to SEQ ID NO: 28364
  CDS (1)..(1392): transl_table=11

SEQ ID NO: 62690 - protein, 463 aa, Streptomyces avermitilis MA-4680; identical to SEQ ID NO: 28365

SEQ ID NO: 62691 - DNA, 1170 bp, Bacillus cereus ATCC 14579; identical to SEQ ID NO: 28366
  CDS (1)..(1170): transl_table=11

SEQ ID NO: 62692 - protein, 389 aa, Bacillus cereus ATCC 14579; identical to SEQ ID NO: 28367

SEQ ID NO: 62693 - DNA, 1389 bp, Shigella flexneri 2a str. 2457T; identical to SEQ ID NO: 28368
  CDS (1)..(1389): transl_table=11

SEQ ID NO: 62694 - protein, 462 aa, Shigella flexneri 2a str. 2457T; identical to SEQ ID NO: 28369

SEQ ID NO: 62695 - DNA, 1203 bp, Chromobacterium violaceum ATCC 12472; identical to SEQ ID NO: 28370
  CDS (1)..(1203): transl_table=11

SEQ ID NO: 62696 - protein, 400 aa, Chromobacterium violaceum ATCC 12472; identical to SEQ ID NO: 28371

SEQ ID NO: 62697 - DNA, 1380 bp, Chromobacterium violaceum ATCC 12472; identical to SEQ ID NO: 28372
  CDS (1)..(1380): transl_table=11

SEQ ID NO: 62698 - protein, 459 aa, Chromobacterium violaceum ATCC 12472; identical to SEQ ID NO: 28373

SEQ ID NO: 62699 - DNA, 1284 bp, Chromobacterium violaceum ATCC 12472; identical to SEQ ID NO: 28374
  CDS (1)..(1284): transl_table=11

SEQ ID NO: 62700 - protein, 427 aa, Chromobacterium violaceum ATCC 12472; identical to SEQ ID NO: 28375

SEQ ID NO: 62701 - DNA, 1380 bp, Chromobacterium violaceum ATCC 12472; identical to SEQ ID NO: 28376
  CDS (1)..(1380): transl_table=11

SEQ ID NO: 62702 - protein, 459 aa, Chromobacterium violaceum ATCC 12472; identical to SEQ ID NO: 28377

SEQ ID NO: 62703 - DNA, 1332 bp, Corynebacterium diphtheriae NCTC 13129; identical to SEQ ID NO: 28378
  CDS (1)..(1332): transl_table=11

SEQ ID NO: 62704 - protein, 443 aa, Corynebacterium diphtheriae NCTC 13129; identical to SEQ ID NO: 28379

SEQ ID NO: 62705 - DNA, 1299 bp, Corynebacterium diphtheriae NCTC 13129; identical to SEQ ID NO: 28380
  CDS (1)..(1299): transl_table=11

SEQ ID NO: 62706 - protein, 432 aa, Corynebacterium diphtheriae NCTC 13129; identical to SEQ ID NO: 28381

SEQ ID NO: 62707 - DNA, 1281 bp, Cupriavidus necator; identical to SEQ ID NO: 28382
  CDS (1)..(1281): transl_table=11

SEQ ID NO: 62708 - protein, 426 aa, Cupriavidus necator; identical to SEQ ID NO: 28383

SEQ ID NO: 62709 - DNA, 1395 bp, Cupriavidus necator; identical to SEQ ID NO: 28384
  CDS (1)..(1395): transl_table=11

SEQ ID NO: 62710 - protein, 464 aa, Cupriavidus necator; identical to SEQ ID NO: 28385

SEQ ID NO: 62711 - DNA, 1458 bp, Mycobacterium avium subsp. paratuberculosis K-10; identical to SEQ ID NO: 28386
  CDS (1)..(1458): transl_table=11

SEQ ID NO: 62712 - protein, 485 aa, Mycobacterium avium subsp. paratuberculosis K-10; identical to SEQ ID NO: 28387

SEQ ID NO: 62713 - DNA, 1392 bp, Mycobacterium avium subsp. paratuberculosis K-10; identical to SEQ ID NO: 28388
  CDS (1)..(1392): transl_table=11

SEQ ID NO: 62714 - protein, 463 aa, Mycobacterium avium subsp. paratuberculosis K-10; identical to SEQ ID NO: 28389

SEQ ID NO: 62715 - DNA, 1392 bp, Mycobacterium avium subsp. paratuberculosis K-10; identical to SEQ ID NO: 28390
  CDS (1)..(1392): transl_table=11

SEQ ID NO: 62716 - protein, 463 aa, Mycobacterium avium subsp. paratuberculosis K-10; identical to SEQ ID NO: 28391

SEQ ID NO: 62717 - DNA, 1170 bp, Bacillus anthracis str. Sterne; identical to SEQ ID NO: 28392
  CDS (1)..(1170): transl_table=11

SEQ ID NO: 62718 - protein, 389 aa, Bacillus anthracis str. Sterne; identical to SEQ ID NO: 28393

SEQ ID NO: 62719 - DNA, 1170 bp, Bacillus thuringiensis serovar konkukian str. 97-27; identical to SEQ ID NO: 28394
  CDS (1)..(1170): transl_table=11

SEQ ID NO: 62720 - protein, 389 aa, Bacillus thuringiensis serovar konkukian str. 97-27; identical to SEQ ID NO: 28395

SEQ ID NO: 62721 - DNA, 1170 bp, Staphylococcus aureus subsp. aureus MRSA252; identical to SEQ ID NO: 28396
  CDS (1)..(1170): transl_table=11

SEQ ID NO: 62722 - protein, 389 aa, Staphylococcus aureus subsp. aureus MRSA252; identical to SEQ ID NO: 28397

SEQ ID NO: 62723 - DNA, 1170 bp, Staphylococcus aureus subsp. aureus MSSA476; identical to SEQ ID NO: 28398
  CDS (1)..(1170): transl_table=11

SEQ ID NO: 62724 - protein, 389 aa, Staphylococcus aureus subsp. aureus MSSA476; identical to SEQ ID NO: 28399

SEQ ID NO: 62725 - DNA, 1389 bp, Erwinia carotovora subsp. atroseptica SCRI1043; identical to SEQ ID NO: 28400
  CDS (1)..(1389): transl_table=11

SEQ ID NO: 62726 - protein, 462 aa, Erwinia carotovora subsp. atroseptica SCRI1043; identical to SEQ ID NO: 28401

SEQ ID NO: 62727 - DNA, 1317 bp, Propionibacterium acnes KPA171202; identical to SEQ ID NO: 28402
  CDS (1)..(1317): transl_table=11

SEQ ID NO: 62728 - protein, 438 aa, Propionibacterium acnes KPA171202; identical to SEQ ID NO: 28403

SEQ ID NO: 62729 - DNA, 1206 bp, Bacillus licheniformis ATCC 14580; identical to SEQ ID NO: 28404
  CDS (1)..(1206): transl_table=11

SEQ ID NO: 62730 - protein, 401 aa, Bacillus licheniformis ATCC 14580; identical to SEQ ID NO: 28405

SEQ ID NO: 62731 - DNA, 1185 bp, Bacillus licheniformis ATCC 14580; identical to SEQ ID NO: 28406
  CDS (1)..(1185): transl_table=11

SEQ ID NO: 62732 - protein, 394 aa, Bacillus licheniformis ATCC 14580; identical to SEQ ID NO: 28407

SEQ ID NO: 62733 - DNA, 1230 bp, Burkholderia mallei ATCC 23344; identical to SEQ ID NO: 28408
  CDS (1)..(1230): transl_table=11

SEQ ID NO: 62734 - protein, 409 aa, Burkholderia mallei ATCC 23344; identical to SEQ ID NO: 28409

SEQ ID NO: 62735 - DNA, 1404 bp, Burkholderia mallei ATCC 23344; identical to SEQ ID NO: 28410
  CDS (1)..(1404): transl_table=11

SEQ ID NO: 62736 - protein, 467 aa, Burkholderia mallei ATCC 23344; identical to SEQ ID NO: 28411

SEQ ID NO: 62737 - DNA, 1281 bp, Burkholderia pseudomallei K96243; identical to SEQ ID NO: 28412
  CDS (1)..(1281): transl_table=11

SEQ ID NO: 62738 - protein, 426 aa, Burkholderia pseudomallei K96243; identical to SEQ ID NO: 28413

SEQ ID NO: 62739 - DNA, 1386 bp, Burkholderia pseudomallei K96243; identical to SEQ ID NO: 28414
  CDS (1)..(1386): transl_table=11

SEQ ID NO: 62740 - protein, 461 aa, Burkholderia pseudomallei K96243; identical to SEQ ID NO: 28415

SEQ ID NO: 62741 - DNA, 1458 bp, Burkholderia pseudomallei K96243; identical to SEQ ID NO: 28416
  CDS (1)..(1458): transl_table=11

SEQ ID NO: 62742 - protein, 485 aa, Burkholderia pseudomallei K96243; identical to SEQ ID NO: 28417

SEQ ID NO: 62743 - DNA, 1275 bp, Burkholderia pseudomallei K96243; identical to SEQ ID NO: 28418
  CDS (1)..(1275): transl_table=11

SEQ ID NO: 62744 - protein, 424 aa, Burkholderia pseudomallei K96243; identical to SEQ ID NO: 28419

SEQ ID NO: 62745 - DNA, 1275 bp, Methylococcus capsulatus str. Bath; identical to SEQ ID NO: 28420
  CDS (1)..(1275): transl_table=11

SEQ ID NO: 62746 - protein, 424 aa, Methylococcus capsulatus str. Bath; identical to SEQ ID NO: 28421

SEQ ID NO: 62747 - DNA, 1470 bp, Nocardia farcinica IFM 10152; identical to SEQ ID NO: 28422
  CDS (1)..(1470): transl_table=11

SEQ ID NO: 62748 - protein, 489 aa, Nocardia farcinica IFM 10152; identical to SEQ ID NO: 28423

SEQ ID NO: 62749 - DNA, 1485 bp, Nocardia farcinica IFM 10152; identical to SEQ ID NO: 28424
  CDS (1)..(1485): transl_table=11

SEQ ID NO: 62750 - protein, 494 aa, Nocardia farcinica IFM 10152; identical to SEQ ID NO: 28425

SEQ ID NO: 62751 - DNA, 1323 bp, Haloarcula marismortui ATCC 43049; identical to SEQ ID NO: 28426
  CDS (1)..(1323): transl_table=11

SEQ ID NO: 62752 - protein, 440 aa, Haloarcula marismortui ATCC 43049; identical to SEQ ID NO: 28427

SEQ ID NO: 62753 - DNA, 1200 bp, Geobacillus kaustophilus HTA426; identical to SEQ ID NO: 28428
  CDS (1)..(1200): transl_table=11

SEQ ID NO: 62754 - protein, 399 aa, Geobacillus kaustophilus HTA426; identical to SEQ ID NO: 28429

SEQ ID NO: 62755 - DNA, 1203 bp, Geobacillus kaustophilus HTA426; identical to SEQ ID NO: 28430
  CDS (1)..(1203): transl_table=11

SEQ ID NO: 62756 - protein, 400 aa, Geobacillus kaustophilus HTA426; identical to SEQ ID NO: 28431

SEQ ID NO: 62757 - DNA, 1389 bp, Salmonella enterica subsp. enterica serovar Paratyphi A str. ATCC; identical to SEQ ID NO: 28432
  CDS (1)..(1389): transl_table=11

SEQ ID NO: 62758 - protein, 462 aa, Salmonella enterica subsp. enterica serovar Paratyphi A str. ATCC; identical to SEQ ID NO: 28433

SEQ ID NO: 62759 - DNA, 1332 bp, Idiomarina loihiensis L2TR; identical to SEQ ID NO: 28434
  CDS (1)..(1332): transl_table=11

SEQ ID NO: 62760 - protein, 443 aa, Idiomarina loihiensis L2TR; identical to SEQ ID NO: 28435

SEQ ID NO: 62761 - DNA, 1692 bp, Azoarcus sp. EbN1; identical to SEQ ID NO: 28436
  CDS (1)..(1692): transl_table=11

SEQ ID NO: 62762 - protein, 563 aa, Azoarcus sp. EbN1; identical to SEQ ID NO: 28437

SEQ ID NO: 62763 - DNA, 1377 bp, Azoarcus sp. EbN1; identical to SEQ ID NO: 28438
  CDS (1)..(1377): transl_table=11

SEQ ID NO: 62764 - protein, 458 aa, Azoarcus sp. EbN1; identical to SEQ ID NO: 28439

SEQ ID NO: 62765 - DNA, 1509 bp, Bacillus clausii KSM-K16; identical to SEQ ID NO: 28440
  CDS (1)..(1509): transl_table=11

SEQ ID NO: 62766 - protein, 502 aa, Bacillus clausii KSM-K16; identical to SEQ ID NO: 28441

SEQ ID NO: 62767 - DNA, 1206 bp, Bacillus clausii KSM-K16; identical to SEQ ID NO: 28442
  CDS (1)..(1206): transl_table=11

SEQ ID NO: 62768 - protein, 401 aa, Bacillus clausii KSM-K16; identical to SEQ ID NO: 28443

SEQ ID NO: 62769 - DNA, 1164 bp, Staphylococcus epidermidis RP62A; identical to SEQ ID NO: 28444
  CDS (1)..(1164): transl_table=11

SEQ ID NO: 62770 - protein, 387 aa, Staphylococcus epidermidis RP62A; identical to SEQ ID NO: 28445

SEQ ID NO: 62771 - DNA, 1389 bp, Salmonella enterica subsp. enterica serovar Choleraesuis str; identical to SEQ ID NO: 28446
  CDS (1)..(1389): transl_table=11

SEQ ID NO: 62772 - protein, 462 aa, Salmonella enterica subsp. enterica serovar Choleraesuis str; identical to SEQ ID NO: 28447

SEQ ID NO: 62773 - DNA, 1212 bp, Pseudomonas syringae pv. syringae B728a; identical to SEQ ID NO: 28448
  CDS (1)..(1212): transl_table=11

SEQ ID NO: 62774 - protein, 403 aa, Pseudomonas syringae pv. syringae B728a; identical to SEQ ID NO: 28449

SEQ ID NO: 62775 - DNA, 1158 bp, Staphylococcus haemolyticus JCSC1435; identical to SEQ ID NO: 28450
  CDS (1)..(1158): transl_table=11

SEQ ID NO: 62776 - protein, 385 aa, Staphylococcus haemolyticus JCSC1435; identical to SEQ ID NO: 28451

SEQ ID NO: 62777 - DNA, 1380 bp, Psychrobacter arcticum 273-4; identical to SEQ ID NO: 28452
  CDS (1)..(1380): transl_table=11

SEQ ID NO: 62778 - protein, 459 aa, Psychrobacter arcticum 273-4; identical to SEQ ID NO: 28453

SEQ ID NO: 62779 - DNA, 1212 bp, Pseudomonas syringae pv. phaseolicola 1448A; identical to SEQ ID NO: 28454
  CDS (1)..(1212): transl_table=11

SEQ ID NO: 62780 - protein, 403 aa, Pseudomonas syringae pv. phaseolicola 1448A; identical to SEQ ID NO: 28455

SEQ ID NO: 62781 - DNA, 1215 bp, Dechloromonas aromatica RCB; identical to SEQ ID NO: 28456
  CDS (1)..(1215): transl_table=11

SEQ ID NO: 62782 - protein, 404 aa, Dechloromonas aromatica RCB; identical to SEQ ID NO: 28457

SEQ ID NO: 62783 - DNA, 1290 bp, Ralstonia eutropha JMP134; identical to SEQ ID NO: 28458
  CDS (1)..(1290): transl_table=11

SEQ ID NO: 62784 - protein, 429 aa, Ralstonia eutropha JMP134; identical to SEQ ID NO: 28459

SEQ ID NO: 62785 - DNA, 1386 bp, Ralstonia eutropha JMP134; identical to SEQ ID NO: 28460
  CDS (1)..(1386): transl_table=11

SEQ ID NO: 62786 - protein, 461 aa, Ralstonia eutropha JMP134; identical to SEQ ID NO: 28461

SEQ ID NO: 62787 - DNA, 1362 bp, Shigella sonnei Ss046; identical to SEQ ID NO: 28462
  CDS (1)..(1362): transl_table=11

SEQ ID NO: 62788 - protein, 453 aa, Shigella sonnei Ss046; identical to SEQ ID NO: 28463

SEQ ID NO: 62789 - DNA, 1269 bp, Thiobacillus denitrificans ATCC 25259; identical to SEQ ID NO: 28464
  CDS (1)..(1269): transl_table=11

SEQ ID NO: 62790 - protein, 422 aa, Thiobacillus denitrificans ATCC 25259; identical to SEQ ID NO: 28465

SEQ ID NO: 62791 - DNA, 1677 bp, Thiobacillus denitrificans ATCC 25259; identical to SEQ ID NO: 28466
  CDS (1)..(1677): transl_table=11

SEQ ID NO: 62792 - protein, 558 aa, Thiobacillus denitrificans ATCC 25259; identical to SEQ ID NO: 28467

SEQ ID NO: 62793 - DNA, 1263 bp, Magnetospirillum magnetotacticum MS-1; identical to SEQ ID NO: 28468
  CDS (1)..(1263)

SEQ ID NO: 62794 - protein, 420 aa, Magnetospirillum magnetotacticum MS-1; identical to SEQ ID NO: 28469

SEQ ID NO: 62795 - DNA, 1407 bp, Pseudomonas aeruginosa UCBPP-PA14; identical to SEQ ID NO: 28470
  CDS (1)..(1407)

SEQ ID NO: 62796 - protein, 468 aa, Pseudomonas aeruginosa UCBPP-PA14; identical to SEQ ID NO: 28471

SEQ ID NO: 62797 - DNA, 1326 bp, Burkholderia cepacia R18194; identical to SEQ ID NO: 28472
  CDS (1)..(1326)

SEQ ID NO: 62798 - protein, 441 aa, Burkholderia cepacia R18194; identical to SEQ ID NO: 28473

SEQ ID NO: 62799 - DNA, 1326 bp, Burkholderia cenocepacia AU 1054; identical to SEQ ID NO: 28474
  CDS (1)..(1326): transl_table=11

SEQ ID NO: 62800 - protein, 441 aa, Burkholderia cenocepacia AU 1054; identical to SEQ ID NO: 28475

SEQ ID NO: 62801 - DNA, 1407 bp, Burkholderia pseudomallei S13; identical to SEQ ID NO: 28476
  CDS (1)..(1407)

SEQ ID NO: 62802 - protein, 468 aa, Burkholderia pseudomallei S13; identical to SEQ ID NO: 28477

SEQ ID NO: 62803 - DNA, 1212 bp, Polaromonas sp. JS666; identical to SEQ ID NO: 28478
  CDS (1)..(1212): transl_table=11

SEQ ID NO: 62804 - protein, 403 aa, Polaromonas sp. JS666; identical to SEQ ID NO: 28479

SEQ ID NO: 62805 - DNA, 1320 bp, Geobacter metallireducens GS-15; identical to SEQ ID NO: 28480
  CDS (1)..(1320): transl_table=11

SEQ ID NO: 62806 - protein, 439 aa, Geobacter metallireducens GS-15; identical to SEQ ID NO: 28481

SEQ ID NO: 62807 - DNA, 1230 bp, Nitrobacter hamburgensis X14; identical to SEQ ID NO: 28482
  CDS (1)..(1230): transl_table=11

SEQ ID NO: 62808 - protein, 409 aa, Nitrobacter hamburgensis X14; identical to SEQ ID NO: 28483

SEQ ID NO: 62809 - DNA, 1209 bp, Paracoccus denitrificans PD1222; identical to SEQ ID NO: 28484
  CDS (1)..(1209): transl_table=11

SEQ ID NO: 62810 - protein, 402 aa, Paracoccus denitrificans PD1222; identical to SEQ ID NO: 28485

SEQ ID NO: 62811 - DNA, 1401 bp, Pseudomonas aeruginosa; identical to SEQ ID NO: 28486
  CDS (1)..(1401): transl_table=11

SEQ ID NO: 62812 - protein, 466 aa, Pseudomonas aeruginosa; identical to SEQ ID NO: 28487

SEQ ID NO: 62813 - DNA, 1416 bp, Mycobacterium fortuitum; identical to SEQ ID NO: 28488
  CDS (1)..(1416): transl_table=11

SEQ ID NO: 62814 - protein, 471 aa, Mycobacterium fortuitum; identical to SEQ ID NO: 28489

SEQ ID NO: 62815 - DNA, 1527 bp, Populus tremula x Populus tremuloides; identical to SEQ ID NO: 28490
  CDS (1)..(1527)

SEQ ID NO: 62816 - protein, 508 aa, Populus tremula x Populus tremuloides; identical to SEQ ID NO: 28491

SEQ ID NO: 62817 - DNA, 1602 bp, Pseudomonas sp; identical to SEQ ID NO: 28492
  CDS (1)..(1602): transl_table=11

SEQ ID NO: 62818 - protein, 533 aa, Pseudomonas sp; identical to SEQ ID NO: 28493

SEQ ID NO: 62819 - DNA, 1302 bp, Halomonas maura; identical to SEQ ID NO: 28494
  CDS (1)..(1302): transl_table=11

SEQ ID NO: 62820 - protein, 433 aa, Halomonas maura; identical to SEQ ID NO: 28495

SEQ ID NO: 62821 - DNA, 1254 bp, Rhizobium sp; identical to SEQ ID NO: 28496
  CDS (1)..(1254): transl_table=11

SEQ ID NO: 62822 - protein, 417 aa, Rhizobium sp; identical to SEQ ID NO: 28497

SEQ ID NO: 62823 - DNA, 1311 bp, Halobacterium mediterranei; identical to SEQ ID NO: 28498
  CDS (1)..(1311): transl_table=11

SEQ ID NO: 62824 - protein, 436 aa, Halobacterium mediterranei; identical to SEQ ID NO: 28499

SEQ ID NO: 62825 - DNA, 1650 bp, Physcomitrella patens; identical to SEQ ID NO: 28500
  CDS (1)..(1650)

SEQ ID NO: 62826 - protein, 549 aa, Physcomitrella patens; identical to SEQ ID NO: 28501

SEQ ID NO: 62827 - DNA, 1353 bp, Corynebacterium glutamicum; identical to SEQ ID NO: 28502
  CDS (1)..(1353): transl_table=11

SEQ ID NO: 62828 - protein, 450 aa, Corynebacterium glutamicum; identical to SEQ ID NO: 28503

SEQ ID NO: 62829 - DNA, 1284 bp, Paracoccus halodenitrificans; identical to SEQ ID NO: 28504
  CDS (1)..(1284): transl_table=11

SEQ ID NO: 62830 - protein, 427 aa, Paracoccus halodenitrificans; identical to SEQ ID NO: 28505

SEQ ID NO: 62831 - DNA, 1593 bp, Paracoccus halodenitrificans; identical to SEQ ID NO: 28506
  CDS (1)..(1593): transl_table=11

SEQ ID NO: 62832 - protein, 530 aa, Paracoccus halodenitrificans; identical to SEQ ID NO: 28507

SEQ ID NO: 62833 - DNA, 2718 bp, Paracoccus pantotrophus; identical to SEQ ID NO: 28508
  CDS (1)..(2718): transl_table=11

SEQ ID NO: 62834 - protein, 905 aa, Paracoccus pantotrophus; identical to SEQ ID NO: 28509

SEQ ID NO: 62835 - DNA, 1266 bp, Pseudomonas fluorescens; identical to SEQ ID NO: 28510
  CDS (1)..(1266): transl_table=11

SEQ ID NO: 62836 - protein, 421 aa, Pseudomonas fluorescens; identical to SEQ ID NO: 28511

SEQ ID NO: 62837 - DNA, 1332 bp, Thermus thermophilus; identical to SEQ ID NO: 28512
  CDS (1)..(1332): transl_table=11

SEQ ID NO: 62838 - protein, 443 aa, Thermus thermophilus; identical to SEQ ID NO: 28513

SEQ ID NO: 62839 - DNA, 1308 bp, Thermus thermophilus; identical to SEQ ID NO: 28514
  CDS (1)..(1308): transl_table=11

SEQ ID NO: 62840 - protein, 435 aa, Thermus thermophilus; identical to SEQ ID NO: 28515

SEQ ID NO: 62841 - DNA, 1449 bp, Cylindrotheca fusiformis; identical to SEQ ID NO: 28516
  CDS (1)..(1449)

SEQ ID NO: 62842 - protein, 482 aa, Cylindrotheca fusiformis; identical to SEQ ID NO: 28517

SEQ ID NO: 62843 - DNA, 1449 bp, Cylindrotheca fusiformis; identical to SEQ ID NO: 28518
  CDS (1)..(1449)

SEQ ID NO: 62844 - protein, 482 aa, Cylindrotheca fusiformis; identical to SEQ ID NO: 28519

SEQ ID NO: 62845 - DNA, 1449 bp, Cylindrotheca fusiformis; identical to SEQ ID NO: 28520
  CDS (1)..(1449)

SEQ ID NO: 62846 - protein, 482 aa, Cylindrotheca fusiformis; identical to SEQ ID NO: 28521

SEQ ID NO: 62847 - DNA, 1212 bp, Pseudomonas aeruginosa; identical to SEQ ID NO: 28522
  CDS (1)..(1212): transl_table=11

SEQ ID NO: 62848 - protein, 403 aa, Pseudomonas aeruginosa; identical to SEQ ID NO: 28523

SEQ ID NO: 62849 - DNA, 1389 bp, Escherichia coli; identical to SEQ ID NO: 28524
  CDS (1)..(1389): transl_table=11

SEQ ID NO: 62850 - protein, 462 aa, Escherichia coli; identical to SEQ ID NO: 28525

SEQ ID NO: 62851 - DNA, 1389 bp, Salmonella typhimurium; identical to SEQ ID NO: 28526
  CDS (1)..(1389): transl_table=11

SEQ ID NO: 62852 - protein, 462 aa, Salmonella typhimurium; identical to SEQ ID NO: 28527

SEQ ID NO: 62853 - DNA, 1266 bp, Bacillus subtilis; identical to SEQ ID NO: 28528
  CDS (1)..(1266): transl_table=11

SEQ ID NO: 62854 - protein, 421 aa, Bacillus subtilis; identical to SEQ ID NO: 28529

SEQ ID NO: 62855 - DNA, 21 bp, Artificial sequence
  (1)..(21): primer
atgagtcactcatccgccccc

SEQ ID NO: 62856 - DNA, 27 bp, Artificial sequence
  (1)..(27): primer
ttattttttagaatgccgaccatatac

SEQ ID NO: 62857 - protein, 512 aa, Artificial sequence; identical to SEQ ID NO: 28532
  Variant (2)..(9): xaa in position 2 to 9 is any amino acid
  Variant (11)..(11): xaa in position 11 is any amino acid
  Variant (13)..(13): xaa in position 13 is any amino acid
  Variant (16)..(16): xaa in position 16 is any amino acid
  Variant (18)..(22): xaa in position 18 to 22 is any amino acid
  Variant (23)..(24): xaa in position 23 to 24 is any or no amino acid
  Variant (26)..(38): xaa in position 26 to 38 is any amino acid
  Variant (39)..(49): xaa in position 39 to 49 is any or no amino acid
  Variant (51)..(51): xaa in position 51 is any amino acid
  Variant (53)..(54): xaa in position 53 to 54 is any amino acid
  Variant (55)..(55): xaa in position 55 is any or no amino acid
  Variant (57)..(57): xaa in position 57 is any amino acid
  Variant (60)..(60): xaa in position 60 is any amino acid
  Variant (64)..(72): xaa in position 64 to 72 is any amino acid
  Variant (74)..(74): xaa in position 74 is any amino acid
  Variant (76)..(86): xaa in position 76 to 86 is any amino acid
  Variant (88)..(101): xaa in position 88 to 101 is any amino acid
  Variant (102)..(110): xaa in position 102 to 110 is any or no amino acid
  Variant (112)..(112): xaa in position 112 is any amino acid
  Variant (113)..(113): xaa in position 113 is any or no amino acid
  Variant (115)..(117): xaa in position 115 to 117 is any amino acid
  Variant (119)..(119): xaa in position 119 is any amino acid
  Variant (123)..(123): xaa in position 123 is any amino acid
  Variant (126)..(127): xaa in position 126 to 127 is any amino acid
  Variant (129)..(133): xaa in position 129 to 133 is any amino acid
  Variant (137)..(140): xaa in position 137 to 140 is any amino acid
  Variant (142)..(142): xaa in position 142 is any amino acid
  Variant (144)..(144): xaa in position 144 is any amino acid
  Variant (147)..(147): xaa in position 147 is any amino acid
  Variant (150)..(150): xaa in position 150 is any amino acid
  Variant (151)..(151): xaa in position 151 is any or no amino acid
  Variant (153)..(153): xaa in position 153 is any amino acid
  Variant (155)..(156): xaa in position 155 to 156 is any amino acid
  Variant (158)..(162): xaa in position 158 to 162 is any amino acid
  Variant (164)..(164): xaa in position 164 is any or no amino acid
  Variant (166)..(181): xaa in position 166 to 181 is any amino acid
  Variant (182)..(210): xaa in position 182 to 210 is any or no amino acid
  Variant (212)..(212): xaa in position 212 is any amino acid
  Variant (214)..(215): xaa in position 214 to 215 is any amino acid
  Variant (217)..(243): xaa in position 217 to 243 is any amino acid
  Variant (244)..(314): xaa in position 244 to 314 is any or no amino acid
  Variant (316)..(320): xaa in position 316 to 320 is any amino acid
  Variant (322)..(324): xaa in position 322 to 324 is any amino acid
  Variant (327)..(327): xaa in position 327 is any amino acid
  Variant (331)..(342): xaa in position 331 to 342 is any amino acid
  Variant (344)..(357): xaa in position 344 to 357 is any amino acid
  Variant (358)..(377): xaa in position 358 to 377 is any or no amino acid
  Variant (379)..(381): xaa in position 379 to 381 is any amino acid
  Variant (383)..(384): xaa in position 383 to 384 is any amino acid
  Variant (387)..(387): xaa in position 387 is any amino acid
  Variant (392)..(392): xaa in position 392 is any amino acid
  Variant (395)..(432): xaa in position 395 to 432 is any amino acid
  Variant (433)..(455): xaa in position 433 to 455 is any or no amino acid
  Variant (457)..(457): xaa in position 457 is any amino acid
  Variant (459)..(459): xaa in position 459 is any amino acid
  Variant (462)..(462): xaa in position 462 is any amino acid
  Variant (464)..(465): xaa in position 464 to 465 is any amino acid
  Variant (467)..(469): xaa in position 467 to 469 is any amino acid
  Variant (471)..(474): xaa in position 471 to 474 is any amino acid
  Variant (475)..(497): xaa in position 475 to 497 is any or no amino acid
  Variant (499)..(501): xaa in position 499 to 501 is any amino acid
  Variant (503)..(507): xaa in position 503 to 507 is any amino acid
  Variant (510)..(510): xaa in position 510 is any amino acid

SEQ ID NO: 62858 - protein, 19 aa, Artificial sequence
  Variant (2)..(10): xaa in position 2 to 10 is any amino acid
  Variant (11)..(11): xaa in position 11 is any or no amino acid
  Variant (13)..(13): xaa in position 13 is any amino acid
  Variant (14)..(14): xaa in position 14 is Ala, Ile or Val
  Variant (16)..(16): xaa in position 16 is any amino acid
  Variant (17)..(17): xaa in position 17 is Ile, Leu, Met or Val
  Variant (18)..(18): xaa in position 18 is any amino acid
  Variant (19)..(19): xaa in position 19 is Ala, Gly or Ser
LXXXXXXXXXXFXXWXXXX

SEQ ID NO: 62859 - protein, 45 aa, Artificial sequence; identical to SEQ ID NO: 28534
  Variant (2)..(3): xaa in position 2 to 3 is any amino acid
  Variant (4)..(4): xaa in position 4 is any or no amino acid
  Variant (6)..(6): xaa in position 6 is Ala, Gly or Thr
  Variant (7)..(7): xaa in position 7 is any amino acid
  Variant (9)..(9): xaa in position 9 is Ala, Gly or Ser
  Variant (10)..(12): xaa in position 10 to 12 is any amino acid
  Variant (13)..(13): xaa in position 13 is Ala, Gly, Pro, Ser or Thr
  Variant (14)..(15): xaa in position 14 to 15 is any amino acid
  Variant (16)..(16): xaa in position 16 is Ala, Gly, Asn, Pro or Ser
  Variant (17)..(18): xaa in position 17 to 18 is any amino acid
  Variant (19)..(19): xaa in position 19 is Phe, His or Tyr
  Variant (20)..(24): xaa in position 20 to 24 is any amino acid
  Variant (26)..(26): xaa in position 26 is any amino acid
  Variant (27)..(27): xaa in position 27 is Ala, Ser or Val
  Variant (28)..(28): xaa in position 28 is any amino acid
  Variant (30)..(31): xaa in position 30 to 31 is any amino acid
  Variant (32)..(33): xaa in position 32 to 33 is any or no amino acid
  Variant (35)..(38): xaa in position 35 to 38 is any amino acid
  Variant (39)..(39): xaa in position 39 is Ala, Gly or Val
  Variant (40)..(44): xaa in position 40 to 44 is any amino acid
  Variant (45)..(45): xaa in position 45 is Phe, Ile, Leu or Val

SEQ ID NO: 62860 - protein, 24 aa, Artificial sequence
  Variant (2)..(3): xaa in position 2 to 3 is any amino acid
  Variant (4)..(4): xaa in position 4 is any or no amino acid
  Variant (6)..(6): xaa in position 6 is any or no amino acid
  Variant (8)..(8): xaa in position 8 is Ala, Gly or Ser
  Variant (9)..(9): xaa in position 9 is Phe or Tyr
  Variant (10)..(10): xaa in position 10 is Ala, Ile or Val
  Variant (11)..(11): xaa in position 11 is Ala or Gly
  Variant (12)..(12): xaa in position 12 is any amino acid
  Variant (13)..(13): xaa in position 13 is Ala, Gly, Ser or Thr
  Variant (14)..(15): xaa in position 14 to 15 is any amino acid
  Variant (16)..(16): xaa in position 16 is Phe, Leu, Met or Val
  Variant (17)..(17): xaa in position 17 is Ala, Gly, Pro, Ser or Thr
  Variant (18)..(23): xaa in position 18 to 23 is any amino acid
  Variant (24)..(24): xaa in position 24 is Phe or Tyr
YXXXFXGXXXXXXXXXXXXXXXXX

SEQ ID NO: 62861 - protein, 33 aa, Artificial sequence; identical to SEQ ID NO: 28536
  Variant (2)..(19): xaa in position 2 to 19 is any amino acid
  Variant (20)..(22): xaa in position 20 to 22 is any or no amino acid
  Variant (24)..(24): xaa in position 24 is Phe, Ile, Leu, Met or Val
  Variant (25)..(25): xaa in position 25 is any amino acid
  Variant (26)..(26): xaa in position 26 is Ala, Gly or Ser
  Variant (27)..(28): xaa in position 27 to 28 is any amino acid
  Variant (30)..(30): xaa in position 30 is Ala, Cys, Gly, Asn, Ser or Thr
  Variant (31)..(31): xaa in position 31 is any amino acid
  Variant (33)..(33): xaa in position 33 is Ala, Gly, Pro or Ser

SEQ ID NO: 62862 - DNA, 990 bp, Escherichia coli; identical to SEQ ID NO: 31211
  CDS (1)..(990)

SEQ ID NO: 62863 - protein, 329 aa, Escherichia coli; identical to SEQ ID NO: 31212

SEQ ID NO: 62864 - DNA, 978 bp, Xenopus tropicalis; identical to SEQ ID NO: 31213
  CDS (1)..(978)

SEQ ID NO: 62865 - protein, 325 aa, Xenopus tropicalis; identical to SEQ ID NO: 31214

SEQ ID NO: 62866 - DNA, 1773 bp, Cryptococcus neoformans var. neoformans JEC21; identical to SEQ ID NO: 31215
  CDS (1)..(1773)

SEQ ID NO: 62867 - protein, 590 aa, Cryptococcus neoformans var. neoformans JEC21; identical to SEQ ID NO: 31216

SEQ ID NO: 62868 - DNA, 996 bp, Cryptococcus neoformans var. neoformans JEC21; identical to SEQ ID NO: 31217
  CDS (1)..(996)

SEQ ID NO: 62869 - protein, 331 aa, Cryptococcus neoformans var. neoformans JEC21; identical to SEQ ID NO: 31218

SEQ ID NO: 62870 - DNA, 1146 bp, Thermococcus kodakaraensis; identical to SEQ ID NO: 31219
  CDS (1)..(1146)

SEQ ID NO: 62871 - protein, 381 aa, Thermococcus kodakaraensis; identical to SEQ ID NO: 31220

SEQ ID NO: 62872 - DNA, 1269 bp, Staphylococcus aureus subsp. aureus COL; identical to SEQ ID NO: 31221
  CDS (1)..(1269)

SEQ ID NO: 62873 - protein, 422 aa, Staphylococcus aureus subsp. aureus COL; identical to SEQ ID NO: 31222

SEQ ID NO: 62874 - DNA, 1104 bp, Staphylococcus epidermidis RP62A; identical to SEQ ID NO: 31223
  CDS (40)..(1104)

SEQ ID NO: 62875 - protein, 354 aa, Staphylococcus epidermidis RP62A; identical to SEQ ID NO: 31224

SEQ ID NO: 62876 - DNA, 1269 bp, Staphylococcus epidermidis RP62A; identical to SEQ ID NO: 31225
  CDS (1)..(1269)

SEQ ID NO: 62877 - protein, 422 aa, Staphylococcus epidermidis RP62A; identical to SEQ ID NO: 31226

SEQ ID NO: 62878 - DNA, 1227 bp, Gluconobacter oxydans 621H; identical to SEQ ID NO: 31227
  CDS (1)..(1227)

SEQ ID NO: 62879 - protein, 408 aa, Gluconobacter oxydans 621H; identical to SEQ ID NO: 31228

SEQ ID NO: 62880 - DNA, 1071 bp, Xanthomonas oryzae pv. oryzae KACC10331; identical to SEQ ID NO: 31229
  CDS (1)..(1071)

SEQ ID NO: 62881 - protein, 356 aa, Xanthomonas oryzae pv. oryzae KACC10331; identical to SEQ ID NO: 31230

SEQ ID NO: 62882 - DNA, 897 bp, Xanthomonas oryzae pv. oryzae KACC10331; identical to SEQ ID NO: 31231
  CDS (1)..(897)

SEQ ID NO: 62883 - protein, 298 aa, Xanthomonas oryzae pv. oryzae KACC10331; identical to SEQ ID NO: 31232

SEQ ID NO: 62884 - DNA, 1131 bp, Vibrio fischeri ES114; identical to SEQ ID NO: 31233
  CDS (1)..(1131)

SEQ ID NO: 62885 - protein, 376 aa, Vibrio fischeri ES114; identical to SEQ ID NO: 31234

SEQ ID NO: 62886 - DNA, 1527 bp, Neisseria gonorrhoeae FA 1090; identical to SEQ ID NO: 31235
  CDS (1)..(1527)

SEQ ID NO: 62887 - protein, 508 aa, Neisseria gonorrhoeae FA 1090; identical to SEQ ID NO: 31236

SEQ ID NO: 62888 - DNA, 1302 bp, Mesorhizobium loti MAFF303099; identical to SEQ ID NO: 31237
  CDS (1)..(1302): transl_table=11

SEQ ID NO: 62889 - protein, 433 aa, Mesorhizobium loti MAFF303099; identical to SEQ ID NO: 31238

SEQ ID NO: 62890 - DNA, 942 bp, Mesorhizobium loti MAFF303099; identical to SEQ ID NO: 31239
  CDS (1)..(942): transl_table=11

SEQ ID NO: 62891 - protein, 313 aa, Mesorhizobium loti MAFF303099; identical to SEQ ID NO: 31240

SEQ ID NO: 62892 - DNA, 984 bp, Mesorhizobium loti MAFF303099; identical to SEQ ID NO: 31241
  CDS (1)..(984): transl_table=11

SEQ ID NO: 62893 - protein, 327 aa, Mesorhizobium loti MAFF303099; identical to SEQ ID NO: 31242

SEQ ID NO: 62894 - DNA, 1059 bp, Mesorhizobium loti MAFF303099; identical to SEQ ID NO: 31243
  CDS (1)..(1059): transl_table=11

SEQ ID NO: 62895 - protein, 352 aa, Mesorhizobium loti MAFF303099; identical to SEQ ID NO: 31244

SEQ ID NO: 62896 - DNA, 1005 bp, Mesorhizobium loti MAFF303099; identical to SEQ ID NO: 31245
  CDS (1)..(1005): transl_table=11

SEQ ID NO: 62897 - protein, 334 aa, Mesorhizobium loti MAFF303099; identical to SEQ ID NO: 31246

SEQ ID NO: 62898 - DNA, 1221 bp, Thermoplasma volcanium GSS1; identical to SEQ ID NO: 31247
  CDS (1)..(1221): transl_table=11

SEQ ID NO: 62899 - protein, 406 aa, Thermoplasma volcanium GSS1; identical to SEQ ID NO: 31248

SEQ ID NO: 62900 - DNA, 1320 bp, Pyrococcus abyssi GE5; identical to SEQ ID NO: 31249
  CDS (1)..(1320): transl_table=11

SEQ ID NO: 62901 - protein, 439 aa, Pyrococcus abyssi GE5; identical to SEQ ID NO: 31250

SEQ ID NO: 62902 - DNA, 1185 bp, Pyrococcus abyssi GE5; identical to SEQ ID NO: 31251
  CDS (1)..(1185): transl_table=11

SEQ ID NO: 62903 - protein, 394 aa, Pyrococcus abyssi GE5; identical to SEQ ID NO: 31252

SEQ ID NO: 62904 - DNA, 1185 bp, Pyrococcus horikoshii OT3; identical to SEQ ID NO: 31253
  CDS (1)..(1185): transl_table=11

SEQ ID NO: 62905 - protein, 394 aa, Pyrococcus horikoshii OT3; identical to SEQ ID NO: 31254

SEQ ID NO: 62906 - DNA, 1323 bp, Pyrococcus horikoshii OT3; identical to SEQ ID NO: 31255
  CDS (1)..(1323): transl_table=11

SEQ ID NO: 62907 - protein, 440 aa, Pyrococcus horikoshii OT3; identical to SEQ ID NO: 31256

SEQ ID NO: 62908 - DNA, 1050 bp, Aeropyrum pernix K1; identical to SEQ ID NO: 31257
  CDS (1)..(1050): transl_table=11

SEQ ID NO: 62909 - protein, 349 aa, Aeropyrum pernix K1; identical to SEQ ID NO: 31258

SEQ ID NO: 62910 - DNA, 1182 bp, Aeropyrum pernix K1; identical to SEQ ID NO: 31259
  CDS (1)..(1182): transl_table=11

SEQ ID NO: 62911 - protein, 393 aa, Aeropyrum pernix K1; identical to SEQ ID NO: 31260

SEQ ID NO: 62912 - DNA, 1041 bp, Arabidopsis thaliana; identical to SEQ ID NO: 31261
  CDS (1)..(1041)

SEQ ID NO: 62913 - protein, 346 aa, Arabidopsis thaliana; identical to SEQ ID NO: 31262

SEQ ID NO: 62914 - DNA, 1059 bp, Aquifex aeolicus VF5; identical to SEQ ID NO: 31263
  CDS (1)..(1059): transl_table=11

SEQ ID NO: 62915 - protein, 352 aa, Aquifex aeolicus VF5; identical to SEQ ID NO: 31264

SEQ ID NO: 62916 - DNA, 1002 bp, Rickettsia prowazekii str. Madrid E; identical to SEQ ID NO: 31265
  CDS (1)..(1002): transl_table=11

SEQ ID NO: 62917 - protein, 333 aa, Rickettsia prowazekii str. Madrid E; identical to SEQ ID NO: 31266

SEQ ID NO: 62918 - DNA, 1206 bp, Thermotoga maritima MSB8; identical to SEQ ID NO: 31267
  CDS (1)..(1206): transl_table=11

SEQ ID NO: 62919 - protein, 401 aa, Thermotoga maritima MSB8; identical to SEQ ID NO: 31268

SEQ ID NO: 62920 - DNA, 1515 bp, Pseudomonas aeruginosa PAO1; identical to SEQ ID NO: 31269
  CDS (1)..(1515): transl_table=11

SEQ ID NO: 62921 - protein, 504 aa, Pseudomonas aeruginosa PAO1; identical to SEQ ID NO: 31270

SEQ ID NO: 62922 - DNA, 963 bp, Pseudomonas aeruginosa PAO1; identical to SEQ ID NO: 31271
  CDS (1)..(963): transl_table=11

SEQ ID NO: 62923 - protein, 320 aa, Pseudomonas aeruginosa PAO1; identical to SEQ ID NO: 31272

SEQ ID NO: 62924 - DNA, 1548 bp, Pseudomonas aeruginosa PAO1; identical to SEQ ID NO: 31273
  CDS (1)..(1548): transl_table=11

SEQ ID NO: 62925 - protein, 515 aa, Pseudomonas aeruginosa PAO1; identical to SEQ ID NO: 31274

SEQ ID NO: 62926 - DNA, 1527 bp, Neisseria meningitidis MC58; identical to SEQ ID NO: 31275
  CDS (1)..(1527): transl_table=11

SEQ ID NO: 62927 - protein, 508 aa, Neisseria meningitidis MC58; identical to SEQ ID NO: 31276

SEQ ID NO: 62928 - DNA, 1221 bp, Methanothermobacter thermautotrophicus str. Delta H; identical to SEQ ID NO: 31277
  CDS (1)..(1221): transl_table=11

SEQ ID NO: 62929 - protein, 406 aa, Methanothermobacter thermautotrophicus str. Delta H; identical to SEQ ID NO: 31278

SEQ ID NO: 62930 - DNA, 1488 bp, Halobacterium salinarum NRC-1; identical to SEQ ID NO: 31279
  CDS (1)..(1488): transl_table=11

SEQ ID NO: 62931 - protein, 495 aa, Halobacterium salinarum NRC-1; identical to SEQ ID NO: 31280

SEQ ID NO: 62932 - DNA, 1527 bp, Neisseria meningitidis Z2491; identical to SEQ ID NO: 31281
  CDS (1)..(1527): transl_table=11

SEQ ID NO: 62933 - protein, 508 aa, Neisseria meningitidis Z2491; identical to SEQ ID NO: 31282

SEQ ID NO: 62934 - DNA, 1707 bp, Deinococcus radiodurans R1; identical to SEQ ID NO: 31283
  CDS (1)..(1707): transl_table=11

SEQ ID NO: 62935 - protein, 568 aa, Deinococcus radiodurans R1; identical to SEQ ID NO: 31284

SEQ ID NO: 62936 - DNA, 1143 bp, Xylella fastidiosa 9a5c; identical to SEQ ID NO: 31285
  CDS (1)..(1143): transl_table=11

SEQ ID NO: 62937 - protein, 380 aa, Xylella fastidiosa 9a5c; identical to SEQ ID NO: 31286

SEQ ID NO: 62938 - DNA, 1218 bp, Sulfolobus solfataricus P2; identical to SEQ ID NO: 31287
  CDS (1)..(1218): transl_table=11

SEQ ID NO: 62939 - protein, 405 aa, Sulfolobus solfataricus P2; identical to SEQ ID NO: 31288

SEQ ID NO: 62940 - DNA, 1038 bp, Sulfolobus solfataricus P2; identical to SEQ ID NO: 31289
  CDS (1)..(1038): transl_table=11

SEQ ID NO: 62941 - protein, 345 aa, Sulfolobus solfataricus P2; identical to SEQ ID NO: 31290

SEQ ID NO: 62942 - DNA, 1191 bp, Sulfolobus solfataricus P2; identical to SEQ ID NO: 31291
  CDS (1)..(1191): transl_table=11

SEQ ID NO: 62943 - protein, 396 aa, Sulfolobus solfataricus P2; identical to SEQ ID NO: 31292

SEQ ID NO: 62944 - DNA, 1251 bp, Streptococcus pneumoniae TIGR4; identical to SEQ ID NO: 31293
  CDS (1)..(1251): transl_table=11

SEQ ID NO: 62945 - protein, 416 aa, Streptococcus pneumoniae TIGR4; identical to SEQ ID NO: 31294

SEQ ID NO: 62946 - DNA, 1314 bp, Agrobacterium tumefaciens str. C58; identical to SEQ ID NO: 31295
  CDS (1)..(1314): transl_table=11

SEQ ID NO: 62947 - protein, 437 aa, Agrobacterium tumefaciens str. C58; identical to SEQ ID NO: 31296

SEQ ID NO: 62948 - DNA, 915 bp, Agrobacterium tumefaciens str. C58; identical to SEQ ID NO: 31297
  CDS (1)..(915): transl_table=11

SEQ ID NO: 62949 - protein, 304 aa, Agrobacterium tumefaciens str. C58; identical to SEQ ID NO: 31298

SEQ ID NO: 62950 - DNA, 1215 bp, Sulfolobus tokodaii str. 7; identical to SEQ ID NO: 31299
  CDS (1)..(1215): transl_table=11

SEQ ID NO: 62951 - protein, 404 aa, Sulfolobus tokodaii str. 7; identical to SEQ ID NO: 31300

SEQ ID NO: 62952 - DNA, 1188 bp, Sulfolobus tokodaii str. 7; identical to SEQ ID NO: 31301
  CDS (1)..(1188): transl_table=11

SEQ ID NO: 62953 - protein, 395 aa, Sulfolobus tokodaii str. 7; identical to SEQ ID NO: 31302

SEQ ID NO: 62954 - DNA, 1248 bp, Sinorhizobium meliloti 1021; identical to SEQ ID NO: 31303
  CDS (1)..(1248): transl_table=11

SEQ ID NO: 62955 - protein, 415 aa, Sinorhizobium meliloti 1021; identical to SEQ ID NO: 31304

SEQ ID NO: 62956 - DNA, 978 bp, Caulobacter crescentus CB15; identical to SEQ ID NO: 31305
  CDS (1)..(978): transl_table=11

SEQ ID NO: 62957 - protein, 325 aa, Caulobacter crescentus CB15; identical to SEQ ID NO: 31306

SEQ ID NO: 62958 - DNA, 1203 bp, Caulobacter crescentus CB15; identical to SEQ ID NO: 31307
  CDS (1)..(1203): transl_table=11

SEQ ID NO: 62959 - protein, 400 aa, Caulobacter crescentus CB15; identical to SEQ ID NO: 31308

SEQ ID NO: 62960 - DNA, 972 bp, Sinorhizobium meliloti 1021; identical to SEQ ID NO: 31309
  CDS (1)..(972)

SEQ ID NO: 62961 - protein, 323 aa, Sinorhizobium meliloti 1021; identical to SEQ ID NO: 31310

SEQ ID NO: 62962 - DNA, 1005 bp, Sinorhizobium meliloti 1021; identical to SEQ ID NO: 31311
  CDS (1)..(1005): transl_table=11

SEQ ID NO: 62963 - protein, 334 aa, Sinorhizobium meliloti 1021; identical to SEQ ID NO: 31312

SEQ ID NO: 62964 - DNA, 1527 bp, Synechocystis sp. PCC 6803; identical to SEQ ID NO: 31313
  CDS (1)..(1527): transl_table=11

SEQ ID NO: 62965 - protein, 508 aa, Synechocystis sp. PCC 6803; identical to SEQ ID NO: 31314

SEQ ID NO: 62966 - DNA, 1269 bp, Listeria monocytogenes EGD-e; identical to SEQ ID NO: 31315
  CDS (1)..(1269): transl_table=11

SEQ ID NO: 62967 - protein, 422 aa, Listeria monocytogenes EGD-e; identical to SEQ ID NO: 31316

SEQ ID NO: 62968 - DNA, 1269 bp, Listeria innocua Clip11262; identical to SEQ ID NO: 31317
  CDS (1)..(1269): transl_table=11

SEQ ID NO: 62969 - protein, 422 aa, Listeria innocua Clip11262; identical to SEQ ID NO: 31318

SEQ ID NO: 62970 - DNA, 1056 bp, Listeria innocua Clip11262; identical to SEQ ID NO: 31319
  CDS (1)..(1056): transl_table=11

SEQ ID NO: 62971 - protein, 351 aa, Listeria innocua Clip11262; identical to SEQ ID NO: 31320

SEQ ID NO: 62972 - DNA, 954 bp, Caenorhabditis elegans; identical to SEQ ID NO: 31321
  CDS (1)..(954)

SEQ ID NO: 62973 - protein, 317 aa, Caenorhabditis elegans; identical to SEQ ID NO: 31322

SEQ ID NO: 62974 - DNA, 1347 bp, Caenorhabditis elegans; identical to SEQ ID NO: 31323
  CDS (1)..(1347)

SEQ ID NO: 62975 - protein, 448 aa, Caenorhabditis elegans; identical to SEQ ID NO: 31324

SEQ ID NO: 62976 - DNA, 1539 bp, Caenorhabditis elegans; identical to SEQ ID NO: 31325
  CDS (1)..(1539)

SEQ ID NO: 62977 - protein, 512 aa, Caenorhabditis elegans; identical to SEQ ID NO: 31326

SEQ ID NO: 62978 - DNA, 1005 bp, Ralstonia solanacearum GMI1000; identical to SEQ ID NO: 31327
  CDS (1)..(1005): transl_table=11

SEQ ID NO: 62979 - protein, 334 aa, Ralstonia solanacearum GMI1000; identical to SEQ ID NO: 31328

SEQ ID NO: 62980 - DNA, 972 bp, Ralstonia solanacearum GMI1000; identical to SEQ ID NO: 31329
  CDS (1)..(972): transl_table=11

SEQ ID NO: 62981 - protein, 323 aa, Ralstonia solanacearum GMI1000; identical to SEQ ID NO: 31330

SEQ ID NO: 62982 - DNA, 975 bp, Agrobacterium tumefaciens str. C58; identical to SEQ ID NO: 31331
  CDS (1)..(975): transl_table=11

SEQ ID NO: 62983 - protein, 324 aa, Agrobacterium tumefaciens str. C58; identical to SEQ ID NO: 31332

SEQ ID NO: 62984 - DNA, 1011 bp, Agrobacterium tumefaciens str. C58; identical to SEQ ID NO: 31333
  CDS (1)..(1011): transl_table=11

SEQ ID NO: 62985 - protein, 336 aa, Agrobacterium tumefaciens str. C58; identical to SEQ ID NO: 31334

SEQ ID NO: 62986 - DNA, 1212 bp, Pyrobaculum aerophilum str. IM2; identical to SEQ ID NO: 31335
  CDS (1)..(1212): transl_table=11

SEQ ID NO: 62987 - protein, 403 aa, Pyrobaculum aerophilum str. IM2; identical to SEQ ID NO: 31336

SEQ ID NO: 62988 - DNA, 1047 bp, Pyrobaculum aerophilum str. IM2; identical to SEQ ID NO: 31337
  CDS (1)..(1047): transl_table=11

SEQ ID NO: 62989 - protein, 348 aa, Pyrobaculum aerophilum str. IM2; identical to SEQ ID NO: 31338

SEQ ID NO: 62990 - DNA, 1209 bp, Clostridium perfringens str. 13; identical to SEQ ID NO: 31339
  CDS (1)..(1209): transl_table=11

SEQ ID NO: 62991 - protein, 402 aa, Clostridium perfringens str. 13; identical to SEQ ID NO: 31340

SEQ ID NO: 62992 - DNA, 1185 bp, Pyrococcus furiosus DSM 3638; identical to SEQ ID NO: 31341
  CDS (1)..(1185): transl_table=11

SEQ ID NO: 62993 - protein, 394 aa, Pyrococcus furiosus DSM 3638; identical to SEQ ID NO: 31342

SEQ ID NO: 62994 - DNA, 1152 bp, Pyrococcus furiosus DSM 3638; identical to SEQ ID NO: 31343
  CDS (1)..(1152): transl_table=11

SEQ ID NO: 62995 - protein, 383 aa, Pyrococcus furiosus DSM 3638; identical to SEQ ID NO: 31344

SEQ ID NO: 62996 - DNA, 1338 bp, Pyrococcus furiosus DSM 3638; identical to SEQ ID NO: 31345
  CDS (1)..(1338): transl_table=11

SEQ ID NO: 62997 - protein, 445 aa, Pyrococcus furiosus DSM 3638; identical to SEQ ID NO: 31346

SEQ ID NO: 62998 - DNA, 1803 bp, Schizosaccharomyces pombe; identical to SEQ ID NO: 31347
  CDS (1)..(1803)

SEQ ID NO: 62999 - protein, 600 aa, Schizosaccharomyces pombe; identical to SEQ ID NO: 31348

SEQ ID NO: 63000 - DNA, 933 bp, Corynebacterium glutamicum ATCC 13032; identical to SEQ ID NO: 31349
  CDS (1)..(933): transl_table=11

SEQ ID NO: 63001 - protein, 310 aa, Corynebacterium glutamicum ATCC 13032; identical to SEQ ID NO: 31350

SEQ ID NO: 63002 - DNA, 1215 bp, Fusobacterium nucleatum subsp. nucleatum ATCC 25586; identical to SEQ ID NO: 31351
  CDS (1)..(1215): transl_table=11

SEQ ID NO: 63003 - protein, 404 aa, Fusobacterium nucleatum subsp. nucleatum ATCC 25586; identical to SEQ ID NO: 31352

SEQ ID NO: 63004 - DNA, 1212 bp, Methanopyrus kandleri AV19; identical to SEQ ID NO: 31353
  CDS (1)..(1212): transl_table=11

SEQ ID NO: 63005 - protein, 403 aa, Methanopyrus kandleri AV19; identical to SEQ ID NO: 31354

SEQ ID NO: 63006 - DNA, 1056 bp, Thermoanaerobacter tengcongensis MB4; identical to SEQ ID NO: 31355
  CDS (1)..(1056): transl_table=11

SEQ ID NO: 63007 - protein, 351 aa, Thermoanaerobacter tengcongensis MB4; identical to SEQ ID NO: 31356

SEQ ID NO: 63008 - DNA, 1230 bp, Streptomyces coelicolor A3(2); identical to SEQ ID NO: 31357
  CDS (1)..(1230)

SEQ ID NO: 63009 - protein, 409 aa, Streptomyces coelicolor A3(2); identical to SEQ ID NO: 31358

SEQ ID NO: 63010 - DNA, 1218 bp, Methanosarcina mazei Go1; identical to SEQ ID NO: 31359
  CDS (1)..(1218): transl_table=11

SEQ ID NO: 63011 - protein, 405 aa, Methanosarcina mazei Go1; identical to SEQ ID NO: 31360

SEQ ID NO: 63012 - DNA, 960 bp, Xanthomonas campestris pv. campestris str. ATCC 33913; identical to SEQ ID NO: 31361
  CDS (1)..(960): transl_table=11

SEQ ID NO: 63013 - protein, 319 aa, Xanthomonas campestris pv. campestris str. ATCC 33913; identical to SEQ ID NO: 31362

SEQ ID NO: 63014 - DNA, 960 bp, Xanthomonas axonopodis pv. citri str. 306; identical to SEQ ID NO: 31363
  CDS (1)..(960): transl_table=11

SEQ ID NO: 63015 - protein, 319 aa, Xanthomonas axonopodis pv. citri str. 306; identical to SEQ ID NO: 31364

SEQ ID NO: 63016 - DNA, 1119 bp, Xanthomonas axonopodis pv. citri str. 306; identical to SEQ ID NO: 31365
  CDS (1)..(1119): transl_table=11

SEQ ID NO: 63017 - protein, 372 aa, Xanthomonas axonopodis pv. citri str. 306; identical to SEQ ID NO: 31366

SEQ ID NO: 63018 - DNA, 1041 bp, Staphylococcus aureus subsp. aureus MW2; identical to SEQ ID NO: 31367
  CDS (1)..(1041): transl_table=11

SEQ ID NO: 63019 - protein, 346 aa, Staphylococcus aureus subsp. aureus MW2; identical to SEQ ID NO: 31368

SEQ ID NO: 63020 - DNA, 1410 bp, Drosophila melanogaster; identical to SEQ ID NO: 31369
  CDS (1)..(1410)

SEQ ID NO: 63021 - protein, 469 aa, Drosophila melanogaster; identical to SEQ ID NO: 31370

SEQ ID NO: 63022 - DNA, 1263 bp, Bacillus anthracis str. A2012; identical to SEQ ID NO: 31371
  CDS (1)..(1263): n means a or g or c or t/u, s means g or c

SEQ ID NO: 63023 - protein, 420 aa, Bacillus anthracis str. A2012; identical to SEQ ID NO: 31372
  Xaa in positions 184 and 201 is unknown

SEQ ID NO: 63024 - DNA, 1545 bp, Yersinia pestis KIM; identical to SEQ ID NO: 31373
  CDS (1)..(1545): transl_table=11

SEQ ID NO: 63025 - protein, 514 aa, Yersinia pestis KIM; identical to SEQ ID NO: 31374

SEQ ID NO: 63026 - DNA, 1062 bp, Oceanobacillus iheyensis HTE831; identical to SEQ ID NO: 31375
  CDS (1)..(1062): transl_table=11

SEQ ID NO: 63027 - protein, 353 aa, Oceanobacillus iheyensis HTE831; identical to SEQ ID NO: 31376

SEQ ID NO: 63028 - DNA, 1017 bp, Oceanobacillus iheyensis HTE831; identical to SEQ ID NO: 31377
  CDS (1)..(1017): transl_table=11

SEQ ID NO: 63029 - protein, 338 aa, Oceanobacillus iheyensis HTE831; identical to SEQ ID NO: 31378

SEQ ID NO: 63030 - DNA, 1227 bp, Brucella suis 1330; identical to SEQ ID NO: 31379
  CDS (1)..(1227): transl_table=11

SEQ ID NO: 63031 - protein, 408 aa, Brucella suis 1330; identical to SEQ ID NO: 31380

SEQ ID NO: 63032 - DNA, 1638 bp, Shewanella oneidensis MR-1; identical to SEQ ID NO: 31381
  CDS (1)..(1638): transl_table=11

SEQ ID NO: 63033 - protein, 545 aa, Shewanella oneidensis MR-1; identical to SEQ ID NO: 31382

SEQ ID NO: 63034 - DNA, 1251 bp, Streptococcus mutans UA159; identical to SEQ ID NO: 31383
  CDS (1)..(1251): transl_table=11

SEQ ID NO: 63035 - protein, 416 aa, Streptococcus mutans UA159; identical to SEQ ID NO: 31384

SEQ ID NO: 63036 - DNA, 951 bp, Drosophila melanogaster; identical to SEQ ID NO: 31385
  CDS (1)..(951)

SEQ ID NO: 63037 - protein, 316 aa, Drosophila melanogaster; identical to SEQ ID NO: 31386

SEQ ID NO: 63038 - DNA, 1311 bp, Corynebacterium efficiens YS-314; identical to SEQ ID NO: 31387
  CDS (1)..(1311): transl_table=11

SEQ ID NO: 63039 - protein, 436 aa, Corynebacterium efficiens YS-314; identical to SEQ ID NO: 31388

SEQ ID NO: 63040 - DNA, 918 bp, Pseudomonas putida KT2440; identical to SEQ ID NO: 31389
  CDS (1)..(918): transl_table=11

SEQ ID NO: 63041 - protein, 305 aa, Pseudomonas putida KT2440; identical to SEQ ID NO: 31390

SEQ ID NO: 63042 - DNA, 1053 bp, Pseudomonas putida KT2440; identical to SEQ ID NO: 31391
  CDS (1)..(1053): transl_table=11

SEQ ID NO: 63043 - protein, 350 aa, Pseudomonas putida KT2440; identical to SEQ ID NO: 31392

SEQ ID NO: 63044 - DNA, 1593 bp, Pseudomonas putida KT2440; identical to SEQ ID NO: 31393
  CDS (1)..(1593): transl_table=11

SEQ ID NO: 63045 - protein, 530 aa, Pseudomonas putida KT2440; identical to SEQ ID NO: 31394

SEQ ID NO: 63046 - DNA, 1275 bp, Staphylococcus epidermidis ATCC 12228; identical to SEQ ID NO: 31395
  CDS (1)..(1275): transl_table=11

SEQ ID NO: 63047 - protein, 424 aa, Staphylococcus epidermidis ATCC 12228; identical to SEQ ID NO: 31396

SEQ ID NO: 63048 - DNA, 1245 bp, Bradyrhizobium japonicum USDA 110; identical to SEQ ID NO: 31397
  CDS (1)..(1245)

SEQ ID NO: 63049 - protein, 414 aa, Bradyrhizobium japonicum USDA 110; identical to SEQ ID NO: 31398

SEQ ID NO: 63050 - DNA, 1005 bp, Bradyrhizobium japonicum USDA 110; identical to SEQ ID NO: 31399
  CDS (1)..(1005)

SEQ ID NO: 63051 - protein, 334 aa, Bradyrhizobium japonicum USDA 110; identical to SEQ ID NO: 31400

SEQ ID NO: 63052 - DNA, 1053 bp, Xylella fastidiosa Temecula1; identical to SEQ ID NO: 31401
  CDS (1)..(1053): transl_table=11

SEQ ID NO: 63053 - protein, 350 aa, Xylella fastidiosa Temecula1; identical to SEQ ID NO: 31402

SEQ ID NO: 63054 - DNA, 1218 bp, Clostridium tetani E88; identical to SEQ ID NO: 31403
  CDS (1)..(1218): transl_table=11

SEQ ID NO: 63055 - protein, 405 aa, Clostridium tetani E88; identical to SEQ ID NO: 31404

SEQ ID NO: 63056 - DNA, 1284 bp, Tropheryma whipplei str. Twist; identical to SEQ ID NO: 31405
  CDS (1)..(1284): transl_table=11

SEQ ID NO: 63057 - protein, 427 aa, Tropheryma whipplei str. Twist; identical to SEQ ID NO: 31406

SEQ ID NO: 63058 - DNA, 1284 bp, Tropheryma whipplei TW08/27; identical to SEQ ID NO: 31407
  CDS (1)..(1284): transl_table=11

SEQ ID NO: 63059 - protein, 427 aa, Tropheryma whipplei TW08/27; identical to SEQ ID NO: 31408

SEQ ID NO: 63060 - DNA, 1524 bp, Pseudomonas syringae pv. tomato str. DC3000; identical to SEQ ID NO: 31409
  CDS (1)..(1524): transl_table=11

SEQ ID NO: 63061 - protein, 507 aa, Pseudomonas syringae pv. tomato str. DC3000; identical to SEQ ID NO: 31410

SEQ ID NO: 63062 - DNA, 1548 bp, Vibrio parahaemolyticus RIMD 2210633; identical to SEQ ID NO: 31411
  CDS (1)..(1548): transl_table=11

SEQ ID NO: 63063 - protein, 515 aa, Vibrio parahaemolyticus RIMD 2210633; identical to SEQ ID NO: 31412

SEQ ID NO: 63064 - DNA, 1545 bp, Salmonella enterica subsp. enterica serovar Typhi Ty2; identical to SEQ ID NO: 31413
  CDS (1)..(1545): transl_table=11

SEQ ID NO: 63065 - protein, 514 aa, Salmonella enterica subsp. enterica serovar Typhi Ty2; identical to SEQ ID NO: 31414

SEQ ID NO: 63066 - DNA, 1056 bp, Enterococcus faecalis V583; identical to SEQ ID NO: 31415
  CDS (1)..(1056): transl_table=11

SEQ ID NO: 63067 - protein, 351 aa, Enterococcus faecalis V583; identical to SEQ ID NO: 31416

SEQ ID NO: 63068 - DNA, 1059 bp, Bacillus cereus ATCC 14579; identical to SEQ ID NO: 31417
  CDS (1)..(1059): transl_table=11

SEQ ID NO: 63069 - protein, 352 aa, Bacillus cereus ATCC 14579; identical to SEQ ID NO: 31418

SEQ ID NO: 63070 - DNA, 1002 bp, Bacillus cereus ATCC 14579; identical to SEQ ID NO: 31419
  CDS (1)..(1002): transl_table=11

SEQ ID NO: 63071 - protein, 333 aa, Bacillus cereus ATCC 14579; identical to SEQ ID NO: 31420

SEQ ID NO: 63072 - DNA, 1512 bp, Nitrosomonas europaea ATCC 19718; identical to SEQ ID NO: 31421
  CDS (1)..(1512): transl_table=11

SEQ ID NO: 63073 - protein, 503 aa, Nitrosomonas europaea ATCC 19718; identical to SEQ ID NO: 31422

SEQ ID NO: 63074 - DNA, 1002 bp, Bacillus anthracis str. Ames; identical to SEQ ID NO: 31423
  CDS (1)..(1002): transl_table=11

SEQ ID NO: 63075 - protein, 333 aa, Bacillus anthracis str. Ames; identical to SEQ ID NO: 31424

SEQ ID NO: 63076 - DNA, 1227 bp, Helicobacter hepaticus ATCC 51449; identical to SEQ ID NO: 31425
  CDS (1)..(1227): transl_table=11

SEQ ID NO: 63077 - protein, 408 aa, Helicobacter hepaticus ATCC 51449; identical to SEQ ID NO: 31426

SEQ ID NO: 63078 - DNA, 1248 bp, Rhodopirellula baltica SH 1; identical to SEQ ID NO: 31427
  CDS (1)..(1248): transl_table=11

SEQ ID NO: 63079 - protein, 415 aa, Rhodopirellula baltica SH 1; identical to SEQ ID NO: 31428

SEQ ID NO: 63080 - DNA, 1545 bp, Candidatus Blochmannia floridanus; identical to SEQ ID NO: 31429
  CDS (1)..(1545): transl_table=11

SEQ ID NO: 63081 - protein, 514 aa, Candidatus Blochmannia floridanus; identical to SEQ ID NO: 31430

SEQ ID NO: 63082 - DNA, 1581 bp, Bordetella parapertussis 12822; identical to SEQ ID NO: 31431
  CDS (1)..(1581): transl_table=11

SEQ ID NO: 63083 - protein, 526 aa, Bordetella parapertussis 12822; identical to SEQ ID NO: 31432

SEQ ID NO: 63084 - DNA, 1218 bp, Bordetella parapertussis 12822; identical to SEQ ID NO: 31433
  CDS (1)..(1218): transl_table=11

SEQ ID NO: 63085 - protein, 405 aa, Bordetella parapertussis 12822; identical to SEQ ID NO: 31434

SEQ ID NO: 63086 - DNA, 969 bp, Bordetella parapertussis 12822; identical to SEQ ID NO: 31435
  CDS (1)..(969): transl_table=11

SEQ ID NO: 63087 - protein, 322 aa, Bordetella parapertussis 12822; identical to SEQ ID NO: 31436

SEQ ID NO: 63088 - DNA, 987 bp, Bordetella bronchiseptica RB50; identical to SEQ ID NO: 31437
  CDS (1)..(987): transl_table=11

SEQ ID NO: 63089 - protein, 328 aa, Bordetella bronchiseptica RB50; identical to SEQ ID NO: 31438

SEQ ID NO: 63090 - DNA, 1509 bp, Bordetella bronchiseptica RB50; identical to SEQ ID NO: 31439
  CDS (1)..(1509): transl_table=11

SEQ ID NO: 63091 - protein, 502 aa, Bordetella bronchiseptica RB50; identical to SEQ ID NO: 31440

SEQ ID NO: 63092 - DNA, 1545 bp, Prochlorococcus marinus str. MIT 9313; identical to SEQ ID NO: 31441
  CDS (1)..(1545): transl_table=11

SEQ ID NO: 63093 - protein, 514 aa, Prochlorococcus marinus str. MIT 9313; identical to SEQ ID NO: 31442

SEQ ID NO: 63094 - DNA, 1530 bp, Synechococcus sp. WH 8102; identical to SEQ ID NO: 31443
  CDS (1)..(1530): transl_table=11

SEQ ID NO: 63095 - protein, 509 aa, Synechococcus sp. WH 8102; identical to SEQ ID NO: 31444

SEQ ID NO: 63096 - DNA, 1530 bp, Chromobacterium violaceum ATCC 12472; identical to SEQ ID NO: 31445
  CDS (1)..(1530): transl_table=11

SEQ ID NO: 63097 - protein, 509 aa, Chromobacterium violaceum ATCC 12472; identical to SEQ ID NO: 31446

SEQ ID NO: 63098 - DNA, 966 bp, Chromobacterium violaceum ATCC 12472; identical to SEQ ID NO: 31447
  CDS (1)..(966): transl_table=11

SEQ ID NO: 63099 - protein, 321 aa, Chromobacterium violaceum ATCC 12472; identical to SEQ ID NO: 31448

SEQ ID NO: 63100 - DNA, 1212 bp, Wolinella succinogenes DSM 1740; identical to SEQ ID NO: 31449
  CDS (1)..(1212): transl_table=11

SEQ ID NO: 63101 - protein, 403 aa, Wolinella succinogenes DSM 1740; identical to SEQ ID NO: 31450

SEQ ID NO: 63102 - DNA, 1188 bp, Gloeobacter violaceus PCC 7421; identical to SEQ ID NO: 31451
  CDS (1)..(1188): transl_table=11

SEQ ID NO: 63103 - protein, 395 aa, Gloeobacter violaceus PCC 7421; identical to SEQ ID NO: 31452

SEQ ID NO: 63104 - DNA, 996 bp, Gloeobacter violaceus PCC 7421; identical to SEQ ID NO: 31453
  CDS (1)..(996): transl_table=11

SEQ ID NO: 63105 - protein, 331 aa, Gloeobacter violaceus PCC 7421; identical to SEQ ID NO: 31454

SEQ ID NO: 63106 - DNA, 969 bp, Photorhabdus luminescens subsp. laumondii TTO1; identical to SEQ ID NO: 31455
  CDS (1)..(969): transl_table=11

SEQ ID NO: 63107 - protein, 322 aa, Photorhabdus luminescens subsp. laumondii TTO1; identical to SEQ ID NO: 31456

SEQ ID NO: 63108 - DNA, 1560 bp, Photorhabdus luminescens subsp. laumondii TTO1; identical to SEQ ID NO: 31457
  CDS (1)..(1560): transl_table=11

SEQ ID NO: 63109 - protein, 519 aa, Photorhabdus luminescens subsp. laumondii TTO1; identical to SEQ ID NO: 31458

SEQ ID NO: 63110 - DNA, 1530 bp, Vibrio vulnificus YJ016; identical to SEQ ID NO: 31459
  CDS (1)..(1530): transl_table=11

SEQ ID NO: 63111 - protein, 509 aa, Vibrio vulnificus YJ016; identical to SEQ ID NO: 31460

SEQ ID NO: 63112 - DNA, 1341 bp, Corynebacterium diphtheriae NCTC 13129; identical to SEQ ID NO: 31461
  CDS (1)..(1341): transl_table=11

SEQ ID NO: 63113 - protein, 446 aa, Corynebacterium diphtheriae NCTC 13129; identical to SEQ ID NO: 31462

SEQ ID NO: 63114 - DNA, 996 bp, Rhodopseudomonas palustris CGA009; identical to SEQ ID NO: 31463
  CDS (1)..(996): transl_table=11

SEQ ID NO: 63115 - protein, 331 aa, Rhodopseudomonas palustris CGA009; identical to SEQ ID NO: 31464

SEQ ID NO: 63116 - DNA, 1209 bp, Geobacter sulfurreducens PCA; identical to SEQ ID NO: 31465
  CDS (1)..(1209): transl_table=11

SEQ ID NO: 63117 - protein, 402 aa, Geobacter sulfurreducens PCA; identical to SEQ ID NO: 31466

SEQ ID NO: 63118 - DNA, 1212 bp, Bdellovibrio bacteriovorus HD100; identical to SEQ ID NO: 31467
  CDS (1)..(1212): transl_table=11

SEQ ID NO: 63119 - protein, 403 aa, Bdellovibrio bacteriovorus HD100; identical to SEQ ID NO: 31468

SEQ ID NO: 63120 - DNA, 1227 bp, Mycoplasma mycoides subsp. mycoides SC str. PG1; identical to SEQ ID NO: 31469
  CDS (1)..(1227): transl_table=4

SEQ ID NO: 63121 - protein, 408 aa, Mycoplasma mycoides subsp. mycoides SC str. PG1; identical to SEQ ID NO: 31470

SEQ ID NO: 63122 - DNA, 1683 bp, Eremothecium gossypii; identical to SEQ ID NO: 31471
  CDS (1)..(1683)

SEQ ID NO: 63123 - protein, 560 aa, Eremothecium gossypii; identical to SEQ ID NO: 31472

SEQ ID NO: 63124 - DNA, 990 bp, Yersinia pestis biovar Medievalis str. 91001; identical to SEQ ID NO: 31473
  CDS (1)..(990): transl_table=11

SEQ ID NO: 63125 - protein, 329 aa, Yersinia pestis biovar Medievalis str. 91001; identical to SEQ ID NO: 31474

SEQ ID NO: 63126 - DNA, 1380 bp, Anopheles gambiae str. PEST; identical to SEQ ID NO: 31475
  CDS (1)..(1380)

SEQ ID NO: 63127 - protein, 459 aa, Anopheles gambiae str. PEST; identical to SEQ ID NO: 31476

SEQ ID NO: 63128 - DNA, 1431 bp, Anopheles gambiae str. PEST; identical to SEQ ID NO: 31477
  CDS (1)..(1431)

SEQ ID NO: 63129 - protein, 476 aa, Anopheles gambiae str. PEST; identical to SEQ ID NO: 31478

SEQ ID NO: 63130 - DNA, 1167 bp, Neurospora crassa; identical to SEQ ID NO: 31479
  CDS (1)..(1167)

SEQ ID NO: 63131 - protein, 388 aa, Neurospora crassa; identical to SEQ ID NO: 31480

SEQ ID NO: 63132 - DNA, 1773 bp, Neurospora crassa; identical to SEQ ID NO: 31481
  CDS (1)..(1773)

SEQ ID NO: 63133 - protein, 590 aa, Neurospora crassa; identical to SEQ ID NO: 31482

SEQ ID NO: 63134 - DNA, 1467 bp, Rattus norvegicus; identical to SEQ ID NO: 31483
  CDS (1)..(1467)

SEQ ID NO: 63135 - protein, 488 aa, Rattus norvegicus; identical to SEQ ID NO: 31484

SEQ ID NO: 63136 - DNA, 1212 bp, Magnaporthe grisea 70-15; identical to SEQ ID NO: 31485
  CDS (1)..(1212)

SEQ ID NO: 63137 - protein, 403 aa, Magnaporthe grisea 70-15; identical to SEQ ID NO: 31486

SEQ ID NO: 63138 - DNA, 1857 bp, Magnaporthe grisea 70-15; identical to SEQ ID NO: 31487
  CDS (1)..(1857)

SEQ ID NO: 63139 - protein, 618 aa, Magnaporthe grisea 70-15; identical to SEQ ID NO: 31488

SEQ ID NO: 63140 - DNA, 1035 bp, Magnaporthe grisea 70-15; identical to SEQ ID NO: 31489
  CDS (1)..(1035)

SEQ ID NO: 63141 - protein, 344 aa, Magnaporthe grisea 70-15; identical to SEQ ID NO: 31490

SEQ ID NO: 63142 - DNA, 1746 bp, Gibberella zeae PH-1; identical to SEQ ID NO: 31491
  CDS (1)..(1746)

SEQ ID NO: 63143 - protein, 581 aa, Gibberella zeae PH-1; identical to SEQ ID NO: 31492

SEQ ID NO: 63144 - DNA, 1098 bp, Gibberella zeae PH-1; identical to SEQ ID NO: 31493
  CDS (1)..(1098)

SEQ ID NO: 63145 - protein, 365 aa, Gibberella zeae PH-1; identical to SEQ ID NO: 31494

SEQ ID NO: 63146 - DNA, 1026 bp, Gibberella zeae PH-1; identical to SEQ ID NO: 31495
  CDS (1)..(1026)

SEQ ID NO: 63147 - protein, 341 aa, Gibberella zeae PH-1; identical to SEQ ID NO: 31496

SEQ ID NO: 63148 - DNA, 1197 bp, Gibberella zeae PH-1; identical to SEQ ID NO: 31497
  CDS (1)..(1197)

SEQ ID NO: 63149 - protein, 398 aa, Gibberella zeae PH-1; identical to SEQ ID NO: 31498

SEQ ID NO: 63150 - DNA, 2019 bp, Ustilago maydis 521; identical to SEQ ID NO: 31499
  CDS (1)..(2019)

SEQ ID NO: 63151 - protein, 672 aa, Ustilago maydis 521; identical to SEQ ID NO: 31500

SEQ ID NO: 63152 - DNA, 1131 bp, Ustilago maydis 521; identical to SEQ ID NO: 31501
  CDS (1)..(1131)

SEQ ID NO: 63153 - protein, 376 aa, Ustilago maydis 521; identical to SEQ ID NO: 31502

SEQ ID NO: 63154 - DNA, 1086 bp, Aspergillus nidulans FGSC A4; identical to SEQ ID NO: 31503
  CDS (1)..(1086)

SEQ ID NO: 63155 - protein, 361 aa, Aspergillus nidulans FGSC A4; identical to SEQ ID NO: 31504

SEQ ID NO: 63156 - DNA, 1764 bp, Aspergillus nidulans FGSC A4; identical to SEQ ID NO: 31505
  CDS (1)..(1764)

SEQ ID NO: 63157 - protein, 587 aa, Aspergillus nidulans FGSC A4; identical to SEQ ID NO: 31506

SEQ ID NO: 63158 - DNA, 1278 bp, Aspergillus nidulans FGSC A4; identical to SEQ ID NO: 31507
  CDS (1)..(1278)

SEQ ID NO: 63159 - protein, 425 aa, Aspergillus nidulans FGSC A4; identical to SEQ ID NO: 31508

SEQ ID NO: 63160 - DNA, 2076 bp, Gallus gallus; identical to SEQ ID NO: 31509
  CDS (1)..(2076)

SEQ ID NO: 63161 - protein, 691 aa, Gallus gallus; identical to SEQ ID NO: 31510

SEQ ID NO: 63162 - DNA, 1083 bp, Candida glabrata CBS138; identical to SEQ ID NO: 31511
  CDS (1)..(1083)

SEQ ID NO: 63163 - protein, 360 aa, Candida glabrata CBS138; identical to SEQ ID NO: 31512

SEQ ID NO: 63164 - DNA, 1716 bp, Candida glabrata CBS138; identical to SEQ ID NO: 31513
  CDS (1)..(1716)

SEQ ID NO: 63165 - protein, 571 aa, Candida glabrata CBS138; identical to SEQ ID NO: 31514

SEQ ID NO: 63166 - DNA, 1134 bp, Kluyveromyces lactis NRRL Y-1140; identical to SEQ ID NO: 31515
  CDS (1)..(1134)

SEQ ID NO: 63167 - protein, 377 aa, Kluyveromyces lactis NRRL Y-1140; identical to SEQ ID NO: 31516

SEQ ID NO: 63168 - DNA, 1704 bp, Kluyveromyces lactis NRRL Y-1140; identical to SEQ ID NO: 31517
  CDS (1)..(1704)

SEQ ID NO: 63169 - protein, 567 aa, Kluyveromyces lactis NRRL Y-1140; identical to SEQ ID NO: 31518

SEQ ID NO: 63170 - DNA, 1719 bp, Debaryomyces hansenii CBS767; identical to SEQ ID NO: 31519
  CDS (1)..(1719)

SEQ ID NO: 63171 - protein, 572 aa, Debaryomyces hansenii CBS767; identical to SEQ ID NO: 31520

SEQ ID NO: 63172 - DNA, 1809 bp, Oryza sativa (japonica cultivar-group); identical to SEQ ID NO: 31521
  CDS (1)..(1809)

SEQ ID NO: 63173 - protein, 602 aa, Oryza sativa (japonica cultivar-group); identical to SEQ ID NO: 31522

SEQ ID NO: 63174 - DNA, 1020 bp, Oryza sativa (japonica cultivar-group); identical to SEQ ID NO: 31523
  CDS (1)..(1020)

SEQ ID NO: 63175 - protein, 339 aa, Oryza sativa (japonica cultivar-group) [sequence omitted]

SEQ ID NO: 63176 - DNA, 972 bp, Yarrowia lipolytica CLIB99; identical to SEQ ID NO: 31525
  CDS (1)..(972)

SEQ ID NO: 63177 - protein, 323 aa, Yarrowia lipolytica CLIB99; identical to SEQ ID NO: 31526

SEQ ID NO: 63178 - DNA, 1590 bp, Yarrowia lipolytica CLIB99; identical to SEQ ID NO: 31527
  CDS (1)..(1590)

SEQ ID NO: 63179 - protein, 529 aa, Yarrowia lipolytica CLIB99; identical to SEQ ID NO: 31528

SEQ ID NO: 63180 - DNA, 990 bp, Yarrowia lipolytica CLIB99; identical to SEQ ID NO: 31529
  CDS (1)..(990)

SEQ ID NO: 63181 - protein, 329 aa, Yarrowia lipolytica CLIB99; identical to SEQ ID NO: 31530

SEQ ID NO: 63182 - DNA, 1179 bp, Canis familiaris; identical to SEQ ID NO: 31531
  CDS (1)..(1179)

SEQ ID NO: 63183 - protein, 392 aa, Canis familiaris; identical to SEQ ID NO: 31532

SEQ ID NO: 63184 - DNA, 936 bp, Thermus thermophilus HB27; identical to SEQ ID NO: 31533
  CDS (1)..(936): transl_table=11

SEQ ID NO: 63185 - protein, 311 aa, Thermus thermophilus HB27; identical to SEQ ID NO: 31534

SEQ ID NO: 63186 - DNA, 1269 bp, Listeria monocytogenes str. 4b F2365; identical to SEQ ID NO: 31535
  CDS (1)..(1269): transl_table=11

SEQ ID NO: 63187 - protein, 422 aa, Listeria monocytogenes str. 4b F2365; identical to SEQ ID NO: 31536

SEQ ID NO: 63188 - DNA, 1206 bp, Picrophilus torridus DSM 9790; identical to SEQ ID NO: 31537
  CDS (1)..(1206): transl_table=11

SEQ ID NO: 63189 - protein, 401 aa, Picrophilus torridus DSM 9790; identical to SEQ ID NO: 31538

SEQ ID NO: 63190 - DNA, 1149 bp, Picrophilus torridus DSM 9790; identical to SEQ ID NO: 31539
  CDS (1)..(1149): transl_table=11

SEQ ID NO: 63191 - protein, 382 aa, Picrophilus torridus DSM 9790; identical to SEQ ID NO: 31540

SEQ ID NO: 63192 - DNA, 1266 bp, Bartonella henselae str. Houston-1; identical to SEQ ID NO: 31541
  CDS (1)..(1266): transl_table=11

SEQ ID NO: 63193 - protein, 421 aa, Bartonella henselae str. Houston-1; identical to SEQ ID NO: 31542

SEQ ID NO: 63194 - DNA, 1539 bp, Acinetobacter sp. ADP1; identical to SEQ ID NO: 31543
  CDS (1)..(1539): transl_table=11

SEQ ID NO: 63195 - protein, 512 aa, Acinetobacter sp. ADP1; identical to SEQ ID NO: 31544

SEQ ID NO: 63196 - DNA, 1005 bp, Erwinia carotovora subsp. atroseptica SCRI1043; identical to SEQ ID NO: 31545
  CDS (1)..(1005)

SEQ ID NO: 63197 - protein, 334 aa, Erwinia carotovora subsp. atroseptica SCRI1043; identical to SEQ ID NO: 31546

SEQ ID NO: 63198 - DNA, 975 bp, Erwinia carotovora subsp. atroseptica SCRI1043; identical to SEQ ID NO: 31547
  CDS (1)..(975)

SEQ ID NO: 63199 - protein, 324 aa, Erwinia carotovora subsp. atroseptica SCRI1043; identical to SEQ ID NO: 31548

SEQ ID NO: 63200 - DNA, 1551 bp, Erwinia carotovora subsp. atroseptica SCRI1043; identical to SEQ ID NO: 31549
  CDS (1)..(1551)

SEQ ID NO: 63201 - protein, 516 aa, Erwinia carotovora subsp. atroseptica SCRI1043; identical to SEQ ID NO: 31550

SEQ ID NO: 63202 - DNA, 1251 bp, Leifsonia xyli subsp. xyli str. CTCB07; identical to SEQ ID NO: 31551
  CDS (1)..(1251): transl_table=11

SEQ ID NO: 63203 - protein, 416 aa, Leifsonia xyli subsp. xyli str. CTCB07; identical to SEQ ID NO: 31552

SEQ ID NO: 63204 - DNA, 1506 bp, Desulfotalea psychrophila LSv54; identical to SEQ ID NO: 31553
  CDS (1)..(1506): transl_table=11

SEQ ID NO: 63205 - protein, 501 aa, Desulfotalea psychrophila LSv54; identical to SEQ ID NO: 31554

SEQ ID NO: 63206 - DNA, 1002 bp, Rickettsia typhi str. Wilmington; identical to SEQ ID NO: 31555
  CDS (1)..(1002): transl_table=11

SEQ ID NO: 63207 - protein, 333 aa, Rickettsia typhi str. Wilmington; identical to SEQ ID NO: 31556

SEQ ID NO: 63208 - DNA, 963 bp, Yersinia pseudotuberculosis IP 32953; identical to SEQ ID NO: 31557
  CDS (1)..(963): transl_table=11

SEQ ID NO: 63209 - protein, 320 aa, Yersinia pseudotuberculosis IP 32953; identical to SEQ ID NO: 31558

SEQ ID NO: 63210 - DNA, 1200 bp, Symbiobacterium thermophilum IAM 14863; identical to SEQ ID NO: 31559
  CDS (1)..(1200): transl_table=11

SEQ ID NO: 63211 - protein, 399 aa, Symbiobacterium thermophilum IAM 14863; identical to SEQ ID NO: 31560

SEQ ID NO: 63212 - DNA, 1233 bp, Symbiobacterium thermophilum IAM 14863; identical to SEQ ID NO: 31561
  CDS (1)..(1233): transl_table=11

SEQ ID NO: 63213 - protein, 410 aa, Symbiobacterium thermophilum IAM 14863; identical to SEQ ID NO: 31562

SEQ ID NO: 63214 - DNA, 1263 bp, Bacillus cereus ZK; identical to SEQ ID NO: 31563
  CDS (1)..(1263): transl_table=11

SEQ ID NO: 63215 - protein, 420 aa, Bacillus cereus ZK; identical to SEQ ID NO: 31564

SEQ ID NO: 63216 - DNA, 1539 bp, Mannheimia succiniciproducens MBEL55E; identical to SEQ ID NO: 31565
  CDS (1)..(1539): transl_table=11

SEQ ID NO: 63217 - protein, 512 aa, Mannheimia succiniciproducens MBEL55E; identical to SEQ ID NO: 31566

SEQ ID NO: 63218 - DNA, 1269 bp, Bacillus licheniformis ATCC 14580; identical to SEQ ID NO: 31567
  CDS (1)..(1269): transl_table=11

SEQ ID NO: 63219 - protein, 422 aa, Bacillus licheniformis ATCC 14580; identical to SEQ ID NO: 31568

SEQ ID NO: 63220 - DNA, 1056 bp, Burkholderia mallei ATCC 23344; identical to SEQ ID NO: 31569
  CDS (1)..(1056): transl_table=11

SEQ ID NO: 63221 - protein, 351 aa, Burkholderia mallei ATCC 23344; identical to SEQ ID NO: 31570

SEQ ID NO: 63222 - DNA, 1524 bp, Burkholderia pseudomallei K96243; identical to SEQ ID NO: 31571
  CDS (1)..(1524): transl_table=11

SEQ ID NO: 63223 - protein, 507 aa, Burkholderia pseudomallei K96243; identical to SEQ ID NO: 31572

SEQ ID NO: 63224 - DNA, 984 bp, Burkholderia pseudomallei K96243; identical to SEQ ID NO: 31573
  CDS (1)..(984): transl_table=11

SEQ ID NO: 63225 - protein, 327 aa, Burkholderia pseudomallei K96243; identical to SEQ ID NO: 31574

SEQ ID NO: 63226 - DNA, 1530 bp, Methylococcus capsulatus str. Bath; identical to SEQ ID NO: 31575
  CDS (1)..(1530): transl_table=11

SEQ ID NO: 63227 - protein, 509 aa, Methylococcus capsulatus str. Bath; identical to SEQ ID NO: 31576

SEQ ID NO: 63228 - DNA, 963 bp, Nocardia farcinica IFM 10152; identical to SEQ ID NO: 31577
  CDS (1)..(963): transl_table=11

SEQ ID NO: 63229 - protein, 320 aa, Nocardia farcinica IFM 10152; identical to SEQ ID NO: 31578

SEQ ID NO: 63230 - DNA, 1356 bp, Nocardia farcinica IFM 10152; identical to SEQ ID NO: 31579
  CDS (1)..(1356): transl_table=11

SEQ ID NO: 63231 - protein, 451 aa, Nocardia farcinica IFM 10152; identical to SEQ ID NO: 31580

SEQ ID NO: 63232 - DNA, 936 bp, Nocardia farcinica IFM 10152; identical to SEQ ID NO: 31581
  CDS (1)..(936): transl_table=11

SEQ ID NO: 63233 - protein, 311 aa, Nocardia farcinica IFM 10152; identical to SEQ ID NO: 31582

SEQ ID NO: 63234 - DNA, 1554 bp, Photobacterium profundum SS9; identical to SEQ ID NO: 31583
  CDS (1)..(1554): transl_table=11

SEQ ID NO: 63235 - protein, 517 aa, Photobacterium profundum SS9; identical to SEQ ID NO: 31584

SEQ ID NO: 63236 - DNA, 1260 bp, Haloarcula marismortui ATCC 43049; identical to SEQ ID NO: 31585
  CDS (1)..(1260): transl_table=11

SEQ ID NO: 63237 - protein, 419 aa, Haloarcula marismortui ATCC 43049; identical to SEQ ID NO: 31586

SEQ ID NO: 63238 - DNA, 1263 bp, Haloarcula marismortui ATCC 43049; identical to SEQ ID NO: 31587
  CDS (1)..(1263): transl_table=11

SEQ ID NO: 63239 - protein, 420 aa, Haloarcula marismortui ATCC 43049; identical to SEQ ID NO: 31588

SEQ ID NO: 63240 - DNA, 1029 bp, Haloarcula marismortui ATCC 43049; identical to SEQ ID NO: 31589
  CDS (1)..(1029): transl_table=11

SEQ ID NO: 63241 - protein, 342 aa, Haloarcula marismortui ATCC 43049; identical to SEQ ID NO: 31590

SEQ ID NO: 63242 - DNA, 1212 bp, Haloarcula marismortui ATCC 43049; identical to SEQ ID NO: 31591
  CDS (1)..(1212): transl_table=11

SEQ ID NO: 63243 - protein, 403 aa, Haloarcula marismortui ATCC 43049; identical to SEQ ID NO: 31592

SEQ ID NO: 63244 - DNA, 1251 bp, Streptococcus thermophilus CNRZ1066; identical to SEQ ID NO: 31593
  CDS (1)..(1251): transl_table=11

SEQ ID NO: 63245 - protein, 416 aa, Streptococcus thermophilus CNRZ1066; identical to SEQ ID NO: 31594

SEQ ID NO: 63246 - DNA, 936 bp, Thermus thermophilus HB8; identical to SEQ ID NO: 31595
  CDS (1)..(936): transl_table=11

SEQ ID NO: 63247 - protein, 311 aa, Thermus thermophilus HB8; identical to SEQ ID NO: 31596

SEQ ID NO: 63248 - DNA, 1209 bp, Geobacillus kaustophilus HTA426; identical to SEQ ID NO: 31597
  CDS (1)..(1209): transl_table=11

SEQ ID NO: 63249 - protein, 402 aa, Geobacillus kaustophilus HTA426; identical to SEQ ID NO: 31598

SEQ ID NO: 63250 - DNA, 1272 bp, Geobacillus kaustophilus HTA426; identical to SEQ ID NO: 31599
  CDS (1)..(1272): transl_table=11

SEQ ID NO: 63251 - protein, 423 aa, Geobacillus kaustophilus HTA426; identical to SEQ ID NO: 31600

SEQ ID NO: 63252 - DNA, 960 bp, Idiomarina loihiensis L2TR; identical to SEQ ID NO: 31601
  CDS (1)..(960): transl_table=11

SEQ ID NO: 63253 - protein, 319 aa, Idiomarina loihiensis L2TR; identical to SEQ ID NO: 31602

SEQ ID NO: 63254 - DNA, 1521 bp, Azoarcus sp. EbN1; identical to SEQ ID NO: 31603
  CDS (1)..(1521): transl_table=11

SEQ ID NO: 63255 - protein, 506 aa, Azoarcus sp. EbN1; identical to SEQ ID NO: 31604

SEQ ID NO: 63256 - DNA, 1242 bp, Azoarcus sp. EbN1; identical to SEQ ID NO: 31605
  CDS (1)..(1242): transl_table=11

SEQ ID NO: 63257 - protein, 413 aa, Azoarcus sp. EbN1; identical to SEQ ID NO: 31606

SEQ ID NO: 63258 - DNA, 1239 bp, Zymomonas mobilis subsp. mobilis ZM4; identical to SEQ ID NO: 31607
  CDS (1)..(1239): transl_table=11

SEQ ID NO: 63259 - protein, 412 aa, Zymomonas mobilis subsp. mobilis ZM4; identical to SEQ ID NO: 31608

SEQ ID NO: 63260 - DNA, 954 bp, Silicibacter pomeroyi DSS-3; identical to SEQ ID NO: 31609
  CDS (1)..(954): transl_table=11

SEQ ID NO: 63261 - protein, 317 aa, Silicibacter pomeroyi DSS-3; identical to SEQ ID NO: 31610

SEQ ID NO: 63262 - DNA, 975 bp, Silicibacter pomeroyi DSS-3; identical to SEQ ID NO: 31611
  CDS (1)..(975): transl_table=11

SEQ ID NO: 63263 - protein, 324 aa, Silicibacter pomeroyi DSS-3; identical to SEQ ID NO: 31612

SEQ ID NO: 63264 - DNA, 1227 bp, Silicibacter pomeroyi DSS-3; identical to SEQ ID NO: 31613
  CDS (1)..(1227): transl_table=11

SEQ ID NO: 63265 - protein, 408 aa, Silicibacter pomeroyi DSS-3; identical to SEQ ID NO: 31614

SEQ ID NO: 63266 - DNA, 1008 bp, Silicibacter pomeroyi DSS-3; identical to SEQ ID NO: 31615
  CDS (1)..(1008): transl_table=11

SEQ ID NO: 63267 - protein, 335 aa, Silicibacter pomeroyi DSS-3; identical to SEQ ID NO: 31616

SEQ ID NO: 63268 - DNA, 921 bp, Silicibacter pomeroyi DSS-3; identical to SEQ ID NO: 31617
  CDS (1)..(921): transl_table=11

SEQ ID NO: 63269 - protein, 306 aa, Silicibacter pomeroyi DSS-3; identical to SEQ ID NO: 31618

SEQ ID NO: 63270 - DNA, 969 bp, Bacillus clausii KSM-K16; identical to SEQ ID NO: 31619
  CDS (1)..(969): transl_table=11

SEQ ID NO: 63271 - protein, 322 aa, Bacillus clausii KSM-K16; identical to SEQ ID NO: 31620

SEQ ID NO: 63272 - DNA, 1245 bp, Bacillus clausii KSM-K16; identical to SEQ ID NO: 31621
  CDS (1)..(1245): transl_table=11

SEQ ID NO: 63273 - protein, 414 aa, Bacillus clausii KSM-K16; identical to SEQ ID NO: 31622

SEQ ID NO: 63274 - DNA, 1071 bp, Bacillus clausii KSM-K16; identical to SEQ ID NO: 31623
  CDS (1)..(1071): transl_table=11

SEQ ID NO: 63275 - protein, 356 aa, Bacillus clausii KSM-K16; identical to SEQ ID NO: 31624

SEQ ID NO: 63276 - DNA, 978 bp, Rhodobacter sphaeroides 2.4.1; identical to SEQ ID NO: 31625
  CDS (1)..(978)

SEQ ID NO: 63277 - protein, 325 aa, Rhodobacter sphaeroides 2.4.1; identical to SEQ ID NO: 31626

SEQ ID NO: 63278 - DNA, 1053 bp, Xylella fastidiosa Dixon; identical to SEQ ID NO: 31627
  CDS (1)..(1053)

SEQ ID NO: 63279 - protein, 350 aa, Xylella fastidiosa Dixon; identical to SEQ ID NO: 31628

SEQ ID NO: 63280 - DNA, 1266 bp, Leuconostoc mesenteroides subsp. mesenteroides ATCC 8293; identical to SEQ ID NO: 31629
  CDS (1)..(1266)

SEQ ID NO: 63281 - protein, 421 aa, Leuconostoc mesenteroides subsp. mesenteroides ATCC 8293; identical to SEQ ID NO: 31630

SEQ ID NO: 63282 - DNA, 1515 bp, Azotobacter vinelandii; identical to SEQ ID NO: 31631
  CDS (1)..(1515)

SEQ ID NO: 63283 - protein, 504 aa, Azotobacter vinelandii; identical to SEQ ID NO: 31632

SEQ ID NO: 63284 - DNA, 1110 bp, Desulfitobacterium hafniense DCB-2; identical to SEQ ID NO: 31633
  CDS (1)..(1110)

SEQ ID NO: 63285 - protein, 369 aa, Desulfitobacterium hafniense DCB-2; identical to SEQ ID NO: 31634

SEQ ID NO: 63286 - DNA, 975 bp, Nostoc punctiforme PCC 73102; identical to SEQ ID NO: 31635
  CDS (1)..(975)

SEQ ID NO: 63287 - protein, 324 aa, Nostoc punctiforme PCC 73102; identical to SEQ ID NO: 31636

SEQ ID NO: 63288 - DNA, 1338 bp, Nostoc punctiforme PCC 73102; identical to SEQ ID NO: 31637
  CDS (1)..(1338)

SEQ ID NO: 63289 - protein, 445 aa, Nostoc punctiforme PCC 73102; identical to SEQ ID NO: 31638

SEQ ID NO: 63290 - DNA, 1266 bp, Bifidobacterium longum DJO10A; identical to SEQ ID NO: 31639
  CDS (1)..(1266)

SEQ ID NO: 63291 - protein, 421 aa, Bifidobacterium longum DJO10A; identical to SEQ ID NO: 31640

SEQ ID NO: 63292 - DNA, 1548 bp, Haemophilus somnus 2336; identical to SEQ ID NO: 31641
  CDS (1)..(1548)

SEQ ID NO: 63293 - protein, 515 aa, Haemophilus somnus 2336; identical to SEQ ID NO: 31642

SEQ ID NO: 63294 - DNA, 1527 bp, Actinobacillus pleuropneumoniae serovar 1 str. 4074; identical to SEQ ID NO: 31643
  CDS (1)..(1527)

SEQ ID NO: 63295 - protein, 508 aa, Actinobacillus pleuropneumoniae serovar 1 str. 4074; identical to SEQ ID NO: 31644

SEQ ID NO: 63296 - DNA, 846 bp, Pseudomonas aeruginosa UCBPP-PA14; identical to SEQ ID NO: 31645
  CDS (1)..(846)

SEQ ID NO: 63297 - protein, 281 aa, Pseudomonas aeruginosa UCBPP-PA14; identical to SEQ ID NO: 31646

SEQ ID NO: 63298 - DNA, 1515 bp, Pseudomonas aeruginosa UCBPP-PA14; identical to SEQ ID NO: 31647
  CDS (1)..(1515)

SEQ ID NO: 63299 - protein, 504 aa, Pseudomonas aeruginosa UCBPP-PA14; identical to SEQ ID NO: 31648

SEQ ID NO: 63300 - DNA, 981 bp, Psychrobacter sp. 273-4; identical to SEQ ID NO: 31649
  CDS (1)..(981)

SEQ ID NO: 63301 - protein, 326 aa, Psychrobacter sp. 273-4; identical to SEQ ID NO: 31650

SEQ ID NO: 63302 - DNA, 1554 bp, Psychrobacter sp. 273-4; identical to SEQ ID NO: 31651
  CDS (1)..(1554)

SEQ ID NO: 63303 - protein, 517 aa, Psychrobacter sp. 273-4; identical to SEQ ID NO: 31652

SEQ ID NO: 63304 - DNA, 1533 bp, Dechloromonas aromatica RCB; identical to SEQ ID NO: 31653
  CDS (1)..(1533)

SEQ ID NO: 63305 - protein, 510 aa, Dechloromonas aromatica RCB; identical to SEQ ID NO: 31654

SEQ ID NO: 63306 - DNA, 1542 bp, Haemophilus influenzae R2866; identical to SEQ ID NO: 31655
  CDS (1)..(1542)

SEQ ID NO: 63307 - protein, 513 aa, Haemophilus influenzae R2866; identical to SEQ ID NO: 31656

SEQ ID NO: 63308 - DNA, 1512 bp, Anabaena variabilis ATCC 29413; identical to SEQ ID NO: 31657
  CDS (1)..(1512)

SEQ ID NO: 63309 - protein, 503 aa, Anabaena variabilis ATCC 29413; identical to SEQ ID NO: 31658

SEQ ID NO: 63310 - DNA, 969 bp, Ralstonia eutropha JMP134; identical to SEQ ID NO: 31659
  CDS (1)..(969)

SEQ ID NO: 63311 - protein, 322 aa, Ralstonia eutropha JMP134; identical to SEQ ID NO: 31660

SEQ ID NO: 63312 - DNA, 1512 bp, Methylobacillus flagellatus KT; identical to SEQ ID NO: 31661
  CDS (1)..(1512)

SEQ ID NO: 63313 - protein, 503 aa, Methylobacillus flagellatus KT; identical to SEQ ID NO: 31662

SEQ ID NO: 63314 - DNA, 948 bp, Mesorhizobium sp. BNC1; identical to SEQ ID NO: 31663
  CDS (1)..(948)

SEQ ID NO: 63315 - protein, 315 aa, Mesorhizobium sp. BNC1; identical to SEQ ID NO: 31664

SEQ ID NO: 63316 - DNA, 975 bp, Mesorhizobium sp. BNC1; identical to SEQ ID NO: 31665
  CDS (1)..(975)

SEQ ID NO: 63317 - protein, 324 aa, Mesorhizobium sp. BNC1; identical to SEQ ID NO: 31666

SEQ ID NO: 63318 - DNA, 1560 bp, Ralstonia eutropha JMP134; identical to SEQ ID NO: 31667
  CDS (1)..(1560)

SEQ ID NO: 63319 - protein, 519 aa, Ralstonia eutropha JMP134; identical to SEQ ID NO: 31668

SEQ ID NO: 63320 - DNA, 990 bp, Anabaena variabilis ATCC 29413; identical to SEQ ID NO: 31669
  CDS (1)..(990)

SEQ ID NO: 63321 - protein, 329 aa, Anabaena variabilis ATCC 29413; identical to SEQ ID NO: 31670

SEQ ID NO: 63322 - DNA, 1524 bp, Burkholderia cepacia R18194; identical to SEQ ID NO: 31671
  CDS (1)..(1524)

SEQ ID NO: 63323 - protein, 507 aa, Burkholderia cepacia R18194; identical to SEQ ID NO: 31672

SEQ ID NO: 63324 - DNA, 921 bp, Burkholderia cepacia R18194; identical to SEQ ID NO: 31673
  CDS (1)..(921)

SEQ ID NO: 63325 - protein, 306 aa, Burkholderia cepacia R18194; identical to SEQ ID NO: 31674

SEQ ID NO: 63326 - DNA, 1044 bp, Burkholderia cepacia R1808; identical to SEQ ID NO: 31675
  CDS (1)..(1044): n means a or g or c or t/u, s means g or c

SEQ ID NO: 63327 - protein, 347 aa, Burkholderia cepacia R1808; identical to SEQ ID NO: 31676
  Xaa in position 326 is unknown

SEQ ID NO: 63328 - DNA, 921 bp, Burkholderia cepacia R1808; identical to SEQ ID NO: 31677
  CDS (1)..(921)

SEQ ID NO: 63329 - protein, 306 aa, Burkholderia cepacia R1808; identical to SEQ ID NO: 31678

SEQ ID NO: 63330 - DNA, 978 bp, Burkholderia cepacia R1808; identical to SEQ ID NO: 31679
  CDS (1)..(978)

SEQ ID NO: 63331 - protein, 325 aa, Burkholderia cepacia R1808; identical to SEQ ID NO: 31680

SEQ ID NO: 63332 - DNA, 1056 bp, Listeria monocytogenes str. 1/2a F6854; identical to SEQ ID NO: 31681
  CDS (1)..(1056): transl_table=11

SEQ ID NO: 63333 - protein, 351 aa, Listeria monocytogenes str. 1/2a F6854; identical to SEQ ID NO: 31682

SEQ ID NO: 63334 - DNA, 1581 bp, Rubrivivax gelatinosus PM1; identical to SEQ ID NO: 31683
  CDS (1)..(1581)

SEQ ID NO: 63335 - protein, 526 aa, Rubrivivax gelatinosus PM1; identical to SEQ ID NO: 31684

SEQ ID NO: 63336 - DNA, 1239 bp, Rubrivivax gelatinosus PM1; identical to SEQ ID NO: 31685
  CDS (1)..(1239)

SEQ ID NO: 63337 - protein, 412 aa, Rubrivivax gelatinosus PM1; identical to SEQ ID NO: 31686

SEQ ID NO: 63338 - DNA, 1515 bp, Pseudomonas fluorescens PfO-1; identical to SEQ ID NO: 31687
  CDS (1)..(1515)

SEQ ID NO: 63339 - protein, 504 aa, Pseudomonas fluorescens PfO-1; identical to SEQ ID NO: 31688

SEQ ID NO: 63340 - DNA, 957 bp, Pseudomonas fluorescens PfO-1; identical to SEQ ID NO: 31689
  CDS (1)..(957)

SEQ ID NO: 63341 - protein, 318 aa, Pseudomonas fluorescens PfO-1; identical to SEQ ID NO: 31690

SEQ ID NO: 63342 - DNA, 918 bp, Pseudomonas fluorescens PfO-1; identical to SEQ ID NO: 31691
  CDS (1)..(918)

SEQ ID NO: 63343 - protein, 305 aa, Pseudomonas fluorescens PfO-1; identical to SEQ ID NO: 31692

SEQ ID NO: 63344 - DNA, 993 bp, Rhodospirillum rubrum; identical to SEQ ID NO: 31693
  CDS (1)..(993)

SEQ ID NO: 63345 - protein, 330 aa, Rhodospirillum rubrum; identical to SEQ ID NO: 31694

SEQ ID NO: 63346 - DNA, 1269 bp, Rhodospirillum rubrum; identical to SEQ ID NO: 31695
  CDS (1)..(1269)

SEQ ID NO: 63347 - protein, 422 aa, Rhodospirillum rubrum; identical to SEQ ID NO: 31696

SEQ ID NO: 63348 - DNA, 1536 bp, Ralstonia metallidurans CH34; identical to SEQ ID NO: 31697
  CDS (1)..(1536)

SEQ ID NO: 63349 - protein, 511 aa, Ralstonia metallidurans CH34; identical to SEQ ID NO: 31698

SEQ ID NO: 63350 - DNA, 969 bp, Ralstonia metallidurans CH34; identical to SEQ ID NO: 31699
  CDS (1)..(969)

SEQ ID NO: 63351 - protein, 322 aa, Ralstonia metallidurans CH34; identical to SEQ ID NO: 31700

SEQ ID NO: 63352 - DNA, 966 bp, Burkholderia fungorum LB400; identical to SEQ ID NO: 31701
  CDS (1)..(966)

SEQ ID NO: 63353 - protein, 321 aa, Burkholderia fungorum LB400; identical to SEQ ID NO: 31702

SEQ ID NO: 63354 - DNA, 1035 bp, Burkholderia fungorum LB400; identical to SEQ ID NO: 31703
  CDS (1)..(1035)

SEQ ID NO: 63355 - protein, 344 aa, Burkholderia fungorum LB400; identical to SEQ ID NO: 31704

SEQ ID NO: 63356 - DNA, 1512 bp, Magnetococcus sp. MC-1; identical to SEQ ID NO: 31705
  CDS (1)..(1512)

SEQ ID NO: 63357 - protein, 503 aa, Magnetococcus sp. MC-1; identical to SEQ ID NO: 31706

SEQ ID NO: 63358 - DNA, 933 bp, Thermobifida fusca; identical to SEQ ID NO: 31707
  CDS (1)..(933)

SEQ ID NO: 63359 - protein, 310 aa, Thermobifida fusca; identical to SEQ ID NO: 31708

SEQ ID NO: 63360 - DNA, 1266 bp, Novosphingobium aromaticivorans DSM 12444; identical to SEQ ID NO: 31709
  CDS (1)..(1266)

SEQ ID NO: 63361 - protein, 421 aa, Novosphingobium aromaticivorans DSM 12444; identical to SEQ ID NO: 31710

SEQ ID NO: 63362 - DNA, 1206 bp, Ferroplasma acidarmanus; identical to SEQ ID NO: 31711
  CDS (1)..(1206)

SEQ ID NO: 63363 - protein, 401 aa, Ferroplasma acidarmanus; identical to SEQ ID NO: 31712

SEQ ID NO: 63364 - DNA, 1254 bp, Cytophaga hutchinsonii; identical to SEQ ID NO: 31713
  CDS (1)..(1254)

SEQ ID NO: 63365 - protein, 417 aa, Cytophaga hutchinsonii; identical to SEQ ID NO: 31714

SEQ ID NO: 63366 - DNA, 1512 bp, Microbulbifer degradans 2-40; identical to SEQ ID NO: 31715
  CDS (1)..(1512)

SEQ ID NO: 63367 - protein, 503 aa, Microbulbifer degradans 2-40; identical to SEQ ID NO: 31716

SEQ ID NO: 63368 - DNA, 927 bp, Haemophilus influenzae 86-028NP; identical to SEQ ID NO: 31717
  CDS (1)..(927)

SEQ ID NO: 63369 - protein, 308 aa, Haemophilus influenzae 86-028NP; identical to SEQ ID NO: 31718

SEQ ID NO: 63370 - DNA, 1056 bp, Pediococcus pentosaceus ATCC 25745; identical to SEQ ID NO: 31719
  CDS (1)..(1056)

SEQ ID NO: 63371 - protein, 351 aa, Pediococcus pentosaceus ATCC 25745; identical to SEQ ID NO: 31720

SEQ ID NO: 63372 - DNA, 1245 bp, Moorella thermoacetica ATCC 39073; identical to SEQ ID NO: 31721
  CDS (1)..(1245)

SEQ ID NO: 63373 - protein, 414 aa, Moorella thermoacetica ATCC 39073; identical to SEQ ID NO: 31722

SEQ ID NO: 63374 - DNA, 1518 bp, Thiobacillus denitrificans ATCC 25259; identical to SEQ ID NO: 31723
  CDS (1)..(1518)

SEQ ID NO: 63375 - protein, 505 aa, Thiobacillus denitrificans ATCC 25259; identical to SEQ ID NO: 31724

SEQ ID NO: 63376 - DNA, 903 bp, Silicibacter sp. TM1040; identical to SEQ ID NO: 31725
  CDS (1)..(903)

SEQ ID NO: 63377 - protein, 300 aa, Silicibacter sp. TM1040; identical to SEQ ID NO: 31726

SEQ ID NO: 63378 - DNA, 966 bp, Silicibacter sp. TM1040; identical to SEQ ID NO: 31727
  CDS (1)..(966)

SEQ ID NO: 63379 - protein, 321 aa, Silicibacter sp. TM1040; identical to SEQ ID NO: 31728

SEQ ID NO: 63380 - DNA, 1284 bp, Silicibacter sp. TM1040; identical to SEQ ID NO: 31729
  CDS (1)..(1284)

SEQ ID NO: 63381 - protein, 427 aa, Silicibacter sp. TM1040; identical to SEQ ID NO: 31730

SEQ ID NO: 63382 - DNA, 1002 bp, Rickettsia akari str. Hartford; identical to SEQ ID NO: 31731
  CDS (1)..(1002)

SEQ ID NO: 63383 - protein, 333 aa, Rickettsia akari str. Hartford; identical to SEQ ID NO: 31732

SEQ ID NO: 63384 - DNA, 1236 bp, Chloroflexus aurantiacus; identical to SEQ ID NO: 31733
  CDS (1)..(1236)

SEQ ID NO: 63385 - protein, 411 aa, Chloroflexus aurantiacus; identical to SEQ ID NO: 31734

SEQ ID NO: 63386 - DNA, 993 bp, Chloroflexus aurantiacus; identical to SEQ ID NO: 31735
  CDS (1)..(993)

SEQ ID NO: 63387 - protein, 330 aa, Chloroflexus aurantiacus; identical to SEQ ID NO: 31736

SEQ ID NO: 63388 - DNA, 1518 bp, Chloroflexus aurantiacus; identical to SEQ ID NO: 31737
  CDS (1)..(1518)

SEQ ID NO: 63389 - protein, 505 aa, Chloroflexus aurantiacus; identical to SEQ ID NO: 31738

SEQ ID NO: 63390 - DNA, 975 bp, Polaromonas sp. JS666; identical to SEQ ID NO: 31739
  CDS (1)..(975)

SEQ ID NO: 63391 - protein, 324 aa, Polaromonas sp. JS666; identical to SEQ ID NO: 31740

SEQ ID NO: 63392 - DNA, 1647 bp, Polaromonas sp. JS666; identical to SEQ ID NO: 31741
  CDS (1)..(1647)

SEQ ID NO: 63393 - protein, 548 aa, Polaromonas sp. JS666; identical to SEQ ID NO: 31742

SEQ ID NO: 63394 - DNA, 1203 bp, Polaromonas sp. JS666; identical to SEQ ID NO: 31743
  CDS (1)..(1203)

SEQ ID NO: 63395 - protein, 400 aa, Polaromonas sp. JS666; identical to SEQ ID NO: 31744

SEQ ID NO: 63396 - DNA, 1008 bp, Polaromonas sp. JS666; identical to SEQ ID NO: 31745
  CDS (1)..(1008)

SEQ ID NO: 63397 - protein, 335 aa, Polaromonas sp. JS666; identical to SEQ ID NO: 31746

SEQ ID NO: 63398 - DNA, 942 bp, Polaromonas sp. JS666; identical to SEQ ID NO: 31747
  CDS (1)..(942)

SEQ ID NO: 63399 - protein, 313 aa, Polaromonas sp. JS666; identical to SEQ ID NO: 31748

SEQ ID NO: 63400 - DNA, 1212 bp, Campylobacter lari RM2100; identical to SEQ ID NO: 31749
  CDS (1)..(1212): transl_table=11

SEQ ID NO: 63401 - protein, 403 aa, Campylobacter lari RM2100; identical to SEQ ID NO: 31750

SEQ ID NO: 63402 - DNA, 1038 bp, Leuconostoc mesenteroides; identical to SEQ ID NO: 31751
  CDS (1)..(1038): transl_table=11

SEQ ID NO: 63403 - protein, 345 aa, Leuconostoc mesenteroides; identical to SEQ ID NO: 31752

SEQ ID NO: 63404 - DNA, 1500 bp, Caenorhabditis elegans; identical to SEQ ID NO: 31753
  CDS (1)..(1500)

SEQ ID NO: 63405 - protein, 499 aa, Caenorhabditis elegans; identical to SEQ ID NO: 31754

SEQ ID NO: 63406 - DNA, 1137 bp, Sorghum bicolor; identical to SEQ ID NO: 31755
  CDS (1)..(1137)

SEQ ID NO: 63407 - protein, 378 aa, Sorghum bicolor; identical to SEQ ID NO: 31756

SEQ ID NO: 63408 - DNA, 1002 bp, Saccharopolyspora spinosa; identical to SEQ ID NO: 31757
  CDS (1)..(1002): transl_table=11

SEQ ID NO: 63409 - protein, 333 aa, Saccharopolyspora spinosa; identical to SEQ ID NO: 31758

SEQ ID NO: 63410 - DNA, 978 bp, Xenopus laevis; identical to SEQ ID NO: 31759
  CDS (1)..(978)

SEQ ID NO: 63411 - protein, 325 aa, Xenopus laevis; identical to SEQ ID NO: 31760

SEQ ID NO: 63412 - DNA, 1536 bp, uncultured bacterium 311; identical to SEQ ID NO: 31761
  CDS (1)..(1536): transl_table=11

SEQ ID NO: 63413 - protein, 511 aa, uncultured bacterium 311; identical to SEQ ID NO: 31762

SEQ ID NO: 63414 - DNA, 972 bp, Rhizobium sp; identical to SEQ ID NO: 31763
  CDS (1)..(972): transl_table=11

SEQ ID NO: 63415 - protein, 323 aa, Rhizobium sp; identical to SEQ ID NO: 31764

SEQ ID NO: 63416 - DNA, 969 bp, Acinetobacter baumannii; identical to SEQ ID NO: 31765
  CDS (1)..(969): transl_table=11

SEQ ID NO: 63417 - protein, 322 aa, Acinetobacter baumannii; identical to SEQ ID NO: 31766

SEQ ID NO: 63418 - DNA, 3522 bp, Dictyostelium discoideum; identical to SEQ ID NO: 31767
  CDS (1)..(3522)

SEQ ID NO: 63419 - protein, 1173 aa, Dictyostelium discoideum; identical to SEQ ID NO: 31768

SEQ ID NO: 63420 - DNA, 1053 bp, Dictyostelium discoideum; identical to SEQ ID NO: 31769
  CDS (1)..(1053)

SEQ ID NO: 63421 - protein, 350 aa, Dictyostelium discoideum; identical to SEQ ID NO: 31770

SEQ ID NO: 63422 - DNA, 1740 bp, Giardia lamblia; identical to SEQ ID NO: 31771
  CDS (1)..(1740)

SEQ ID NO: 63423 - protein, 579 aa, Giardia lamblia; identical to SEQ ID NO: 31772

SEQ ID NO: 63424 - DNA, 1848 bp, Podospora anserina; identical to SEQ ID NO: 31773
  CDS (1)..(1848)

SEQ ID NO: 63425 - protein, 615 aa, Podospora anserina; identical to SEQ ID NO: 31774

SEQ ID NO: 63426 - DNA, 981 bp, Burkholderia pickettii; identical to SEQ ID NO: 31775
  CDS (1)..(981): transl_table=11

SEQ ID NO: 63427 - protein, 326 aa, Burkholderia pickettii; identical to SEQ ID NO: 31776

SEQ ID NO: 63428 - DNA, 1779 bp, Arabidopsis thaliana; identical to SEQ ID NO: 31777
  CDS (1)..(1779)

SEQ ID NO: 63429 - protein, 592 aa, Arabidopsis thaliana; identical to SEQ ID NO: 31778

SEQ ID NO: 63430 - DNA, 1080 bp, Mus musculus; identical to SEQ ID NO: 31779
  CDS (1)..(1080)

SEQ ID NO: 63431 - protein, 359 aa, Mus musculus; identical to SEQ ID NO: 31780

SEQ ID NO: 63432 - DNA, 1809 bp, Oryza sativa; identical to SEQ ID NO: 31781
  CDS (1)..(1809)

SEQ ID NO: 63433 - protein, 602 aa, Oryza sativa; identical to SEQ ID NO: 31782

SEQ ID NO: 63434 - DNA, 942 bp, Mus musculus; identical to SEQ ID NO: 31783
  CDS (1)..(942)

SEQ ID NO: 63435 - protein, 313 aa, Mus musculus; identical to SEQ ID NO: 31784

SEQ ID NO: 63436 - DNA, 1806 bp, Nicotiana attenuata; identical to SEQ ID NO: 31785
  CDS (1)..(1806)

SEQ ID NO: 63437 - protein, 601 aa, Nicotiana attenuata; identical to SEQ ID NO: 31786

SEQ ID NO: 63438 - DNA, 1542 bp, Gamma; identical to SEQ ID NO: 31787
  CDS (1)..(1542): n means a or g or c or t/u, s means g or c

SEQ ID NO: 63439 - protein, 513 aa, Gamma; identical to SEQ ID NO: 31788
  Xaa in position 460 is unknown

SEQ ID NO: 63440 - DNA, 1113 bp, Bacillus halodurans; identical to SEQ ID NO: 31789
  CDS (1)..(1113): transl_table=11

SEQ ID NO: 63441 - protein, 370 aa, Bacillus halodurans; identical to SEQ ID NO: 31790

SEQ ID NO: 63442 - DNA, 1263 bp, Bacillus cereus; identical to SEQ ID NO: 31791
  CDS (1)..(1263): transl_table=11

SEQ ID NO: 63443 - protein, 420 aa, Bacillus cereus; identical to SEQ ID NO: 31792

SEQ ID NO: 63444 - DNA, 987 bp, Homo sapiens; identical to SEQ ID NO: 31793
  CDS (1)..(987)

SEQ ID NO: 63445 - protein, 328 aa, Homo sapiens; identical to SEQ ID NO: 31794

SEQ ID NO: 63446 - DNA, 984 bp, Mus musculus; identical to SEQ ID NO: 31795
  CDS (1)..(984)

SEQ ID NO: 63447 - protein, 327 aa, Mus musculus; identical to SEQ ID NO: 31796

SEQ ID NO: 63448 - DNA, 1023 bp, Homo sapiens; identical to SEQ ID NO: 31797
  CDS (1)..(1023)

SEQ ID NO: 63449 - protein, 340 aa, Homo sapiens; identical to SEQ ID NO: 31798

SEQ ID NO: 63450 - DNA, 1020 bp, Mus musculus; identical to SEQ ID NO: 31799
  CDS (1)..(1020)

SEQ ID NO: 63451 - protein, 339 aa, Mus musculus; identical to SEQ ID NO: 31800

SEQ ID NO: 63452 - DNA, 1083 bp, Saccharomyces cerevisiae; identical to SEQ ID NO: 31801
  CDS (1)..(1083)

SEQ ID NO: 63453 - protein, 360 aa, Saccharomyces cerevisiae; identical to SEQ ID NO: 31802

SEQ ID NO: 63454 - DNA, 1269 bp, Bacillus subtilis; identical to SEQ ID NO: 31803
  CDS (1)..(1269): transl_table=11

SEQ ID NO: 63455 - protein, 422 aa, Bacillus subtilis; identical to SEQ ID NO: 31804

SEQ ID NO: 63456 - DNA, 1773 bp, Cicer arietinum; identical to SEQ ID NO: 31805
  CDS (1)..(1773)

SEQ ID NO: 63457 - protein, 590 aa, Cicer arietinum; identical to SEQ ID NO: 31806

SEQ ID NO: 63458 - DNA, 1311 bp, Corynebacterium glutamicum; identical to SEQ ID NO: 31807
  CDS (1)..(1311): transl_table=11

SEQ ID NO: 63459 - protein, 436 aa, Corynebacterium glutamicum; identical to SEQ ID NO: 31808

SEQ ID NO: 63460 - DNA, 1545 bp, Escherichia coli; identical to SEQ ID NO: 31809
  CDS (1)..(1545): transl_table=11

SEQ ID NO: 63461 - protein, 514 aa, Escherichia coli [sequence omitted]

SEQ ID NO: 63462 - DNA, 1251 bp, Lactococcus lactis; identical to SEQ ID NO: 31811
  CDS (1)..(1251): transl_table=11

SEQ ID NO: 63463 - protein, 416 aa, Lactococcus lactis; identical to SEQ ID NO: 31812

SEQ ID NO: 63464 - DNA, 1788 bp, Lycopersicon esculentum; identical to SEQ ID NO: 31813
  CDS (1)..(1788)

SEQ ID NO: 63465 - protein, 595 aa, Lycopersicon esculentum; identical to SEQ ID NO: 31814

SEQ ID NO: 63466 - DNA, 1290 bp, Mycobacterium bovis; identical to SEQ ID NO: 31815
  CDS (1)..(1290): transl_table=11

SEQ ID NO: 63467 - protein, 429 aa, Mycobacterium bovis; identical to SEQ ID NO: 31816

SEQ ID NO: 63468 - DNA, 1284 bp, Mycobacterium leprae; identical to SEQ ID NO: 31817
  CDS (1)..(1284): transl_table=11

SEQ ID NO: 63469 - protein, 427 aa, Mycobacterium leprae; identical to SEQ ID NO: 31818

SEQ ID NO: 63470 - DNA, 1542 bp, Pasteurella multocida; identical to SEQ ID NO: 31819
  CDS (1)..(1542): transl_table=11

SEQ ID NO: 63471 - protein, 513 aa, Pasteurella multocida; identical to SEQ ID NO: 31820

SEQ ID NO: 63472 - DNA, 1545 bp, Salmonella typhimurium; identical to SEQ ID NO: 31821
  CDS (1)..(1545): transl_table=11

SEQ ID NO: 63473 - protein, 514 aa, Salmonella typhimurium; identical to SEQ ID NO: 31822

SEQ ID NO: 63474 - DNA, 990 bp, Salmonella typhimurium; identical to SEQ ID NO: 31823
  CDS (1)..(990): transl_table=11

SEQ ID NO: 63475 - protein, 329 aa, Salmonella typhimurium; identical to SEQ ID NO: 31824

SEQ ID NO: 63476 - DNA, 1653 bp, Arxula adeninivorans; identical to SEQ ID NO: 31825
  CDS (1)..(1653)

SEQ ID NO: 63477 - protein, 550 aa, Arxula adeninivorans; identical to SEQ ID NO: 31826

SEQ ID NO: 63478 - DNA, 1731 bp, Saccharomyces cerevisiae; identical to SEQ ID NO: 31827
  CDS (1)..(1731)

SEQ ID NO: 63479 - protein, 576 aa, Saccharomyces cerevisiae; identical to SEQ ID NO: 31828

SEQ ID NO: 63480 - DNA, 1149 bp, Synechocystis sp; identical to SEQ ID NO: 31829
  CDS (1)..(1149)

SEQ ID NO: 63481 - protein, 382 aa, Synechocystis sp; identical to SEQ ID NO: 31830

SEQ ID NO: 63482 - DNA, 999 bp, Rhizobium sp; identical to SEQ ID NO: 31831
  CDS (1)..(999): transl_table=11

SEQ ID NO: 63483 - protein, 332 aa, Rhizobium sp; identical to SEQ ID NO: 31832

SEQ ID NO: 63484 - DNA, 972 bp, Schizosaccharomyces pombe; identical to SEQ ID NO: 31833
  CDS (1)..(972)

SEQ ID NO: 63485 - protein, 323 aa, Schizosaccharomyces pombe; identical to SEQ ID NO: 31834

SEQ ID NO: 63486 - DNA, 981 bp, Saccharomyces cerevisiae; identical to SEQ ID NO: 31835
  CDS (1)..(981)

SEQ ID NO: 63487 - protein, 326 aa, Saccharomyces cerevisiae; identical to SEQ ID NO: 31836

SEQ ID NO: 63488 - DNA, 24 bp, Artificial sequence
  (1)..(24): primer
atgcatattacatacgatctgccg

SEQ ID NO: 63489 - DNA, 23 bp, Artificial sequence
  (1)..(23): primer
ttaagcgtcaacgaaaccggtga

SEQ ID NO: 63490 - protein, 516 aa, Artificial sequence; identical to SEQ ID NO: 31839
  Variant (3)..(13): xaa in position 3 to 13 is any amino acid
  Variant (14)..(96): xaa in position 14 to 96 is any or no amino acid
  Variant (98)..(98): xaa in position 98 is any amino acid
  Variant (100)..(101): xaa in position 100 to 101 is any amino acid
  Variant (103)..(106): xaa in position 103 to 106 is any amino acid
  Variant (107)..(121): xaa in position 107 to 121 is any or no amino acid
  Variant (124)..(124): xaa in position 124 is any amino acid
  Variant (127)..(138): xaa in position 127 to 138 is any amino acid
  Variant (139)..(178): xaa in position 139 to 178 is any or no amino acid
  Variant (180)..(180): xaa in position 180 is any amino acid
  Variant (184)..(185): xaa in position 184 to 185 is any amino acid
  Variant (186)..(189): xaa in position 186 to 189 is any or no amino acid
  Variant (191)..(204): xaa in position 191 to 204 is any amino acid
  Variant (206)..(211): xaa in position 206 to 211 is any amino acid
  Variant (213)..(219): xaa in position 213 to 219 is any amino acid
  Variant (221)..(257): xaa in position 221 to 257 is any amino acid
  Variant (258)..(270): xaa in position 258 to 270 is any or no amino acid
  Variant (273)..(273): xaa in position 273 is any amino acid
  Variant (275)..(277): xaa in position 275 to 277 is any amino acid
  Variant (279)..(291): xaa in position 279 to 291 is any amino acid
  Variant (292)..(340): xaa in position 292 to 340 is any or no amino acid
  Variant (346)..(347): xaa in position 346 to 347 is any amino acid
  Variant (349)..(394): xaa in position 349 to 394 is any amino acid
  Variant (395)..(440): xaa in position 395 to 440 is any or no amino acid
  Variant (442)..(461): xaa in position 442 to 461 is any amino acid
  Variant (463)..(469): xaa in position 463 to 469 is any amino acid
  Variant (471)..(484): xaa in position 471 to 484 is any amino acid
  Variant (485)..(513): xaa in position 485 to 513 is any or no amino acid
  Variant (515)..(515): xaa in position 515 is any amino acid

SEQ ID NO: 63491 - protein, 224 aa, Artificial sequence; identical to SEQ ID NO: 31840
  Variant (1)..(1): xaa in position 1 is Val, Ile, Leu, Phe or Met
  Variant (2)..(3): xaa in position 2 to 3 is any amino acid
  Variant (5)..(5): xaa in position 5 is any amino acid
  Variant (6)..(6): xaa in position 6 is Glu or Asp
  Variant (7)..(8): xaa in position 7 to 8 is any amino acid
  Variant (9)..(9): xaa in position 9 is Gln, Asn, Leu, Thr or Ser
  Variant (10)..(12): xaa in position 10 to 12 is any amino acid
  Variant (13)..(13): xaa in position 13 is Ser, Ala or Thr
  Variant (14)..(14): xaa in position 14 is Phe or Tyr
  Variant (15)..(15): xaa in position 15 is Lys or Arg
  Variant (16)..(16): xaa in position 16 is any amino acid
  Variant (18)..(18): xaa in position 18 is Gly or Leu
  Variant (19)..(35): xaa in position 19 to 35 is any amino acid
  Variant (36)..(54): xaa in position 36 to 54 is any or no amino acid
  Variant (55)..(55): xaa in position 55 is Ser or Thr
  Variant (56)..(56): xaa in position 56 is any amino acid
  Variant (58)..(58): xaa in position 58 is Asn or Gly
  Variant (59)..(59): xaa in position 59 is any amino acid
  Variant (60)..(60): xaa in position 60 is Ala, Gly or Ser
  Variant (61)..(61): xaa in position 61 is any amino acid
  Variant (62)..(62): xaa in position 62 is any or no amino acid
  Variant (63)..(63): xaa in position 63 is Gly, Ala, Leu, Ser or Cys
  Variant (64)..(64): xaa in position 64 is any amino acid
  Variant (65)..(65): xaa in position 65 is Ala or Ser
  Variant (66)..(67): xaa in position 66 to 67 is any amino acid
  Variant (68)..(68): xaa in position 68 is Ala, Cys, Gly or Ser
  Variant (69)..(76): xaa in position 69 to 76 is any amino acid
  Variant (77)..(77): xaa in position 77 is Ile, Val, Leu or Thr
  Variant (78)..(78): xaa in position 78 is Val, Phe, Ile, Tyr, Leu, Cys or Ala
  Variant (79)..(79): xaa in position 79 is Met, Val, Pro, Leu, Ile or Ala
  Variant (80)..(80): xaa in position 80 is Pro, Ser, Thr, Glu, Lys or Asp
  Variant (81)..(82): xaa in position 81 to 82 is any amino acid
  Variant (83)..(83): xaa in position 83 is Thr, Ala, Val, Ile, Lys, Ser or Asn
  Variant (84)..(86): xaa in position 84 to 86 is any amino acid
  Variant (87)..(87): xaa in position 87 is Lys, Ile, Val, Thr, Ala or Met
  Variant (88)..(94): xaa in position 88 to 94 is any amino acid
  Variant (95)..(95): xaa in position 95 is any or no amino acid
  Variant (96)..(96): xaa in position 96 is Gly or Ser
  Variant (97)..(97): xaa in position 97 is Ala, Gly, Lys or Ser
  Variant (98)..(123): xaa in position 98 to 123 is any amino acid
  Variant (124)..(135): xaa in position 124 to 135 is any or no amino acid
  Variant (136)..(136): xaa in position 136 is Ile, Val, Leu or Phe
  Variant (137)..(144): xaa in position 137 to 144 is any amino acid
  Variant (145)..(145): xaa in position 145 is Ile, Met, Leu, Val, Trp, Ala or Gln
  Variant (146)..(146): xaa in position 146 is any amino acid
  Variant (148)..(148): xaa in position 148 is any amino acid
  Variant (149)..(149): xaa in position 149 is Gly, Ala, Lys, Ser, Arg or Thr
  Variant (150)..(150): xaa in position 150 is Thr or Ser
  Variant (151)..(153): xaa in position 151 to 153 is any amino acid
  Variant (154)..(154): xaa in position 154 is Glu or Asp
  Variant (155)..(155): xaa in position 155 is Ile, Leu, Met, Val, Ala, Phe or Trp
  Variant (156)..(162): xaa in position 156 to 162 is any amino acid
  Variant (163)..(211): xaa in position 163 to 211 is any or no amino acid
  Variant (212)..(212): xaa in position 212 is Val, Ile or Leu
  Variant (213)..(214): xaa in position 213 to 214 is any amino acid
  Variant (215)..(215): xaa in position 215 is Pro, Ala, Ser, Cys, Gly, Gln or Asn
  Variant (216)..(216): xaa in position 216 is Val, Ile, Leu, Met, Thr, Cys or Ala
  Variant (217)..(217): xaa in position 217 is Gly or Ser
  Variant (218)..(218): xaa in position 218 is any amino acid
  Variant (219)..(219): xaa in position 219 is Gly or Ala
  Variant (220)..(220): xaa in position 220 is Gly or Ser
  Variant (221)..(223): xaa in position 221 to 223 is any amino acid
  Variant (224)..(224): xaa in position 224 is Gly, Ala or Ser

SEQ ID NO: 63492 - DNA, 2376 bp, Saccharomyces cerevisiae; identical to SEQ ID NO: 35553
  CDS (1)..(2376)

SEQ ID NO: 63493 - protein, 791 aa, Saccharomyces cerevisiae; identical to SEQ ID NO: 35554

SEQ ID NO: 63494 - DNA, 717 bp, Danio rerio; identical to SEQ ID NO: 35555
  CDS (1)..(717)

SEQ ID NO: 63495 - protein, 238 aa, Danio rerio; identical to SEQ ID NO: 35556

SEQ ID NO: 63496 - DNA, 1506 bp, Caenorhabditis elegans; identical to SEQ ID NO: 35557
  CDS (1)..(1506)

SEQ ID NO: 63497 - protein, 501 aa, Caenorhabditis elegans; identical to SEQ ID NO: 35558

SEQ ID NO: 63498 - DNA, 684 bp, Caenorhabditis elegans; identical to SEQ ID NO: 35559
  CDS (1)..(684)

SEQ ID NO: 63499 - protein, 227 aa, Caenorhabditis elegans; identical to SEQ ID NO: 35560

SEQ ID NO: 63500 - DNA, 720 bp, Homo sapiens; identical to SEQ ID NO: 35561
  CDS (1)..(720)

SEQ ID NO: 63501 - protein, 239 aa, Homo sapiens; identical to SEQ ID NO: 35562

SEQ ID NO: 63502 - DNA, 1272 bp, Leptospira interrogans serovar Lai str. 56601; identical to SEQ ID NO: 35563
  CDS (1)..(1272): transl_table=11

SEQ ID NO: 63503 - protein, 423 aa, Leptospira interrogans serovar Lai str. 56601; identical to SEQ ID NO: 35564

SEQ ID NO: 63504 - DNA, 1497 bp, Leptospira interrogans serovar Lai str. 56601; identical to SEQ ID NO: 35565
  CDS (1)..(1497): transl_table=11

SEQ ID NO: 63505 - protein, 498 aa, Leptospira interrogans serovar Lai str. 56601; identical to SEQ ID NO: 35566

SEQ ID NO: 63506 - DNA, 1287 bp, Leptospira interrogans serovar Lai str. 56601; identical to SEQ ID NO: 35567
  CDS (1)..(1287): transl_table=11

SEQ ID NO: 63507 - protein, 428 aa, Leptospira interrogans serovar Lai str. 56601; identical to SEQ ID NO: 35568

SEQ ID NO: 63508 - DNA, 870 bp, Leptospira interrogans serovar Lai str. 56601; identical to SEQ ID NO: 35569
  CDS (1)..(870): transl_table=11

SEQ ID NO: 63509 - protein, 289 aa, Leptospira interrogans serovar Lai str. 56601; identical to SEQ ID NO: 35570

SEQ ID NO: 63510 - DNA, 1281 bp, Leptospira interrogans serovar Lai str. 56601; identical to SEQ ID NO: 35571
  CDS (1)..(1281): transl_table=11

SEQ ID NO: 63511 - protein, 426 aa, Leptospira interrogans serovar Lai str. 56601; identical to SEQ ID NO: 35572

SEQ ID NO: 63512 - DNA, 1227 bp, Leptospira interrogans serovar Lai str. 56601; identical to SEQ ID NO: 35573
  CDS (1)..(1227): transl_table=11

SEQ ID NO: 63513 - protein, 408 aa, Leptospira interrogans serovar Lai str. 56601; identical to SEQ ID NO: 35574

SEQ ID NO: 63514 - DNA, 1134 bp, Leptospira interrogans serovar Lai str. 56601; identical to SEQ ID NO: 35575
  CDS (1)..(1134): transl_table=11

SEQ ID NO: 63515 - protein, 377 aa, Leptospira interrogans serovar Lai str. 56601; identical to SEQ ID NO: 35576

SEQ ID NO: 63516 - DNA, 936 bp, Leptospira interrogans serovar Lai str. 56601; identical to SEQ ID NO: 35577
  CDS (1)..(936): transl_table=11

SEQ ID NO: 63517 - protein, 311 aa, Leptospira interrogans serovar Lai str. 56601; identical to SEQ ID NO: 35578

SEQ ID NO: 63518 - DNA, 990 bp, Leptospira interrogans serovar Lai str. 56601; identical to SEQ ID NO: 35579
  CDS (1)..(990): transl_table=11

SEQ ID NO: 63519 - protein, 329 aa, Leptospira interrogans serovar Lai str. 56601; identical to SEQ ID NO: 35580

SEQ ID NO: 63520 - DNA, 1458 bp, Caenorhabditis elegans; identical to SEQ ID NO: 35581
  CDS (1)..(1458)

SEQ ID NO: 63521 - protein, 485 aa, Caenorhabditis elegans; identical to SEQ ID NO: 35582

SEQ ID NO: 63522 - DNA, 2160 bp, Eremothecium gossypii; identical to SEQ ID NO: 35583
  CDS (1)..(2160)

SEQ ID NO: 63523 - protein, 719 aa, Eremothecium gossypii; identical to SEQ ID NO: 35584

SEQ ID NO: 63524 - DNA, 3123 bp, Magnaporthe grisea 70-15; identical to SEQ ID NO: 35585
  CDS (1)..(3123)

SEQ ID NO: 63525 - protein, 1040 aa, Magnaporthe grisea 70-15; identical to SEQ ID NO: 35586

SEQ ID NO: 63526 - DNA, 2940 bp, Gibberella zeae PH-1; identical to SEQ ID NO: 35587
  CDS (1)..(2940)

SEQ ID NO: 63527 - protein, 979 aa, Gibberella zeae PH-1; identical to SEQ ID NO: 35588

SEQ ID NO: 63528 - DNA, 2943 bp, Aspergillus nidulans FGSC A4; identical to SEQ ID NO: 35589
  CDS (1)..(2943)

SEQ ID NO: 63529 - protein, 980 aa, Aspergillus nidulans FGSC A4; identical to SEQ ID NO: 35590

SEQ ID NO: 63530 - DNA, 2607 bp, Candida glabrata CBS138; identical to SEQ ID NO: 35591
  CDS (1)..(2607)

SEQ ID NO: 63531 - protein, 868 aa, Candida glabrata CBS138; identical to SEQ ID NO: 35592

SEQ ID NO: 63532 - DNA, 2379 bp, Kluyveromyces lactis NRRL Y-1140; identical to SEQ ID NO: 35593
  CDS (1)..(2379)

SEQ ID NO: 63533 - protein, 792 aa, Kluyveromyces lactis NRRL Y-1140; identical to SEQ ID NO: 35594

SEQ ID NO: 63534 - DNA, 2301 bp, Yarrowia lipolytica CLIB99; identical to SEQ ID NO: 35595
  CDS (1)..(2301)

SEQ ID NO: 63535 - protein, 766 aa, Yarrowia lipolytica CLIB99; identical to SEQ ID NO: 35596

SEQ ID NO: 63536 - DNA, 2466 bp, Candida albicans SC5314; identical to SEQ ID NO: 35597
  CDS (1)..(2466): transl_table=12

SEQ ID NO: 63537 - protein, 821 aa, Candida albicans SC5314; identical to SEQ ID NO: 35598

SEQ ID NO: 63538 - DNA, 1137 bp, Leptospira interrogans serovar Copenhageni str. Fiocruz L1-130; identical to SEQ ID NO: 35599
  CDS (1)..(1137): transl_table=11

SEQ ID NO: 63539 - protein, 378 aa, Leptospira interrogans serovar Copenhageni str. Fiocruz L1-130; identical to SEQ ID NO: 35600

SEQ ID NO: 63540 - DNA, 1209 bp, Leptospira interrogans serovar Copenhageni str. Fiocruz L1-130; identical to SEQ ID NO: 35601
  CDS (1)..(1209): transl_table=11

SEQ ID NO: 63541 - protein, 402 aa, Leptospira interrogans serovar Copenhageni str. Fiocruz L1-130; identical to SEQ ID NO: 35602

SEQ ID NO: 63542 - DNA, 1566 bp, Leptospira interrogans serovar Copenhageni str. Fiocruz L1-130; identical to SEQ ID NO: 35603
  CDS (1)..(1566): transl_table=11

SEQ ID NO: 63543 - protein, 521 aa, Leptospira interrogans serovar Copenhageni str. Fiocruz L1-130; identical to SEQ ID NO: 35604

SEQ ID NO: 63544 - DNA, 1134 bp, Leptospira interrogans serovar Copenhageni str. Fiocruz L1-130; identical to SEQ ID NO: 35605
  CDS (1)..(1134): transl_table=11

SEQ ID NO: 63545 - protein, 377 aa, Leptospira interrogans serovar Copenhageni str. Fiocruz L1-130; identical to SEQ ID NO: 35606

SEQ ID NO: 63546 - DNA, 1281 bp, Leptospira interrogans serovar Copenhageni str. Fiocruz L1-130; identical to SEQ ID NO: 35607
  CDS (1)..(1281): transl_table=11

SEQ ID NO: 63547 - protein, 426 aa, Leptospira interrogans serovar Copenhageni str. Fiocruz L1-130; identical to SEQ ID NO: 35608

SEQ ID NO: 63548 - DNA, 1719 bp, Leptospira interrogans serovar Copenhageni str. Fiocruz L1-130; identical to SEQ ID NO: 35609
  CDS (1)..(1719): transl_table=11

SEQ ID NO: 63549 - protein, 572 aa, Leptospira interrogans serovar Copenhageni str. Fiocruz L1-130; identical to SEQ ID NO: 35610

SEQ ID NO: 63550 - DNA, 1272 bp, Leptospira interrogans serovar Copenhageni str. Fiocruz L1-130; identical to SEQ ID NO: 35611
  CDS (1)..(1272): transl_table=11

SEQ ID NO: 63551 - protein, 423 aa, Leptospira interrogans serovar Copenhageni str. Fiocruz L1-130; identical to SEQ ID NO: 35612

SEQ ID NO: 63552 - DNA, 819 bp, Leptospira interrogans serovar Copenhageni str. Fiocruz L1-130; identical to SEQ ID NO: 35613
  CDS (1)..(819): transl_table=11

SEQ ID NO: 63553 - protein, 272 aa, Leptospira interrogans serovar Copenhageni str. Fiocruz L1-130; identical to SEQ ID NO: 35614

SEQ ID NO: 63554 - DNA, 1320 bp, Caenorhabditis briggsae; identical to SEQ ID NO: 35615
  CDS (1)..(1320)

SEQ ID NO: 63555 - protein, 439 aa, Caenorhabditis briggsae; identical to SEQ ID NO: 35616

SEQ ID NO: 63556 - DNA, 720 bp, Homo sapiens; identical to SEQ ID NO: 35617
  CDS (1)..(720)

SEQ ID NO: 63557 - protein, 239 aa, Homo sapiens; identical to SEQ ID NO: 35618

SEQ ID NO: 63558 - DNA, 720 bp, Homo sapiens; identical to SEQ ID NO: 35619
  CDS (1)..(720)

SEQ ID NO: 63559 - protein, 239 aa, Homo sapiens; identical to SEQ ID NO: 35620

SEQ ID NO: 63560 - DNA, 24 bp, Artificial sequence
  (1)..(24): primer
atggtagcgacatcttcaaagagg

SEQ ID NO: 63561 - DNA, 23 bp, Artificial sequence
  (1)..(23): primer
ttactccggagagttggcgctta

SEQ ID NO: 63562 - protein, 380 aa, Artificial sequence; identical to SEQ ID NO: 35623
  Variant (2)..(9): xaa in position 2 to 9 is any amino acid
  Variant (10)..(11): xaa in position 10 to 11 is any or no amino acid
  Variant (13)..(13): xaa in position 13 is any amino acid
  Variant (15)..(18): xaa in position 15 to 18 is any amino acid
  Variant (20)..(21): xaa in position 20 to 21 is any amino acid
  Variant (24)..(24): xaa in position 24 is any amino acid
  Variant (27)..(28): xaa in position 27 to 28 is any amino acid
  Variant (30)..(31): xaa in position 30 to 31 is any amino acid
  Variant (32)..(33): xaa in position 32 to 33 is any or no amino acid
  Variant (35)..(36): xaa in position 35 to 36 is any amino acid
  Variant (38)..(38): xaa in position 38 is any amino acid
  Variant (40)..(41): xaa in position 40 to 41 is any amino acid
  Variant (43)..(45): xaa in position 43 to 45 is any or no amino acid
  Variant (47)..(52): xaa in position 47 to 52 is any amino acid
  Variant (53)..(53): xaa in position 53 is any or no amino acid
  Variant (55)..(59): xaa in position 55 to 59 is any amino acid
  Variant (61)..(62): xaa in position 61 to 62 is any amino acid
  Variant (64)..(64): xaa in position 64 is any amino acid
  Variant (66)..(67): xaa in position 66 to 67 is any amino acid
  Variant (69)..(75): xaa in position 69 to 75 is any amino acid
  Variant (76)..(90): xaa in position 76 to 90 is any or no amino acid
  Variant (93)..(94): xaa in position 93 to 94 is any amino acid
  Variant (96)..(97): xaa in position 96 to 97 is any amino acid
  Variant (99)..(105): xaa in position 99 to 105 is any amino acid
  Variant (106)..(128): xaa in position 106 to 128 is any or no amino acid
  Variant (130)..(137): xaa in position 130 to 137 is any amino acid
  Variant (139)..(143): xaa in position 139 to 143 is any amino acid
  Variant (145)..(151): xaa in position 145 to 151 is any amino acid
  Variant (153)..(166): xaa in position 153 to 166 is any amino acid
  Variant (167)..(214): xaa in position 167 to 214 is any or no amino acid
  Variant (216)..(217): xaa in position 216 to 217 is any amino acid
  Variant (219)..(219): xaa in position 219 is any amino acid
  Variant (221)..(221): xaa in position 221 is any amino acid
  Variant (222)..(222): xaa in position 222 is any or no amino acid
  Variant (224)..(228): xaa in position 224 to 228 is any amino acid
  Variant (229)..(265): xaa in position 229 to 265 is any or no amino acid
  Variant (267)..(268): xaa in position 267 to 268 is any amino acid
  Variant (270)..(271): xaa in position 270 to 271 is any amino acid
  Variant (273)..(274): xaa in position 273 to 274 is any amino acid
  Variant (276)..(296): xaa in position 276 to 296 is any amino acid
  Variant (297)..(311): xaa in position 297 to 311 is any or no amino acid
  Variant (313)..(314): xaa in position 313 to 314 is any amino acid
  Variant (316)..(337): xaa in position 316 to 337 is any amino acid
  Variant (338)..(364): xaa in position 338 to 364 is any or no amino acid
  Variant (366)..(378): xaa in position 366 to 378 is any amino acid
  Variant (379)..(379): xaa in position 379 is any or no amino acid

SEQ ID NO: 63563 - protein, 46 aa, Artificial sequence; identical to SEQ ID NO: 35624
  Variant (2)..(4): xaa in position 2 to 4 is any or no amino acid
  Variant (6)..(13): xaa in position 6 to 13 is any amino acid
  Variant (14)..(14): xaa in position 14 is any or no amino acid
  Variant (16)..(17): xaa in position 16 to 17 is any amino acid
  Variant (18)..(18): xaa in position 18 is Phe, Ile, Leu or Val
  Variant (19)..(19): xaa in position 19 is any amino acid
  Variant (20)..(20): xaa in position 20 is Ile, Leu or Val
  Variant (21)..(22): xaa in position 21 to 22 is any amino acid
  Variant (24)..(24): xaa in position 24 is any amino acid
  Variant (25)..(25): xaa in position 25 is Phe, Ile or Leu
  Variant (26)..(27): xaa in position 26 to 27 is any amino acid
  Variant (28)..(28): xaa in position 28 is Phe, Ile, Leu or Val
  Variant (29)..(29): xaa in position 29 is Pro or Ser
  Variant (30)..(31): xaa in position 30 to 31 is any amino acid
  Variant (32)..(32): xaa in position 32 is Ile, Leu or Val
  Variant (33)..(37): xaa in position 33 to 37 is any amino acid
  Variant (39)..(45): xaa in position 39 to 45 is any amino acid
  Variant (46)..(46): xaa in position 46 is Asn or Ser

SEQ ID NO: 63564 - DNA, 612 bp, Escherichia coli; identical to SEQ ID NO: 15395
  CDS (1)..(612)

SEQ ID NO: 63565 - protein, 203 aa, Escherichia coli; identical to SEQ ID NO: 15396

SEQ ID NO: 63566 - DNA, 558 bp, Mesorhizobium loti MAFF303099; identical to SEQ ID NO: 15397
  CDS (1)..(558): transl_table=11

SEQ ID NO: 63567 - protein, 185 aa, Mesorhizobium loti MAFF303099; identical to SEQ ID NO: 15398

SEQ ID NO: 63568 - DNA, 591 bp, Mesorhizobium loti MAFF303099; identical to SEQ ID NO: 15399
  CDS (1)..(591): transl_table=11

SEQ ID NO: 63569 - protein, 196 aa, Mesorhizobium loti MAFF303099; identical to SEQ ID NO: 15400

SEQ ID NO: 63570 - DNA, 558 bp, Mesorhizobium loti MAFF303099; identical to SEQ ID NO: 15401
  CDS (1)..(558): transl_table=11

SEQ ID NO: 63571 - protein, 185 aa, Mesorhizobium loti MAFF303099; identical to SEQ ID NO: 15402

SEQ ID NO: 63572 - DNA, 579 bp, Vibrio cholerae O1 biovar eltor str. N16961; identical to SEQ ID NO: 15403
  CDS (1)..(579): transl_table=11

SEQ ID NO: 63573 - protein, 192 aa, Vibrio cholerae O1 biovar eltor str. N16961; identical to SEQ ID NO: 15404

SEQ ID NO: 63574 - DNA, 561 bp, Bacillus halodurans C-125; identical to SEQ ID NO: 15405
  CDS (1)..(561): transl_table=11

SEQ ID NO: 63575 - protein, 186 aa, Bacillus halodurans C-125; identical to SEQ ID NO: 15406

SEQ ID NO: 63576 - DNA, 612 bp, Pasteurella multocida subsp. multocida str. Pm70; identical to SEQ ID NO: 15407
  CDS (1)..(612): transl_table=11

SEQ ID NO: 63577 - protein, 203 aa, Pasteurella multocida subsp. multocida str. Pm70; identical to SEQ ID NO: 15408

SEQ ID NO: 63578 - DNA, 771 bp, Lactococcus lactis subsp. lactis Il1403; identical to SEQ ID NO: 15409
  CDS (1)..(771): transl_table=11

SEQ ID NO: 63579 - protein, 256 aa, Lactococcus lactis subsp. lactis Il1403; identical to SEQ ID NO: 15410

SEQ ID NO: 63580 - DNA, 612 bp, Lactococcus lactis subsp. lactis Il1403; identical to SEQ ID NO: 15411
  CDS (1)..(612): transl_table=11

SEQ ID NO: 63581 - protein, 203 aa, Lactococcus lactis subsp. lactis Il1403; identical to SEQ ID NO: 15412

SEQ ID NO: 63582 - DNA, 603 bp, Lactococcus lactis subsp. lactis Il1403; identical to SEQ ID NO: 15413
  CDS (1)..(603): transl_table=11

SEQ ID NO: 63583 - protein, 200 aa, Lactococcus lactis subsp. lactis Il1403; identical to SEQ ID NO: 15414

SEQ ID NO: 63584 - DNA, 612 bp, Lactococcus lactis subsp. lactis Il1403; identical to SEQ ID NO: 15415
  CDS (1)..(612): transl_table=11

SEQ ID NO: 63585 - protein, 203 aa, Lactococcus lactis subsp. lactis Il1403; identical to SEQ ID NO: 15416

SEQ ID NO: 63586 - DNA, 462 bp, Lactococcus lactis subsp. lactis Il1403; identical to SEQ ID NO: 15417
  CDS (1)..(462): transl_table=11

SEQ ID NO: 63587 - protein, 153 aa, Lactococcus lactis subsp. lactis Il1403; identical to SEQ ID NO: 15418

SEQ ID NO: 63588 - DNA, 567 bp, Streptococcus pyogenes M1 GAS; identical to SEQ ID NO: 15419
  CDS (1)..(567): transl_table=11

SEQ ID NO: 63589 - protein, 188 aa, Streptococcus pyogenes M1 GAS; identical to SEQ ID NO: 15420

SEQ ID NO: 63590 - DNA, 513 bp, Neisseria meningitidis Z2491; identical to SEQ ID NO: 15421
  CDS (1)..(513): transl_table=11

SEQ ID NO: 63591 - protein, 170 aa, Neisseria meningitidis Z2491; identical to SEQ ID NO: 15422

SEQ ID NO: 63592 - DNA, 549 bp, Escherichia coli O157:H7; identical to SEQ ID NO: 15423
  CDS (1)..(549): transl_table=11

SEQ ID NO: 63593 - protein, 182 aa, Escherichia coli O157:H7; identical to SEQ ID NO: 15424

SEQ ID NO: 63594 - DNA, 558 bp, Streptococcus pneumoniae TIGR4; identical to SEQ ID NO: 15425
  CDS (1)..(558): transl_table=11

SEQ ID NO: 63595 - protein, 185 aa, Streptococcus pneumoniae TIGR4; identical to SEQ ID NO: 15426

SEQ ID NO: 63596 - DNA, 561 bp, Clostridium acetobutylicum ATCC 824; identical to SEQ ID NO: 15427
  CDS (1)..(561): transl_table=11

SEQ ID NO: 63597 - protein, 186 aa, Clostridium acetobutylicum ATCC 824; identical to SEQ ID NO: 15428

SEQ ID NO: 63598 - DNA, 615 bp, Clostridium acetobutylicum ATCC 824; identical to SEQ ID NO: 15429
  CDS (1)..(615): transl_table=11

SEQ ID NO: 63599 - protein, 204 aa, Clostridium acetobutylicum ATCC 824; identical to SEQ ID NO: 15430

SEQ ID NO: 63600 - DNA, 600 bp, Staphylococcus aureus subsp. aureus Mu50; identical to SEQ ID NO: 15431
  CDS (1)..(600): transl_table=11

SEQ ID NO: 63601 - protein, 199 aa, Staphylococcus aureus subsp. aureus Mu50; identical to SEQ ID NO: 15432

SEQ ID NO: 63602 - DNA, 552 bp, Escherichia coli K12; identical to SEQ ID NO: 15433
  CDS (1)..(552): transl_table=11

SEQ ID NO: 63603 - protein, 183 aa, Escherichia coli K12; identical to SEQ ID NO: 15434

SEQ ID NO: 63604 - DNA, 615 bp, Sinorhizobium meliloti 1021; identical to SEQ ID NO: 15435
  CDS (1)..(615): transl_table=11

SEQ ID NO: 63605 - protein, 204 aa, Sinorhizobium meliloti 1021; identical to SEQ ID NO: 15436

SEQ ID NO: 63606 - DNA, 552 bp, Salmonella typhimurium LT2; identical to SEQ ID NO: 15437
  CDS (1)..(552): transl_table=11

SEQ ID NO: 63607 - protein, 183 aa, Salmonella typhimurium LT2; identical to SEQ ID NO: 15438

SEQ ID NO: 63608 - DNA, 564 bp, Listeria monocytogenes EGD-e; identical to SEQ ID NO: 15439
  CDS (1)..(564): transl_table=11

SEQ ID NO: 63609 - protein, 187 aa, Listeria monocytogenes EGD-e; identical to SEQ ID NO: 15440

SEQ ID NO: 63610 - DNA, 570 bp, Listeria innocua Clip11262; identical to SEQ ID NO: 15441
  CDS (1)..(570): transl_table=11

SEQ ID NO: 63611 - protein, 189 aa, Listeria innocua Clip11262; identical to SEQ ID NO: 15442

SEQ ID NO: 63612 - DNA, 564 bp, Listeria innocua Clip11262; identical to SEQ ID NO: 15443
  CDS (1)..(564): transl_table=11

SEQ ID NO: 63613 - protein, 187 aa, Listeria innocua Clip11262; identical to SEQ ID NO: 15444

SEQ ID NO: 63614 - DNA, 579 bp, Nostoc sp. PCC 7120; identical to SEQ ID NO: 15445
  CDS (1)..(579): transl_table=11

SEQ ID NO: 63615 - protein, 192 aa, Nostoc sp. PCC 7120; identical to SEQ ID NO: 15446

SEQ ID NO: 63616 - DNA, 828 bp, Nostoc sp. PCC 7120; identical to SEQ ID NO: 15447
  CDS (1)..(828): transl_table=11

SEQ ID NO: 63617 - protein, 275 aa, Nostoc sp. PCC 7120; identical to SEQ ID NO: 15448

SEQ ID NO: 63618 - DNA, 513 bp, Ralstonia solanacearum GMI1000; identical to SEQ ID NO: 15449
  CDS (1)..(513): transl_table=11

SEQ ID NO: 63619 - protein, 170 aa, Ralstonia solanacearum GMI1000; identical to SEQ ID NO: 15450

SEQ ID NO: 63620 - DNA, 618 bp, Agrobacterium tumefaciens str. C58; identical to SEQ ID NO: 15451
  CDS (1)..(618): transl_table=11

SEQ ID NO: 63621 - protein, 205 aa, Agrobacterium tumefaciens str. C58; identical to SEQ ID NO: 15452

SEQ ID NO: 63622 - DNA, 561 bp, Agrobacterium tumefaciens str. C58; identical to SEQ ID NO: 15453
  CDS (1)..(561): transl_table=11

SEQ ID NO: 63623 - protein, 186 aa, Agrobacterium tumefaciens str. C58; identical to SEQ ID NO: 15454

SEQ ID NO: 63624 - DNA, 633 bp, Agrobacterium tumefaciens str. C58; identical to SEQ ID NO: 15455
  CDS (1)..(633): transl_table=11

SEQ ID NO: 63625 - protein, 210 aa, Agrobacterium tumefaciens str. C58; identical to SEQ ID NO: 15456

SEQ ID NO: 63626 - DNA, 687 bp, Brucella melitensis 16M; identical to SEQ ID NO: 15457
  CDS (1)..(687): transl_table=11

SEQ ID NO: 63627 - protein, 228 aa, Brucella melitensis 16M; identical to SEQ ID NO: 15458

SEQ ID NO: 63628 - DNA, 681 bp, Pyrobaculum aerophilum str. IM2; identical to SEQ ID NO: 15459
  CDS (1)..(681): transl_table=11

SEQ ID NO: 63629 - protein, 226 aa, Pyrobaculum aerophilum str. IM2; identical to SEQ ID NO: 15460

SEQ ID NO: 63630 - DNA, 585 bp, Clostridium perfringens str. 13; identical to SEQ ID NO: 15461
  CDS (1)..(585): transl_table=11

SEQ ID NO: 63631 - protein, 194 aa, Clostridium perfringens str. 13; identical to SEQ ID NO: 15462

SEQ ID NO: 63632 - DNA, 501 bp, Pyrococcus furiosus DSM 3638; identical to SEQ ID NO: 15463
  CDS (1)..(501): transl_table=11

SEQ ID NO: 63633 - protein, 166 aa, Pyrococcus furiosus DSM 3638; identical to SEQ ID NO: 15464

SEQ ID NO: 63634 - DNA, 687 bp, Corynebacterium glutamicum ATCC 13032; identical to SEQ ID NO: 15465
  CDS (1)..(687): transl_table=11

SEQ ID NO: 63635 - protein, 228 aa, Corynebacterium glutamicum ATCC 13032; identical to SEQ ID NO: 15466

SEQ ID NO: 63636 - DNA, 576 bp, Methanosarcina acetivorans C2A; identical to SEQ ID NO: 15467
  CDS (1)..(576): transl_table=11

SEQ ID NO: 63637 - protein, 191 aa, Methanosarcina acetivorans C2A; identical to SEQ ID NO: 15468

SEQ ID NO: 63638 - DNA, 600 bp, Methanosarcina acetivorans C2A; identical to SEQ ID NO: 15469
  CDS (1)..(600): transl_table=11

SEQ ID NO: 63639 - protein, 199 aa, Methanosarcina acetivorans C2A; identical to SEQ ID NO: 15470

SEQ ID NO: 63640 - DNA, 525 bp, Methanosarcina acetivorans C2A; identical to SEQ ID NO: 15471
  CDS (1)..(525): transl_table=11

SEQ ID NO: 63641 - protein, 174 aa, Methanosarcina acetivorans C2A; identical to SEQ ID NO: 15472

SEQ ID NO: 63642 - DNA, 555 bp, Methanosarcina acetivorans C2A; identical to SEQ ID NO: 15473
  CDS (1)..(555): transl_table=11

SEQ ID NO: 63643 - protein, 184 aa, Methanosarcina acetivorans C2A; identical to SEQ ID NO: 15474

SEQ ID NO: 63644 - DNA, 663 bp, Thermoanaerobacter tengcongensis MB4; identical to SEQ ID NO: 15475
  CDS (1)..(663): transl_table=11

SEQ ID NO: 63645 - protein, 220 aa, Thermoanaerobacter tengcongensis MB4; identical to SEQ ID NO: 15476

SEQ ID NO: 63646 - DNA, 528 bp, Streptomyces coelicolor A3(2); identical to SEQ ID NO: 15477
  CDS (1)..(528)

SEQ ID NO: 63647 - protein, 175 aa, Streptomyces coelicolor A3(2); identical to SEQ ID NO: 15478

SEQ ID NO: 63648 - DNA, 804 bp, Streptomyces coelicolor A3(2); identical to SEQ ID NO: 15479
  CDS (1)..(804)

SEQ ID NO: 63649 - protein, 267 aa, Streptomyces coelicolor A3(2); identical to SEQ ID NO: 15480

SEQ ID NO: 63650 - DNA, 582 bp, Streptomyces coelicolor A3(2); identical to SEQ ID NO: 15481
  CDS (1)..(582)

SEQ ID NO: 63651 - protein, 193 aa, Streptomyces coelicolor A3(2); identical to SEQ ID NO: 15482

SEQ ID NO: 63652 - DNA, 564 bp, Methanosarcina mazei Go1; identical to SEQ ID NO: 15483
  CDS (1)..(564): transl_table=11

SEQ ID NO: 63653 - protein, 187 aa, Methanosarcina mazei Go1; identical to SEQ ID NO: 15484

SEQ ID NO: 63654 - DNA, 702 bp, Methanosarcina mazei Go1; identical to SEQ ID NO: 15485
  CDS (1)..(702): transl_table=11

SEQ ID NO: 63655 - protein, 233 aa, Methanosarcina mazei Go1; identical to SEQ ID NO: 15486

SEQ ID NO: 63656 - DNA, 579 bp, Xanthomonas campestris pv. campestris str. ATCC 33913; identical to SEQ ID NO: 15487
  CDS (1)..(579): transl_table=11

SEQ ID NO: 63657 - protein, 192 aa, Xanthomonas campestris pv. campestris str. ATCC 33913; identical to SEQ ID NO: 15488

SEQ ID NO: 63658 - DNA, 579 bp, Xanthomonas axonopodis pv. citri str. 306; identical to SEQ ID NO: 15489
  CDS (1)..(579): transl_table=11

SEQ ID NO: 63659 - protein, 192 aa, Xanthomonas axonopodis pv. citri str. 306; identical to SEQ ID NO: 15490

SEQ ID NO: 63660 - DNA, 639 bp, Streptococcus agalactiae 2603V/R; identical to SEQ ID NO: 15491
  CDS (1)..(639): transl_table=11

SEQ ID NO: 63661 - protein, 212 aa, Streptococcus agalactiae 2603V/R; identical to SEQ ID NO: 15492

SEQ ID NO: 63662 - DNA, 549 bp, Streptococcus agalactiae 2603V/R; identical to SEQ ID NO: 15493
  CDS (1)..(549): transl_table=11

SEQ ID NO: 63663 - protein, 182 aa, Streptococcus agalactiae 2603V/R; identical to SEQ ID NO: 15494

SEQ ID NO: 63664 - DNA, 540 bp, Oceanobacillus iheyensis HTE831; identical to SEQ ID NO: 15495
  CDS (1)..(540): transl_table=11

SEQ ID NO: 63665 - protein, 179 aa, Oceanobacillus iheyensis HTE831; identical to SEQ ID NO: 15496

SEQ ID NO: 63666 - DNA, 675 bp, Bifidobacterium longum NCC2705; identical to SEQ ID NO: 15497
  CDS (1)..(675): transl_table=11

SEQ ID NO: 63667 - protein, 224 aa, Bifidobacterium longum NCC2705; identical to SEQ ID NO: 15498

SEQ ID NO: 63668 - DNA, 678 bp, Bifidobacterium longum NCC2705; identical to SEQ ID NO: 15499
  CDS (1)..(678): transl_table=11

SEQ ID NO: 63669 - protein, 225 aa, Bifidobacterium longum NCC2705; identical to SEQ ID NO: 15500

SEQ ID NO: 63670 - DNA, 597 bp, Leptospira interrogans serovar Lai str. 56601; identical to SEQ ID NO: 15501
  CDS (1)..(597): transl_table=11

SEQ ID NO: 63671 - protein, 198 aa, Leptospira interrogans serovar Lai str. 56601; identical to SEQ ID NO: 15502

SEQ ID NO: 63672 - DNA, 579 bp, Shewanella oneidensis MR-1; identical to SEQ ID NO: 15503
  CDS (1)..(579): transl_table=11

SEQ ID NO: 63673 - protein, 192 aa, Shewanella oneidensis MR-1; identical to SEQ ID NO: 15504

SEQ ID NO: 63674 - DNA, 630 bp, Shewanella oneidensis MR-1; identical to SEQ ID NO: 15505
  CDS (1)..(630): transl_table=11

SEQ ID NO: 63675 - protein, 209 aa, Shewanella oneidensis MR-1; identical to SEQ ID NO: 15506

SEQ ID NO: 63676 - DNA, 699 bp, Streptococcus mutans UA159; identical to SEQ ID NO: 15507
  CDS (1)..(699): transl_table=11

SEQ ID NO: 63677 - protein, 232 aa, Streptococcus mutans UA159; identical to SEQ ID NO: 15508

SEQ ID NO: 63678 - DNA, 648 bp, Streptomyces coelicolor A3(2); identical to SEQ ID NO: 15509
  CDS (1)..(648)

SEQ ID NO: 63679 - protein, 215 aa, Streptomyces coelicolor A3(2); identical to SEQ ID NO: 15510

SEQ ID NO: 63680 - DNA, 567 bp, Pseudomonas putida KT2440; identical to SEQ ID NO: 15511
  CDS (1)..(567): transl_table=11

SEQ ID NO: 63681 - protein, 188 aa, Pseudomonas putida KT2440; identical to SEQ ID NO: 15512

SEQ ID NO: 63682 - DNA, 552 bp, Escherichia coli CFT073; identical to SEQ ID NO: 15513
  CDS (1)..(552): transl_table=11

SEQ ID NO: 63683 - protein, 183 aa, Escherichia coli CFT073; identical to SEQ ID NO: 15514

SEQ ID NO: 63684 - DNA, 549 bp, Escherichia coli CFT073; identical to SEQ ID NO: 15515
  CDS (1)..(549): transl_table=11

SEQ ID NO: 63685 - protein, 182 aa, Escherichia coli CFT073; identical to SEQ ID NO: 15516

SEQ ID NO: 63686 - DNA, 588 bp, Mycoplasma penetrans HF-2; identical to SEQ ID NO: 15517
  CDS (1)..(588): transl_table=4

SEQ ID NO: 63687 - protein, 195 aa, Mycoplasma penetrans HF-2; identical to SEQ ID NO: 15518

SEQ ID NO: 63688 - DNA, 771 bp, Vibrio vulnificus CMCP6; identical to SEQ ID NO: 15519
  CDS (1)..(771): transl_table=11

SEQ ID NO: 63689 - protein, 256 aa, Vibrio vulnificus CMCP6; identical to SEQ ID NO: 15520

SEQ ID NO: 63690 - DNA, 594 bp, Vibrio vulnificus CMCP6; identical to SEQ ID NO: 15521
  CDS (1)..(594): transl_table=11

SEQ ID NO: 63691 - protein, 197 aa, Vibrio vulnificus CMCP6; identical to SEQ ID NO: 15522

SEQ ID NO: 63692 - DNA, 549 bp, Vibrio vulnificus CMCP6; identical to SEQ ID NO: 15523
  CDS (1)..(549): transl_table=11

SEQ ID NO: 63693 - protein, 182 aa, Vibrio vulnificus CMCP6; identical to SEQ ID NO: 15524

SEQ ID NO: 63694 - DNA, 621 bp, Bradyrhizobium japonicum USDA 110; identical to SEQ ID NO: 15525
  CDS (1)..(621)

SEQ ID NO: 63695 - protein, 206 aa, Bradyrhizobium japonicum USDA 110; identical to SEQ ID NO: 15526

SEQ ID NO: 63696 - DNA, 564 bp, Clostridium tetani E88; identical to SEQ ID NO: 15527
  CDS (1)..(564): transl_table=11

SEQ ID NO: 63697 - protein, 187 aa, Clostridium tetani E88; identical to SEQ ID NO: 15528

SEQ ID NO: 63698 - DNA, 618 bp, Lactobacillus plantarum WCFS1; identical to SEQ ID NO: 15529
  CDS (1)..(618): transl_table=11

SEQ ID NO: 63699 - protein, 205 aa, Lactobacillus plantarum WCFS1; identical to SEQ ID NO: 15530

SEQ ID NO: 63700 - DNA, 609 bp, Lactobacillus plantarum WCFS1; identical to SEQ ID NO: 15531
  CDS (1)..(609): transl_table=11

SEQ ID NO: 63701 - protein, 202 aa, Lactobacillus plantarum WCFS1; identical to SEQ ID NO: 15532

SEQ ID NO: 63702 - DNA, 555 bp, Lactobacillus plantarum WCFS1; identical to SEQ ID NO: 15533
  CDS (1)..(555): transl_table=11

SEQ ID NO: 63703 - protein, 184 aa, Lactobacillus plantarum WCFS1; identical to SEQ ID NO: 15534

SEQ ID NO: 63704 - DNA, 603 bp, Lactobacillus plantarum WCFS1; identical to SEQ ID NO: 15535
  CDS (1)..(603): transl_table=11

SEQ ID NO: 63705 - protein, 200 aa, Lactobacillus plantarum WCFS1; identical to SEQ ID NO: 15536

SEQ ID NO: 63706 - DNA, 621 bp, Lactobacillus plantarum WCFS1; identical to SEQ ID NO: 15537
  CDS (1)..(621): transl_table=11

SEQ ID NO: 63707 - protein, 206 aa, Lactobacillus plantarum WCFS1; identical to SEQ ID NO: 15538

SEQ ID NO: 63708 - DNA, 570 bp, Lactobacillus plantarum WCFS1; identical to SEQ ID NO: 15539
  CDS (1)..(570): transl_table=11

SEQ ID NO: 63709 - protein, 189 aa, Lactobacillus plantarum WCFS1; identical to SEQ ID NO: 15540

SEQ ID NO: 63710 - DNA, 561 bp, Lactobacillus plantarum WCFS1; identical to SEQ ID NO: 15541
  CDS (1)..(561): transl_table=11

SEQ ID NO: 63711 - protein, 186 aa, Lactobacillus plantarum WCFS1; identical to SEQ ID NO: 15542

SEQ ID NO: 63712 - DNA, 555 bp, Vibrio parahaemolyticus RIMD 2210633; identical to SEQ ID NO: 15543
  CDS (1)..(555): transl_table=11

SEQ ID NO: 63713 - protein, 184 aa, Vibrio parahaemolyticus RIMD 2210633; identical to SEQ ID NO: 15544

SEQ ID NO: 63714 - DNA, 549 bp, Vibrio parahaemolyticus RIMD 2210633; identical to SEQ ID NO: 15545
  CDS (1)..(549): transl_table=11

SEQ ID NO: 63715 - protein, 182 aa, Vibrio parahaemolyticus RIMD 2210633; identical to SEQ ID NO: 15546

SEQ ID NO: 63716 - DNA, 552 bp, Salmonella enterica subsp. enterica serovar Typhi Ty2; identical to SEQ ID NO: 15547
  CDS (1)..(552): transl_table=11

SEQ ID NO: 63717 - protein, 183 aa, Salmonella enterica subsp. enterica serovar Typhi Ty2; identical to SEQ ID NO: 15548

SEQ ID NO: 63718 - DNA, 759 bp, Bacteroides thetaiotaomicron VPI-5482; identical to SEQ ID NO: 15549
  CDS (1)..(759): transl_table=11

SEQ ID NO: 63719 - protein, 252 aa, Bacteroides thetaiotaomicron VPI-5482; identical to SEQ ID NO: 15550

SEQ ID NO: 63720 - DNA, 624 bp, Bacteroides thetaiotaomicron VPI-5482; identical to SEQ ID NO: 15551
  CDS (1)..(624): transl_table=11

SEQ ID NO: 63721 - protein, 207 aa, Bacteroides thetaiotaomicron VPI-5482; identical to SEQ ID NO: 15552

SEQ ID NO: 63722 - DNA, 564 bp, Bacteroides thetaiotaomicron VPI-5482; identical to SEQ ID NO: 15553
  CDS (1)..(564): transl_table=11

SEQ ID NO: 63723 - protein, 187 aa, Bacteroides thetaiotaomicron VPI-5482; identical to SEQ ID NO: 15554

SEQ ID NO: 63724 - DNA, 606 bp, Bacteroides thetaiotaomicron VPI-5482; identical to SEQ ID NO: 15555
  CDS (1)..(606): transl_table=11

SEQ ID NO: 63725 - protein, 201 aa, Bacteroides thetaiotaomicron VPI-5482; identical to SEQ ID NO: 15556

SEQ ID NO: 63726 - DNA, 552 bp, Bacteroides thetaiotaomicron VPI-5482; identical to SEQ ID NO: 15557
  CDS (1)..(552): transl_table=11

SEQ ID NO: 63727 - protein, 183 aa, Bacteroides thetaiotaomicron VPI-5482; identical to SEQ ID NO: 15558

SEQ ID NO: 63728 - DNA, 846 bp, Enterococcus faecalis V583; identical to SEQ ID NO: 15559
  CDS (1)..(846): transl_table=11

SEQ ID NO: 63729 - protein, 281 aa, Enterococcus faecalis V583; identical to SEQ ID NO: 15560

SEQ ID NO: 63730 - DNA, 639 bp, Enterococcus faecalis V583; identical to SEQ ID NO: 15561
  CDS (1)..(639): transl_table=11

SEQ ID NO: 63731 - protein, 212 aa, Enterococcus faecalis V583; identical to SEQ ID NO: 15562

SEQ ID NO: 63732 - DNA, 582 bp, Enterococcus faecalis V583; identical to SEQ ID NO: 15563
  CDS (1)..(582): transl_table=11

SEQ ID NO: 63733 - protein, 193 aa, Enterococcus faecalis V583; identical to SEQ ID NO: 15564

SEQ ID NO: 63734 - DNA, 723 bp, Bacillus cereus ATCC 14579; identical to SEQ ID NO: 15565
  CDS (1)..(723): transl_table=11

SEQ ID NO: 63735 - protein, 240 aa, Bacillus cereus ATCC 14579; identical to SEQ ID NO: 15566

SEQ ID NO: 63736 - DNA, 561 bp, Bacillus cereus ATCC 14579; identical to SEQ ID NO: 15567
  CDS (1)..(561): transl_table=11

SEQ ID NO: 63737 - protein, 186 aa, Bacillus cereus ATCC 14579; identical to SEQ ID NO: 15568

SEQ ID NO: 63738 - DNA, 666 bp, Bacillus anthracis str. Ames; identical to SEQ ID NO: 15569
  CDS (1)..(666): transl_table=11

SEQ ID NO: 63739 - protein, 221 aa, Bacillus anthracis str. Ames; identical to SEQ ID NO: 15570

SEQ ID NO: 63740 - DNA, 564 bp, Bacillus anthracis str. Ames; identical to SEQ ID NO: 15571
  CDS (1)..(564): transl_table=11

SEQ ID NO: 63741 - protein, 187 aa, Bacillus anthracis str. Ames; identical to SEQ ID NO: 15572

SEQ ID NO: 63742 - DNA, 723 bp, Bacillus anthracis str. Ames; identical to SEQ ID NO: 15573
  CDS (1)..(723): transl_table=11

SEQ ID NO: 63743 - protein, 240 aa, Bacillus anthracis str. Ames; identical to SEQ ID NO: 15574

SEQ ID NO: 63744 - DNA, 618 bp, Helicobacter hepaticus ATCC 51449; identical to SEQ ID NO: 15575
  CDS (1)..(618): transl_table=11

SEQ ID NO: 63745 - protein, 205 aa, Helicobacter hepaticus ATCC 51449; identical to SEQ ID NO: 15576

SEQ ID NO: 63746 - DNA, 555 bp, Rhodopirellula baltica SH 1; identical to SEQ ID NO: 15577
  CDS (1)..(555): transl_table=11

SEQ ID NO: 63747 - protein, 184 aa, Rhodopirellula baltica SH 1; identical to SEQ ID NO: 15578

SEQ ID NO: 63748 - DNA, 522 bp, Chromobacterium violaceum ATCC 12472; identical to SEQ ID NO: 15579
  CDS (1)..(522): transl_table=11

SEQ ID NO: 63749 - protein, 173 aa, Chromobacterium violaceum ATCC 12472; identical to SEQ ID NO: 15580

SEQ ID NO: 63750 - DNA, 561 bp, Gloeobacter violaceus PCC 7421; identical to SEQ ID NO: 15581
  CDS (1)..(561): transl_table=11

SEQ ID NO: 63751 - protein, 186 aa, Gloeobacter violaceus PCC 7421; identical to SEQ ID NO: 15582

SEQ ID NO: 63752 - DNA, 771 bp, Vibrio vulnificus YJ016; identical to SEQ ID NO: 15583
  CDS (1)..(771): transl_table=11

SEQ ID NO: 63753 - protein, 256 aa, Vibrio vulnificus YJ016; identical to SEQ ID NO: 15584

SEQ ID NO: 63754 - DNA, 558 bp, Vibrio vulnificus YJ016; identical to SEQ ID NO: 15585
  CDS (1)..(558): transl_table=11

SEQ ID NO: 63755 - protein, 185 aa, Vibrio vulnificus YJ016; identical to SEQ ID NO: 15586

SEQ ID NO: 63756 - DNA, 657 bp, Vibrio vulnificus YJ016; identical to SEQ ID NO: 15587
  CDS (1)..(657): transl_table=11

SEQ ID NO: 63757 - protein, 218 aa, Vibrio vulnificus YJ016; identical to SEQ ID NO: 15588

SEQ ID NO: 63758 - DNA, 621 bp, Vibrio vulnificus YJ016; identical to SEQ ID NO: 15589
  CDS (1)..(621): transl_table=11

SEQ ID NO: 63759 - protein, 206 aa, Vibrio vulnificus YJ016; identical to SEQ ID NO: 15590

SEQ ID NO: 63760 - DNA, 570 bp, Corynebacterium diphtheriae NCTC 13129; identical to SEQ ID NO: 15591
  CDS (1)..(570): transl_table=11

SEQ ID NO: 63761 - protein, 189 aa, Corynebacterium diphtheriae NCTC 13129; identical to SEQ ID NO: 15592

SEQ ID NO: 63762 - DNA, 573 bp, Rhodopseudomonas palustris CGA009; identical to SEQ ID NO: 15593
  CDS (1)..(573): transl_table=11

SEQ ID NO: 63763 - protein, 190 aa, Rhodopseudomonas palustris CGA009; identical to SEQ ID NO: 15594

SEQ ID NO: 63764 - DNA, 615 bp, Lactobacillus johnsonii NCC 533; identical to SEQ ID NO: 15595
  CDS (1)..(615): transl_table=11

SEQ ID NO: 63765 - protein, 204 aa, Lactobacillus johnsonii NCC 533; identical to SEQ ID NO: 15596

SEQ ID NO: 63766 - DNA, 564 bp, Bacillus cereus ATCC 10987; identical to SEQ ID NO: 15597
  CDS (1)..(564): transl_table=11

SEQ ID NO: 63767 - protein, 187 aa, Bacillus cereus ATCC 10987; identical to SEQ ID NO: 15598

SEQ ID NO: 63768 - DNA, 2154 bp, Neurospora crassa; identical to SEQ ID NO: 15599
  CDS (1)..(2154)

SEQ ID NO: 63769 - protein, 717 aa, Neurospora crassa; identical to SEQ ID NO: 15600

SEQ ID NO: 63770 - DNA, 660 bp, Magnaporthe grisea 70-15; identical to SEQ ID NO: 15601
  CDS (1)..(660)

SEQ ID NO: 63771 - protein, 219 aa, Magnaporthe grisea 70-15; identical to SEQ ID NO: 15602

SEQ ID NO: 63772 - DNA, 699 bp, Gibberella zeae PH-1; identical to SEQ ID NO: 15603
  CDS (1)..(699)

SEQ ID NO: 63773 - protein, 232 aa, Gibberella zeae PH-1; identical to SEQ ID NO: 15604

SEQ ID NO: 63774 - DNA, 699 bp, Gibberella zeae PH-1; identical to SEQ ID NO: 15605
  CDS (1)..(699)

SEQ ID NO: 63775 - protein, 232 aa, Gibberella zeae PH-1; identical to SEQ ID NO: 15606

SEQ ID NO: 63776 - DNA, 690 bp, Ustilago maydis 521; identical to SEQ ID NO: 15607
  CDS (1)..(690)

SEQ ID NO: 63777 - protein, 229 aa, Ustilago maydis 521; identical to SEQ ID NO: 15608

SEQ ID NO: 63778 - DNA, 702 bp, Aspergillus nidulans FGSC A4; identical to SEQ ID NO: 15609
  CDS (1)..(702)

SEQ ID NO: 63779 - protein, 233 aa, Aspergillus nidulans FGSC A4; identical to SEQ ID NO: 15610

SEQ ID NO: 63780 - DNA, 618 bp, Aspergillus nidulans FGSC A4; identical to SEQ ID NO: 15611
  CDS (1)..(618)

SEQ ID NO: 63781 - protein, 205 aa, Aspergillus nidulans FGSC A4; identical to SEQ ID NO: 15612

SEQ ID NO: 63782 - DNA, 573 bp, Candida glabrata CBS138; identical to SEQ ID NO: 15613
  CDS (1)..(573)

SEQ ID NO: 63783 - protein, 190 aa, Candida glabrata CBS138; identical to SEQ ID NO: 15614

SEQ ID NO: 63784 - DNA, 570 bp, Kluyveromyces lactis NRRL Y-1140; identical to SEQ ID NO: 15615
  CDS (1)..(570)

SEQ ID NO: 63785 - protein, 189 aa, Kluyveromyces lactis NRRL Y-1140; identical to SEQ ID NO: 15616

SEQ ID NO: 63786 - DNA, 693 bp, Debaryomyces hansenii CBS767; identical to SEQ ID NO: 15617
  CDS (1)..(693)

SEQ ID NO: 63787 - protein, 230 aa, Debaryomyces hansenii CBS767; identical to SEQ ID NO: 15618

SEQ ID NO: 63788 - DNA, 690 bp, Debaryomyces hansenii CBS767; identical to SEQ ID NO: 15619
  CDS (1)..(690)

SEQ ID NO: 63789 - protein, 229 aa, Debaryomyces hansenii CBS767; identical to SEQ ID NO: 15620

SEQ ID NO: 63790 - DNA, 666 bp, Yarrowia lipolytica CLIB99; identical to SEQ ID NO: 15621
  CDS (1)..(666)

SEQ ID NO: 63791 - protein, 221 aa, Yarrowia lipolytica CLIB99; identical to SEQ ID NO: 15622

SEQ ID NO: 63792 - DNA, 840 bp, Yarrowia lipolytica CLIB99; identical to SEQ ID NO: 15623
  CDS (1)..(840)

SEQ ID NO: 63793 - protein, 279 aa, Yarrowia lipolytica CLIB99; identical to SEQ ID NO: 15624

SEQ ID NO: 63794 - DNA, 642 bp, Cryptococcus neoformans var. neoformans JEC21; identical to SEQ ID NO: 15625
  CDS (1)..(642)

SEQ ID NO: 63795 - protein, 213 aa, Cryptococcus neoformans var. neoformans JEC21; identical to SEQ ID NO: 15626

SEQ ID NO: 63796 - DNA, 546 bp, Dictyostelium discoideum; identical to SEQ ID NO: 15627
  CDS (1)..(546)

SEQ ID NO: 63797 - protein, 181 aa, Dictyostelium discoideum; identical to SEQ ID NO: 15628

SEQ ID NO: 63798 - DNA, 576 bp, Dictyostelium discoideum; identical to SEQ ID NO: 15629
  CDS (1)..(576)

SEQ ID NO: 63799 - protein, 191 aa, Dictyostelium discoideum; identical to SEQ ID NO: 15630

SEQ ID NO: 63800 - DNA, 591 bp, Dictyostelium discoideum; identical to SEQ ID NO: 15631
  CDS (1)..(591)

SEQ ID NO: 63801 - protein, 196 aa, Dictyostelium discoideum; identical to SEQ ID NO: 15632

SEQ ID NO: 63802 - DNA, 573 bp, Dictyostelium discoideum; identical to SEQ ID NO: 15633
  CDS (1)..(573)

SEQ ID NO: 63803 - protein, 190 aa, Dictyostelium discoideum; identical to SEQ ID NO: 15634

SEQ ID NO: 63804 - DNA, 459 bp, Entamoeba histolytica HM-1:IMSS; identical to SEQ ID NO: 15635
  CDS (1)..(459)

SEQ ID NO: 63805 - protein, 152 aa, Entamoeba histolytica HM-1:IMSS; identical to SEQ ID NO: 15636

SEQ ID NO: 63806 - DNA, 609 bp, Entamoeba histolytica HM-1:IMSS; identical to SEQ ID NO: 15637
  CDS (1)..(609)

SEQ ID NO: 63807 - protein, 202 aa, Entamoeba histolytica HM-1:IMSS; identical to SEQ ID NO: 15638

SEQ ID NO: 63808 - DNA, 609 bp, Entamoeba histolytica HM-1:IMSS; identical to SEQ ID NO: 15639
  CDS (1)..(609)

SEQ ID NO: 63809 - protein, 202 aa, Entamoeba histolytica HM-1:IMSS; identical to SEQ ID NO: 15640

SEQ ID NO: 63810 - DNA, 549 bp, Entamoeba histolytica HM-1:IMSS; identical to SEQ ID NO: 15641
  CDS (1)..(549)

SEQ ID NO: 63811 - protein, 182 aa, Entamoeba histolytica HM-1:IMSS; identical to SEQ ID NO: 15642

SEQ ID NO: 63812 - DNA, 612 bp, Entamoeba histolytica HM-1:IMSS; identical to SEQ ID NO: 15643
  CDS (1)..(612)

SEQ ID NO: 63813 - protein, 203 aa, Entamoeba histolytica HM-1:IMSS; identical to SEQ ID NO: 15644

SEQ ID NO: 63814 - DNA, 615 bp, Entamoeba histolytica HM-1:IMSS; identical to SEQ ID NO: 15645
  CDS (1)..(615)

SEQ ID NO: 63815 - protein, 204 aa, Entamoeba histolytica HM-1:IMSS; identical to SEQ ID NO: 15646

SEQ ID NO: 63816 - DNA, 924 bp, Candida albicans SC5314; identical to SEQ ID NO: 15647
  CDS (1)..(924): transl_table=12

SEQ ID NO: 63817 - protein, 307 aa, Candida albicans SC5314; identical to SEQ ID NO: 15648

SEQ ID NO: 63818 - DNA, 888 bp, Thermus thermophilus HB27; identical to SEQ ID NO: 15649
  CDS (1)..(888): transl_table=11

SEQ ID NO: 63819 - protein, 295 aa, Thermus thermophilus HB27; identical to SEQ ID NO: 15650

SEQ ID NO: 63820 - DNA, 594 bp, Desulfovibrio vulgaris subsp. vulgaris str. Hildenborough; identical to SEQ ID NO: 15651
  CDS (1)..(594): transl_table=11

SEQ ID NO: 63821 - protein, 197 aa, Desulfovibrio vulgaris subsp. vulgaris str. Hildenborough; identical to SEQ ID NO: 15652

SEQ ID NO: 63822 - DNA, 570 bp, Listeria monocytogenes str. 4b F2365; identical to SEQ ID NO: 15653
  CDS (1)..(570): transl_table=11

SEQ ID NO: 63823 - protein, 189 aa, Listeria monocytogenes str. 4b F2365; identical to SEQ ID NO: 15654

SEQ ID NO: 63824 - DNA, 564 bp, Listeria monocytogenes str. 4b F2365; identical to SEQ ID NO: 15655
  CDS (1)..(564): transl_table=11

SEQ ID NO: 63825 - protein, 187 aa, Listeria monocytogenes str. 4b F2365; identical to SEQ ID NO: 15656

SEQ ID NO: 63826 - DNA, 564 bp, Bacillus thuringiensis serovar konkukian str. 97-27; identical to SEQ ID NO: 15657
  CDS (1)..(564): transl_table=11

SEQ ID NO: 63827 - protein, 187 aa, Bacillus thuringiensis serovar konkukian str. 97-27; identical to SEQ ID NO: 15658

SEQ ID NO: 63828 - DNA, 486 bp, Staphylococcus aureus subsp. aureus MRSA252; identical to SEQ ID NO: 15659
  CDS (1)..(486): transl_table=11

SEQ ID NO: 63829 - protein, 161 aa, Staphylococcus aureus subsp. aureus MRSA252; identical to SEQ ID NO: 15660

SEQ ID NO: 63830 - DNA, 600 bp, Staphylococcus aureus subsp. aureus MRSA252; identical to SEQ ID NO: 15661
  CDS (1)..(600): transl_table=11

SEQ ID NO: 63831 - protein, 199 aa, Staphylococcus aureus subsp. aureus MRSA252; identical to SEQ ID NO: 15662

SEQ ID NO: 63832 - DNA, 627 bp, Erwinia carotovora subsp. atroseptica SCRI1043; identical to SEQ ID NO: 15663
  CDS (1)..(627)

SEQ ID NO: 63833 - protein, 208 aa, Erwinia carotovora subsp. atroseptica SCRI1043; identical to SEQ ID NO: 15664

SEQ ID NO: 63834 - DNA, 573 bp, Propionibacterium acnes KPA171202; identical to SEQ ID NO: 15665
  CDS (1)..(573): transl_table=11

SEQ ID NO: 63835 - protein, 190 aa, Propionibacterium acnes KPA171202; identical to SEQ ID NO: 15666

SEQ ID NO: 63836 - DNA, 510 bp, Desulfotalea psychrophila LSv54; identical to SEQ ID NO: 15667
  CDS (1)..(510): transl_table=11

SEQ ID NO: 63837 - protein, 169 aa, Desulfotalea psychrophila LSv54; identical to SEQ ID NO: 15668

SEQ ID NO: 63838 - DNA, 579 bp, Bacillus licheniformis ATCC 14580; identical to SEQ ID NO: 15669
  CDS (1)..(579): transl_table=11

SEQ ID NO: 63839 - protein, 192 aa, Bacillus licheniformis ATCC 14580; identical to SEQ ID NO: 15670

SEQ ID NO: 63840 - DNA, 564 bp, Bacillus cereus E33L; identical to SEQ ID NO: 15671
  CDS (1)..(564): transl_table=11

SEQ ID NO: 63841 - protein, 187 aa, Bacillus cereus E33L; identical to SEQ ID NO: 15672

SEQ ID NO: 63842 - DNA, 603 bp, Mannheimia succiniciproducens MBEL55E; identical to SEQ ID NO: 15673
  CDS (1)..(603): transl_table=11

SEQ ID NO: 63843 - protein, 200 aa, Mannheimia succiniciproducens MBEL55E; identical to SEQ ID NO: 15674

SEQ ID NO: 63844 - DNA, 597 bp, Mannheimia succiniciproducens MBEL55E; identical to SEQ ID NO: 15675
  CDS (1)..(597): transl_table=11

SEQ ID NO: 63845 - protein, 198 aa, Mannheimia succiniciproducens MBEL55E; identical to SEQ ID NO: 15676

SEQ ID NO: 63846 - DNA, 606 bp, Bacteroides fragilis YCH46; identical to SEQ ID NO: 15677
  CDS (1)..(606): transl_table=11

SEQ ID NO: 63847 - protein, 201 aa, Bacteroides fragilis YCH46; identical to SEQ ID NO: 15678

SEQ ID NO: 63848 - DNA, 630 bp, Bacteroides fragilis YCH46; identical to SEQ ID NO: 15679
  CDS (1)..(630): transl_table=11

SEQ ID NO: 63849 - protein, 209 aa, Bacteroides fragilis YCH46; identical to SEQ ID NO: 15680

SEQ ID NO: 63850 - DNA, 627 bp, Bacteroides fragilis YCH46; identical to SEQ ID NO: 15681
  CDS (1)..(627): transl_table=11

SEQ ID NO: 63851 - protein, 208 aa, Bacteroides fragilis YCH46; identical to SEQ ID NO: 15682

SEQ ID NO: 63852 - DNA, 591 bp, Methylococcus capsulatus str. Bath; identical to SEQ ID NO: 15683
  CDS (1)..(591): transl_table=11

SEQ ID NO: 63853 - protein, 196 aa, Methylococcus capsulatus str. Bath; identical to SEQ ID NO: 15684

SEQ ID NO: 63854 - DNA, 648 bp, Photobacterium profundum SS9; identical to SEQ ID NO: 15685
  CDS (1)..(648): transl_table=11

SEQ ID NO: 63855 - protein, 215 aa, Photobacterium profundum SS9; identical to SEQ ID NO: 15686

SEQ ID NO: 63856 - DNA, 549 bp, Photobacterium profundum SS9; identical to SEQ ID NO: 15687
  CDS (1)..(549): transl_table=11

SEQ ID NO: 63857 - protein, 182 aa, Photobacterium profundum SS9; identical to SEQ ID NO: 15688

SEQ ID NO: 63858 - DNA, 564 bp, Photobacterium profundum SS9; identical to SEQ ID NO: 15689
  CDS (1)..(564): transl_table=11

SEQ ID NO: 63859 - protein, 187 aa, Photobacterium profundum SS9; identical to SEQ ID NO: 15690

SEQ ID NO: 63860 - DNA, 561 bp, Haloarcula marismortui ATCC 43049; identical to SEQ ID NO: 15691
  CDS (1)..(561): transl_table=11

SEQ ID NO: 63861 - protein, 186 aa, Haloarcula marismortui ATCC 43049; identical to SEQ ID NO: 15692

SEQ ID NO: 63862 - DNA, 675 bp, Geobacillus kaustophilus HTA426; identical to SEQ ID NO: 15693
  CDS (1)..(675): transl_table=11

SEQ ID NO: 63863 - protein, 224 aa, Geobacillus kaustophilus HTA426; identical to SEQ ID NO: 15694

SEQ ID NO: 63864 - DNA, 558 bp, Geobacillus kaustophilus HTA426; identical to SEQ ID NO: 15695
  CDS (1)..(558): transl_table=11

SEQ ID NO: 63865 - protein, 185 aa, Geobacillus kaustophilus HTA426; identical to SEQ ID NO: 15696

SEQ ID NO: 63866 - DNA, 552 bp, Azoarcus sp. EbN1; identical to SEQ ID NO: 15697
  CDS (1)..(552): transl_table=11

SEQ ID NO: 63867 - protein, 183 aa, Azoarcus sp. EbN1; identical to SEQ ID NO: 15698

SEQ ID NO: 63868 - DNA, 600 bp, Zymomonas mobilis subsp. mobilis ZM4; identical to SEQ ID NO: 15699
  CDS (1)..(600): transl_table=11

SEQ ID NO: 63869 - protein, 199 aa, Zymomonas mobilis subsp. mobilis ZM4; identical to SEQ ID NO: 15700

SEQ ID NO: 63870 - DNA, 693 bp, Dehalococcoides ethenogenes 195; identical to SEQ ID NO: 15701
  CDS (1)..(693): transl_table=11

SEQ ID NO: 63871 - protein, 230 aa, Dehalococcoides ethenogenes 195; identical to SEQ ID NO: 15702

SEQ ID NO: 63872 - DNA, 486 bp, Staphylococcus aureus subsp. aureus COL; identical to SEQ ID NO: 15703
  CDS (1)..(486): transl_table=11

SEQ ID NO: 63873 - protein, 161 aa, Staphylococcus aureus subsp. aureus COL; identical to SEQ ID NO: 15704

SEQ ID NO: 63874 - DNA, 600 bp, Staphylococcus aureus subsp. aureus COL; identical to SEQ ID NO: 15705
  CDS (1)..(600): transl_table=11

SEQ ID NO: 63875 - protein, 199 aa, Staphylococcus aureus subsp. aureus COL; identical to SEQ ID NO: 15706

SEQ ID NO: 63876 - DNA, 615 bp, Lactobacillus acidophilus NCFM; identical to SEQ ID NO: 15707
  CDS (1)..(615): transl_table=11

SEQ ID NO: 63877 - protein, 204 aa, Lactobacillus acidophilus NCFM; identical to SEQ ID NO: 15708

SEQ ID NO: 63878 - DNA, 600 bp, Vibrio fischeri ES114; identical to SEQ ID NO: 15709
  CDS (1)..(600): transl_table=11

SEQ ID NO: 63879 - protein, 199 aa, Vibrio fischeri ES114; identical to SEQ ID NO: 15710

SEQ ID NO: 63880 - DNA, 546 bp, Vibrio fischeri ES114; identical to SEQ ID NO: 15711
  CDS (1)..(546): transl_table=11

SEQ ID NO: 63881 - protein, 181 aa, Vibrio fischeri ES114; identical to SEQ ID NO: 15712

SEQ ID NO: 63882 - DNA, 552 bp, Vibrio fischeri ES114; identical to SEQ ID NO: 15713
  CDS (1)..(552): transl_table=11

SEQ ID NO: 63883 - protein, 183 aa, Vibrio fischeri ES114; identical to SEQ ID NO: 15714

SEQ ID NO: 63884 - DNA, 756 bp, Vibrio fischeri ES114; identical to SEQ ID NO: 15715
  CDS (1)..(756): transl_table=11

SEQ ID NO: 63885 - protein, 251 aa, Vibrio fischeri ES114; identical to SEQ ID NO: 15716

SEQ ID NO: 63886 - DNA, 522 bp, Bacteroides fragilis NCTC 9343; identical to SEQ ID NO: 15717
  CDS (1)..(522): transl_table=11

SEQ ID NO: 63887 - protein, 173 aa, Bacteroides fragilis NCTC 9343; identical to SEQ ID NO: 15718

SEQ ID NO: 63888 - DNA, 600 bp, Bacteroides fragilis NCTC 9343; identical to SEQ ID NO: 15719
  CDS (1)..(600): transl_table=11

SEQ ID NO: 63889 - protein, 199 aa, Bacteroides fragilis NCTC 9343; identical to SEQ ID NO: 15720

SEQ ID NO: 63890 - DNA, 630 bp, Bacteroides fragilis NCTC 9343; identical to SEQ ID NO: 15721
  CDS (1)..(630): transl_table=11

SEQ ID NO: 63891 - protein, 209 aa, Bacteroides fragilis NCTC 9343; identical to SEQ ID NO: 15722

SEQ ID NO: 63892 - DNA, 624 bp, Bacteroides fragilis NCTC 9343; identical to SEQ ID NO: 15723
  CDS (1)..(624): transl_table=11

SEQ ID NO: 63893 - protein, 207 aa, Bacteroides fragilis NCTC 9343; identical to SEQ ID NO: 15724

SEQ ID NO: 63894 - DNA, 552 bp, Bacteroides fragilis NCTC 9343; identical to SEQ ID NO: 15725
  CDS (1)..(552): transl_table=11

SEQ ID NO: 63895 - protein, 183 aa, Bacteroides fragilis NCTC 9343; identical to SEQ ID NO: 15726

SEQ ID NO: 63896 - DNA, 588 bp, Bacteroides fragilis NCTC 9343; identical to SEQ ID NO: 15727
  CDS (1)..(588): transl_table=11

SEQ ID NO: 63897 - protein, 195 aa, Bacteroides fragilis NCTC 9343; identical to SEQ ID NO: 15728

SEQ ID NO: 63898 - DNA, 690 bp, Brucella abortus biovar 1 str. 9-941; identical to SEQ ID NO: 15729
  CDS (1)..(690): transl_table=11

SEQ ID NO: 63899 - protein, 229 aa, Brucella abortus biovar 1 str. 9-941; identical to SEQ ID NO: 15730

SEQ ID NO: 63900 - DNA, 690 bp, Chloroflexus aurantiacus; identical to SEQ ID NO: 15731
  CDS (1)..(690)

SEQ ID NO: 63901 - protein, 229 aa, Chloroflexus aurantiacus; identical to SEQ ID NO: 15732

SEQ ID NO: 63902 - DNA, 564 bp, Chloroflexus aurantiacus; identical to SEQ ID NO: 15733
  CDS (1)..(564)

SEQ ID NO: 63903 - protein, 187 aa, Chloroflexus aurantiacus; identical to SEQ ID NO: 15734

SEQ ID NO: 63904 - DNA, 615 bp, Lactobacillus gasseri; identical to SEQ ID NO: 15735
  CDS (1)..(615)

SEQ ID NO: 63905 - protein, 204 aa, Lactobacillus gasseri; identical to SEQ ID NO: 15736

SEQ ID NO: 63906 - DNA, 606 bp, Magnetospirillum magnetotacticum MS-1; identical to SEQ ID NO: 15737
  CDS (1)..(606)

SEQ ID NO: 63907 - protein, 201 aa, Magnetospirillum magnetotacticum MS-1; identical to SEQ ID NO: 15738

SEQ ID NO: 63908 - DNA, 702 bp, Leuconostoc mesenteroides subsp. mesenteroides ATCC 8293; identical to SEQ ID NO: 15739
  CDS (1)..(702)

SEQ ID NO: 63909 - protein, 233 aa, Leuconostoc mesenteroides subsp. mesenteroides ATCC 8293; identical to SEQ ID NO: 15740

SEQ ID NO: 63910 - DNA, 561 bp, Nostoc punctiforme PCC 73102; identical to SEQ ID NO: 15741
  CDS (1)..(561)

SEQ ID NO: 63911 - protein, 186 aa, Nostoc punctiforme PCC 73102; identical to SEQ ID NO: 15742

SEQ ID NO: 63912 - DNA, 594 bp, Nostoc punctiforme PCC 73102; identical to SEQ ID NO: 15743
  CDS (1)..(594)

SEQ ID NO: 63913 - protein, 197 aa, Nostoc punctiforme PCC 73102; identical to SEQ ID NO: 15744

SEQ ID NO: 63914 - DNA, 702 bp, Nostoc punctiforme PCC 73102; identical to SEQ ID NO: 15745
  CDS (1)..(702)

SEQ ID NO: 63915 - protein, 233 aa, Nostoc punctiforme PCC 73102; identical to SEQ ID NO: 15746

SEQ ID NO: 63916 - DNA, 675 bp, Bifidobacterium longum DJO10A; identical to SEQ ID NO: 15747
  CDS (1)..(675)

SEQ ID NO: 63917 - protein, 224 aa, Bifidobacterium longum DJO10A; identical to SEQ ID NO: 15748

SEQ ID NO: 63918 - DNA, 633 bp, Bifidobacterium longum DJO10A; identical to SEQ ID NO: 15749
  CDS (1)..(633)

SEQ ID NO: 63919 - protein, 210 aa, Bifidobacterium longum DJO10A; identical to SEQ ID NO: 15750

SEQ ID NO: 63920 - DNA, 609 bp, Desulfovibrio desulfuricans G20; identical to SEQ ID NO: 15751
  CDS (1)..(609)

SEQ ID NO: 63921 - protein, 202 aa, Desulfovibrio desulfuricans G20; identical to SEQ ID NO: 15752

SEQ ID NO: 63922 - DNA, 558 bp, Desulfovibrio desulfuricans G20; identical to SEQ ID NO: 15753
  CDS (1)..(558)

SEQ ID NO: 63923 - protein, 185 aa, Desulfovibrio desulfuricans G20; identical to SEQ ID NO: 15754

SEQ ID NO: 63924 - DNA, 576 bp, Anabaena variabilis ATCC 29413; identical to SEQ ID NO: 15755
  CDS (1)..(576)

SEQ ID NO: 63925 - protein, 191 aa, Anabaena variabilis ATCC 29413; identical to SEQ ID NO: 15756

SEQ ID NO: 63926 - DNA, 561 bp, Anabaena variabilis ATCC 29413; identical to SEQ ID NO: 15757
  CDS (1)..(561)

SEQ ID NO: 63927 - protein, 186 aa, Anabaena variabilis ATCC 29413; identical to SEQ ID NO: 15758

SEQ ID NO: 63928 - DNA, 576 bp, Actinobacillus pleuropneumoniae serovar 1 str. 4074; identical to SEQ ID NO: 15759
  CDS (1)..(576)

SEQ ID NO: 63929 - protein, 191 aa, Actinobacillus pleuropneumoniae serovar 1 str. 4074; identical to SEQ ID NO: 15760

SEQ ID NO: 63930 - DNA, 501 bp, Burkholderia cepacia R18194; identical to SEQ ID NO: 15761
  CDS (1)..(501)

SEQ ID NO: 63931 - protein, 166 aa, Burkholderia cepacia R18194; identical to SEQ ID NO: 15762

SEQ ID NO: 63932 - DNA, 609 bp, Burkholderia cepacia R18194; identical to SEQ ID NO: 15763
  CDS (1)..(609)

SEQ ID NO: 63933 - protein, 202 aa, Burkholderia cepacia R18194; identical to SEQ ID NO: 15764

SEQ ID NO: 63934 - DNA, 528 bp, Listeria monocytogenes str. 4b H7858; identical to SEQ ID NO: 15765
  CDS (1)..(528): transl_table=11

SEQ ID NO: 63935 - protein, 175 aa, Listeria monocytogenes str. 4b H7858; identical to SEQ ID NO: 15766

SEQ ID NO: 63936 - DNA, 570 bp, Listeria monocytogenes str. 4b H7858; identical to SEQ ID NO: 15767
  CDS (1)..(570): transl_table=11

SEQ ID NO: 63937 - protein, 189 aa, Listeria monocytogenes str. 4b H7858; identical to SEQ ID NO: 15768

SEQ ID NO: 63938 - DNA, 564 bp, Bacillus cereus G9241; identical to SEQ ID NO: 15769
  CDS (1)..(564): transl_table=11

SEQ ID NO: 63939 - protein, 187 aa, Bacillus cereus G9241; identical to SEQ ID NO: 15770

SEQ ID NO: 63940 - DNA, 558 bp, Bacillus cereus G9241; identical to SEQ ID NO: 15771
  CDS (1)..(558): transl_table=11

SEQ ID NO: 63941 - protein, 185 aa, Bacillus cereus G9241; identical to SEQ ID NO: 15772

SEQ ID NO: 63942 - DNA, 588 bp, Burkholderia fungorum LB400; identical to SEQ ID NO: 15773
  CDS (1)..(588)

SEQ ID NO: 63943 - protein, 195 aa, Burkholderia fungorum LB400; identical to SEQ ID NO: 15774

SEQ ID NO: 63944 - DNA, 555 bp, Thermobifida fusca; identical to SEQ ID NO: 15775
  CDS (1)..(555)

SEQ ID NO: 63945 - protein, 184 aa, Thermobifida fusca; identical to SEQ ID NO: 15776

SEQ ID NO: 63946 - DNA, 513 bp, Cytophaga hutchinsonii; identical to SEQ ID NO: 15777
  CDS (1)..(513)

SEQ ID NO: 63947 - protein, 170 aa, Cytophaga hutchinsonii; identical to SEQ ID NO: 15778

SEQ ID NO: 63948 - DNA, 654 bp, Cytophaga hutchinsonii; identical to SEQ ID NO: 15779
  CDS (1)..(654)

SEQ ID NO: 63949 - protein, 217 aa, Cytophaga hutchinsonii; identical to SEQ ID NO: 15780

SEQ ID NO: 63950 - DNA, 744 bp, Microbulbifer degradans 2-40; identical to SEQ ID NO: 15781
  CDS (1)..(744)

SEQ ID NO: 63951 - protein, 247 aa, Microbulbifer degradans 2-40; identical to SEQ ID NO: 15782

SEQ ID NO: 63952 - DNA, 549 bp, Microbulbifer degradans 2-40; identical to SEQ ID NO: 15783
  CDS (1)..(549)

SEQ ID NO: 63953 - protein, 182 aa, Microbulbifer degradans 2-40; identical to SEQ ID NO: 15784

SEQ ID NO: 63954 - DNA, 417 bp, Oenococcus oeni PSU-1; identical to SEQ ID NO: 15785
  CDS (1)..(417)

SEQ ID NO: 63955 - protein, 138 aa, Oenococcus oeni PSU-1; identical to SEQ ID NO: 15786

SEQ ID NO: 63956 - DNA, 567 bp, Pediococcus pentosaceus ATCC 25745; identical to SEQ ID NO: 15787
  CDS (1)..(567)

SEQ ID NO: 63957 - protein, 188 aa, Pediococcus pentosaceus ATCC 25745; identical to SEQ ID NO: 15788

SEQ ID NO: 63958 - DNA, 555 bp, Pediococcus pentosaceus ATCC 25745; identical to SEQ ID NO: 15789
  CDS (1)..(555)

SEQ ID NO: 63959 - protein, 184 aa, Pediococcus pentosaceus ATCC 25745; identical to SEQ ID NO: 15790

SEQ ID NO: 63960 - DNA, 552 bp, Pediococcus pentosaceus ATCC 25745; identical to SEQ ID NO: 15791
  CDS (1)..(552)

SEQ ID NO: 63961 - protein, 183 aa, Pediococcus pentosaceus ATCC 25745; identical to SEQ ID NO: 15792

SEQ ID NO: 63962 - DNA, 465 bp, Streptococcus suis 89/1591; identical to SEQ ID NO: 15793
  CDS (1)..(465)

SEQ ID NO: 63963 - protein, 154 aa, Streptococcus suis 89/1591; identical to SEQ ID NO: 15794

SEQ ID NO: 63964 - DNA, 606 bp, Desulfovibrio desulfuricans G20; identical to SEQ ID NO: 15795
  CDS (1)..(606)

SEQ ID NO: 63965 - protein, 201 aa, Desulfovibrio desulfuricans G20; identical to SEQ ID NO: 15796

SEQ ID NO: 63966 - DNA, 543 bp, Chloroflexus aurantiacus; identical to SEQ ID NO: 15797
  CDS (1)..(543)

SEQ ID NO: 63967 - protein, 180 aa, Chloroflexus aurantiacus; identical to SEQ ID NO: 15798

SEQ ID NO: 63968 - DNA, 186 bp, Brevibacterium linens BL2; identical to SEQ ID NO: 15799
  CDS (1)..(186)

SEQ ID NO: 63969 - protein, 61 aa, Brevibacterium linens BL2; identical to SEQ ID NO: 15800

SEQ ID NO: 63970 - DNA, 612 bp, Lactococcus lactis subsp. cremoris SK11; identical to SEQ ID NO: 15801
  CDS (1)..(612)

SEQ ID NO: 63971 - protein, 203 aa, Lactococcus lactis subsp. cremoris SK11; identical to SEQ ID NO: 15802

SEQ ID NO: 63972 - DNA, 588 bp, Lactococcus lactis subsp. cremoris SK11; identical to SEQ ID NO: 15803
  CDS (1)..(588)

SEQ ID NO: 63973 - protein, 195 aa, Lactococcus lactis subsp. cremoris SK11; identical to SEQ ID NO: 15804

SEQ ID NO: 63974 - DNA, 597 bp, Lactobacillus casei ATCC 334; identical to SEQ ID NO: 15805
  CDS (1)..(597)

SEQ ID NO: 63975 - protein, 198 aa, Lactobacillus casei ATCC 334; identical to SEQ ID NO: 15806

SEQ ID NO: 63976 - DNA, 705 bp, Lactobacillus casei ATCC 334; identical to SEQ ID NO: 15807
  CDS (1)..(705)

SEQ ID NO: 63977 - protein, 234 aa, Lactobacillus casei ATCC 334; identical to SEQ ID NO: 15808

SEQ ID NO: 63978 - DNA, 591 bp, Lactobacillus delbrueckii subsp. bulgaricus ATCC BAA-365; identical to SEQ ID NO: 15809
  CDS (1)..(591)

SEQ ID NO: 63979 - protein, 196 aa, Lactobacillus delbrueckii subsp. bulgaricus ATCC BAA-365; identical to SEQ ID NO: 15810

SEQ ID NO: 63980 - DNA, 609 bp, Bacillus anthracis str. A2012; identical to SEQ ID NO: 15811
  CDS (1)..(609): n means a or g or c or t/u, s means g or c

SEQ ID NO: 63981 - protein, 202 aa, Bacillus anthracis str. A2012; identical to SEQ ID NO: 15812
  Xaa in position 136 is unknown

SEQ ID NO: 63982 - DNA, 534 bp, Anaeromyxobacter dehalogenans 2CP-C; identical to SEQ ID NO: 15813
  CDS (1)..(534): transl_table=11

SEQ ID NO: 63983 - protein, 177 aa, Anaeromyxobacter dehalogenans 2CP-C; identical to SEQ ID NO: 15814

SEQ ID NO: 63984 - DNA, 663 bp, Streptococcus pneumoniae TIGR4; identical to SEQ ID NO: 15815
  CDS (1)..(663)

SEQ ID NO: 63985 - protein, 220 aa, Streptococcus pneumoniae TIGR4; identical to SEQ ID NO: 15816

SEQ ID NO: 63986 - DNA, 558 bp, Burkholderia vietnamiensis G4; identical to SEQ ID NO: 15817
  CDS (1)..(558): transl_table=11

SEQ ID NO: 63987 - protein, 185 aa, Burkholderia vietnamiensis G4; identical to SEQ ID NO: 15818

SEQ ID NO: 63988 - DNA, 576 bp, Crocosphaera watsonii WH 8501; identical to SEQ ID NO: 15819
  CDS (1)..(576): transl_table=11

SEQ ID NO: 63989 - protein, 191 aa, Crocosphaera watsonii WH 8501; identical to SEQ ID NO: 15820

SEQ ID NO: 63990 - DNA, 555 bp, Chlorobium phaeobacteroides DSM 266; identical to SEQ ID NO: 15821
  CDS (1)..(555): transl_table=11

SEQ ID NO: 63991 - protein, 184 aa, Chlorobium phaeobacteroides DSM 266; identical to SEQ ID NO: 15822

SEQ ID NO: 63992 - DNA, 618 bp, Chlorobium phaeobacteroides BS1; identical to SEQ ID NO: 15823
  CDS (1)..(618): transl_table=11

SEQ ID NO: 63993 - protein, 205 aa, Chlorobium phaeobacteroides BS1; identical to SEQ ID NO: 15824

SEQ ID NO: 63994 - DNA, 576 bp, Exiguobacterium sp. 255-15; identical to SEQ ID NO: 15825
  CDS (1)..(576): transl_table=11

SEQ ID NO: 63995 - protein, 191 aa, Exiguobacterium sp. 255-15; identical to SEQ ID NO: 15826

SEQ ID NO: 63996 - DNA, 552 bp, Exiguobacterium sp. 255-15; identical to SEQ ID NO: 15827
  CDS (1)..(552): transl_table=11

SEQ ID NO: 63997 - protein, 183 aa, Exiguobacterium sp. 255-15; identical to SEQ ID NO: 15828

SEQ ID NO: 63998 - DNA, 702 bp, Exiguobacterium sp. 255-15; identical to SEQ ID NO: 15829
  CDS (1)..(702): transl_table=11

SEQ ID NO: 63999 - protein, 233 aa, Exiguobacterium sp. 255-15; identical to SEQ ID NO: 15830

SEQ ID NO: 64000 - DNA, 642 bp, Methanosarcina barkeri str. fusaro; identical to SEQ ID NO: 15831
  CDS (1)..(642): transl_table=11

SEQ ID NO: 64001 - protein, 213 aa, Methanosarcina barkeri str. fusaro; identical to SEQ ID NO: 15832

SEQ ID NO: 64002 - DNA, 600 bp, Methanosarcina barkeri str. fusaro; identical to SEQ ID NO: 15833
  CDS (1)..(600): transl_table=11

SEQ ID NO: 64003 - protein, 199 aa, Methanosarcina barkeri str. fusaro; identical to SEQ ID NO: 15834

SEQ ID NO: 64004 - DNA, 549 bp, Methanosarcina barkeri str. fusaro; identical to SEQ ID NO: 15835
  CDS (1)..(549): transl_table=11

SEQ ID NO: 64005 - protein, 182 aa, Methanosarcina barkeri str. fusaro; identical to SEQ ID NO: 15836

SEQ ID NO: 64006 - DNA, 609 bp, Methanosarcina barkeri str. fusaro; identical to SEQ ID NO: 15837
  CDS (1)..(609): transl_table=11

SEQ ID NO: 64007 - protein, 202 aa, Methanosarcina barkeri str. fusaro; identical to SEQ ID NO: 15838

SEQ ID NO: 64008 - DNA, 531 bp, Desulfuromonas acetoxidans DSM 684; identical to SEQ ID NO: 15839
  CDS (1)..(531): transl_table=11

SEQ ID NO: 64009 - protein, 176 aa, Desulfuromonas acetoxidans DSM 684; identical to SEQ ID NO: 15840

SEQ ID NO: 64010 - DNA, 555 bp, Jannaschia sp. CCS1; identical to SEQ ID NO: 15841
  CDS (1)..(555): transl_table=11

SEQ ID NO: 64011 - protein, 184 aa, Jannaschia sp. CCS1; identical to SEQ ID NO: 15842

SEQ ID NO: 64012 - DNA, 630 bp, Frankia sp. EAN1pec; identical to SEQ ID NO: 15843
  CDS (1)..(630): transl_table=11

SEQ ID NO: 64013 - protein, 209 aa, Frankia sp. EAN1pec; identical to SEQ ID NO: 15844

SEQ ID NO: 64014 - DNA, 555 bp, Shewanella baltica OS155; identical to SEQ ID NO: 15845
  CDS (1)..(555): transl_table=11

SEQ ID NO: 64015 - protein, 184 aa, Shewanella baltica OS155; identical to SEQ ID NO: 15846

SEQ ID NO: 64016 - DNA, 585 bp, Shewanella baltica OS155; identical to SEQ ID NO: 15847
  CDS (1)..(585): transl_table=11

SEQ ID NO: 64017 - protein, 194 aa, Shewanella baltica OS155; identical to SEQ ID NO: 15848

SEQ ID NO: 64018 - DNA, 726 bp, Ralstonia metallidurans CH34; identical to SEQ ID NO: 15849
  CDS (1)..(726): transl_table=11

SEQ ID NO: 64019 - protein, 241 aa, Ralstonia metallidurans CH34; identical to SEQ ID NO: 15850

SEQ ID NO: 64020 - DNA, 549 bp, Paracoccus denitrificans PD1222; identical to SEQ ID NO: 15851
  CDS (1)..(549): transl_table=11

SEQ ID NO: 64021 - protein, 182 aa, Paracoccus denitrificans PD1222; identical to SEQ ID NO: 15852

SEQ ID NO: 64022 - DNA, 615 bp, Shewanella frigidimarina NCIMB 400; identical to SEQ ID NO: 15853
  CDS (1)..(615): transl_table=11

SEQ ID NO: 64023 - protein, 204 aa, Shewanella frigidimarina NCIMB 400; identical to SEQ ID NO: 15854

SEQ ID NO: 64024 - DNA, 777 bp, Escherichia coli; identical to SEQ ID NO: 15855
  CDS (1)..(777): transl_table=11

SEQ ID NO: 64025 - protein, 258 aa, Escherichia coli; identical to SEQ ID NO: 15856

SEQ ID NO: 64026 - DNA, 651 bp, Pseudomonas fluorescens; identical to SEQ ID NO: 15857
  CDS (1)..(651): transl_table=11

SEQ ID NO: 64027 - protein, 216 aa, Pseudomonas fluorescens; identical to SEQ ID NO: 15858

SEQ ID NO: 64028 - DNA, 579 bp, Staphylococcus haemolyticus; identical to SEQ ID NO: 15859
  CDS (1)..(579): transl_table=11

SEQ ID NO: 64029 - protein, 192 aa, Staphylococcus haemolyticus; identical to SEQ ID NO: 15860

SEQ ID NO: 64030 - DNA, 648 bp, Aspergillus fumigatus Af293; identical to SEQ ID NO: 15861
  CDS (1)..(648)

SEQ ID NO: 64031 - protein, 215 aa, Aspergillus fumigatus Af293; identical to SEQ ID NO: 15862

SEQ ID NO: 64032 - DNA, 747 bp, Aspergillus fumigatus Af293; identical to SEQ ID NO: 15863
  CDS (1)..(747)

SEQ ID NO: 64033 - protein, 248 aa, Aspergillus fumigatus Af293; identical to SEQ ID NO: 15864

SEQ ID NO: 64034 - DNA, 687 bp, Aspergillus fumigatus Af293; identical to SEQ ID NO: 15865
  CDS (1)..(687)

SEQ ID NO: 64035 - protein, 228 aa, Aspergillus fumigatus Af293; identical to SEQ ID NO: 15866

SEQ ID NO: 64036 - DNA, 603 bp, Lactobacillus crispatus; identical to SEQ ID NO: 15867
  CDS (1)..(603): transl_table=11

SEQ ID NO: 64037 - protein, 200 aa, Lactobacillus crispatus; identical to SEQ ID NO: 15868

SEQ ID NO: 64038 - DNA, 642 bp, Cryptococcus neoformans var; identical to SEQ ID NO: 15869
  CDS (1)..(642)

SEQ ID NO: 64039 - protein, 213 aa, Cryptococcus neoformans var; identical to SEQ ID NO: 15870

SEQ ID NO: 64040 - DNA, 513 bp, Klebsiella pneumoniae; identical to SEQ ID NO: 15871
  CDS (1)..(513): transl_table=11

SEQ ID NO: 64041 - protein, 170 aa, Klebsiella pneumoniae; identical to SEQ ID NO: 15872

SEQ ID NO: 64042 - DNA, 555 bp, Vibrio cholerae non; identical to SEQ ID NO: 15873
  CDS (1)..(555): transl_table=11

SEQ ID NO: 64043 - protein, 184 aa, Vibrio cholerae non; identical to SEQ ID NO: 15874

SEQ ID NO: 64044 - DNA, 645 bp, Rhizobium etli; identical to SEQ ID NO: 15875
  CDS (1)..(645): transl_table=11

SEQ ID NO: 64045 - protein, 214 aa, Rhizobium etli; identical to SEQ ID NO: 15876

SEQ ID NO: 64046 - DNA, 558 bp, Bacillus stearothermophilus; identical to SEQ ID NO: 15877
  CDS (1)..(558): transl_table=11

SEQ ID NO: 64047 - protein, 185 aa, Bacillus stearothermophilus; identical to SEQ ID NO: 15878

SEQ ID NO: 64048 - DNA, 594 bp, Rhizobium leguminosarum bv; identical to SEQ ID NO: 15879
  CDS (1)..(594): transl_table=11

SEQ ID NO: 64049 - protein, 197 aa, Rhizobium leguminosarum bv; identical to SEQ ID NO: 15880

SEQ ID NO: 64050 - DNA, 573 bp, Dictyostelium discoideum; identical to SEQ ID NO: 15881
  CDS (1)..(573)

SEQ ID NO: 64051 - protein, 190 aa, Dictyostelium discoideum; identical to SEQ ID NO: 15882

SEQ ID NO: 64052 - DNA, 657 bp, Physcomitrella patens; identical to SEQ ID NO: 15883
  CDS (1)..(657)

SEQ ID NO: 64053 - protein, 218 aa, Physcomitrella patens; identical to SEQ ID NO: 15884

SEQ ID NO: 64054 - DNA, 636 bp, Aeromonas hydrophila; identical to SEQ ID NO: 15885
  CDS (1)..(636): transl_table=11

SEQ ID NO: 64055 - protein, 211 aa, Aeromonas hydrophila; identical to SEQ ID NO: 15886

SEQ ID NO: 64056 - DNA, 600 bp, Aeromonas hydrophila; identical to SEQ ID NO: 15887
  CDS (1)..(600): transl_table=11

SEQ ID NO: 64057 - protein, 199 aa, Aeromonas hydrophila; identical to SEQ ID NO: 15888

SEQ ID NO: 64058 - DNA, 678 bp, Corynebacterium glutamicum; identical to SEQ ID NO: 15889
  CDS (1)..(678): transl_table=11

SEQ ID NO: 64059 - protein, 225 aa, Corynebacterium glutamicum; identical to SEQ ID NO: 15890

SEQ ID NO: 64060 - DNA, 624 bp, Lactococcus lactis; identical to SEQ ID NO: 15891
  CDS (1)..(624): transl_table=11

SEQ ID NO: 64061 - protein, 207 aa, Lactococcus lactis; identical to SEQ ID NO: 15892

SEQ ID NO: 64062 - DNA, 621 bp, Candida albicans; identical to SEQ ID NO: 15893
  CDS (1)..(621): transl_table=12

SEQ ID NO: 64063 - protein, 206 aa, Candida albicans; identical to SEQ ID NO: 15894

SEQ ID NO: 64064 - DNA, 519 bp, Staphylococcus aureus; identical to SEQ ID NO: 15895
  CDS (1)..(519): transl_table=11

SEQ ID NO: 64065 - protein, 172 aa, Staphylococcus aureus; identical to SEQ ID NO: 15896

SEQ ID NO: 64066 - DNA, 555 bp, Bacillus subtilis; identical to SEQ ID NO: 15897
  CDS (1)..(555): transl_table=11

SEQ ID NO: 64067 - protein, 184 aa, Bacillus subtilis; identical to SEQ ID NO: 15898

SEQ ID NO: 64068 - DNA, 552 bp, Escherichia coli; identical to SEQ ID NO: 15433
  CDS (1)..(552)

SEQ ID NO: 64069 - protein, 183 aa, Escherichia coli; identical to SEQ ID NO: 15434

SEQ ID NO: 64070 - DNA, 573 bp, Rhizobium leguminosarum bv; identical to SEQ ID NO: 15901
  CDS (1)..(573): transl_table=11

SEQ ID NO: 64071 - protein, 190 aa, Rhizobium leguminosarum bv; identical to SEQ ID NO: 15902

SEQ ID NO: 64072 - DNA, 552 bp, Rhizobium meliloti; identical to SEQ ID NO: 15903
  CDS (1)..(552): transl_table=11

SEQ ID NO: 64073 - protein, 183 aa, Rhizobium meliloti; identical to SEQ ID NO: 15904

SEQ ID NO: 64074 - DNA, 624 bp, Lactococcus lactis subsp; identical to SEQ ID NO: 15905
  CDS (1)..(624): transl_table=11

SEQ ID NO: 64075 - protein, 207 aa, Lactococcus lactis subsp; identical to SEQ ID NO: 15906

SEQ ID NO: 64076 - DNA, 645 bp, Methanococcus jannaschii; identical to SEQ ID NO: 15907
  CDS (1)..(645): transl_table=11

SEQ ID NO: 64077 - protein, 214 aa, Methanococcus jannaschii; identical to SEQ ID NO: 15908

SEQ ID NO: 64078 - DNA, 624 bp, Schizosaccharomyces pombe; identical to SEQ ID NO: 15909
  CDS (1)..(624)

SEQ ID NO: 64079 - protein, 207 aa, Schizosaccharomyces pombe; identical to SEQ ID NO: 15910

SEQ ID NO: 64080 - DNA, 591 bp, Saccharomyces cerevisiae; identical to SEQ ID NO: 15911
  CDS (1)..(591)

SEQ ID NO: 64081 - protein, 196 aa, Saccharomyces cerevisiae; identical to SEQ ID NO: 15912

SEQ ID NO: 64082 - DNA, 25 bp, Artificial sequence
  (1)..(25): primer
atgaacatgccaatgaccgaaagaa

SEQ ID NO: 64083 - DNA, 28 bp, Artificial sequence
  (1)..(28): primer
ttaaactgacgattcaactttataatct

SEQ ID NO: 64084 - protein, 204 aa, Artificial sequence; identical to SEQ ID NO: 15915
  Variant (2)..(4): xaa in position 2 to 4 is any amino acid
  Variant (5)..(9): xaa in position 5 to 9 is any or no amino acid
  Variant (11)..(26): xaa in position 11 to 26 is any or no amino acid
  Variant (28)..(28): xaa in position 28 is any amino acid
  Variant (31)..(41): xaa in position 31 to 41 is any amino acid
  Variant (42)..(92): xaa in position 42 to 92 is any or no amino acid
  Variant (94)..(94): xaa in position 94 is any or no amino acid
  Variant (97)..(97): xaa in position 97 is any amino acid
  Variant (98)..(101): xaa in position 98 to 101 is any or no amino acid
  Variant (103)..(106): xaa in position 103 to 106 is any amino acid
  Variant (108)..(109): xaa in position 108 to 109 is any amino acid
  Variant (110)..(112): xaa in position 110 to 112 is any or no amino acid
  Variant (114)..(119): xaa in position 114 to 119 is any amino acid
  Variant (120)..(152): xaa in position 120 to 152 is any or no amino acid
  Variant (154)..(154): xaa in position 154 is any amino acid
  Variant (156)..(159): xaa in position 156 to 159 is any amino acid
  Variant (163)..(166): xaa in position 163 to 166 is any or no amino acid
  Variant (168)..(169): xaa in position 168 to 169 is any or no amino acid
  Variant (172)..(172): xaa in position 172 is any or no amino acid
  Variant (175)..(177): xaa in position 175 to 177 is any or no amino acid
  Variant (188)..(188): xaa in position 188 is any amino acid
  Variant (191)..(193): xaa in position 191 to 193 is any amino acid
  Variant (195)..(196): xaa in position 195 to 196 is any amino acid
  Variant (198)..(198): xaa in position 198 is any amino acid
  Variant (200)..(200): xaa in position 200 is any amino acid

SEQ ID NO: 64085 - protein, 12 aa, Artificial sequence
  Variant (2)..(2): xaa in position 2 is any or no amino acid
  Variant (4)..(5): xaa in position 4 to 5 is any amino acid
  Variant (6)..(6): xaa in position 6 is Ala, Cys, Thr or Val
  Variant (7)..(7): xaa in position 7 is any amino acid
  Variant (8)..(8): xaa in position 8 is Phe, Ile, Leu, Met or Val
  Variant (9)..(11): xaa in position 9 to 11 is any amino acid
  Variant (12)..(12): xaa in position 12 is Ala, Cys, Asp, Gly, Asn, Ser, Thr or Val
IXGXXXXXXXXX

SEQ ID NO: 64086 - protein, 43 aa, Artificial sequence; identical to SEQ ID NO: 15917
  Variant (2)..(2): xaa in position 2 is any amino acid
  Variant (3)..(4): xaa in position 3 to 4 is any or no amino acid
  Variant (6)..(10): xaa in position 6 to 10 is any amino acid
  Variant (11)..(12): xaa in position 11 to 12 is any or no amino acid
  Variant (14)..(14): xaa in position 14 is Ala, Ile or Val
  Variant (15)..(15): xaa in position 15 is any amino acid
  Variant (16)..(16): xaa in position 16 is Ile, Leu or Val
  Variant (17)..(17): xaa in position 17 is Asp, Gly or Thr
  Variant (18)..(19): xaa in position 18 to 19 is any amino acid
  Variant (20)..(20): xaa in position 20 is Ala, Cys, Gly, Ser, Thr or Val
  Variant (21)..(21): xaa in position 21 is any amino acid
  Variant (22)..(22): xaa in position 22 is Ala, Ile, Leu or Val
  Variant (23)..(23): xaa in position 23 is Ala, Gly or Ser
  Variant (24)..(25): xaa in position 24 to 25 is any amino acid
  Variant (26)..(26): xaa in position 26 is Ala, Cys, Ser or Thr
  Variant (27)..(27): xaa in position 27 is any amino acid
  Variant (28)..(28): xaa in position 28 is Ala, Ile or Val
  Variant (29)..(31): xaa in position 29 to 31 is any amino acid
  Variant (32)..(32): xaa in position 32 is Phe, Ile, Leu, Met or Val
  Variant (33)..(39): xaa in position 33 to 39 is any amino acid
  Variant (41)..(41): xaa in position 41 is any amino acid
  Variant (43)..(43): xaa in position 43 is Ala, Cys or Gly

SEQ ID NO: 64087 - DNA, 414 bp, Escherichia coli
  CDS (1)..(414)
atgaacaatttaattattacgacccgacaatcaccagtacgtttactggttgattatgttgccacaaccatcttgtggacattatttgcgttgttcatattcttattcgccatggatctgctgacgggttattactggcaaagcgaggccagaagccgacttcagttctattttttgctggcagtggcgaatgccgtcgtgttaattgtctgggcgctgtacaataagctgcgttttcaaaaacagcagcatcatgcagcctaccaatatacgccgcaagaatatgcagagagcttagcaatacctgatgagctctatcagcaactacaaaaaagccacaggatgagcgtacacttcaccagccaggggcaaataaaaatggttgtttcagaaaaagcgctagtccgggcataa

SEQ ID NO: 64088 - protein, 137 aa, Escherichia coli
MNNLIITTRQSPVRLLVDYVATTILWTLFALFIFLFAMDLLTGYYWQSEARSRLQFYFLLAVANAVVLIVWALYNKLRFQKQQHHAAYQYTPQEYAESLAIPDELYQQLQKSHRMSVHFTSQGQIKMVVSEKALVRA

SEQ ID NO: 64089 - DNA, 468 bp, Yersinia pestis KIM
  CDS (1)..(468): transl_table=11
atgagtacgcccctgatttttacggaacagcgtctgctaccgcgctggattgacattatcattacggcgttagcctggtttggttttgtcttcctgctggtgcggggctttttggaaatgattagccgagcgccacatatggggccgataccgttgaggatttatattctcagcggtttgacgacgattgcattatatctggcgatagcggcatttaatgccgtcgtactgattatctgggccaaatacaatcaggtccgtttccaggttgaacgccgtggccaccgacccgatctggatgatgatgaattggcaagcagcatggcgctttcacctgagttgatcgcccaactcaaaagtggctcgtgtctcacgttatacaatgatgagcacgggcatttattggatgtgaaagaggggctccaactgccagaagttgctccagtgatccatttacgccagggatga

SEQ ID NO: 64090 - protein, 155 aa, Yersinia pestis KIM
MSTPLIFTEQRLLPRWIDIIITALAWFGFVFLLVRGFLEMISRAPHMGPIPLRIYILSGLTTIALYLAIAAFNAVVLIIWAKYNQVRFQVERRGHRPDLDDDELASSMALSPELIAQLKSGSCLTLYNDEHGHLLDVKEGLQLPEVAPVIHLRQG

SEQ ID NO: 64091 - DNA, 468 bp, Yersinia pseudotuberculosis IP 32953
  CDS (1)..(468): transl_table=11
atgagtacgcccctgatttttacggaacagcgtctgctaccgcgctggattgacattatcattacggcgttagcctggtttggttttatcttcctgctggtgcggggctttttggaaatgattagccgagcgccacatatggggccgataccgttgaggatttatattctcagcggtttgacgacgattgcattatatctggcgatagcggcatttaatgccgtcgtactgattatctgggccaaatacaatcaggtccgtttccaggttgaacgccgtggccaccgacccgatctggatgatgatgaattggcaagcagcatggcgctttcacctgagttgatcgcccaactcaaaagtggctcgtgtctcacgttatacaatgatgagcacgggcatttattggatgtgaaagaggggctccaactgccagaagttgctccagtgatccatttacgccagggatga

SEQ ID NO: 64092 - protein, 155 aa, Yersinia pseudotuberculosis IP 32953
MSTPLIFTEQRLLPRWIDIIITALAWFGFIFLLVRGFLEMISRAPHMGPIPLRIYILSGLTTIALYLAIAAFNAVVLIIWAKYNQVRFQVERRGHRPDLDDDELASSMALSPELIAQLKSGSCLTLYNDEHGHLLDVKEGLQLPEVAPVIHLRQG

SEQ ID NO: 64093 - DNA, 525 bp, Pseudomonas fluorescens Pf-5
  CDS (1)..(525): transl_table=11
atgaaaatcatccgaacccgccagcgtccgttcatggtgatcgtcgacgttgtcctcaccgtactggcctgggtaggcctgctgtacttgctggttcgtgggctcattccgctgctggacagccatgaagggccgcggatcgaagcgggcatgctcgatgccctgaccaccctgcagttctatgcctgggtggcggtactcaatgcggtgctgctgatttcctgggcccgctaccgccagcgtcgcaacaagagctacccgccccggctgccggcacccgtggtggacgacaagcgcctgagcgaaaccttcaagctcaacgacgcgaccttcgcccagatgcgccagcccggcaccatgatcgtgcacaacgacgaggaaggcggtatcagccacgtcaccacgcagttctatcgcattcttcccgaagaccagcagcacccgccgctaagggtggaaccgccaccgcgggtgatccatctgcgttcggaaggggatgaaggcaagaagacaggagaagattga

SEQ ID NO: 64094 - protein, 174 aa, Pseudomonas fluorescens Pf-5
MKIIRTRQRPFMVIVDVVLTVLAWVGLLYLLVRGLIPLLDSHEGPRIEAGMLDALTTLQFYAWVAVLNAVLLISWARYRQRRNKSYPPRLPAPVVDDKRLSETFKLNDATFAQMRQPGTMIVHNDEEGGISHVTTQFYRILPEDQQHPPLRVEPPPRVIHLRSEGDEGKKTGED

SEQ ID NO: 64095 - DNA, 534 bp, Pseudomonas fluorescens PfO-1
  CDS (1)..(534)
atgaaaatcatccggacccggcaacgaccgtttctggtgctgctcgatgcgttcttcaccgtgctggcctggatcggcctgctgtatctgctggtacgcggtctgtggccgctgattgatactcacgaaggtgggccacgcctcgacaactcggcgttcgaagccctcggcaccttgcagatttacctgtgggtggcggtggtcaacgcggtgatcctgatcggctgggcgcgctatcagcaacgcaagagccgcagcttcgcccagcgccgcctgccgtccccggtggtcgacgatgaagggctgagccgcagcttcaaactgtgcgacgagcgctttcagaaactgcgcgggccgggcgtgatgaccatccacaacgatcaggacggcgatgtcagtcatgtggtgccgcatctgtggccggttcagccgcaggagctgccatcaccgctggccccgctggaacatcctcgggtgatctttctgcacgccgaggacgacgacaaccgcgagccgcttaaccggatcacctga

SEQ ID NO: 64096 - protein, 177 aa, Pseudomonas fluorescens PfO-1
MKIIRTRQRPFLVLLDAFFTVLAWIGLLYLLVRGLWPLIDTHEGGPRLDNSAFEALGTLQIYLWVAVVNAVILIGWARYQQRKSRSFAQRRLPSPVVDDEGLSRSFKLCDERFQKLRGPGVMTIHNDQDGDVSHVVPHLWPVQPQELPSPLAPLEHPRVIFLHAEDDDNREPLNRIT

SEQ ID NO: 64097 - DNA, 26 bp, Artificial sequence
  (1)..(26): primer
atgaacaatttaattattacgacccg

SEQ ID NO: 64098 - DNA, 23 bp, Artificial sequence
  (1)..(23): primer
ttatgcccggactagcgcttttt

SEQ ID NO: 64099 - protein, 134 aa, Artificial sequence
  Variant (2)..(2): xaa in position 2 is any amino acid
  Variant (4)..(4): xaa in position 4 is any amino acid
  Variant (7)..(12): xaa in position 7 to 12 is any amino acid
  Variant (14)..(16): xaa in position 14 to 16 is any amino acid
  Variant (18)..(18): xaa in position 18 is any amino acid
  Variant (22)..(22): xaa in position 22 is any amino acid
  Variant (24)..(26): xaa in position 24 to 26 is any amino acid
  Variant (32)..(38): xaa in position 32 to 38 is any amino acid
  Variant (39)..(40): xaa in position 39 to 40 is any or no amino acid
  Variant (42)..(42): xaa in position 42 is any amino acid
  Variant (44)..(47): xaa in position 44 to 47 is any amino acid
  Variant (48)..(54): xaa in position 48 to 54 is any or no amino acid
  Variant (56)..(56): xaa in position 56 is any amino acid
  Variant (58)..(60): xaa in position 58 to 60 is any amino acid
  Variant (62)..(64): xaa in position 62 to 64 is any amino acid
  Variant (66)..(67): xaa in position 66 to 67 is any amino acid
  Variant (71)..(71): xaa in position 71 is any amino acid
  Variant (74)..(74): xaa in position 74 is any amino acid
  Variant (77)..(77): xaa in position 77 is any amino acid
  Variant (79)..(81): xaa in position 79 to 81 is any amino acid
  Variant (82)..(83): xaa in position 82 to 83 is any or no amino acid
  Variant (85)..(89): xaa in position 85 to 89 is any amino acid
  Variant (91)..(93): xaa in position 91 to 93 is any amino acid
  Variant (95)..(96): xaa in position 95 to 96 is any amino acid
  Variant (99)..(100): xaa in position 99 to 100 is any amino acid
  Variant (102)..(103): xaa in position 102 to 103 is any amino acid
  Variant (105)..(106): xaa in position 105 to 106 is any amino acid
  Variant (108)..(109): xaa in position 108 to 109 is any amino acid
  Variant (111)..(113): xaa in position 111 to 113 is any amino acid
  Variant (116)..(124): xaa in position 116 to 124 is any amino acid
  Variant (127)..(128): xaa in position 127 to 128 is any amino acid
  Variant (130)..(133): xaa in position 130 to 133 is any amino acid
IXTXQRXXXXXXDXXXTXLAWXGXXXLLVRGXXXXXXXXXHXGXXXXXXXXXXXLXTXXXYXXXAXXNAVXLIXWAXYXXXXXRXXXXXRXXXPXXDDXXLXXSXXLXXEXXXQLXXXXXXXXXNDXXGXXXXV

SEQ ID NO: 64100 - protein, 21 aa, Artificial sequence
  Variant (2)..(2): xaa in position 2 is any amino acid
  Variant (4)..(4): xaa in position 4 is Glu or Arg
  Variant (7)..(7): xaa in position 7 is Leu or Pro
  Variant (8)..(8): xaa in position 8 is Phe or Leu
  Variant (9)..(11): xaa in position 9 to 11 is any amino acid
  Variant (12)..(12): xaa in position 12 is Ile, Leu or Val
  Variant (14)..(14): xaa in position 14 is Ala, Ile or Val
  Variant (15)..(15): xaa in position 15 is Phe, Ile or Val
  Variant (16)..(16): xaa in position 16 is Phe, Ile or Leu
  Variant (18)..(18): xaa in position 18 is Ala or Val
IXTXQRXXXXXXDXXXTXLAW

SEQ ID NO: 64101 - protein, 18 aa, Artificial sequence
  Variant (2)..(2): xaa in position 2 is Phe or Leu
  Variant (3)..(3): xaa in position 3 is any amino acid
  Variant (4)..(4): xaa in position 4 is Ile, Leu or Val
  Variant (6)..(8): xaa in position 6 to 8 is any or no amino acid
  Variant (11)..(11): xaa in position 11 is Ile or Val
  Variant (14)..(14): xaa in position 14 is Gly, Ile or Val
  Variant (17)..(17): xaa in position 17 is any amino acid
YXXXAXXXAVXLIXWAXY

SEQ ID NO: 64102 - protein, 10 aa, Artificial sequence
  Variant (3)..(3): xaa in position 3 is Glu or Gln
  Variant (4)..(4): xaa in position 4 is Asp, Glu or His
  Variant (6)..(8): xaa in position 6 to 8 is any or no amino acid
  Variant (10)..(10): xaa in position 10 is Leu or Val
NDXXGXXXHX

SEQ ID NO: 64103 - DNA, 1071 bp, Escherichia coli K12; identical to SEQ ID NO: 23463
  CDS (1)..(1071)

SEQ ID NO: 64104 - protein, 356 aa, Escherichia coli K12; identical to SEQ ID NO: 23464

SEQ ID NO: 64105 - DNA, 1068 bp, Yersinia pestis; identical to SEQ ID NO: 23465
  CDS (1)..(1068)

SEQ ID NO: 64106 - protein, 355 aa, Yersinia pestis; identical to SEQ ID NO: 23466

SEQ ID NO: 64107 - DNA, 1068 bp, Salmonella enterica subsp. enterica serovar Typhi; identical to SEQ ID NO: 23467
  CDS (1)..(1068)

SEQ ID NO: 64108 - protein, 355 aa, Salmonella enterica subsp. enterica serovar Typhi; identical to SEQ ID NO: 23468

SEQ ID NO: 64109 - DNA, 1074 bp, Vibrio cholerae; identical to SEQ ID NO: 23469
  CDS (1)..(1074)

SEQ ID NO: 64110 - protein, 357 aa, Vibrio cholerae; identical to SEQ ID NO: 23470

SEQ ID NO: 64111 - DNA, 1128 bp, Xylella fastidiosa; identical to SEQ ID NO: 23471
  CDS (1)..(1128)

SEQ ID NO: 64112 - protein, 375 aa, Xylella fastidiosa; identical to SEQ ID NO: 23472

SEQ ID NO: 64113 - DNA, 1065 bp, Salmonella typhimurium; identical to SEQ ID NO: 23473
  CDS (1)..(1065)

SEQ ID NO: 64114 - protein, 354 aa, Salmonella typhimurium; identical to SEQ ID NO: 23474

SEQ ID NO: 64115 - DNA, 1059 bp, Campylobacter jejuni; identical to SEQ ID NO: 23475
  CDS (1)..(1059)

SEQ ID NO: 64116 - protein, 352 aa, Campylobacter jejuni; identical to SEQ ID NO: 23476

SEQ ID NO: 64117 - DNA, 1089 bp, Haemophilus influenzae; identical to SEQ ID NO: 23477
  CDS (1)..(1089)

SEQ ID NO: 64118 - protein, 362 aa, Haemophilus influenzae; identical to SEQ ID NO: 23478

SEQ ID NO: 64119 - DNA, 1125 bp, Bacteroides fragilis; identical to SEQ ID NO: 23479
  CDS (1)..(1125)

SEQ ID NO: 64120 - protein, 374 aa, Bacteroides fragilis; identical to SEQ ID NO: 23480

SEQ ID NO: 64121 - DNA, 1098 bp, Mannheimia succiniciproducens MBEL55E; identical to SEQ ID NO: 23481
  CDS (1)..(1098)

SEQ ID NO: 64122 - protein, 365 aa, Mannheimia succiniciproducens MBEL55E; identical to SEQ ID NO: 23482

SEQ ID NO: 64123 - DNA, 1068 bp, Erwinia carotovora; identical to SEQ ID NO: 23483
  CDS (1)..(1068)

SEQ ID NO: 64124 - protein, 355 aa, Erwinia carotovora; identical to SEQ ID NO: 23484

SEQ ID NO: 64125 - DNA, 1125 bp, Bacteroides thetaiotaomicron; identical to SEQ ID NO: 23485
  CDS (1)..(1125)

SEQ ID NO: 64126 - protein, 374 aa, Bacteroides thetaiotaomicron; identical to SEQ ID NO: 23486

SEQ ID NO: 64127 - DNA, 1068 bp, Buchnera aphidicola; identical to SEQ ID NO: 23487
  CDS (1)..(1068)

SEQ ID NO: 64128 - protein, 355 aa, Buchnera aphidicola; identical to SEQ ID NO: 23488

SEQ ID NO: 64129 - DNA, 1074 bp, Buchnera aphidicola; identical to SEQ ID NO: 23489
  CDS (1)..(1074)

SEQ ID NO: 64130 - protein, 357 aa, Buchnera aphidicola; identical to SEQ ID NO: 23490

SEQ ID NO: 64131 - DNA, 1074 bp, Candidatus Blochmannia floridanus; identical to SEQ ID NO: 23491
  CDS (1)..(1074)

SEQ ID NO: 64132 - protein, 357 aa, Candidatus Blochmannia floridanus; identical to SEQ ID NO: 23492

SEQ ID NO: 64133 - DNA, 1092 bp, Pasteurella multocida; identical to SEQ ID NO: 23493
  CDS (1)..(1092)

SEQ ID NO: 64134 - protein, 363 aa, Pasteurella multocida; identical to SEQ ID NO: 23494

SEQ ID NO: 64135 - DNA, 1068 bp, Photorhabdus luminescens; identical to SEQ ID NO: 23495
  CDS (1)..(1068)

SEQ ID NO: 64136 - protein, 355 aa, Photorhabdus luminescens; identical to SEQ ID NO: 23496

SEQ ID NO: 64137 - DNA, 1086 bp, Photobacterium profundum; identical to SEQ ID NO: 23497
  CDS (1)..(1086)

SEQ ID NO: 64138 - protein, 361 aa, Photobacterium profundum; identical to SEQ ID NO: 23498

SEQ ID NO: 64139 - DNA, 1092 bp, Shewanella oneidensis; identical to SEQ ID NO: 23499
  CDS (1)..(1092)

SEQ ID NO: 64140 - protein, 363 aa, Shewanella oneidensis; identical to SEQ ID NO: 23500

SEQ ID NO: 64141 - DNA, 1074 bp, Vibrio vulnificus; identical to SEQ ID NO: 23501
  CDS (1)..(1074)

SEQ ID NO: 64142 - protein, 357 aa, Vibrio vulnificus; identical to SEQ ID NO: 23502

SEQ ID NO: 64143 - DNA, 1128 bp, Xanthomonas campestris; identical to SEQ ID NO: 23503
  CDS (1)..(1128)

SEQ ID NO: 64144 - protein, 375 aa, Xanthomonas campestris; identical to SEQ ID NO: 23504

SEQ ID NO: 64145 - DNA, 27 bp, Artificial sequence
  (1)..(27): primer
atgatgagtcagaagtatctttttatc

SEQ ID NO: 64146 - DNA, 23 bp, Artificial sequence
  (1)..(23): primer
ttacagcactcctttcgacgagg

SEQ ID NO: 64147 - protein, 392 aa, Artificial sequence; identical to SEQ ID NO: 23507
  Variant (6)..(8): xaa in position 6 to 8 is any amino acid
  Variant (11)..(14): xaa in position 11 to 14 is any amino acid
  Variant (16)..(16): xaa in position 16 is any amino acid
  Variant (18)..(20): xaa in position 18 to 20 is any amino acid
  Variant (23)..(47): xaa in position 23 to 47 is any amino acid
  Variant (50)..(50): xaa in position 50 is any amino acid
  Variant (54)..(57): xaa in position 54 to 57 is any amino acid
  Variant (59)..(61): xaa in position 59 to 61 is any amino acid
  Variant (63)..(68): xaa in position 63 to 68 is any amino acid
  Variant (70)..(76): xaa in position 70 to 76 is any amino acid
  Variant (78)..(79): xaa in position 78 to 79 is any amino acid
  Variant (81)..(84): xaa in position 81 to 84 is any amino acid
  Variant (86)..(96): xaa in position 86 to 96 is any amino acid
  Variant (100)..(117): xaa in position 100 to 117 is any amino acid
  Variant (119)..(121): xaa in position 119 to 121 is any amino acid
  Variant (125)..(126): xaa in position 125 to 126 is any amino acid
  Variant (128)..(163): xaa in position 128 to 163 is any amino acid
  Variant (165)..(185): xaa in position 165 to 185 is any amino acid
  Variant (187)..(191): xaa in position 187 to 191 is any amino acid
  Variant (193)..(193): xaa in position 193 is any amino acid
  Variant (195)..(195): xaa in position 195 is any amino acid
  Variant (198)..(204): xaa in position 198 to 204 is any amino acid
  Variant (206)..(214): xaa in position 206 to 214 is any amino acid
  Variant (217)..(219): xaa in position 217 to 219 is any amino acid
  Variant (221)..(221): xaa in position 221 is any amino acid
  Variant (225)..(225): xaa in position 225 is any amino acid
  Variant (227)..(229): xaa in position 227 to 229 is any amino acid
  Variant (231)..(240): xaa in position 231 to 240 is any amino acid
  Variant (243)..(245): xaa in position 243 to 245 is any amino acid
  Variant (247)..(247): xaa in position 247 is any amino acid
  Variant (250)..(251): xaa in position 250 to 251 is any amino acid
  Variant (254)..(264): xaa in position 254 to 264 is any amino acid
  Variant (266)..(268): xaa in position 266 to 268 is any amino acid
  Variant (270)..(270): xaa in position 270 is any amino acid
  Variant (272)..(273): xaa in position 272 to 273 is any amino acid
  Variant (275)..(293): xaa in position 275 to 293 is any amino acid
  Variant (295)..(296): xaa in position 295 to 296 is any amino acid
  Variant (301)..(308): xaa in position 301 to 308 is any amino acid
  Variant (310)..(312): xaa in position 310 to 312 is any amino acid
  Variant (314)..(327): xaa in position 314 to 327 is any amino acid
  Variant (329)..(336): xaa in position 329 to 336 is any amino acid
  Variant (340)..(340): xaa in position 340 is any amino acid
  Variant (342)..(349): xaa in position 342 to 349 is any amino acid
  Variant (351)..(355): xaa in position 351 to 355 is any amino acid
  Variant (357)..(357): xaa in position 357 is any amino acid
  Variant (359)..(359): xaa in position 359 is any amino acid
  Variant (362)..(363): xaa in position 362 to 363 is any amino acid
  Variant (365)..(366): xaa in position 365 to 366 is any amino acid
  Variant (369)..(390): xaa in position 369 to 390 is any amino acid

SEQ ID NO: 64148 - protein, 397 aa, Artificial sequence; identical to SEQ ID NO: 23508
  Variant (11)..(11): xaa in position 11 is any amino acid
  Variant (14)..(15): xaa in position 14 to 15 is any amino acid
  Variant (17)..(17): xaa in position 17 is any amino acid
  Variant (19)..(19): xaa in position 19 is any amino acid
  Variant (21)..(23): xaa in position 21 to 23 is any amino acid
  Variant (26)..(30): xaa in position 26 to 30 is any amino acid
  Variant (34)..(34): xaa in position 34 is any amino acid
  Variant (36)..(37): xaa in position 36 to 37 is any amino acid
  Variant (39)..(46): xaa in position 39 to 46 is any amino acid
  Variant (49)..(50): xaa in position 49 to 50 is any amino acid
  Variant (58)..(58): xaa in position 58 is any amino acid
  Variant (60)..(60): xaa in position 60 is any amino acid
  Variant (62)..(64): xaa in position 62 to 64 is any amino acid
  Variant (66)..(67): xaa in position 66 to 67 is any amino acid
  Variant (70)..(71): xaa in position 70 to 71 is any amino acid
  Variant (73)..(77): xaa in position 73 to 77 is any amino acid
  Variant (81)..(82): xaa in position 81 to 82 is any amino acid
  Variant (84)..(86): xaa in position 84 to 86 is any amino acid
  Variant (92)..(96): xaa in position 92 to 96 is any amino acid
  Variant (98)..(98): xaa in position 98 is any amino acid
  Variant (103)..(105): xaa in position 103 to 105 is any amino acid
  Variant (107)..(109): xaa in position 107 to 109 is any amino acid
  Variant (111)..(116): xaa in position 111 to 116 is any amino acid
  Variant (118)..(120): xaa in position 118 to 120 is any amino acid
  Variant (122)..(122): xaa in position 122 is any amino acid
  Variant (128)..(128): xaa in position 128 is any amino acid
  Variant (131)..(132): xaa in position 131 to 132 is any amino acid
  Variant (135)..(135): xaa in position 135 is any amino acid
  Variant (137)..(138): xaa in position 137 to 138 is any amino acid
  Variant (140)..(143): xaa in position 140 to 143 is any amino acid
  Variant (145)..(166): xaa in position 145 to 166 is any amino acid
  Variant (168)..(169): xaa in position 168 to 169 is any amino acid
  Variant (171)..(173): xaa in position 171 to 173 is any amino acid
  Variant (175)..(188): xaa in position 175 to 188 is any amino acid
  Variant (190)..(190): xaa in position 190 is any amino acid
  Variant (192)..(192): xaa in position 192 is any amino acid
  Variant (194)..(194): xaa in position 194 is any amino acid
  Variant (196)..(196): xaa in position 196 is any amino acid
  Variant (201)..(201): xaa in position 201 is any amino acid
  Variant (203)..(203): xaa in position 203 is any amino acid
  Variant (205)..(207): xaa in position 205 to 207 is any amino acid
  Variant (210)..(215): xaa in position 210 to 215 is any amino acid
  Variant (217)..(217): xaa in position 217 is any amino acid
  Variant (220)..(221): xaa in position 220 to 221 is any amino acid
  Variant (228)..(228): xaa in position 228 is any amino acid
  Variant (232)..(232): xaa in position 232 is any amino acid
  Variant (234)..(234): xaa in position 234 is any amino acid
  Variant (236)..(243): xaa in position 236 to 243 is any amino acid
  Variant (247)..(247): xaa in position 247 is any amino acid
  Variant (250)..(250): xaa in position 250 is any amino acid
  Variant (254)..(254): xaa in position 254 is any amino acid
  Variant (258)..(258): xaa in position 258 is any amino acid
  Variant (263)..(263): xaa in position 263 is any amino acid
  Variant (265)..(267): xaa in position 265 to 267 is any amino acid
  Variant (271)..(271): xaa in position 271 is any amino acid
  Variant (276)..(276): xaa in position 276 is any amino acid
  Variant (278)..(296): xaa in position 278 to 296 is any amino acid
  Variant (299)..(299): xaa in position 299 is any amino acid
  Variant (305)..(306): xaa in position 305 to 306 is any amino acid
  Variant (308)..(308): xaa in position 308 is any amino acid
  Variant (310)..(310): xaa in position 310 is any amino acid
  Variant (313)..(313): xaa in position 313 is any amino acid
  Variant (318)..(322): xaa in position 318 to 322 is any amino acid
  Variant (324)..(324): xaa in position 324 is any amino acid
  Variant (326)..(330): xaa in position 326 to 330 is any amino acid
  Variant (332)..(334): xaa in position 332 to 334 is any amino acid
  Variant (338)..(339): xaa in position 338 to 339 is any amino acid
  Variant (343)..(343): xaa in position 343 is any amino acid
  Variant (346)..(352): xaa in position 346 to 352 is any amino acid
  Variant (356)..(358): xaa in position 356 to 358 is any amino acid
  Variant (360)..(360): xaa in position 360 is any amino acid
  Variant (365)..(366): xaa in position 365 to 366 is any amino acid
  Variant (368)..(368): xaa in position 368 is any amino acid
  Variant (372)..(374): xaa in position 372 to 374 is any amino acid
  Variant (376)..(376): xaa in position 376 is any amino acid
  Variant (378)..(378): xaa in position 378 is any amino acid
  Variant (381)..(386): xaa in position 381 to 386 is any amino acid
  Variant (388)..(389): xaa in position 388 to 389 is any amino acid
  Variant (396)..(396): xaa in position 396 is any amino acid

SEQ ID NO: 64149 - protein, 25 aa, Artificial sequence
  Variant (1)..(1): xaa in position 1 is Leu or Val
  Variant (2)..(2): xaa in position 2 is Phe or Leu
  Variant (3)..(3): xaa in position 3 is Ile or Val
  Variant (9)..(9): xaa in position 9 is Leu or Ile
  Variant (10)..(10): xaa in position 10 is Ile or Val
  Variant (11)..(11): xaa in position 11 is any amino acid
  Variant (14)..(14): xaa in position 14 is any amino acid
  Variant (15)..(15): xaa in position 15 is any or no amino acid
  Variant (16)..(16): xaa in position 16 is Asp or Asn
  Variant (17)..(17): xaa in position 17 is any amino acid
  Variant (19)..(19): xaa in position 19 is Val, Ile or Leu
  Variant (21)..(22): xaa in position 21 to 22 is any amino acid
  Variant (23)..(23): xaa in position 23 is Asp, Glu, Ala or Asn
XXXDRDGTXXXEPXXXXQXDXXXKL

SEQ ID NO: 64150 - protein, 22 aa, Artificial sequence
  Variant (1)..(1): xaa in position 1 is Tyr or Phe
  Variant (2)..(2): xaa in position 2 is any amino acid
  Variant (3)..(3): xaa in position 3 is Phe or Leu
  Variant (4)..(4): xaa in position 4 is Val or Ile
  Variant (5)..(5): xaa in position 5 is Met or Ile
  Variant (6)..(6): xaa in position 6 is Val or Ile
  Variant (7)..(7): xaa in position 7 is Thr or Ser
  Variant (10)..(10): xaa in position 10 is Asp or Asn
  Variant (14)..(14): xaa in position 14 is Thr or Ser
  Variant (15)..(15): xaa in position 15 is any amino acid
  Variant (16)..(16): xaa in position 16 is Ser, Ala, Asn or Leu
  Variant (17)..(17): xaa in position 17 is Phe or Tyr
  Variant (19)..(21): xaa in position 19 to 21 is any amino acid
XXXXXXXNQXGLGXXXXPXXXF

SEQ ID NO: 64151 - protein, 42 aa, Artificial sequence; identical to SEQ ID NO: 23511
  Variant (4)..(6): xaa in position 4 to 6 is any amino acid
  Variant (7)..(7): xaa in position 7 is Leu or Met
  Variant (8)..(8): xaa in position 8 is Val, Ile, Leu or Met
  Variant (9)..(10): xaa in position 9 to 10 is any amino acid
  Variant (11)..(11): xaa in position 11 is Tyr, Trp or Phe
  Variant (12)..(12): xaa in position 12 is Leu or Ile
  Variant (13)..(17): xaa in position 13 to 17 is any amino acid
  Variant (18)..(18): xaa in position 18 is Asp or Asn
  Variant (19)..(21): xaa in position 19 to 21 is any amino acid
  Variant (23)..(23): xaa in position 23 is any amino acid
  Variant (24)..(24): xaa in position 24 is Val or Met
  Variant (25)..(25): xaa in position 25 is Ile or Val
  Variant (29)..(29): xaa in position 29 is any amino acid
  Variant (30)..(30): xaa in position 30 is Thr or Ser
  Variant (32)..(32): xaa in position 32 is Ile, Val, Leu or Met
  Variant (33)..(33): xaa in position 33 is any amino acid
  Variant (34)..(34): xaa in position 34 is Leu or Phe
  Variant (35)..(35): xaa in position 35 is Ala or Gly
  Variant (36)..(36): xaa in position 36 is any amino acid
  Variant (37)..(37): xaa in position 37 is Asn, Ala or Ser
  Variant (38)..(38): xaa in position 38 is Met, Leu or Ile
  Variant (39)..(39): xaa in position 39 is Gly, Ala or Asn
  Variant (40)..(40): xaa in position 40 is Ile, Leu, Val or Cys
  Variant (41)..(41): xaa in position 41 is any amino acid
  Variant (42)..(42): xaa in position 42 is Gly, Ala or Ser

SEQ ID NO: 64152 - protein, 45 aa, Artificial sequence; identical to SEQ ID NO: 23512
  Variant (2)..(2): xaa in position 2 is any amino acid
  Variant (3)..(3): xaa in position 3 is Ala or Arg
  Variant (4)..(4): xaa in position 4 is any amino acid
  Variant (5)..(5): xaa in position 5 is Val, Ile or Tyr
  Variant (6)..(6): xaa in position 6 is any amino acid
  Variant (8)..(8): xaa in position 8 is any amino acid
  Variant (10)..(10): xaa in position 10 is Lys, Asn or Arg
  Variant (13)..(13): xaa in position 13 is any amino acid
  Variant (14)..(14): xaa in position 14 is Ile or Val
  Variant (15)..(15): xaa in position 15 is any amino acid
  Variant (16)..(16): xaa in position 16 is Val or Ile
  Variant (17)..(17): xaa in position 17 is any amino acid
  Variant (18)..(18): xaa in position 18 is Val, Leu or Ile
  Variant (19)..(19): xaa in position 19 is any amino acid
  Variant (21)..(21): xaa in position 21 is Asp or Asn
  Variant (22)..(26): xaa in position 22 to 26 is any amino acid
  Variant (27)..(27): xaa in position 27 is any or no amino acid
  Variant (28)..(28): xaa in position 28 is Ile or Thr
  Variant (29)..(29): xaa in position 29 is any amino acid
  Variant (32)..(32): xaa in position 32 is Leu, Val or Ile
  Variant (33)..(33): xaa in position 33 is any amino acid
  Variant (34)..(34): xaa in position 34 is Phe or Met
  Variant (36)..(36): xaa in position 36 is Asp or Asn
  Variant (40)..(40): xaa in position 40 is Asp or Glu
  Variant (42)..(42): xaa in position 42 is Ile or Leu
  Variant (43)..(43): xaa in position 43 is Ala, Gly or Ser
  Variant (44)..(44): xaa in position 44 is any amino acid

SEQ ID NO: 64153 - protein, 61 aa, Artificial sequence; identical to SEQ ID NO: 23513
  Variant (3)..(3): xaa in position 3 is Leu or Ile
  Variant (4)..(4): xaa in position 4 is any amino acid
  Variant (5)..(5): xaa in position 5 is Ile or Val
  Variant (7)..(7): xaa in position 7 is Asp or Glu
  Variant (10)..(10): xaa in position 10 is Thr or Ser
  Variant (11)..(11): xaa in position 11 is Val or Ile
  Variant (14)..(14): xaa in position 14 is Thr or Val
  Variant (15)..(15): xaa in position 15 is Ala or Gly
  Variant (16)..(16): xaa in position 16 is Leu or Ile
  Variant (17)..(17): xaa in position 17 is Ala, Val or Ser
  Variant (18)..(18): xaa in position 18 is Leu or Ile
  Variant (19)..(19): xaa in position 19 is Gly or Arg
  Variant (20)..(20): xaa in position 20 is any amino acid
  Variant (21)..(21): xaa in position 21 is Ala or Cys
  Variant (22)..(22): xaa in position 22 is Leu, Ile or Val
  Variant (23)..(24): xaa in position 23 to 24 is any amino acid
  Variant (26)..(26): xaa in position 26 is Leu, Ile or Val
  Variant (27)..(27): xaa in position 27 is Gly, Asn or Arg
  Variant (28)..(28): xaa in position 28 is Asp, Asn or Ser
  Variant (30)..(30): xaa in position 30 is any amino acid
  Variant (32)..(32): xaa in position 32 is Ile or Leu
  Variant (33)..(33): xaa in position 33 is any amino acid
  Variant (35)..(35): xaa in position 35 is Phe or Tyr
  Variant (36)..(53): xaa in position 36 to 53 is any or no amino acid
  Variant (55)..(55): xaa in position 55 is Phe or Tyr
  Variant (56)..(56): xaa in position 56 is any amino acid
  Variant (61)..(61): xaa in position 61 is Glu or Asp

SEQ ID NO: 64154 - protein, 68 aa, Artificial sequence; identical to SEQ ID NO: 23514
  Variant (1)..(1): xaa in position 1 is Val, Ile or Leu
  Variant (3)..(3): xaa in position 3 is any amino acid
  Variant (4)..(4): xaa in position 4 is Leu, Met or Phe
  Variant (5)..(5): xaa in position 5 is any amino acid
  Variant (6)..(6): xaa in position 6 is Thr or Ser
  Variant (7)..(7): xaa in position 7 is Glu, His or Asp
  Variant (8)..(8): xaa in position 8 is Met or Leu
  Variant (9)..(10): xaa in position 9 to 10 is any amino acid
  Variant (14)..(14): xaa in position 14 is any amino acid
  Variant (16)..(16): xaa in position 16 is Leu, Ile, Val or Phe
  Variant (17)..(22): xaa in position 17 to 22 is any amino acid
  Variant (23)..(23): xaa in position 23 is Thr, Asn or Ser
  Variant (25)..(25): xaa in position 25 is His or Asn
  Variant (26)..(26): xaa in position 26 is Leu, Ile or Val
  Variant (27)..(29): xaa in position 27 to 29 is any amino acid
  Variant (31)..(31): xaa in position 31 is any amino acid
  Variant (33)..(33): xaa in position 33 is Asp, Glu or Ala
  Variant (36)..(37): xaa in position 36 to 37 is any amino acid
  Variant (39)..(39): xaa in position 39 is Ser, Gly or Ala
  Variant (40)..(40): xaa in position 40 is Leu, Cys or Ile
  Variant (43)..(43): xaa in position 43 is Ala, Val or Ser
  Variant (44)..(44): xaa in position 44 is Phe or Leu
  Variant (45)..(45): xaa in position 45 is Gly or Ala
  Variant (46)..(46): xaa in position 46 is Arg or Lys
  Variant (47)..(47): xaa in position 47 is Thr, Ala or Ser
  Variant (48)..(48): xaa in position 48 is Leu or Val
  Variant (49)..(49): xaa in position 49 is Arg, Lys or Asn
  Variant (50)..(50): xaa in position 50 is Gln, Met or Lys
  Variant (51)..(51): xaa in position 51 is Ala or Cys
  Variant (52)..(52): xaa in position 52 is Ile, Leu or Val
  Variant (53)..(53): xaa in position 53 is any amino acid
  Variant (54)..(55): xaa in position 54 to 55 is any or no amino acid
  Variant (56)..(56): xaa in position 56 is Val, Ile or Arg
  Variant (57)..(57): xaa in position 57 is any amino acid
  Variant (58)..(58): xaa in position 58 is Gly, His or Ser
  Variant (59)..(60): xaa in position 59 to 60 is any amino acid
  Variant (61)..(61): xaa in position 61 is Leu, Met or Ile
  Variant (62)..(62): xaa in position 62 is Pro or Ala
  Variant (63)..(64): xaa in position 63 to 64 is Ser or Thr
  Variant (67)..(67): xaa in position 67 is any amino acid
  Variant (68)..(68): xaa in position 68 is Leu or Ile

SEQ ID NO: 64155 - DNA, 1575 bp, Escherichia coli K12; identical to SEQ ID NO: 10324
  CDS (244)..(1575)

SEQ ID NO: 64156 - protein, 443 aa, Escherichia coli K12; identical to SEQ ID NO: 10325

SEQ ID NO: 64157 - DNA, 1326 bp, Yersinia pestis; identical to SEQ ID NO: 10326
  CDS (1)..(1326)

SEQ ID NO: 64158 - protein, 441 aa, Yersinia pestis; identical to SEQ ID NO: 10327

SEQ ID NO: 64159 - DNA, 1332 bp, Salmonella enterica subsp. enterica serovar Typhi; identical to SEQ ID NO: 10328
  CDS (1)..(1332)

SEQ ID NO: 64160 - protein, 443 aa, Salmonella enterica subsp. enterica serovar Typhi; identical to SEQ ID NO: 10329

SEQ ID NO: 64161 - DNA, 1311 bp, Neisseria meningitidis; identical to SEQ ID NO: 10330
  CDS (1)..(1311)

SEQ ID NO: 64162 - protein, 436 aa, Neisseria meningitidis; identical to SEQ ID NO: 10331

SEQ ID NO: 64163 - DNA, 1863 bp, Arabidopsis thaliana (mouse-ear cress); identical to SEQ ID NO: 10332
  CDS (1)..(1863)

SEQ ID NO: 64164 - protein, 620 aa, Arabidopsis thaliana (mouse-ear cress); identical to SEQ ID NO: 10333

SEQ ID NO: 64165 - DNA, 1371 bp, Vibrio cholerae; identical to SEQ ID NO: 10334
  CDS (1)..(1371)

SEQ ID NO: 64166 - protein, 456 aa, Vibrio cholerae; identical to SEQ ID NO: 10335

SEQ ID NO: 64167 - DNA, 1299 bp, Pseudomonas aeruginosa; identical to SEQ ID NO: 10336
  CDS (1)..(1299)

SEQ ID NO: 64168 - protein, 432 aa, Pseudomonas aeruginosa; identical to SEQ ID NO: 10337

SEQ ID NO: 64169 - DNA, 1259 bp, Pseudomonas aeruginosa; identical to SEQ ID NO: 10338
  CDS (45)..(1238)

SEQ ID NO: 64170 - protein, 397 aa, Pseudomonas aeruginosa; identical to SEQ ID NO: 10339

SEQ ID NO: 64171 - DNA, 1716 bp, Arabidopsis thaliana (mouse-ear cress); identical to SEQ ID NO: 10340
  CDS (1)..(1716)

SEQ ID NO: 64172 - protein, 571 aa, Arabidopsis thaliana (mouse-ear cress); identical to SEQ ID NO: 10341

SEQ ID NO: 64173 - DNA, 1326 bp, Erwinia carotovora; identical to SEQ ID NO: 10342
  CDS (1)..(1326)

SEQ ID NO: 64174 - protein, 441 aa, Erwinia carotovora; identical to SEQ ID NO: 10343

SEQ ID NO: 64175 - DNA, 1356 bp, Acinetobacter sp; identical to SEQ ID NO: 10344
  CDS (1)..(1356)

SEQ ID NO: 64176 - protein, 451 aa, Acinetobacter sp; identical to SEQ ID NO: 10345

SEQ ID NO: 64177 - DNA, 1326 bp, Photobacterium profundum; identical to SEQ ID NO: 10346
  CDS (1)..(1326)

SEQ ID NO: 64178 - protein, 441 aa, Photobacterium profundum; identical to SEQ ID NO: 10347

SEQ ID NO: 64179 - DNA, 1872 bp, Oryza sativa; identical to SEQ ID NO: 10348
  CDS (1)..(1731)

SEQ ID NO: 64180 - protein, 576 aa, Oryza sativa; identical to SEQ ID NO: 10349

SEQ ID NO: 64181 - DNA, 1308 bp, Chromobacterium violaceum; identical to SEQ ID NO: 10350
  CDS (1)..(1308)

SEQ ID NO: 64182 - protein, 435 aa, Chromobacterium violaceum; identical to SEQ ID NO: 10351

SEQ ID NO: 64183 - DNA, 1404 bp, Bordetella parapertussis; identical to SEQ ID NO: 10352
  CDS (1)..(1404)

SEQ ID NO: 64184 - protein, 467 aa, Bordetella parapertussis; identical to SEQ ID NO: 10353

SEQ ID NO: 64185 - DNA, 1335 bp, Nitrosomonas europaea; identical to SEQ ID NO: 10354
  CDS (1)..(1335)

SEQ ID NO: 64186 - protein, 444 aa, Nitrosomonas europaea; identical to SEQ ID NO: 10355

SEQ ID NO: 64187 - DNA, 2075 bp, Arabidopsis thaliana; identical to SEQ ID NO: 10356
  CDS (120)..(1949)

SEQ ID NO: 64188 - protein, 609 aa, Arabidopsis thaliana; identical to SEQ ID NO: 10357

SEQ ID NO: 64189 - DNA, 1728 bp, Oryza sativa; identical to SEQ ID NO: 10358
  CDS (1)..(1728)

SEQ ID NO: 64190 - protein, 575 aa, Oryza sativa; identical to SEQ ID NO: 10359

SEQ ID NO: 64191 - DNA, 1329 bp, Buchnera aphidicola; identical to SEQ ID NO: 10360
  CDS (1)..(1329)

SEQ ID NO: 64192 - protein, 442 aa, Buchnera aphidicola; identical to SEQ ID NO: 10361

SEQ ID NO: 64193 - DNA, 1314 bp, Haemophilus ducreyi; identical to SEQ ID NO: 10362
  CDS (1)..(1314)

SEQ ID NO: 64194 - protein, 437 aa, Haemophilus ducreyi; identical to SEQ ID NO: 10363

SEQ ID NO: 64195 - DNA, 1323 bp, Pasteurella multocida; identical to SEQ ID NO: 10364
  CDS (1)..(1323)

SEQ ID NO: 64196 - protein, 440 aa, Pasteurella multocida; identical to SEQ ID NO: 10365

SEQ ID NO: 64197 - DNA, 1347 bp, Photorhabdus luminescens; identical to SEQ ID NO: 10366
  CDS (1)..(1347)

SEQ ID NO: 64198 - protein, 448 aa, Photorhabdus luminescens; identical to SEQ ID NO: 10367

SEQ ID NO: 64199 - DNA, 1299 bp, Pseudomonas putida; identical to SEQ ID NO: 10368
  CDS (1)..(1299)

SEQ ID NO: 64200 - protein, 432 aa, Pseudomonas putida; identical to SEQ ID NO: 10369

SEQ ID NO: 64201 - DNA, 1299 bp, Pseudomonas syringae; identical to SEQ ID NO: 10370
  CDS (1)..(1299)

SEQ ID NO: 64202 - protein, 432 aa, Pseudomonas syringae; identical to SEQ ID NO: 10371

SEQ ID NO: 64203 - DNA, 1356 bp, Ralstonia solanacearum; identical to SEQ ID NO: 10372
  CDS (1)..(1356)

SEQ ID NO: 64204 - protein, 451 aa, Ralstonia solanacearum; identical to SEQ ID NO: 10373

SEQ ID NO: 64205 - DNA, 1338 bp, Shewanella oneidensis; identical to SEQ ID NO: 10374
  CDS (1)..(1338)

SEQ ID NO: 64206 - protein, 445 aa, Shewanella oneidensis; identical to SEQ ID NO: 10375

SEQ ID NO: 64207 - DNA, 1338 bp, Vibrio parahaemolyticus; identical to SEQ ID NO: 10376
  CDS (1)..(1338)

SEQ ID NO: 64208 - protein, 445 aa, Vibrio parahaemolyticus; identical to SEQ ID NO: 10377

SEQ ID NO: 64209 - DNA, 25 bp, Artificial sequence
  (1)..(25): primer
atggtaaaggaacgtaaaaccgagt

SEQ ID NO: 64210 - DNA, 24 bp, Artificial sequence
  (1)..(24): primer
ttaccctaaatccgccatcaacac

SEQ ID NO: 64211 - protein, 528 aa, Artificial sequence; identical to SEQ ID NO: 13504
  Variant (2)..(3): xaa in position 2 to 3 is any amino acid
  Variant (6)..(8): xaa in position 6 to 8 is any amino acid
  Variant (11)..(13): xaa in position 11 to 13 is any amino acid
  Variant (16)..(17): xaa in position 16 to 17 is any amino acid
  Variant (21)..(24): xaa in position 21 to 24 is any amino acid
  Variant (26)..(42): xaa in position 26 to 42 is any amino acid
  Variant (44)..(45): xaa in position 44 to 45 is any amino acid
  Variant (49)..(49): xaa in position 49 is any amino acid
  Variant (52)..(54): xaa in position 52 to 54 is any amino acid
  Variant (56)..(56): xaa in position 56 is any amino acid
  Variant (58)..(58): xaa in position 58 is any amino acid
  Variant (60)..(60): xaa in position 60 is any amino acid
  Variant (62)..(62): xaa in position 62 is any amino acid
  Variant (65)..(67): xaa in position 65 to 67 is any amino acid
  Variant (69)..(76): xaa in position 69 to 76 is any amino acid
  Variant (78)..(81): xaa in position 78 to 81 is any amino acid
  Variant (83)..(83): xaa in position 83 is any amino acid
  Variant (86)..(88): xaa in position 86 to 88 is any amino acid
  Variant (90)..(94): xaa in position 90 to 94 is any amino acid
  Variant (96)..(96): xaa in position 96 is any amino acid
  Variant (98)..(102): xaa in position 98 to 102 is any amino acid
  Variant (104)..(104): xaa in position 104 is any amino acid
  Variant (106)..(106): xaa in position 106 is any amino acid
  Variant (109)..(114): xaa in position 109 to 114 is any amino acid
  Variant (115)..(123): xaa in position 115 to 123 is any or no amino acid
  Variant (125)..(131): xaa in position 125 to 131 is any amino acid
  Variant (133)..(133): xaa in position 133 is any amino acid
  Variant (138)..(139): xaa in position 138 to 139 is any amino acid
  Variant (141)..(141): xaa in position 141 is any amino acid
  Variant (143)..(143): xaa in position 143 is any amino acid
  Variant (146)..(147): xaa in position 146 to 147 is any amino acid
  Variant (149)..(149): xaa in position 149 is any amino acid
  Variant (151)..(154): xaa in position 151 to 154 is any amino acid
  Variant (156)..(157): xaa in position 156 to 157 is any amino acid
  Variant (159)..(159): xaa in position 159 is any amino acid
  Variant (162)..(164): xaa in position 162 to 164 is any amino acid
  Variant (166)..(168): xaa in position 166 to 168 is any amino acid
  Variant (170)..(173): xaa in position 170 to 173 is any amino acid
  Variant (177)..(178): xaa in position 177 to 178 is any amino acid
  Variant (180)..(182): xaa in position 180 to 182 is any amino acid
  Variant (184)..(184): xaa in position 184 is any amino acid
  Variant (188)..(188): xaa in position 188 is any amino acid
  Variant (192)..(193): xaa in position 192 to 193 is any amino acid
  Variant (195)..(196): xaa in position 195 to 196 is any amino acid
  Variant (199)..(200): xaa in position 199 to 200 is any amino acid
  Variant (202)..(203): xaa in position 202 to 203 is any amino acid
  Variant (205)..(205): xaa in position 205 is any amino acid
  Variant (207)..(207): xaa in position 207 is any amino acid
  Variant (209)..(209): xaa in position 209 is any amino acid
  Variant (211)..(216): xaa in position 211 to 216 is any amino acid
  Variant (218)..(222): xaa in position 218 to 222 is any amino acid
  Variant (224)..(228): xaa in position 224 to 228 is any amino acid
  Variant (230)..(248): xaa in position 230 to 248 is any amino acid
  Variant (249)..(330): xaa in position 249 to 330 is any or no amino acid
  Variant (332)..(333): xaa in position 332 to 333 is any amino acid
  Variant (335)..(336): xaa in position 335 to 336 is any amino acid
  Variant (339)..(340): xaa in position 339 to 340 is any amino acid
  Variant (343)..(343): xaa in position 343 is any amino acid
  Variant (345)..(345): xaa in position 345 is any amino acid
  Variant (347)..(352): xaa in position 347 to 352 is any amino acid
  Variant (355)..(355): xaa in position 355 is any amino acid
  Variant (358)..(358): xaa in position 358 is any amino acid
  Variant (362)..(364): xaa in position 362 to 364 is any amino acid
  Variant (366)..(366): xaa in position 366 is any amino acid
  Variant (369)..(376): xaa in position 369 to 376 is any amino acid
  Variant (378)..(379): xaa in position 378 to 379 is any amino acid
  Variant (381)..(381): xaa in position 381 is any amino acid
  Variant (383)..(385): xaa in position 383 to 385 is any amino acid
  Variant (387)..(388): xaa in position 387 to 388 is any amino acid
  Variant (390)..(392): xaa in position 390 to 392 is any amino acid
  Variant (395)..(395): xaa in position 395 is any amino acid
  Variant (399)..(400): xaa in position 399 to 400 is any amino acid
  Variant (402)..(402): xaa in position 402 is any amino acid
  Variant (405)..(405): xaa in position 405 is any amino acid
  Variant (407)..(407): xaa in position 407 is any amino acid
  Variant (410)..(410): xaa in position 410 is any amino acid
  Variant (413)..(417): xaa in position 413 to 417 is any amino acid
  Variant (419)..(421): xaa in position 419 to 421 is any amino acid
  Variant (423)..(423): xaa in position 423 is any amino acid
  Variant (425)..(427): xaa in position 425 to 427 is any amino acid
  Variant (429)..(429): xaa in position 429 is any amino acid
  Variant (434)..(434): xaa in position 434 is any amino acid
  Variant (436)..(442): xaa in position 436 to 442 is any amino acid
  Variant (443)..(446): xaa in position 443 to 446 is any or no amino acid
  Variant (448)..(448): xaa in position 448 is any amino acid
  Variant (451)..(451): xaa in position 451 is any amino acid
  Variant (454)..(454): xaa in position 454 is any amino acid
  Variant (456)..(457): xaa in position 456 to 457 is any amino acid
  Variant (459)..(462): xaa in position 459 to 462 is any amino acid
  Variant (464)..(465): xaa in position 464 to 465 is any amino acid
  Variant (468)..(473): xaa in position 468 to 473 is any amino acid
  Variant (475)..(477): xaa in position 475 to 477 is any amino acid
  Variant (479)..(481): xaa in position 479 to 481 is any amino acid
  Variant (484)..(484): xaa in position 484 is any amino acid
  Variant (488)..(491): xaa in position 488 to 491 is any amino acid
  Variant (494)..(496): xaa in position 494 to 496 is any amino acid
  Variant (499)..(505): xaa in position 499 to 505 is any amino acid
  Variant (508)..(513): xaa in position 508 to 513 is any amino acid
  Variant (516)..(518): xaa in position 516 to 518 is any amino acid
  Variant (520)..(520): xaa in position 520 is any amino acid
  Variant (522)..(527): xaa in position 522 to 527 is any amino acid

SEQ ID NO: 64212 - protein, 108 aa, Artificial sequence; identical to SEQ ID NO: 13500
  Variant (1)..(1): xaa in position 1 is Val or Ile
  Variant (2)..(3): xaa in position 2 to 3 is any amino acid
  Variant (4)..(4): xaa in position 4 is Phe or Leu
  Variant (6)..(6): xaa in position 6 is any amino acid
  Variant (7)..(7): xaa in position 7 is Ser, Ala or Val
  Variant (8)..(8): xaa in position 8 is any amino acid
  Variant (10)..(10): xaa in position 10 is Tyr or His
  Variant (11)..(11): xaa in position 11 is Ile, Val or Leu
  Variant (12)..(14): xaa in position 12 to 14 is any amino acid
  Variant (15)..(15): xaa in position 15 is Arg, His or Ser
  Variant (16)..(17): xaa in position 16 to 17 is any amino acid
  Variant (18)..(18): xaa in position 18 is Thr, Lys or Val
  Variant (19)..(19): xaa in position 19 is any amino acid
  Variant (21)..(21): xaa in position 21 is Ile, Leu, Val or Ala
  Variant (22)..(24): xaa in position 22 to 24 is any amino acid
  Variant (25)..(25): xaa in position 25 is Gly, Ala, Ser or Asp
  Variant (26)..(26): xaa in position 26 is Glu, Asp, Arg or Asn
  Variant (27)..(27): xaa in position 27 is any amino acid
  Variant (28)..(28): xaa in position 28 is Ile, Val or Leu
  Variant (29)..(38): xaa in position 29 to 38 is any amino acid
  Variant (39)..(42): xaa in position 39 to 42 is any or no amino acid
  Variant (44)..(44): xaa in position 44 is Ile, Leu, Val or Phe
  Variant (45)..(45): xaa in position 45 is any amino acid
  Variant (46)..(46): xaa in position 46 is Leu or Phe
  Variant (47)..(47): xaa in position 47 is Leu or Met
  Variant (48)..(49): xaa in position 48 to 49 is any amino acid
  Variant (50)..(50): xaa in position 50 is Leu or Met
  Variant (52)..(52): xaa in position 52 is Ile, Val, Leu, Met or Ala
  Variant (53)..(54): xaa in position 53 to 54 is any amino acid
  Variant (55)..(55): xaa in position 55 is Val or Ile
  Variant (56)..(56): xaa in position 56 is Leu, Val or Ile
  Variant (57)..(57): xaa in position 57 is Val or Ile
  Variant (58)..(58): xaa in position 58 is any amino acid
  Variant (60)..(62): xaa in position 60 to 62 is any amino acid
  Variant (63)..(63): xaa in position 63 is Gln or Phe
  Variant (64)..(64): xaa in position 64 is Ile, Val or Leu
  Variant (65)..(67): xaa in position 65 to 67 is any amino acid
  Variant (68)..(68): xaa in position 68 is Leu or Ala
  Variant (69)..(75): xaa in position 69 to 75 is any amino acid
  Variant (76)..(76): xaa in position 76 is any or no amino acid
  Variant (77)..(77): xaa in position 77 is Tyr, Phe or Ile
  Variant (78)..(81): xaa in position 78 to 81 is any amino acid
  Variant (82)..(82): xaa in position 82 is Arg or Ala
  Variant (83)..(83): xaa in position 83 is Val, Ile or Pro
  Variant (85)..(85): xaa in position 85 is Asp or Thr
  Variant (86)..(88): xaa in position 86 to 88 is any amino acid
  Variant (89)..(89): xaa in position 89 is Leu or Met
  Variant (90)..(91): xaa in position 90 to 91 is any amino acid
  Variant (92)..(92): xaa in position 92 is Val, Ala or Ile
  Variant (93)..(94): xaa in position 93 to 94 is any amino acid
  Variant (95)..(95): xaa in position 95 is Ala, Ser, Val or Phe
  Variant (96)..(96): xaa in position 96 is Ala, Val or Ser
  Variant (98)..(102): xaa in position 98 to 102 is any amino acid
  Variant (103)..(103): xaa in position 103 is Ile, Phe or Val
  Variant (104)..(104): xaa in position 104 is any amino acid
  Variant (105)..(105): xaa in position 105 is Ala or Ser
  Variant (106)..(106): xaa in position 106 is any amino acid
  Variant (107)..(107): xaa in position 107 is Leu or Phe
  Variant (108)..(108): xaa in position 108 is Ser or Cys

SEQ ID NO: 64213 - protein, 79 aa, Artificial sequence; identical to SEQ ID NO: 13501
  Variant (1)..(1): xaa in position 1 is Val or Leu
  Variant (2)..(2): xaa in position 2 is any amino acid
  Variant (3)..(3): xaa in position 3 is Ser, Thr or Gly
  Variant (4)..(4): xaa in position 4 is Gly or Ser
  Variant (6)..(8): xaa in position 6 to 8 is any amino acid
  Variant (9)..(9): xaa in position 9 is Ala or Ser
  Variant (10)..(10): xaa in position 10 is Gln, Arg or Lys
  Variant (11)..(11): xaa in position 11 is Pro or Arg
  Variant (12)..(12): xaa in position 12 is any amino acid
  Variant (14)..(14): xaa in position 14 is Val or Ile
  Variant (15)..(16): xaa in position 15 to 16 is any amino acid
  Variant (18)..(18): xaa in position 18 is Val, Ile or Thr
  Variant (20)..(22): xaa in position 20 to 22 is any amino acid
  Variant (23)..(23): xaa in position 23 is Thr, Ser or Ala
  Variant (25)..(25): xaa in position 25 is any amino acid
  Variant (26)..(26): xaa in position 26 is Val or Ile
  Variant (27)..(27): xaa in position 27 is Arg or Lys
  Variant (28)..(28): xaa in position 28 is Arg, Lys or Ala
  Variant (29)..(29): xaa in position 29 is Ile, Val or Thr
  Variant (30)..(30): xaa in position 30 is Asp or Asn
  Variant (31)..(33): xaa in position 31 to 33 is any amino acid
  Variant (34)..(34): xaa in position 34 is Ile, Leu or Val
  Variant (35)..(37): xaa in position 35 to 37 is any amino acid
  Variant (38)..(38): xaa in position 38 is Leu or Ile
  Variant (39)..(42): xaa in position 39 to 42 is any amino acid
  Variant (43)..(43): xaa in position 43 is Ile, Val or Leu
  Variant (45)..(45): xaa in position 45 is Leu, Val or Trp
  Variant (46)..(46): xaa in position 46 is Leu, Ile, Val or Met
  Variant (47)..(47): xaa in position 47 is any amino acid
  Variant (48)..(48): xaa in position 48 is Pro or Asn
  Variant (49)..(49): xaa in position 49 is any amino acid
  Variant (50)..(50): xaa in position 50 is Gly or Ala
  Variant (51)..(51): xaa in position 51 is any amino acid
  Variant (53)..(53): xaa in position 53 is any amino acid
  Variant (54)..(54): xaa in position 54 is Thr or Ser
  Variant (56)..(57): xaa in position 56 to 57 is any amino acid
  Variant (58)..(58): xaa in position 58 is Phe or Leu
  Variant (59)..(59): xaa in position 59 is Asn or Tyr
  Variant (60)..(60): xaa in position 60 is Leu or Cys
  Variant (61)..(61): xaa in position 61 is any amino acid
  Variant (62)..(62): xaa in position 62 is any or no amino acid
  Variant (63)..(63): xaa in position 63 is Glu, Tyr or Leu
  Variant (64)..(64): xaa in position 64 is Glu, Asp, Asn or Gln
  Variant (65)..(65): xaa in position 65 is any amino acid
  Variant (67)..(69): xaa in position 67 to 69 is any amino acid
  Variant (70)..(70): xaa in position 70 is Ala or Ser
  Variant (71)..(72): xaa in position 71 to 72 is any amino acid
  Variant (73)..(73): xaa in position 73 is Leu or Ile
  Variant (74)..(74): xaa in position 74 is any amino acid
  Variant (75)..(75): xaa in position 75 is Ala or Val
  Variant (76)..(76): xaa in position 76 is Asp or Glu
  Variant (78)..(78): xaa in position 78 is Leu or Met
  Variant (79)..(79): xaa in position 79 is Ile, Leu or Val

SEQ ID NO: 64214 - protein, 103 aa, Artificial sequence; identical to SEQ ID NO: 13502
  Variant (1)..(1): xaa in position 1 is Leu or Ile
  Variant (2)..(6): xaa in position 2 to 6 is any amino acid
  Variant (7)..(7): xaa in position 7 is Ala or Val
  Variant (8)..(10): xaa in position 8 to 10 is any amino acid
  Variant (12)..(12): xaa in position 12 is Val or Ile
  Variant (13)..(13): xaa in position 13 is any amino acid
  Variant (15)..(15): xaa in position 15 is any amino acid
  Variant (16)..(16): xaa in position 16 is His or Gln
  Variant (17)..(17): xaa in position 17 is Leu or Ile
  Variant (18)..(18): xaa in position 18 is Ile, Val or Leu
  Variant (19)..(23): xaa in position 19 to 23 is any amino acid
  Variant (25)..(25): xaa in position 25 is Ala, Ser or Val
  Variant (26)..(26): xaa in position 26 is Leu, Ile or Val
  Variant (27)..(27): xaa in position 27 is Leu or Ile
  Variant (28)..(28): xaa in position 28 is any amino acid
  Variant (30)..(30): xaa in position 30 is Leu, His or Ile
  Variant (32)..(34): xaa in position 32 to 34 is any amino acid
  Variant (36)..(36): xaa in position 36 is any amino acid
  Variant (38)..(38): xaa in position 38 is Thr or Ser
  Variant (39)..(39): xaa in position 39 is any amino acid
  Variant (40)..(40): xaa in position 40 is Ile, Val, Leu or Met
  Variant (41)..(47): xaa in position 41 to 47 is any amino acid
  Variant (48)..(49): xaa in position 48 to 49 is any or no amino acid
  Variant (51)..(51): xaa in position 51 is any amino acid
  Variant (53)..(55): xaa in position 53 to 55 is any amino acid
  Variant (57)..(57): xaa in position 57 is Ile, Val or Leu
  Variant (58)..(59): xaa in position 58 to 59 is any amino acid
  Variant (60)..(60): xaa in position 60 is Ile or Leu
  Variant (61)..(62): xaa in position 61 to 62 is any amino acid
  Variant (63)..(63): xaa in position 63 is Leu or Ile
  Variant (64)..(64): xaa in position 64 is Ile or Leu
  Variant (65)..(65): xaa in position 65 is any amino acid
  Variant (69)..(70): xaa in position 69 to 70 is any amino acid
  Variant (72)..(72): xaa in position 72 is any amino acid
  Variant (74)..(74): xaa in position 74 is Val or Leu
  Variant (75)..(75): xaa in position 75 is any amino acid
  Variant (77)..(77): xaa in position 77 is any amino acid
  Variant (78)..(78): xaa in position 78 is Arg or Asp
  Variant (79)..(80): xaa in position 79 to 80 is any amino acid
  Variant (81)..(81): xaa in position 81 is Leu or Ile
  Variant (82)..(82): xaa in position 82 is Glu or Leu
  Variant (83)..(84): xaa in position 83 to 84 is any amino acid
  Variant (85)..(85): xaa in position 85 is Ile, Leu or Val
  Variant (86)..(87): xaa in position 86 to 87 is any amino acid
  Variant (88)..(88): xaa in position 88 is Phe or Tyr
  Variant (89)..(89): xaa in position 89 is any amino acid
  Variant (90)..(91): xaa in position 90 to 91 is Ile, Val or Leu
  Variant (92)..(92): xaa in position 92 is any amino acid
  Variant (93)..(93): xaa in position 93 is Arg, His or Lys
  Variant (94)..(94): xaa in position 94 is Asp or Glu
  Variant (95)..(95): xaa in position 95 is Gly or Asn
  Variant (96)..(98): xaa in position 96 to 98 is any amino acid
  Variant (99)..(99): xaa in position 99 is Ala or Gly
  Variant (101)..(101): xaa in position 101 is Ala, Ser or Val
  Variant (103)..(103): xaa in position 103 is Leu or Met

SEQ ID NO: 64215 - protein, 76 aa, Artificial sequence; identical to SEQ ID NO: 13503
  Variant (1)..(1): xaa in position 1 is Gly, Ala or Cys
  Variant (3)..(3): xaa in position 3 is Met, Leu, Val, Ile or Phe
  Variant (5)..(5): xaa in position 5 is Cys or Ala
  Variant (6)..(6): xaa in position 6 is Val, Leu or Ile
  Variant (7)..(7): xaa in position 7 is any amino acid
  Variant (8)..(8): xaa in position 8 is Val or Ile
  Variant (9)..(12): xaa in position 9 to 12 is any amino acid
  Variant (13)..(13): xaa in position 13 is Arg or Gln
  Variant (14)..(17): xaa in position 14 to 17 is any amino acid
  Variant (19)..(20): xaa in position 19 to 20 is any amino acid
  Variant (21)..(22): xaa in position 21 to 22 is Leu or Ile
  Variant (23)..(28): xaa in position 23 to 28 is any amino acid
  Variant (29)..(29): xaa in position 29 is Ala or Ser
  Variant (30)..(32): xaa in position 30 to 32 is any amino acid
  Variant (33)..(33): xaa in position 33 is Gly, Asn or Arg
  Variant (34)..(36): xaa in position 34 to 36 is any amino acid
  Variant (37)..(37): xaa in position 37 is Leu, Ile or Val
  Variant (39)..(39): xaa in position 39 is Val, Ala or Leu
  Variant (41)..(41): xaa in position 41 is Thr or Ser
  Variant (43)..(43): xaa in position 43 is any amino acid
  Variant (44)..(44): xaa in position 44 is Thr or Ser
  Variant (45)..(46): xaa in position 45 to 46 is any amino acid
  Variant (49)..(49): xaa in position 49 is any amino acid
  Variant (50)..(50): xaa in position 50 is any or no amino acid
  Variant (51)..(51): xaa in position 51 is Arg, Gln or His
  Variant (54)..(60): xaa in position 54 to 60 is any amino acid
  Variant (61)..(61): xaa in position 61 is Leu or Ile
  Variant (63)..(64): xaa in position 63 to 64 is any amino acid
  Variant (65)..(65): xaa in position 65 is Lys or Arg
  Variant (66)..(68): xaa in position 66 to 68 is any amino acid
  Variant (69)..(69): xaa in position 69 is Tyr or Ile
  Variant (70)..(72): xaa in position 70 to 72 is any amino acid
  Variant (73)..(73): xaa in position 73 is any or no amino acid
  Variant (75)..(75): xaa in position 75 is any amino acid
  Variant (76)..(76): xaa in position 76 is Ser or Ala

SEQ ID NO: 64216 - DNA, 1434 bp, Escherichia coli K12; identical to SEQ ID NO: 4679
  CDS (1)..(1434)

SEQ ID NO: 64217 - protein, 477 aa, Escherichia coli K12 [sequence omitted]

SEQ ID NO: 64218 - DNA, 1314 bp, Pyrococcus abyssi; identical to SEQ ID NO: 4681
  CDS (1)..(1314)

SEQ ID NO: 64219 - protein, 437 aa, Pyrococcus abyssi; identical to SEQ ID NO: 4682

SEQ ID NO: 64220 - DNA, 1425 bp, Chlamydia muridarum, Chlamydia trachomatis MoPn; identical to SEQ ID NO: 4683
  CDS (1)..(1425)

SEQ ID NO: 64221 - protein, 474 aa, Chlamydia muridarum, Chlamydia trachomatis MoPn; identical to SEQ ID NO: 4684

SEQ ID NO: 64222 - DNA, 1434 bp, Clostridium acetobutylicum; identical to SEQ ID NO: 4685
  CDS (1)..(1434)

SEQ ID NO: 64223 - protein, 477 aa, Clostridium acetobutylicum; identical to SEQ ID NO: 4686

SEQ ID NO: 64224 - DNA, 1431 bp, Yersinia pestis; identical to SEQ ID NO: 4687
  CDS (1)..(1431)

SEQ ID NO: 64225 - protein, 476 aa, Yersinia pestis; identical to SEQ ID NO: 4688

SEQ ID NO: 64226 - DNA, 1443 bp, Agrobacterium tumefaciens; identical to SEQ ID NO: 4689
  CDS (1)..(1443)

SEQ ID NO: 64227 - protein, 480 aa, Agrobacterium tumefaciens; identical to SEQ ID NO: 4690

SEQ ID NO: 64228 - DNA, 1479 bp, Nostoc sp. PCC 7120; identical to SEQ ID NO: 4691
  CDS (1)..(1479)

SEQ ID NO: 64229 - protein, 492 aa, Nostoc sp. PCC 7120; identical to SEQ ID NO: 4692

SEQ ID NO: 64230 - DNA, 1419 bp, Nostoc sp. PCC 7120; identical to SEQ ID NO: 4693
  CDS (1)..(1419)

SEQ ID NO: 64231 - protein, 472 aa, Nostoc sp. PCC 7120; identical to SEQ ID NO: 4694

SEQ ID NO: 64232 - DNA, 1431 bp, Haemophilus influenzae; identical to SEQ ID NO: 4695
  CDS (1)..(1431)

SEQ ID NO: 64233 - protein, 476 aa, Haemophilus influenzae; identical to SEQ ID NO: 4696

SEQ ID NO: 64234 - DNA, 1392 bp, Aquifex aeolicus; identical to SEQ ID NO: 4697
  CDS (1)..(1392)

SEQ ID NO: 64235 - protein, 463 aa, Aquifex aeolicus; identical to SEQ ID NO: 4698

SEQ ID NO: 64236 - DNA, 1371 bp, Pyrococcus horikoshii; identical to SEQ ID NO: 4699
  CDS (1)..(1371)

SEQ ID NO: 64237 - protein, 456 aa, Pyrococcus horikoshii; identical to SEQ ID NO: 4700

SEQ ID NO: 64238 - DNA, 1431 bp, Chlamydophila pneumoniae, Chlamydia pneumoniae; identical to SEQ ID NO: 4701
  CDS (1)..(1431)

SEQ ID NO: 64239 - protein, 476 aa, Chlamydophila pneumoniae, Chlamydia pneumoniae; identical to SEQ ID NO: 4702

SEQ ID NO: 64240 - DNA, 1452 bp, Lactococcus lactis subsp. lactis; identical to SEQ ID NO: 4703
  CDS (1)..(1452)

SEQ ID NO: 64241 - protein, 483 aa, Lactococcus lactis subsp. lactis; identical to SEQ ID NO: 4704

SEQ ID NO: 64242 - DNA, 1461 bp, Sinorhizobium meliloti; identical to SEQ ID NO: 4705
  CDS (1)..(1461)

SEQ ID NO: 64243 - protein, 486 aa, Sinorhizobium meliloti; identical to SEQ ID NO: 4706

SEQ ID NO: 64244 - DNA, 1425 bp, Chlamydia trachomatis; identical to SEQ ID NO: 4707
  CDS (1)..(1425)

SEQ ID NO: 64245 - protein, 474 aa, Chlamydia trachomatis; identical to SEQ ID NO: 4708

SEQ ID NO: 64246 - DNA, 1701 bp, Sulfolobus solfataricus; identical to SEQ ID NO: 4709
  CDS (1)..(1701)

SEQ ID NO: 64247 - protein, 566 aa, Sulfolobus solfataricus; identical to SEQ ID NO: 4710

SEQ ID NO: 64248 - DNA, 1566 bp, Methanococcus jannaschii; identical to SEQ ID NO: 4711
  CDS (1)..(1566)

SEQ ID NO: 64249 - protein, 521 aa, Methanococcus jannaschii; identical to SEQ ID NO: 4712

SEQ ID NO: 64250 - DNA, 1431 bp, Bacillus halodurans; identical to SEQ ID NO: 4713
  CDS (1)..(1431)

SEQ ID NO: 64251 - protein, 476 aa, Bacillus halodurans; identical to SEQ ID NO: 4714

SEQ ID NO: 64252 - DNA, 1455 bp, Vibrio cholerae; identical to SEQ ID NO: 4715
  CDS (1)..(1455)

SEQ ID NO: 64253 - protein, 484 aa, Vibrio cholerae; identical to SEQ ID NO: 4716

SEQ ID NO: 64254 - DNA, 1833 bp, Arabidopsis thaliana (mouse-ear cress); identical to SEQ ID NO: 4717
  CDS (1)..(1833)

SEQ ID NO: 64255 - protein, 610 aa, Arabidopsis thaliana (mouse-ear cress); identical to SEQ ID NO: 4718

SEQ ID NO: 64256 - DNA, 1461 bp, Thermotoga maritima; identical to SEQ ID NO: 4719
  CDS (1)..(1461)

SEQ ID NO: 64257 - protein, 486 aa, Thermotoga maritima; identical to SEQ ID NO: 4720

SEQ ID NO: 64258 - DNA, 1542 bp, Pseudomonas aeruginosa; identical to SEQ ID NO: 4721
  CDS (1)..(1542)

SEQ ID NO: 64259 - protein, 513 aa, Pseudomonas aeruginosa; identical to SEQ ID NO: 4722

SEQ ID NO: 64260 - DNA, 3078 bp, Arabidopsis thaliana (mouse-ear cress); identical to SEQ ID NO: 4723
  CDS (1)..(3078)

SEQ ID NO: 64261 - protein, 1025 aa, Arabidopsis thaliana (mouse-ear cress); identical to SEQ ID NO: 4724

SEQ ID NO: 64262 - DNA, 1434 bp, Streptococcus pneumoniae; identical to SEQ ID NO: 4725
  CDS (1)..(1434)

SEQ ID NO: 64263 - protein, 477 aa, Streptococcus pneumoniae; identical to SEQ ID NO: 4726

SEQ ID NO: 64264 - DNA, 2533 bp, Oryza sativa (rice); identical to SEQ ID NO: 4727
  CDS (114)..(1994)

SEQ ID NO: 64265 - protein, 626 aa, Oryza sativa (rice); identical to SEQ ID NO: 4728

SEQ ID NO: 64266 - DNA, 1818 bp, Zea mays (maize); identical to SEQ ID NO: 4729
  CDS (1)..(1818)

SEQ ID NO: 64267 - protein, 605 aa, Zea mays (maize); identical to SEQ ID NO: 4730

SEQ ID NO: 64268 - DNA, 1455 bp, Bacillus subtilis; identical to SEQ ID NO: 4731
  CDS (1)..(1455)

SEQ ID NO: 64269 - protein, 484 aa, Bacillus subtilis; identical to SEQ ID NO: 4732

SEQ ID NO: 64270 - DNA, 2168 bp, Manihot esculenta (cassava); identical to SEQ ID NO: 4733
  CDS (75)..(1901)

SEQ ID NO: 64271 - protein, 608 aa, Manihot esculenta (cassava); identical to SEQ ID NO: 4734

SEQ ID NO: 64272 - DNA, 2035 bp, Pisum sativum (garden pea); identical to SEQ ID NO: 4735
  CDS (82)..(1893)

SEQ ID NO: 64273 - protein, 603 aa, Pisum sativum (garden pea); identical to SEQ ID NO: 4736

SEQ ID NO: 64274 - DNA, 1476 bp, Synechocystis sp; identical to SEQ ID NO: 4737
  CDS (1)..(1476)

SEQ ID NO: 64275 - protein, 491 aa, Synechocystis sp; identical to SEQ ID NO: 4738

SEQ ID NO: 64276 - DNA, 1434 bp, Synechocystis sp; identical to SEQ ID NO: 4739
  CDS (1)..(1434)

SEQ ID NO: 64277 - protein, 477 aa, Synechocystis sp; identical to SEQ ID NO: 4740

SEQ ID NO: 64278 - DNA, 2868 bp, Zea mays (maize); identical to SEQ ID NO: 4741
  CDS (670)..(2868)

SEQ ID NO: 64279 - protein, 732 aa, Zea mays (maize); identical to SEQ ID NO: 4742

SEQ ID NO: 64280 - DNA, 2480 bp, Zea mays (maize); identical to SEQ ID NO: 4743
  CDS (58)..(2154)

SEQ ID NO: 64281 - protein, 698 aa, Zea mays (maize); identical to SEQ ID NO: 4744

SEQ ID NO: 64282 - DNA, 6027 bp, Zea mays (maize); identical to SEQ ID NO: 4745
  CDS (120)..(5144)

SEQ ID NO: 64283 - protein, 1674 aa, Zea mays (maize); identical to SEQ ID NO: 4746

SEQ ID NO: 64284 - DNA, 2991 bp, Zea mays (maize); identical to SEQ ID NO: 4747
  CDS (602)..(2470): n means a or g or c or t/u, s means g or c

SEQ ID NO: 64285 - protein, 622 aa, Zea mays (maize); identical to SEQ ID NO: 4748

SEQ ID NO: 64286 - DNA, 2360 bp, Solanum tuberosum (potato); identical to SEQ ID NO: 4749
  CDS (68)..(1993)

SEQ ID NO: 64287 - protein, 641 aa, Solanum tuberosum (potato); identical to SEQ ID NO: 4750

SEQ ID NO: 64288 - DNA, 2124 bp, Ipomoea batatas (sweet potato); identical to SEQ ID NO: 4751
  CDS (23)..(1849)

SEQ ID NO: 64289 - protein, 608 aa, Ipomoea batatas (sweet potato); identical to SEQ ID NO: 4752

SEQ ID NO: 64290 - DNA, 2287 bp, Sorghum bicolor (sorghum); identical to SEQ ID NO: 4753
  CDS (207)..(2033)

SEQ ID NO: 64291 - protein, 608 aa, Sorghum bicolor (sorghum); identical to SEQ ID NO: 4754

SEQ ID NO: 64292 - DNA, 4110 bp, Schizosaccharomyces pombe; identical to SEQ ID NO: 4755
  CDS (1)..(4110)

SEQ ID NO: 64293 - protein, 1369 aa, Schizosaccharomyces pombe; identical to SEQ ID NO: 4756

SEQ ID NO: 64294 - DNA, 1812 bp, Hordeum vulgare (barley); identical to SEQ ID NO: 4757
  CDS (1)..(1812)

SEQ ID NO: 64295 - protein, 603 aa, Hordeum vulgare (barley); identical to SEQ ID NO: 4758

SEQ ID NO: 64296 - DNA, 2161 bp, Solanum tuberosum (potato); identical to SEQ ID NO: 4759
  CDS (37)..(1860)

SEQ ID NO: 64297 - protein, 607 aa, Solanum tuberosum (potato); identical to SEQ ID NO: 4760

SEQ ID NO: 64298 - DNA, 2825 bp, Triticum aestivum; identical to SEQ ID NO: 4761
  CDS (162)..(2561)

SEQ ID NO: 64299 - protein, 799 aa, Triticum aestivum; identical to SEQ ID NO: 4762

SEQ ID NO: 64300 - DNA, 2771 bp, Triticum aestivum; identical to SEQ ID NO: 4763
  CDS (280)..(2550)

SEQ ID NO: 64301 - protein, 756 aa, Triticum aestivum; identical to SEQ ID NO: 4764

SEQ ID NO: 64302 - DNA, 4121 bp, Zea mays; identical to SEQ ID NO: 4765
  CDS (442)..(3954)

SEQ ID NO: 64303 - protein, 1170 aa, Zea mays; identical to SEQ ID NO: 4766

SEQ ID NO: 64304 - DNA, 3240 bp, Chlamydomonas reinhardtii; identical to SEQ ID NO: 4767
  CDS (138)..(2264)

SEQ ID NO: 64305 - protein, 708 aa, Chlamydomonas reinhardtii; identical to SEQ ID NO: 4768

SEQ ID NO: 64306 - DNA, 3049 bp, Chlamydomonas reinhardtii; identical to SEQ ID NO: 4769
  CDS (190)..(1920)

SEQ ID NO: 64307 - protein, 576 aa, Chlamydomonas reinhardtii; identical to SEQ ID NO: 4770

SEQ ID NO: 64308 - DNA, 2716 bp, Chlamydomonas reinhardtii; identical to SEQ ID NO: 4771
  CDS (93)..(2048)

SEQ ID NO: 64309 - protein, 651 aa, Chlamydomonas reinhardtii; identical to SEQ ID NO: 4772

SEQ ID NO: 64310 - DNA, 2325 bp, Ipomoea batatas; identical to SEQ ID NO: 4773
  CDS (155)..(2047)

SEQ ID NO: 64311 - protein, 630 aa, Ipomoea batatas; identical to SEQ ID NO: 4774

SEQ ID NO: 64312 - DNA, 1440 bp, Erwinia carotovora subsp; identical to SEQ ID NO: 4775
  CDS (1)..(1440)

SEQ ID NO: 64313 - protein, 479 aa, Erwinia carotovora subsp; identical to SEQ ID NO: 4776

SEQ ID NO: 64314 - DNA, 1497 bp, Bacillus thuringiensis serovar konkukian str; identical to SEQ ID NO: 4777
  CDS (1)..(1497)

SEQ ID NO: 64315 - protein, 498 aa, Bacillus thuringiensis serovar konkukian str; identical to SEQ ID NO: 4778

SEQ ID NO: 64316 - DNA, 1431 bp, Mycoplasma mobile; identical to SEQ ID NO: 4779
  CDS (1)..(1431): transl-table=4

SEQ ID NO: 64317 - protein, 476 aa, Mycoplasma mobile; identical to SEQ ID NO: 4780

SEQ ID NO: 64318 - DNA, 1815 bp, Hordeum bulbosum; identical to SEQ ID NO: 4781
  CDS (1)..(1815)

SEQ ID NO: 64319 - protein, 604 aa, Hordeum bulbosum; identical to SEQ ID NO: 4782

SEQ ID NO: 64320 - DNA, 1527 bp, Photobacterium profundum; identical to SEQ ID NO: 4783
  CDS (1)..(1527)

SEQ ID NO: 64321 - protein, 508 aa, Photobacterium profundum; identical to SEQ ID NO: 4784

SEQ ID NO: 64322 - DNA, 1569 bp, Methanococcus maripaludis; identical to SEQ ID NO: 4785
  CDS (1)..(1569)

SEQ ID NO: 64323 - protein, 522 aa, Methanococcus maripaludis; identical to SEQ ID NO: 4786

SEQ ID NO: 64324 - DNA, 1503 bp, Parachlamydia sp; identical to SEQ ID NO: 4787
  CDS (1)..(1503)

SEQ ID NO: 64325 - protein, 500 aa, Parachlamydia sp; identical to SEQ ID NO: 4788

SEQ ID NO: 64326 - DNA, 1452 bp, Rhodopseudomonas palustris; identical to SEQ ID NO: 4789
  CDS (1)..(1452)

SEQ ID NO: 64327 - protein, 483 aa, Rhodopseudomonas palustris; identical to SEQ ID NO: 4790

SEQ ID NO: 64328 - DNA, 1173 bp, Corynebacterium diphtheriae; identical to SEQ ID NO: 4791
  CDS (1)..(1173)

SEQ ID NO: 64329 - protein, 390 aa, Corynebacterium diphtheriae; identical to SEQ ID NO: 4792

SEQ ID NO: 64330 - DNA, 1578 bp, Ostreococcus tauri; identical to SEQ ID NO: 4793
  CDS (1)..(1578)

SEQ ID NO: 64331 - protein, 525 aa, Ostreococcus tauri; identical to SEQ ID NO: 4794

SEQ ID NO: 64332 - DNA, 1725 bp, Ostreococcus tauri; identical to SEQ ID NO: 4795
  CDS (1)..(1725)

SEQ ID NO: 64333 - protein, 574 aa, Ostreococcus tauri; identical to SEQ ID NO: 4796

SEQ ID NO: 64334 - DNA, 2022 bp, Ostreococcus tauri; identical to SEQ ID NO: 4797
  CDS (1)..(2022)

SEQ ID NO: 64335 - protein, 673 aa, Ostreococcus tauri; identical to SEQ ID NO: 4798

SEQ ID NO: 64336 - DNA, 2939 bp, Colocasia esculenta; identical to SEQ ID NO: 4799
  CDS (220)..(2634)

SEQ ID NO: 64337 - protein, 804 aa, Colocasia esculenta; identical to SEQ ID NO: 4800

SEQ ID NO: 64338 - DNA, 1554 bp, Thermoproteus tenax; identical to SEQ ID NO: 4801
  CDS (1)..(1554)

SEQ ID NO: 64339 - protein, 517 aa, Thermoproteus tenax; identical to SEQ ID NO: 4802

SEQ ID NO: 64340 - DNA, 1470 bp, Desulfovibrio vulgaris; identical to SEQ ID NO: 4803
  CDS (1)..(1470)

SEQ ID NO: 64341 - protein, 489 aa, Desulfovibrio vulgaris; identical to SEQ ID NO: 4804

SEQ ID NO: 64342 - DNA, 1323 bp, Thermus thermophilus; identical to SEQ ID NO: 4805
  CDS (1)..(1323)

SEQ ID NO: 64343 - protein, 440 aa, Thermus thermophilus; identical to SEQ ID NO: 4806

SEQ ID NO: 64344 - DNA, 1431 bp, Bacillus cereus; identical to SEQ ID NO: 4807
  CDS (1)..(1431)

SEQ ID NO: 64345 - protein, 476 aa, Bacillus cereus; identical to SEQ ID NO: 4808

SEQ ID NO: 64346 - DNA, 1476 bp, Treponema denticola; identical to SEQ ID NO: 4809
  CDS (1)..(1476)

SEQ ID NO: 64347 - protein, 491 aa, Treponema denticola; identical to SEQ ID NO: 4810

SEQ ID NO: 64348 - DNA, 1173 bp, Mycobacterium paratuberculosis; identical to SEQ ID NO: 4811
  CDS (1)..(1173)

SEQ ID NO: 64349 - protein, 390 aa, Mycobacterium paratuberculosis; identical to SEQ ID NO: 4812

SEQ ID NO: 64350 - DNA, 2486 bp, Phaseolus vulgaris; identical to SEQ ID NO: 4813
  CDS (39)..(2255)

SEQ ID NO: 64351 - protein, 738 aa, Phaseolus vulgaris; identical to SEQ ID NO: 4814

SEQ ID NO: 64352 - DNA, 2570 bp, Phaseolus vulgaris; identical to SEQ ID NO: 4815
  CDS (135)..(2309)

SEQ ID NO: 64353 - protein, 724 aa, Phaseolus vulgaris; identical to SEQ ID NO: 4816

SEQ ID NO: 64354 - DNA, 2444 bp, Phaseolus vulgaris; identical to SEQ ID NO: 4817
  CDS (78)..(2015)

SEQ ID NO: 64355 - protein, 645 aa, Phaseolus vulgaris; identical to SEQ ID NO: 4818

SEQ ID NO: 64356 - DNA, 1827 bp, Hordeum spontaneum; identical to SEQ ID NO: 4819
  CDS (1)..(1827)

SEQ ID NO: 64357 - protein, 608 aa, Hordeum spontaneum; identical to SEQ ID NO: 4820

SEQ ID NO: 64358 - DNA, 1248 bp, Gloeobacter violaceus; identical to SEQ ID NO: 4821
  CDS (1)..(1248)

SEQ ID NO: 64359 - protein, 415 aa, Gloeobacter violaceus; identical to SEQ ID NO: 4822

SEQ ID NO: 64360 - DNA, 3219 bp, Oryza sativa; identical to SEQ ID NO: 4823
  CDS (1)..(3219)

SEQ ID NO: 64361 - protein, 1072 aa, Oryza sativa; identical to SEQ ID NO: 4824

SEQ ID NO: 64362 - DNA, 2547 bp, Oryza sativa; identical to SEQ ID NO: 4825
  CDS (97)..(2022)

SEQ ID NO: 64363 - protein, 641 aa, Oryza sativa; identical to SEQ ID NO: 4826

SEQ ID NO: 64364 - DNA, 1242 bp, Streptomyces avermitilis; identical to SEQ ID NO: 4827
  CDS (1)..(1242)

SEQ ID NO: 64365 - protein, 413 aa, Streptomyces avermitilis; identical to SEQ ID NO: 4828

SEQ ID NO: 64366 - DNA, 2208 bp, Phaseolus vulgaris; identical to SEQ ID NO: 4829
  CDS (144)..(1991)

SEQ ID NO: 64367 - protein, 615 aa, Phaseolus vulgaris; identical to SEQ ID NO: 4830

SEQ ID NO: 64368 - DNA, 2748 bp, Oryza sativa; identical to SEQ ID NO: 4831
  CDS (1)..(2748)

SEQ ID NO: 64369 - protein, 915 aa, Oryza sativa; identical to SEQ ID NO: 4832

SEQ ID NO: 64370 - DNA, 1605 bp, Shewanella oneidensis; identical to SEQ ID NO: 4833
  CDS (1)..(1605)

SEQ ID NO: 64371 - protein, 534 aa, Shewanella oneidensis; identical to SEQ ID NO: 4834

SEQ ID NO: 64372 - DNA, 1173 bp, Corynebacterium efficiens; identical to SEQ ID NO: 4835
  CDS (1)..(1173)

SEQ ID NO: 64373 - protein, 390 aa, Corynebacterium efficiens; identical to SEQ ID NO: 4836

SEQ ID NO: 64374 - DNA, 2340 bp, Colocasia esculenta; identical to SEQ ID NO: 4837
  CDS (155)..(2086)

SEQ ID NO: 64375 - protein, 643 aa, Colocasia esculenta; identical to SEQ ID NO: 4838

SEQ ID NO: 64376 - DNA, 2409 bp, Hordeum vulgare; identical to SEQ ID NO: 4839
  CDS (1)..(2409)

SEQ ID NO: 64377 - protein, 802 aa, Hordeum vulgare; identical to SEQ ID NO: 4840

SEQ ID NO: 64378 - DNA, 2115 bp, Setaria italica; identical to SEQ ID NO: 4841
  CDS (142)..(1959)

SEQ ID NO: 64379 - protein, 605 aa, Setaria italica; identical to SEQ ID NO: 4842

SEQ ID NO: 64380 - DNA, 2081 bp, Triticum aestivum; identical to SEQ ID NO: 4843
  CDS (1)..(1800)

SEQ ID NO: 64381 - protein, 599 aa, Triticum aestivum; identical to SEQ ID NO: 4844

SEQ ID NO: 64382 - DNA, 1230 bp, Corynebacterium glutamicum; identical to SEQ ID NO: 4845
  CDS (1)..(1230)

SEQ ID NO: 64383 - protein, 409 aa, Corynebacterium glutamicum; identical to SEQ ID NO: 4846

SEQ ID NO: 64384 - DNA, 1356 bp, Pyrococcus furiosus; identical to SEQ ID NO: 4847
  CDS (1)..(1356)

SEQ ID NO: 64385 - protein, 451 aa, Pyrococcus furiosus; identical to SEQ ID NO: 4848

SEQ ID NO: 64386 - DNA, 2112 bp, Oryza sativa; identical to SEQ ID NO: 4849
  CDS (61)..(1887)

SEQ ID NO: 64387 - protein, 608 aa, Oryza sativa; identical to SEQ ID NO: 4850

SEQ ID NO: 64388 - DNA, 2496 bp, Oryza sativa; identical to SEQ ID NO: 4851
  CDS (1)..(2496)

SEQ ID NO: 64389 - protein, 831 aa, Oryza sativa; identical to SEQ ID NO: 4852

SEQ ID NO: 64390 - DNA, 1443 bp, Rhizobium loti; identical to SEQ ID NO: 4853
  CDS (1)..(1443)

SEQ ID NO: 64391 - protein, 480 aa, Rhizobium loti; identical to SEQ ID NO: 4854

SEQ ID NO: 64392 - DNA, 2100 bp, Pisum sativum; identical to SEQ ID NO: 4855
  CDS (6)..(1847)

SEQ ID NO: 64393 - protein, 613 aa, Pisum sativum; identical to SEQ ID NO: 4856

SEQ ID NO: 64394 - DNA, 3386 bp, Triticum aestivum; identical to SEQ ID NO: 4857
  CDS (251)..(2995)

SEQ ID NO: 64395 - protein, 914 aa, Triticum aestivum; identical to SEQ ID NO: 4858

SEQ ID NO: 64396 - DNA, 2919 bp, Oryza sativa; identical to SEQ ID NO: 4859
  CDS (165)..(2597)

SEQ ID NO: 64397 - protein, 810 aa, Oryza sativa; identical to SEQ ID NO: 4860

SEQ ID NO: 64398 - DNA, 2394 bp, Oryza sativa; identical to SEQ ID NO: 4861
  CDS (34)..(2118)

SEQ ID NO: 64399 - protein, 694 aa, Oryza sativa; identical to SEQ ID NO: 4862

SEQ ID NO: 64400 - DNA, 2903 bp, Oryza sativa; identical to SEQ ID NO: 4863
  CDS (86)..(2335)

SEQ ID NO: 64401 - protein, 749 aa, Oryza sativa; identical to SEQ ID NO: 4864

SEQ ID NO: 64402 - DNA, 1719 bp, Sulfolobus tokodaii; identical to SEQ ID NO: 4865
  CDS (1)..(1719)

SEQ ID NO: 64403 - protein, 572 aa, Sulfolobus tokodaii; identical to SEQ ID NO: 4866

SEQ ID NO: 64404 - DNA, 2270 bp, Perilla frutescens; identical to SEQ ID NO: 4867
  CDS (172)..(1986)

SEQ ID NO: 64405 - protein, 604 aa, Perilla frutescens; identical to SEQ ID NO: 4868

SEQ ID NO: 64406 - DNA, 1701 bp, Sulfolobus acidocaldarius; identical to SEQ ID NO: 4869
  CDS (1)..(1701)

SEQ ID NO: 64407 - protein, 566 aa, Sulfolobus acidocaldarius; identical to SEQ ID NO: 4870

SEQ ID NO: 64408 - DNA, 2793 bp, Triticum aestivum; identical to SEQ ID NO: 4871
  CDS (135)..(2531)

SEQ ID NO: 64409 - protein, 798 aa, Triticum aestivum; identical to SEQ ID NO: 4872

SEQ ID NO: 64410 - DNA, 5346 bp, Triticum aestivum; identical to SEQ ID NO: 4873
  CDS (29)..(4915)

SEQ ID NO: 64411 - protein, 1628 aa, Triticum aestivum; identical to SEQ ID NO: 4874

SEQ ID NO: 64412 - DNA, 2502 bp, Arabidopsis thaliana; identical to SEQ ID NO: 4875
  CDS (1)..(2379)

SEQ ID NO: 64413 - protein, 792 aa, Arabidopsis thaliana; identical to SEQ ID NO: 4876

SEQ ID NO: 64414 - DNA, 2592 bp, Sorghum bicolor; identical to SEQ ID NO: 4877
  CDS (59)..(1948)

SEQ ID NO: 64415 - protein, 629 aa, Sorghum bicolor; identical to SEQ ID NO: 4878

SEQ ID NO: 64416 - DNA, 1815 bp, Triticum turgidum subsp; identical to SEQ ID NO: 4879
  CDS (1)..(1815)

SEQ ID NO: 64417 - protein, 604 aa, Triticum turgidum subsp; identical to SEQ ID NO: 4880

SEQ ID NO: 64418 - DNA, 2575 bp, Manihot esculenta; identical to SEQ ID NO: 4881
  CDS (50)..(2305)

SEQ ID NO: 64419 - protein, 751 aa, Manihot esculenta; identical to SEQ ID NO: 4882

SEQ ID NO: 64420 - DNA, 2842 bp, Triticum aestivum; identical to SEQ ID NO: 4883
  CDS (89)..(2488)

SEQ ID NO: 64421 - protein, 799 aa, Triticum aestivum; identical to SEQ ID NO: 4884

SEQ ID NO: 64422 - DNA, 1818 bp, Triticum monococcum; identical to SEQ ID NO: 4885
  CDS (1)..(1818)

SEQ ID NO: 64423 - protein, 605 aa, Triticum monococcum; identical to SEQ ID NO: 4886

SEQ ID NO: 64424 - DNA, 2081 bp, Triticum aestivum; identical to SEQ ID NO: 4887
  CDS (120)..(1919)

SEQ ID NO: 64425 - protein, 599 aa, Triticum aestivum; identical to SEQ ID NO: 4888

SEQ ID NO: 64426 - DNA, 2591 bp, Triticum aestivum; identical to SEQ ID NO: 4889
  CDS (256)..(2199)

SEQ ID NO: 64427 - protein, 647 aa, Triticum aestivum; identical to SEQ ID NO: 4890

SEQ ID NO: 64428 - DNA, 1872 bp, Oryza sativa; identical to SEQ ID NO: 4891
  CDS (1)..(1872)

SEQ ID NO: 64429 - protein, 623 aa, Oryza sativa; identical to SEQ ID NO: 4892

SEQ ID NO: 64430 - DNA, 2028 bp, Triticum aestivum; identical to SEQ ID NO: 4893
  CDS (30)..(1754)

SEQ ID NO: 64431 - protein, 574 aa, Triticum aestivum; identical to SEQ ID NO: 4894

SEQ ID NO: 64432 - DNA, 3901 bp, Vigna unguiculata; identical to SEQ ID NO: 4895
  CDS (161)..(3604)

SEQ ID NO: 64433 - protein, 1147 aa, Vigna unguiculata; identical to SEQ ID NO: 4896

SEQ ID NO: 64434 - DNA, 3519 bp, Vigna unguiculata; identical to SEQ ID NO: 4897
  CDS (386)..(3010)

SEQ ID NO: 64435 - protein, 874 aa, Vigna unguiculata; identical to SEQ ID NO: 4898

SEQ ID NO: 64436 - DNA, 2221 bp, Phaseolus vulgaris; identical to SEQ ID NO: 4899
  CDS (30)..(1850)

SEQ ID NO: 64437 - protein, 606 aa, Phaseolus vulgaris; identical to SEQ ID NO: 4900

SEQ ID NO: 64438 - DNA, 2107 bp, Astragalus membranaceus; identical to SEQ ID NO: 4901
  CDS (96)..(1919)

SEQ ID NO: 64439 - protein, 607 aa, Astragalus membranaceus; identical to SEQ ID NO: 4902

SEQ ID NO: 64440 - DNA, 1389 bp, Bradyrhizobium japonicum; identical to SEQ ID NO: 4903
  CDS (1)..(1389)

SEQ ID NO: 64441 - protein, 462 aa, Bradyrhizobium japonicum; identical to SEQ ID NO: 4904

SEQ ID NO: 64442 - DNA, 1530 bp, Agrobacterium tumefaciens; identical to SEQ ID NO: 4905
  CDS (1)..(1530)

SEQ ID NO: 64443 - protein, 509 aa, Agrobacterium tumefaciens; identical to SEQ ID NO: 4906

SEQ ID NO: 64444 - DNA, 1449 bp, Bradyrhizobium japonicum; identical to SEQ ID NO: 4907
  CDS (1)..(1449)

SEQ ID NO: 64445 - protein, 482 aa, Bradyrhizobium japonicum; identical to SEQ ID NO: 4908

SEQ ID NO: 64446 - DNA, 1431 bp, Bacillus cereus; identical to SEQ ID NO: 4909
  CDS (1)..(1431)

SEQ ID NO: 64447 - protein, 476 aa, Bacillus cereus; identical to SEQ ID NO: 4910

SEQ ID NO: 64448 - DNA, 1458 bp, Bacillus stearothermophilus; identical to SEQ ID NO: 4911
  CDS (1)..(1458)

SEQ ID NO: 64449 - protein, 485 aa, Bacillus stearothermophilus; identical to SEQ ID NO: 4912

SEQ ID NO: 64450 - DNA, 1533 bp, Bordetella bronchiseptica; identical to SEQ ID NO: 4913
  CDS (1)..(1533)

SEQ ID NO: 64451 - protein, 510 aa, Bordetella bronchiseptica; identical to SEQ ID NO: 4914

SEQ ID NO: 64452 - DNA, 1428 bp, Chlamydophila caviae; identical to SEQ ID NO: 4915
  CDS (1)..(1428)

SEQ ID NO: 64453 - protein, 475 aa, Chlamydophila caviae; identical to SEQ ID NO: 4916

SEQ ID NO: 64454 - DNA, 1467 bp, Chlorobium tepidum; identical to SEQ ID NO: 4917
  CDS (1)..(1467)

SEQ ID NO: 64455 - protein, 488 aa, Chlorobium tepidum; identical to SEQ ID NO: 4918

SEQ ID NO: 64456 - DNA, 1449 bp, Clostridium perfringens; identical to SEQ ID NO: 4919
  CDS (1)..(1449)

SEQ ID NO: 64457 - protein, 482 aa, Clostridium perfringens; identical to SEQ ID NO: 4920

SEQ ID NO: 64458 - DNA, 1335 bp, Deinococcus radiodurans; identical to SEQ ID NO: 4921
  CDS (1)..(1335)

SEQ ID NO: 64459 - protein, 444 aa, Deinococcus radiodurans; identical to SEQ ID NO: 4922

SEQ ID NO: 64460 - DNA, 1386 bp, Fusobacterium nucleatum; identical to SEQ ID NO: 4923
  CDS (1)..(1386)

SEQ ID NO: 64461 - protein, 461 aa, Fusobacterium nucleatum; identical to SEQ ID NO: 4924

SEQ ID NO: 64462 - DNA, 1377 bp, Gloeobacter violaceus; identical to SEQ ID NO: 4925
  CDS (1)..(1377)

SEQ ID NO: 64463 - protein, 458 aa, Gloeobacter violaceus; identical to SEQ ID NO: 4926

SEQ ID NO: 64464 - DNA, 1440 bp, Lactobacillus plantarum; identical to SEQ ID NO: 4927
  CDS (1)..(1440)

SEQ ID NO: 64465 - protein, 479 aa, Lactobacillus plantarum; identical to SEQ ID NO: 4928

SEQ ID NO: 64466 - DNA, 1488 bp, Nitrosomonas europaea; identical to SEQ ID NO: 4929
  CDS (1)..(1488)

SEQ ID NO: 64467 - protein, 495 aa, Nitrosomonas europaea; identical to SEQ ID NO: 4930

SEQ ID NO: 64468 - DNA, 1434 bp, Oceanobacillus iheyensis; identical to SEQ ID NO: 4931
  CDS (1)..(1434)

SEQ ID NO: 64469 - protein, 477 aa, Oceanobacillus iheyensis; identical to SEQ ID NO: 4932

SEQ ID NO: 64470 - DNA, 1443 bp, Pasteurella multocida; identical to SEQ ID NO: 4933
  CDS (1)..(1443)

SEQ ID NO: 64471 - protein, 480 aa, Pasteurella multocida; identical to SEQ ID NO: 4934

SEQ ID NO: 64472 - DNA, 1506 bp, Prochlorococcus marinus; identical to SEQ ID NO: 4935
  CDS (1)..(1506)

SEQ ID NO: 64473 - protein, 501 aa, Prochlorococcus marinus; identical to SEQ ID NO: 4936

SEQ ID NO: 64474 - DNA, 1500 bp, Prochlorococcus marinus; identical to SEQ ID NO: 4937
  CDS (1)..(1500)

SEQ ID NO: 64475 - protein, 499 aa, Prochlorococcus marinus; identical to SEQ ID NO: 4938

SEQ ID NO: 64476 - DNA, 1452 bp, Prochlorococcus marinus subsp; identical to SEQ ID NO: 4939
  CDS (1)..(1452)

SEQ ID NO: 64477 - protein, 483 aa, Prochlorococcus marinus subsp; identical to SEQ ID NO: 4940

SEQ ID NO: 64478 - DNA, 1560 bp, Pseudomonas putida; identical to SEQ ID NO: 4941
  CDS (1)..(1560)

SEQ ID NO: 64479 - protein, 519 aa, Pseudomonas putida; identical to SEQ ID NO: 4942

SEQ ID NO: 64480 - DNA, 1455 bp, Pseudomonas syringae; identical to SEQ ID NO: 4943
  CDS (1)..(1455)

SEQ ID NO: 64481 - protein, 484 aa, Pseudomonas syringae; identical to SEQ ID NO: 4944

SEQ ID NO: 64482 - DNA, 1626 bp, Ralstonia solanacearum; identical to SEQ ID NO: 4945
  CDS (1)..(1626)

SEQ ID NO: 64483 - protein, 541 aa, Ralstonia solanacearum; identical to SEQ ID NO: 4946

SEQ ID NO: 64484 - DNA, 1446 bp, Rhizobium loti; identical to SEQ ID NO: 4947
  CDS (1)..(1446)

SEQ ID NO: 64485 - protein, 481 aa, Rhizobium loti; identical to SEQ ID NO: 4948

SEQ ID NO: 64486 - DNA, 1443 bp, Rhizobium tropici; identical to SEQ ID NO: 4949
  CDS (1)..(1443)

SEQ ID NO: 64487 - protein, 480 aa, Rhizobium tropici; identical to SEQ ID NO: 4950

SEQ ID NO: 64488 - DNA, 1524 bp, Rhodopirellula baltica; identical to SEQ ID NO: 4951
  CDS (1)..(1524)

SEQ ID NO: 64489 - protein, 507 aa, Rhodopirellula baltica; identical to SEQ ID NO: 4952

SEQ ID NO: 64490 - DNA, 1434 bp, Rhodobacter sphaeroides; identical to SEQ ID NO: 4953
  CDS (1)..(1434)

SEQ ID NO: 64491 - protein, 477 aa, Rhodobacter sphaeroides; identical to SEQ ID NO: 4954

SEQ ID NO: 64492 - DNA, 1434 bp, Salmonella typhimurium; identical to SEQ ID NO: 4955
  CDS (1)..(1434)

SEQ ID NO: 64493 - protein, 477 aa, Salmonella typhimurium; identical to SEQ ID NO: 4956

SEQ ID NO: 64494 - DNA, 1431 bp, Streptococcus mutans; identical to SEQ ID NO: 4957
  CDS (1)..(1431)

SEQ ID NO: 64495 - protein, 476 aa, Streptococcus mutans; identical to SEQ ID NO: 4958

SEQ ID NO: 64496 - DNA, 1425 bp, Synechococcus elongatus; identical to SEQ ID NO: 4959
  CDS (1)..(1425)

SEQ ID NO: 64497 - protein, 474 aa, Synechococcus elongatus; identical to SEQ ID NO: 4960

SEQ ID NO: 64498 - DNA, 1398 bp, Synechococcus sp; identical to SEQ ID NO: 4961
  CDS (1)..(1398)

SEQ ID NO: 64499 - protein, 465 aa, Synechococcus sp; identical to SEQ ID NO: 4962

SEQ ID NO: 64500 - DNA, 1542 bp, Synechococcus sp; identical to SEQ ID NO: 4963
  CDS (1)..(1542)

SEQ ID NO: 64501 - protein, 513 aa, Synechococcus sp; identical to SEQ ID NO: 4964

SEQ ID NO: 64502 - DNA, 1317 bp, Thermus caldophilus; identical to SEQ ID NO: 4965
  CDS (1)..(1317)

SEQ ID NO: 64503 - protein, 438 aa, Thermus caldophilus; identical to SEQ ID NO: 4966

SEQ ID NO: 64504 - DNA, 1458 bp, Vibrio parahaemolyticus; identical to SEQ ID NO: 4967
  CDS (1)..(1458)

SEQ ID NO: 64505 - protein, 485 aa, Vibrio parahaemolyticus; identical to SEQ ID NO: 4968

SEQ ID NO: 64506 - DNA, 1458 bp, Vibrio vulnificus; identical to SEQ ID NO: 4969
  CDS (1)..(1458)

SEQ ID NO: 64507 - protein, 485 aa, Vibrio vulnificus; identical to SEQ ID NO: 4970

SEQ ID NO: 64508 - DNA, 1425 bp, Xanthomonas axonopodis; identical to SEQ ID NO: 4971
  CDS (1)..(1425)

SEQ ID NO: 64509 - protein, 474 aa, Xanthomonas axonopodis; identical to SEQ ID NO: 4972

SEQ ID NO: 64510 - DNA, 1425 bp, Xanthomonas campestris; identical to SEQ ID NO: 4973
  CDS (1)..(1425)

SEQ ID NO: 64511 - protein, 474 aa, Xanthomonas campestris; identical to SEQ ID NO: 4974

SEQ ID NO: 64512 - DNA, 2345 bp, Antirrhinum majus; identical to SEQ ID NO: 4975
  CDS (10)..(1836)

SEQ ID NO: 64513 - protein, 608 aa, Antirrhinum majus; identical to SEQ ID NO: 4976

SEQ ID NO: 64514 - DNA, 2211 bp, Ipomoea batatas; identical to SEQ ID NO: 4977
  CDS (93)..(1919)

SEQ ID NO: 64515 - protein, 608 aa, Ipomoea batatas; identical to SEQ ID NO: 4978

SEQ ID NO: 64516 - DNA, 2988 bp, Pisum sativum; identical to SEQ ID NO: 4979
  CDS (140)..(2398)

SEQ ID NO: 64517 - protein, 752 aa, Pisum sativum; identical to SEQ ID NO: 4980

SEQ ID NO: 64518 - DNA, 2329 bp, Arabidopsis thaliana; identical to SEQ ID NO: 4981
  CDS (67)..(2025)

SEQ ID NO: 64519 - protein, 652 aa, Arabidopsis thaliana; identical to SEQ ID NO: 4982

SEQ ID NO: 64520 - DNA, 4127 bp, Solanum tuberosum; identical to SEQ ID NO: 4983
  CDS (143)..(3835)

SEQ ID NO: 64521 - protein, 1230 aa, Solanum tuberosum; identical to SEQ ID NO: 4984

SEQ ID NO: 64522 - DNA, 25 bp, Artificial sequence
  (1)..(25): primer
atgcaggttttacatgtatgttcag

SEQ ID NO: 64523 - DNA, 26 bp, Artificial sequence
  (1)..(26): primer
ttatttcaagcgatagtaaagctcac

SEQ ID NO: 64524 - protein, 974 aa, Artificial sequence; identical to SEQ ID NO: 32738
  Variant (2)..(2): xaa in position 2 is any amino acid
  Variant (5)..(5): xaa in position 5 is any amino acid
  Variant (10)..(10): xaa in position 10 is any amino acid
  Variant (14)..(14): xaa in position 14 is any amino acid
  Variant (18)..(108): xaa in position 18 to 108 is any or no amino acid
  Variant (119)..(119): xaa in position 119 is any amino acid
  Variant (123)..(124): xaa in position 123 to 124 is any amino acid
  Variant (126)..(151): xaa in position 126 to 151 is any or no amino acid
  Variant (153)..(153): xaa in position 153 is any amino acid
  Variant (155)..(155): xaa in position 155 is any amino acid
  Variant (160)..(160): xaa in position 160 is any amino acid
  Variant (162)..(171): xaa in position 162 to 171 is any amino acid
  Variant (173)..(178): xaa in position 173 to 178 is any amino acid
  Variant (179)..(209): xaa in position 179 to 209 is any or no amino acid
  Variant (211)..(216): xaa in position 211 to 216 is any amino acid
  Variant (217)..(218): xaa in position 217 to 218 is any or no amino acid
  Variant (221)..(223): xaa in position 221 to 223 is any amino acid
  Variant (227)..(227): xaa in position 227 is any amino acid
  Variant (229)..(229): xaa in position 229 is any amino acid
  Variant (231)..(232): xaa in position 231 to 232 is any amino acid
  Variant (234)..(234): xaa in position 234 is any amino acid
  Variant (235)..(262): xaa in position 235 to 262 is any or no amino acid
  Variant (264)..(264): xaa in position 264 is any amino acid
  Variant (266)..(268): xaa in position 266 to 268 is any amino acid
  Variant (272)..(275): xaa in position 272 to 275 is any amino acid
  Variant (279)..(280): xaa in position 279 to 280 is any amino acid
  Variant (281)..(406): xaa in position 281 to 406 is any or no amino acid
  Variant (420)..(420): xaa in position 420 is any amino acid
  Variant (424)..(425): xaa in position 424 to 425 is any or no amino acid
  Variant (427)..(429): xaa in position 427 to 429 is any or no amino acid
  Variant (431)..(442): xaa in position 431 to 442 is any or no amino acid
  Variant (446)..(446): xaa in position 446 is any amino acid
  Variant (456)..(456): xaa in position 456 is any amino acid
  Variant (457)..(464): xaa in position 457 to 464 is any or no amino acid
  Variant (466)..(475): xaa in position 466 to 475 is any or no amino acid
  Variant (477)..(491): xaa in position 477 to 491 is any or no amino acid
  Variant (493)..(514): xaa in position 493 to 514 is any or no amino acid
  Variant (523)..(524): xaa in position 523 to 524 is any or no amino acid
  Variant (529)..(529): xaa in position 529 is any amino acid
  Variant (537)..(537): xaa in position 537 is any amino acid
  Variant (540)..(540): xaa in position 540 is any amino acid
  Variant (542)..(549): xaa in position 542 to 549 is any or no amino acid
  Variant (551)..(551): xaa in position 551 is any or no amino acid
  Variant (553)..(553): xaa in position 553 is any or no amino acid
  Variant (557)..(557): xaa in position 557 is any or no amino acid
  Variant (560)..(560): xaa in position 560 is any amino acid
  Variant (561)..(567): xaa in position 561 to 567 is any or no amino acid
  Variant (569)..(569): xaa in position 569 is any amino acid
  Variant (577)..(578): xaa in position 577 to 578 is any amino acid
  Variant (579)..(579): xaa in position 579 is any or no amino acid
  Variant (583)..(584): xaa in position 583 to 584 is any amino acid
  Variant (586)..(587): xaa in position 586 to 587 is any or no amino acid
  Variant (589)..(607): xaa in position 589 to 607 is any or no amino acid
  Variant (609)..(612): xaa in position 609 to 612 is any or no amino acid
  Variant (614)..(641): xaa in position 614 to 641 is any or no amino acid
  Variant (643)..(645): xaa in position 643 to 645 is any or no amino acid
  Variant (647)..(647): xaa in position 647 is any or no amino acid
  Variant (651)..(652): xaa in position 651 to 652 is any amino acid
  Variant (656)..(656): xaa in position 656 is any amino acid
  Variant (658)..(663): xaa in position 658 to 663 is any or no amino acid
  Variant (668)..(668): xaa in position 668 is any amino acid
  Variant (673)..(674): xaa in position 673 to 674 is any amino acid
  Variant (682)..(683): xaa in position 682 to 683 is any amino acid
  Variant (686)..(687): xaa in position 686 to 687 is any amino acid
  Variant (690)..(692): xaa in position 690 to 692 is any amino acid
  Variant (693)..(704): xaa in position 693 to 704 is any or no amino acid
  Variant (715)..(715): xaa in position 715 is any amino acid
  Variant (716)..(729): xaa in position 716 to 729 is any or no amino acid
  Variant (732)..(733): xaa in position 732 to 733 is any or no amino acid
  Variant (735)..(736): xaa in position 735 to 736 is any amino acid
  Variant (738)..(739): xaa in position 738 to 739 is any amino acid
  Variant (740)..(740): xaa in position 740 is any or no amino acid
  Variant (742)..(743): xaa in position 742 to 743 is any amino acid
  Variant (745)..(748): xaa in position 745 to 748 is any or no amino acid
  Variant (750)..(752): xaa in position 750 to 752 is any or no amino acid
  Variant (754)..(754): xaa in position 754 is any or no amino acid
  Variant (756)..(758): xaa in position 756 to 758 is any amino acid
  Variant (762)..(762): xaa in position 762 is any amino acid
  Variant (764)..(764): xaa in position 764 is any amino acid
  Variant (782)..(844): xaa in position 782 to 844 is any or no amino acid
  Variant (847)..(847): xaa in position 847 is any amino acid
  Variant (858)..(859): xaa in position 858 to 859 is any amino acid
  Variant (864)..(864): xaa in position 864 is any amino acid
  Variant (868)..(868): xaa in position 868 is any amino acid
  Variant (870)..(871): xaa in position 870 to 871 is any amino acid
  Variant (872)..(892): xaa in position 872 to 892 is any or no amino acid
  Variant (894)..(894): xaa in position 894 is any or no amino acid
  Variant (897)..(897): xaa in position 897 is any amino acid
  Variant (900)..(901): xaa in position 900 to 901 is any amino acid
  Variant (903)..(905): xaa in position 903 to 905 is any amino acid
  Variant (907)..(908): xaa in position 907 to 908 is any amino acid
  Variant (911)..(911): xaa in position 911 is any amino acid
  Variant (915)..(916): xaa in position 915 to 916 is any or no amino acid
  Variant (918)..(942): xaa in position 918 to 942 is any or no amino acid
  Variant (944)..(945): xaa in position 944 to 945 is any or no amino acid
  Variant (947)..(952): xaa in position 947 to 952 is any or no amino acid
  Variant (955)..(956): xaa in position 955 to 956 is any amino acid
  Variant (961)..(962): xaa in position 961 to 962 is any amino acid
  Variant (965)..(966): xaa in position 965 to 966 is any amino acid
  Variant (968)..(969): xaa in position 968 to 969 is any amino acid
  Variant (972)..(973): xaa in position 972 to 973 is any amino acid

SEQ ID NO: 64525 - protein, 56 aa, Artificial sequence; identical to SEQ ID NO: 6176
  Variant (1)..(1): xaa in position 1 is Gly or Ala
  Variant (2)..(4): xaa in position 2 to 4 is any amino acid
  Variant (5)..(5): xaa in position 5 is Ala, Ser or Cys
  Variant (6)..(7): xaa in position 6 to 7 is any amino acid
  Variant (8)..(8): xaa in position 8 is Val, Ile, Leu or Ala
  Variant (9)..(9): xaa in position 9 is any amino acid
  Variant (10)..(10): xaa in position 10 is Thr, Ala or Val
  Variant (13)..(14): xaa in position 13 to 14 is any amino acid
  Variant (15)..(15): xaa in position 15 is Tyr, Met or His
  Variant (16)..(16): xaa in position 16 is Ala, Ser, Leu, Lys or Val
  Variant (17)..(17): xaa in position 17 is any amino acid
  Variant (18)..(18): xaa in position 18 is Glu, Gln or Asp
  Variant (19)..(19): xaa in position 19 is Ile, Leu, Val or Glu
  Variant (20)..(28): xaa in position 20 to 28 is any amino acid
  Variant (29)..(43): xaa in position 29 to 43 is any or no amino acid
  Variant (44)..(44): xaa in position 44 is Gly, Val or Tyr
  Variant (45)..(45): xaa in position 45 is Ile or Val
  Variant (46)..(46): xaa in position 46 is any amino acid
  Variant (49)..(49): xaa in position 49 is Ile, Met, Val, Leu or Cys
  Variant (51)..(52): xaa in position 51 to 52 is any amino acid
  Variant (53)..(53): xaa in position 53 is any or no amino acid
  Variant (54)..(54): xaa in position 54 is Trp, Tyr, Phe or Leu
  Variant (55)..(55): xaa in position 55 is any amino acid
  Variant (56)..(56): xaa in position 56 is Pro or Glu

SEQ ID NO: 64526 - protein, 65 aa, Artificial sequence; identical to SEQ ID NO: 6177
  Variant (1)..(1): xaa in position 1 is Lys, Arg or Phe
  Variant (2)..(4): xaa in position 2 to 4 is any amino acid
  Variant (5)..(5): xaa in position 5 is Lys, Arg, Ala or Glu
  Variant (6)..(7): xaa in position 6 to 7 is any amino acid
  Variant (8)..(8): xaa in position 8 is Leu, Val or Ile
  Variant (9)..(11): xaa in position 9 to 11 is any amino acid
  Variant (12)..(12): xaa in position 12 is Leu, Val, Phe, Met or Thr
  Variant (13)..(13): xaa in position 13 is any amino acid
  Variant (14)..(14): xaa in position 14 is Leu, Ile, Phe or Val
  Variant (15)..(19): xaa in position 15 to 19 is any amino acid
  Variant (20)..(22): xaa in position 20 to 22 is any or no amino acid
  Variant (23)..(23): xaa in position 23 is Leu, Val, Ile or Met
  Variant (24)..(24): xaa in position 24 is Ile, Val, Phe, Leu, Tyr or Met
  Variant (25)..(26): xaa in position 25 to 26 is any amino acid
  Variant (27)..(27): xaa in position 27 is Ile or Val
  Variant (28)..(28): xaa in position 28 is Gly, Ser, Thr, Cys or Ala
  Variant (30)..(30): xaa in position 30 is Leu, Ile or Phe
  Variant (31)..(32): xaa in position 31 to 32 is any amino acid
  Variant (33)..(33): xaa in position 33 is any or no amino acid
  Variant (37)..(37): xaa in position 37 is any amino acid
  Variant (38)..(38): xaa in position 38 is Asp, His or Glu
  Variant (39)..(39): xaa in position 39 is any amino acid
  Variant (40)..(40): xaa in position 40 is Ile, Leu, Val, Met, Ala or Thr
  Variant (41)..(54): xaa in position 41 to 54 is any amino acid
  Variant (55)..(59): xaa in position 55 to 59 is any or no amino acid
  Variant (60)..(60): xaa in position 60 is Val, Ile, Ala, Leu or Tyr
  Variant (61)..(61): xaa in position 61 is Leu, Ile, Val, Met or Cys
  Variant (62)..(62): xaa in position 62 is Leu, Val, Ile or Ala
  Variant (64)..(64): xaa in position 64 is any amino acid
  Variant (65)..(65): xaa in position 65 is Gly, Ala, Ser, Pro or Cys

SEQ ID NO: 64527 - protein, 51 aa, Artificial sequence; identical to SEQ ID NO: 6178
  Variant (1)..(1): xaa in position 1 is Phe, Tyr, Leu or His
  Variant (2)..(5): xaa in position 2 to 5 is any amino acid
  Variant (6)..(6): xaa in position 6 is Ala, Ser, Ile or Val
  Variant (7)..(7): xaa in position 7 is His, Arg or Gln
  Variant (8)..(8): xaa in position 8 is any amino acid
  Variant (9)..(9): xaa in position 9 is Ile, Val, Leu, Met or Ala
  Variant (10)..(10): xaa in position 10 is any amino acid
  Variant (11)..(11): xaa in position 11 is Ala, Gly or Thr
  Variant (12)..(12): xaa in position 12 is Gly, Ala or Ser
  Variant (13)..(13): xaa in position 13 is any amino acid
  Variant (15)..(16): xaa in position 15 to 16 is any amino acid
  Variant (17)..(17): xaa in position 17 is Leu, Ile, Val, Ala, Met or Cys
  Variant (18)..(18): xaa in position 18 is Met, Ile, Val, His or Cys
  Variant (19)..(19): xaa in position 19 is Pro or Thr
  Variant (21)..(21): xaa in position 21 is any amino acid
  Variant (22)..(22): xaa in position 22 is Phe or Tyr
  Variant (24)..(24): xaa in position 24 is Pro or Ala
  Variant (25)..(25): xaa in position 25 is Cys, Phe or Leu
  Variant (27)..(27): xaa in position 27 is Leu or Ile
  Variant (28)..(28): xaa in position 28 is any amino acid
  Variant (29)..(29): xaa in position 29 is Gln, Asn or Pro
  Variant (30)..(30): xaa in position 30 is Leu, Met or Ile
  Variant (31)..(31): xaa in position 31 is any amino acid
  Variant (32)..(32): xaa in position 32 is Ala, Gly or Ser
  Variant (33)..(33): xaa in position 33 is Met, Leu or Gln
  Variant (34)..(34): xaa in position 34 is any amino acid
  Variant (35)..(35): xaa in position 35 is Tyr, Phe, Cys or Leu
  Variant (36)..(36): xaa in position 36 is Gly, Ala or Asn
  Variant (37)..(37): xaa in position 37 is Thr, Ser, Ala or Cys
  Variant (38)..(38): xaa in position 38 is Val, Ile, Leu, Pro or Ala
  Variant (39)..(39): xaa in position 39 is Pro, Cys or Val
  Variant (40)..(40): xaa in position 40 is Ile, Val, Leu or Ala
  Variant (41)..(41): xaa in position 41 is Val, Ala or Cys
  Variant (42)..(42): xaa in position 42 is Arg, His, Ala, Ser or Thr
  Variant (43)..(43): xaa in position 43 is any amino acid
  Variant (44)..(44): xaa in position 44 is Thr or Val
  Variant (47)..(47): xaa in position 47 is Leu or Ile
  Variant (48)..(48): xaa in position 48 is any amino acid
  Variant (49)..(49): xaa in position 49 is Asp or Glu
  Variant (50)..(50): xaa in position 50 is Thr, Ser or Val
  Variant (51)..(51): xaa in position 51 is Val or Ile

SEQ ID NO: 64528 - DNA, 834 bp, Escherichia coli
  CDS (1)..(834)
atgctggcgatgccttccgctatctccgtcgctgtattacccgattcaccgcacgccagagagatggcgaccaaagcgcataacagcgggcacgaagtgttgattcatctcccgatggcaccgttgagtaaacagccgctggagaaaaatacgctacgcccggagatgagcagcgacgaaattgagcgcattattcgtagtgcggtcaataacgtgccctatgccgtggggatcaacaaccacatgggcagcaagatgacctctaacctgtttggtatgcagaaagtgatgcaggcgctggagcgttacaatctttacttcctcgacagcgtaaccatcggtaatacccaggcgatgcgcgccgcgcaaggcactggcgtgaaggtgatcaaacggaaggtattcctcgacgattcgcaaaatgaagcggacatccgtgtgcaatttaatcgcgcaattgacctggcgcgtcgcaacggttcgaccattgccattgggcatcctcaccctgcaacggtacgcgtgttgcaacagatggtttataacctgccgccagacattacgctggtgaaagccagcagcttgctgaatgaaccgcaggttgatacttctacaccgccgaaaaacgctgtgcctgatgcaccgcgtaatccgttccgtggcgtgaagctgtgcaaaccgaagaaaccgatagaacctgtttatgctaatcgcttctttgaagtattaagcgaaagcatcagccagagcacgctgatcgtttacttccagcatcagtggcaaggctggggcaaacagcccgaagcggcgaagtttaacgctagcgcaaattaa

SEQ ID NO: 64529 - protein, 277 aa, Escherichia coli
MLAMPSAISVAVLPDSPHAREMATKAHNSGHEVLIHLPMAPLSKQPLEKNTLRPEMSSDEIERIIRSAVNNVPYAVGINNHMGSKMTSNLFGMQKVMQALERYNLYFLDSVTIGNTQAMRAAQGTGVKVIKRKVFLDDSQNEADIRVQFNRAIDLARRNGSTIAIGHPHPATVRVLQQMVYNLPPDITLVKASSLLNEPQVDTSTPPKNAVPDAPRNPFRGVKLCKPKKPIEPVYANRFFEVLSESISQSTLIVYFQHQWQGWGKQPEAAKFNASAN

SEQ ID NO: 64530 - DNA, 882 bp, Borrelia burgdorferi B31
  CDS (1)..(882): transl_table=11
atgtttgtattttatattaaaaaaaacaagtttattattgtaatttttattataatttctattgttattgcaataactcaggcatttgcaagttttttatattttaatgacaattcaaaaattgcaaatgccccacttaaaaataggtttgaaaaaacacaaaaagaaagcttaataataaaaaacaacaacgaggataaaaaagccaaaagcaaacctaagttttacttaatcattgacgacgtgggctatgatgaatttatgttagaacaatttataaaacttaatcttaaaataacttatgctattattccatttttaccaaaatcaatgagtttatacaaaaaactaaaaaatgctaacaaaacagtaataatacatttcccaatgcaatcaaaacatagaaattcaatagaaaaatttcatataaacataaaagataaaaaagaagaaatacacaaaaaaatcgaaaaagcatttaaaaagtatcctgatgcaaaaataatgaataaccatatgggaagtttaatcacttcaaataaagatttgatgaaaatcattttagaaaagcttaaagagattgacagatattttttcgacagcgtaactattgcaggaagcgtaccagaaataataggcaaagaaattggagttaaagtagaaaaaagagacgtatttcttgatagcaaagacacagaagagtccgtaacaaaggagcttgaaaaagcaaaaaatattgctagaaaaaatggaatggtaaaagtaataggacacatttggtctaaaaatacgctaaaagtccttaaaaaagaaggacctgatttaaaccaggaattcgaattcgacaacttattaaatctttacgaggaaacaatcagatga

SEQ ID NO: 64531 - protein, 293 aa, Borrelia burgdorferi B31
MFVFYIKKNKFIIVIFIIISIVIAITQAFASFLYFNDNSKIANAPLKNRFEKTQKESLIIKNNNEDKKAKSKPKFYLIIDDVGYDEFMLEQFIKLNLKITYAIIPFLPKSMSLYKKLKNANKTVIIHFPMQSKHRNSIEKFHINIKDKKEEIHKKIEKAFKKYPDAKIMNNHMGSLITSNKDLMKIILEKLKEIDRYFFDSVTIAGSVPEIIGKEIGVKVEKRDVFLDSKDTEESVTKELEKAKNIARKNGMVKVIGHIWSKNTLKVLKKEGPDLNQEFEFDNLLNLYEETIR

SEQ ID NO: 64532 - DNA, 822 bp, Bacillus halodurans C-125
  CDS (1)..(822): transl_table=11
atgcaaacgtattttaagcttattttccttctttcagcctccctcctctgtcttggtttggcaagtccagatgattcaaataaaggcgagatgaaacgagcagccatcattattgatgattttggcggggatgtaaagggtgttgatgattttttgacaggagagattccagttaccgtagcggttatgccctttcttgaacactcaacaaaacaagcagaaatagcccaagcagccggactggaagtgattgttcatatgcctcttgagccgaaaaaaggcaaaatctcgtggcttgggccaagtggaatcacaagtaatttatccgtgggagaagtgaagagtcgcgtgaggaaagcctttgatgatatcccctacgcagttggcttaaacaatcacatggggtcgaaaatcgttgaaaacgaaaaaatcatgcgagccattctcgaagttgtaaaggaaaaaaatgcattcattatcgatagtgggacaagcccacactcccttattcctcaattggcagaggagctagaggttccttatgcgacgaggagcatctttttagacaatactcactcatctagaaaagaagttataaaaaacatgcgtaagctcgcaaaaaaagcaaaacaaggttccgagccaatcgggattggtcatgtgggggtacgtggggatgagacgtatgctggaatccgttccatgttggacgaatttcaagcagagtcgattcagctcgtccccgtctctcaactactgccaagccctattgaagaagaccacaacaagttttggcaacaaccttttcaagcaaaggagtga

SEQ ID NO: 64533 - protein, 273 aa, Bacillus halodurans C-125
MQTYFKLIFLLSASLLCLGLASPDDSNKGEMKRAAIIIDDFGGDVKGVDDFLTGEIPVTVAVMPFLEHSTKQAEIAQAAGLEVIVHMPLEPKKGKISWLGPSGITSNLSVGEVKSRVRKAFDDIPYAVGLNNHMGSKIVENEKIMRAILEVVKEKNAFIIDSGTSPHSLIPQLAEELEVPYATRSIFLDNTHSSRKEVIKNMRKLAKKAKQGSEPIGIGHVGVRGDETYAGIRSMLDEFQAESIQLVPVSQLLPSPIEEDHNKFWQQPFQAKE

SEQ ID NO: 64534 - DNA, 843 bp, Pasteurella multocida subsp. multocida str. Pm70
  CDS (1)..(843): transl_table=11
atgaaaacaattggcgtcaaaagggtgaaaagtgcgctactttttgggggattttggatcagcatggcgttggcacagcctgccaagttagccattgtgatcgatgatattgggtatcaccagaaagaagacgcacaaatttatgcgctaccaaaagaaatttcggtggcgattatcccgtctgctccacatgctcgccaacgtaatgaacaagcctatcaacaaggtcgtgatattttaatccatatgcccatgcaaccgttaagtcatcagcgcattgaagcgggaggattacatgttggcatgcgccaagaggacgtacaacaacgtgtgcaaactgccaaggcgattgtgtctcatgccattggcatgaataatcacatgggcagtgccgcgactgctgacgcggagttaatgcataaattaatgcaagaactgaaagtgcaagatttgttctttcttgatagccgcaccattggacgcagtgtggcaggcaaaatagccaaagagtacggggtacaaagcctcgatcgccacatttttttggatgacaaagacacttatgcggatgttgaacgtcaatttcaacgtgcagtgcattatgcacaaaagcacggtacggcaatcgcgattggtcatccacgtaaaaatacagtagccgtgttacaagccggattaaaacacttacccgataatgtacagctagtcggcatggggcgtttgtggcgtagtgaaacagagacggcgccgaaaccgcttatttctctctttaatacaatgccagcaccaacatcgaacatgccttatcaggctgtcccaatgttgagaggcataccgcaataa

SEQ ID NO: 64535 - protein, 280 aa, Pasteurella multocida subsp. multocida str. Pm70
MKTIGVKRVKSALLFGGFWISMALAQPAKLAIVIDDIGYHQKEDAQIYALPKEISVAIIPSAPHARQRNEQAYQQGRDILIHMPMQPLSHQRIEAGGLHVGMRQEDVQQRVQTAKAIVSHAIGMNNHMGSAATADAELMHKLMQELKVQDLFFLDSRTIGRSVAGKIAKEYGVQSLDRHIFLDDKDTYADVERQFQRAVHYAQKHGTAIAIGHPRKNTVAVLQAGLKHLPDNVQLVGMGRLWRSETETAPKPLISLFNTMPAPTSNMPYQAVPMLRGIPQ

SEQ ID NO: 64536 - DNA, 774 bp, Pseudomonas aeruginosa PAO1
  CDS (1)..(774): transl_table=11
atgtcggcgttccgcgttgccctgctgggcctgtgcctgctgttcaaccaggcccaggcccgccaggaccccgtcccctaccagcgcccgccgctgctgaccgtggtcatcgatgacctcgggcagaacctggcgcgcgaccgccgggtcctcgacctgccccccggcgtaaccctggcgatcatcccggaaaccccgcatgccgccgaactggcccgcgaggcgcaccagcgcgggcgcacggtgatcctgcacatgccgatggacccagccggcggtccctacgcctggcggccggagctgacccaggaagagcgtgcgcggcggctggacgcggcgctggccaaggtgccgttcgtgcagggcctgaacaaccacgagggcagccgcatgaccgcggtgcgcccggcgatggcctggctcgccgaggaactccagcgtcgcggcctgtacctggtcgacagccgcaccagcgccgccaccgtggccgccagcgaggcgcagcggatcggcctggcgagcgtctcgcgcgatgtgttcctcgacaacgaagccacaccggaagcggtctccgcacaactgcaggccggcgtcgccctggcccgcaagcagggttcggcgttgctcatcggccacccgcacaaggccaccctcgacgtgctggcgcgggagctgccgaagctgcgcgcccagggcatcgagctggtaccgccgcagatgctcatcggcgagcgcggcaaccgcaacgtcaacccacgccaggcgccgcactga

SEQ ID NO: 64537 - protein, 257 aa, Pseudomonas aeruginosa PAO1
MSAFRVALLGLCLLFNQAQARQDPVPYQRPPLLTVVIDDLGQNLARDRRVLDLPPGVTLAIIPETPHAAELAREAHQRGRTVILHMPMDPAGGPYAWRPELTQEERARRLDAALAKVPFVQGLNNHEGSRMTAVRPAMAWLAEELQRRGLYLVDSRTSAATVAASEAQRIGLASVSRDVFLDNEATPEAVSAQLQAGVALARKQGSALLIGHPHKATLDVLARELPKLRAQGIELVPPQMLIGERGNRNVNPRQAPH

SEQ ID NO: 64538 - DNA, 963 bp, Salmonella typhimurium LT2
  CDS (1)..(963): transl_table=11
ttgcctcagtttcgtcgctccattctcacgctggccactttgctggcgtttgcacatcccgttttcgctggcaagctcgccatcgtgattgatgattttggctatcgcccgcacacggaaaaccaggttctggcgctgccgccaaacatctccgtcgctgtactgcccaacgcgccgcacgcgcgcgaaatggcaactaaagcgcacaatagcgggcatgaggtgttaatccatctgccgatggcgccgctaagcaaacagccgctggagaaggatacgctgcgaccagatatgagcagcgatgagatcgagcgcattatccgcgaggcggtaaacaacgtgccgtatgccgtcgggcttaataaccacatgggcagcgcaatgacttccagcctgttcggtatgcaaaaagttatgcaggcgctggaacattacaatctctattttctcgacagcatgacgattggcaatagccaggcgatgcgcgcggcatccggtacgggtgtgaaagtgatcaagcgcaaagtgttcctcgacgatacgcaaaacgaggcggatatccgtcgtcagtttaatcgcgctatcgaactggcccgtcgcaacggttccgctatcgcgattggtcatccacatcccgcaacggttcgcgtgctgcaacagatggtttatcgcctgccggcggatatcaccctggtacgtccaggcagcctgctcaacgaaccgcaggtagatacgtcccgacctggtgtgacgccgcagaaaattgacgcgccgcgcaatcccttccgcggcgtaaagatgtgcaagccgaaaaaaccgctgcaaccggtctacgctacgcgctttttcagcgtcatcggcgagagcattacgcaaagttccgtggttacctggtttcagcaccagtggcaaggctgggggaaaatcgccgcgcctaaaaacgtgagcgctaagacagattga

SEQ ID NO: 64539 - protein, 320 aa, Salmonella typhimurium LT2
MPQFRRSILTLATLLAFAHPVFAGKLAIVIDDFGYRPHTENQVLALPPNISVAVLPNAPHAREMATKAHNSGHEVLIHLPMAPLSKQPLEKDTLRPDMSSDEIERIIREAVNNVPYAVGLNNHMGSAMTSSLFGMQKVMQALEHYNLYFLDSMTIGNSQAMRAASGTGVKVIKRKVFLDDTQNEADIRRQFNRAIELARRNGSAIAIGHPHPATVRVLQQMVYRLPADITLVRPGSLLNEPQVDTSRPGVTPQKIDAPRNPFRGVKMCKPKKPLQPVYATRFFSVIGESITQSSVVTWFQHQWQGWGKIAAPKNVSAKTD

SEQ ID NO: 64540 - DNA, 756 bp, Shewanella oneidensis MR-1
  CDS (1)..(756): transl_table=11
gtgcgtctactttacattttggctctttggactatcagtgttgccccgagcaatgcggctcaaattgccctgatcatcgatgacattggctatcgtcataccgacgaagccgtactttcgttgccgagttctgtcacgctgtcggtattaccgcacacgccactgagcagcaaactggccaaagccgcacacgcaaatggtcacgaaattatgctgcatttacccatgcaggcgctaaatggcaaagccttaggcgttggtggattaaccaataatatgaacgaagcacaaattcgtagcagcgtacttgccgccatggccagtgtacccttcgctaaaggtgccaacaatcatatgggcagcttactcacgcagcttgatgaccccatgctctgggtgatggaaacgctcaaacagaagcagttctattttgtcgacagcatgacgactaaatttaccaaggcgggagatagggcagatcaactcggtgtgccactacttcgacgtcagctatttctcgacaatgatgtcagcactcaagcactagaaagacaatttaacttgatgataagtcaggctcacgcacaaggcagtttagtggccatcgcgcatccttaccccgaaaccattcacttcttaaaagccaacttagcacgcctgaaggcggaagggattgagctagtaccgacatcacgcttgttgcccatcaaactagcccatgaaaaaggggctaatctaactgtaagacagaaatag

SEQ ID NO: 64541 - protein, 251 aa, Shewanella oneidensis MR-1
MRLLYILALWTISVAPSNAAQIALIIDDIGYRHTDEAVLSLPSSVTLSVLPHTPLSSKLAKAAHANGHEIMLHLPMQALNGKALGVGGLTNNMNEAQIRSSVLAAMASVPFAKGANNHMGSLLTQLDDPMLWVMETLKQKQFYFVDSMTTKFTKAGDRADQLGVPLLRRQLFLDNDVSTQALERQFNLMISQAHAQGSLVAIAHPYPETIHFLKANLARLKAEGIELVPTSRLLPIKLAHEKGANLTVRQK

SEQ ID NO: 64542 - DNA, 768 bp, Pseudomonas putida KT2440
  CDS (1)..(768): transl_table=11
atgcgttatctgctgtgtctgttgttttgcctgatggccggaatcgcgcaagcggcaccggccaacaaggcctacatgagcatcatcatcgacgacctgggccagagcccagagcgcgacagccgtaccctggccctgcctgggccggtgaccatggcgatcatgcccgacaccccgcatgccaccgactttgcacgccaggcgcacaaggccggcaagacggtgatcctgcacatgcccatggacccggccaccgggccctatgcctggcacccgggcatcgccatcgaagagctggcgcggcgcctggacgcagcattggtcaaggtgccctacgccgccggcatcaacaaccacatgggtagccgcatgaccgcacagcgtgaacccatggcgtggttgatgggcgagctgcagcggcgccatctgttctttgtcgacagccgcaccagtgccgccacggttgccgcggccgaggctcaagcacacgatgtcgcgcatgtatcacgggatgtatttctggatgacgtgcgcacgccggaagccatcgacgctcagctgcaacagggtattgcactggcccgcaagcaaggctcggccgtgttgatcggccacccctacccgcagacgctagcggtgctggaaagtcagattccacggctcaagcaattggggatcgaactggtcacgctgcaacagatgatcgccacacgtggcaaccaggccatgcctgcacacggtaagcatggccgttacagcaatcgctag

SEQ ID NO: 64543 - protein, 255 aa, Pseudomonas putida KT2440
MRYLLCLLFCLMAGIAQAAPANKAYMSIIIDDLGQSPERDSRTLALPGPVTMAIMPDTPHATDFARQAHKAGKTVILHMPMDPATGPYAWHPGIAIEELARRLDAALVKVPYAAGINNHMGSRMTAQREPMAWLMGELQRRHLFFVDSRTSAATVAAAEAQAHDVAHVSRDVFLDDVRTPEAIDAQLQQGIALARKQGSAVLIGHPYPQTLAVLESQIPRLKQLGIELVTLQQMIATRGNQAMPAHGKHGRYSNR

SEQ ID NO: 64544 - DNA, 783 bp, Pseudomonas syringae pv. tomato str. DC3000
  CDS (1)..(783): transl_table=11
gtgcgctttctcggctcgcttctgttggcactctcgatcactggcgctgcgcatgcagcgccagtcgatcatgctgaaaaaacctcgaaagcctacttcaccctgatcatcgacgatctgggccagaacccggtgcgcgacagccgtactctggcgctcccaggcccggtcacgctggcgatcatgcccgacaccccgcacgccaccgagtttgcccgcgaggcccatcgcgccggtaaaacggtgattctgcacatgccgatggaccccgcgaccggcccttacgcctggcaccccgagctgcctctgccggaactggaaagtcgtctgaatgcagcgctgttgaaagtgccgtatgccgccggtatcaataaccacatgggcagccgcatgaccgccgagccggtagccatgacctggctaatggccgaactgcagcgacgtcatctgtttttcgtcgacagccgcaccagcgcaaaaaccgtggccgccgccgaggcgcagcgcatcggtctggccagcgtttcgcgcgatgtgttcctggacgacgaacgcacggccgaagccatcacccgccaattgcagactgcaatcaaactggcccaaaagcacggttcagcggtggttatcggtcacccctacccggtcacgctggacgtgctggagcgcgagctgcccaagctcaaggctcagggcgtcgaatggatcgacctgcgcagcatgatcagcgaacgcggcaatcaggcgagtgcggcgcatggcaagaatggactttaccgctga

SEQ ID NO: 64545 - protein, 260 aa, Pseudomonas syringae pv. tomato str. DC3000
MRFLGSLLLALSITGAAHAAPVDHAEKTSKAYFTLIIDDLGQNPVRDSRTLALPGPVTLAIMPDTPHATEFAREAHRAGKTVILHMPMDPATGPYAWHPELPLPELESRLNAALLKVPYAAGINNHMGSRMTAEPVAMTWLMAELQRRHLFFVDSRTSAKTVAAAEAQRIGLASVSRDVFLDDERTAEAITRQLQTAIKLAQKHGSAVVIGHPYPVTLDVLERELPKLKAQGVEWIDLRSMISERGNQASAAHGKNGLYR

SEQ ID NO: 64546 - DNA, 963 bp, Salmonella enterica subsp. enterica serovar Typhi Ty2
  CDS (1)..(963): transl_table=11
ttgcctcagtttcgtcgctccattctcacgctggccactttgctggcatttgcacatcccgttttcgctggcaagctcgccatcgtgattgatgattttggctatcgcccgcacacggaaaaccaggttctggcgctgccgccaaacatctccgtcgctgtactgcccaacgcgccgcacgcgcgcgaaatggcgactaaagcgcacaatagcgggcatgaggtgttaatccatctgccgatggcgccgctaagcaaacagccgctggagaaggatacgctgcgaccagatatgagcagcgatgagatcgagcgcattatccgcgaggcggtaaacaacgtgccgtatgccgttgggcttaataaccacatgggcagcgcaatgacttccagcctgttcggtatgcaaaaagttatgcaggcgctggaacattacaatctctattttctcgacagcatgacgattggcaatagccaggcgatgcgcgcggcatccggtacgggtgtgaaagtgatcaagcgcaaagtgttcctcgacgatacgcaaaacgaggcggatatccgtcgtcagtttaatcgcactatcgaactggcccgtcgcaacggttccgctatcgcgattggtcatccgcatcccgcaacggttcgcgtgctgcaacagatggtttatcgcctgccggcagatatcaccctggtacgtccaggcagcctgctcaacgaaccgcaggtagatacgtctcgacctgatttgacgccgcagaaaattgacgcgccgcgcaatccctttcgcggcgtgaagatgtgcaagccgaaaaaaccgctgcaaccagtctacgctacgcgctttttcagcgtcatcggcgagagcattacgcaaagttccgtgattgtctggtttcagcaccagtggcaaggctgggggaaaatcgccgcgcctaaaaacatgagcgctaagacagattga

SEQ ID NO: 64547 - protein, 320 aa, Salmonella enterica subsp. enterica serovar Typhi Ty2
MPQFRRSILTLATLLAFAHPVFAGKLAIVIDDFGYRPHTENQVLALPPNISVAVLPNAPHAREMATKAHNSGHEVLIHLPMAPLSKQPLEKDTLRPDMSSDEIERIIREAVNNVPYAVGLNNHMGSAMTSSLFGMQKVMQALEHYNLYFLDSMTIGNSQAMRAASGTGVKVIKRKVFLDDTQNEADIRRQFNRTIELARRNGSAIAIGHPHPATVRVLQQMVYRLPADITLVRPGSLLNEPQVDTSRPDLTPQKIDAPRNPFRGVKMCKPKKPLQPVYATRFFSVIGESITQSSVIVWFQHQWQGWGKIAAPKNMSAKTD

SEQ ID NO: 64548 - DNA, 771 bp, Bacillus cereus ATCC 14579
  CDS (1)..(771): transl_table=11
atgcgaaaatatacgattgcattattcatcattgttttgtttttaccgtccttcttatttcctattcaagcaaatgctcatacgaataaagttgctattgtcattgatgatttcggaaataatatgaaggggactaatcaaatgttatcacttcccattccactcactgttgctgttatgccttttcttccttccacaaaagaagatgcaatagctgcccataagaaaggccatgaagttattatacatatgccaatggaacctataaaaggtaaaaaagaatggcttgggccgaaagcaattacaactgatttaagcgatgaagaaataaacaaccgacttgaacaagcgattcaagaagtaccgcatgcaattggaatgaacaatcatatggggtcaaaagtaacagcggatgaaagaattgttcgccttatacttgctgcttgtaaaaaacacggtttattttacttagatagtaaaacgaatcctaatagtgtcgtcccaaaaatcggaaaagaattaggagttcctattattgaaaaccaactattttttgatgatgtgtatacagcaggacatatttcaaaacaagcccaattactcatcaaaaaaattcaagaaaaacctattatggtagctatcgggcatgtgggccctccaggtgaaattacatcacgcgttattgaaacttctatccctaaaattcgtgagcatgcagactttattttcttatctgatctagcattatccccgcctcctgtttcaaaataa

SEQ ID NO: 64549 - protein, 256 aa, Bacillus cereus ATCC 14579
MRKYTIALFIIVLFLPSFLFPIQANAHTNKVAIVIDDFGNNMKGTNQMLSLPIPLTVAVMPFLPSTKEDAIAAHKKGHEVIIHMPMEPIKGKKEWLGPKAITTDLSDEEINNRLEQAIQEVPHAIGMNNHMGSKVTADERIVRLILAACKKHGLFYLDSKTNPNSVVPKIGKELGVPIIENQLFFDDVYTAGHISKQAQLLIKKIQEKPIMVAIGHVGPPGEITSRVIETSIPKIREHADFIFLSDLALSPPPVSK

SEQ ID NO: 64550 - DNA, 816 bp, Photorhabdus luminescens subsp. laumondii TTO1
  CDS (1)..(816): transl_table=11
ttgggagataatcaggtgagacaacgcaaactcgcaaaactcattggtactaccgccctgttacttttgagcctacaaaccggtgctgcccgtttggctattgttatcgatgattttggctaccgtcctcataatgaaaacaaaatattgcagatgcctgttgcaatctctatcgccattctgccggattcaccgcatggcagggagatggctgaaaaagcctataaacaagggcgggagatcttaatccacctgccaatggcacctttaagtaagcaactgctagaaccggatactctccagccaaccatgagcagtgaagatattgaccgcatcatccagcgtgcaatacaaaaagttccttatgctgtaggaatcaataaccatatgggcagcgctatgacttcgagcttgccgggaatgcagaaagtgatgcgttcactgtctggttataacctctattttctcgacagcgtgacgattggcaatactcaagcaacaaaggcagcacaaggcacacctgttcgcgttatccgccgtaatgttttcctagatgatgtgcaatcagaagcggaaactcgtcatcagttaaaccgtgcgatttccattgcccgtaagaatggttccgctattgctatcggtcatcctcattcaacaaccattcgtgcattacaacagatgctgccaacgcttcccgctgatattgagttagtcagcccaagtaggttgttaagtggcaaacctgttggtgataacccacataaatggggcaagctgtgtgaactcaacaaccaccgactaaagtcggtgggttag

SEQ ID NO: 64551 - protein, 271 aa, Photorhabdus luminescens subsp. laumondii TTO1
MGDNQVRQRKLAKLIGTTALLLLSLQTGAARLAIVIDDFGYRPHNENKILQMPVAISIAILPDSPHGREMAEKAYKQGREILIHLPMAPLSKQLLEPDTLQPTMSSEDIDRIIQRAIQKVPYAVGINNHMGSAMTSSLPGMQKVMRSLSGYNLYFLDSVTIGNTQATKAAQGTPVRVIRRNVFLDDVQSEAETRHQLNRAISIARKNGSAIAIGHPHSTTIRALQQMLPTLPADIELVSPSRLLSGKPVGDNPHKWGKLCELNNHRLKSVG

SEQ ID NO: 64552 - DNA, 873 bp, Geobacter sulfurreducens PCA
  CDS (1)..(873): transl_table=11
atggctctggtcgtcatagcggtaatcgccgctgttttttttcttgatcgcgcgtaccgcaaacaaccggtcgtgcagcagaccccacctcccgtggtggagcgtcacaagcttcctccccgagagccggaacaaccagttgcccacgaagactacacgggggttatccaccacccggccgaaccacagcgcgcgcagcgtccaacggggccgggaacccttgccgtcatcatcgacgacatggggaaggggcttcctgaggcgcgtgccctgatggatatcggtattccgctcacctttgccatcattccgggactgccgaaggtcagacgggttgccgaggaggcccggcagcggggaattgaggtaatggtacatctgcccatggagcccaaaggatatcccgaaaggcggcttgaggcgaacggactcctcctctcacagggcgacgatgagattgccggccgggtaaacggttacctgaacgagattccccaggcagtcggggcgaacaatcacatgggctccgggtttaccgagaaccgtcagaaaatggctgtggtgatgggggtactgaaggaaagggggctgttctttgtagacagtaagacatcccctgtctcggtgggtgatgccgtggcgcgggaaatgggggtgcgcacggcggtgcggaacgtcttcctcgacaatatccaggaatcgggctacatcacgaaccaactccgtcaggccgcttcgatcgcccgaaagcggggcaatgccatagcgatttgccacccgcatcctgccaccatccagacccttgccgtcgagttaccgcgtctgcgggacgaggggatcacctttgtgacggtgtcgaggctggtcaggtag

SEQ ID NO: 64553 - protein, 290 aa, Geobacter sulfurreducens PCA
MALVVIAVIAAVFFLDRAYRKQPVVQQTPPPVVERHKLPPREPEQPVAHEDYTGVIHHPAEPQRAQRPTGPGTLAVIIDDMGKGLPEARALMDIGIPLTFAIIPGLPKVRRVAEEARQRGIEVMVHLPMEPKGYPERRLEANGLLLSQGDDEIAGRVNGYLNEIPQAVGANNHMGSGFTENRQKMAVVMGVLKERGLFFVDSKTSPVSVGDAVAREMGVRTAVRNVFLDNIQESGYITNQLRQAASIARKRGNAIAICHPHPATIQTLAVELPRLRDEGITFVTVSRLVR

SEQ ID NO: 64554 - DNA, 1173 bp, Treponema denticola ATCC 35405
  CDS (1)..(1173): transl_table=11
atggcaaaaaagagcaccaaaacaggaaaaacaactaaaccggtaaaaaaaaccggaaaaaaaagaagaaaaaagtcaaaaattaactataccggagctatagccggttttttggcagtctgtataataatgctcgcagtatttttgtttataattccttcggtaaaaaataaagatgaaacaacgaataaaacgcaaattgccaaggaacaagaaaaaatagaagaagaaaagcctaaaactaccgaaaagccgcctatagaaagcaaggctaaagataagcgtaccgaaaaaactaaggaagctgaaacgcaggcctcaaaaaatctgcctaaagaagctgcaaaaaagactttacatgataagcctaaagaaagcgaaaaggcgggcagagaaaacaaggcaaaaaagcctgaaaatcccataatcacgggtaagcctaaacctcaagaacaagagcctgacgtttcggcctaccctattcaggacctgcctgagcttccctcaaagggaaaacttatttttgtgtttgacgatgcaggacacaaccttgaacagttacagtattttttggatttaccctttccctgtaccatagccgttttgcctaagctgcctaactcaagagaaacggcaagaagaataagggctgccggaaaggaactcatccttcatcagcctatgcaggcattaaaccccaatattaatccgggagatggagccgttaaacccggcatggaccgtgaagagataaaaaaaatcgtagcttcaaatgtggaagaaattgggcccatagccggaatgaataaccacgagggctctcttattacatcggatgaaaaagctatggaggcagtgcttgaattgtgcagggaaaaaaacatatactttttggattcccgcaccagctcaaaaagcgttgttcctcaagttgcaaaaaaactgaatatgaatatttgggaaagagctgtctttcttgataataaaaaagataaggcctatatgaaaaaacaaattatagaaggcttggaaattgcctcacaaagaggtgaagcgattatgataggccatgtgtttaccgtagatcttgcaatccttttaaaagaaatgtactccgatttaacacaagaaggatatacattttctacaatttcaaaatcaaaagggaaataa

SEQ ID NO: 64555 - protein, 390 aa, Treponema denticola ATCC 35405
MAKKSTKTGKTTKPVKKTGKKRRKKSKINYTGAIAGFLAVCIIMLAVFLFIIPSVKNKDETTNKTQIAKEQEKIEEEKPKTTEKPPIESKAKDKRTEKTKEAETQASKNLPKEAAKKTLHDKPKESEKAGRENKAKKPENPIITGKPKPQEQEPDVSAYPIQDLPELPSKGKLIFVFDDAGHNLEQLQYFLDLPFPCTIAVLPKLPNSRETARRIRAAGKELILHQPMQALNPNINPGDGAVKPGMDREEIKKIVASNVEEIGPIAGMNNHEGSLITSDEKAMEAVLELCREKNIYFLDSRTSSKSVVPQVAKKLNMNIWERAVFLDNKKDKAYMKKQIIEGLEIASQRGEAIMIGHVFTVDLAILLKEMYSDLTQEGYTFSTISKSKGK

SEQ ID NO: 64556 - DNA, 771 bp, Bacillus cereus ATCC 10987
  CDS (1)..(771): transl_table=11
atgcgcaaatatacgattgcattgcttattttgactatgtttttaccatctttcttgtttcctgttgaggccaaggctcatacaaataaagtagctattgtcattgatgacttcggcaataatatgaaaggaactgataaaatgttatcacttcctattccactaactgttgctgttatgccttttcttccttccacaaaggaagatgcgatagcggctcataagaaaggacacgaagttattatacatatgccaatggaaccgattaaaggtaaaaaagaatggcttggaccaaaagcaattacaactgatttaagcgacgaagaaataaataatcgactcgaacaagcgattcaagaagtgccacatgcaattgggatgaataatcatatgggatcaaaagtgactgcagacgaaagaattgtacgacttatacttgcagcttgtaaaaaacacggtttattttatttagatagcaaaacaaatcctaagagtgtcgtcccaaaaatcgggaaagaattaggagtgccaattattgaaaatcaattattttttgatgacgtgtacacagcggcacatatttcaaaacaagcccaattactcattaaaaaacttcaagaaaaaccgattatggtagctatcggacatgttgggcctccaggtgaaattacatcacgtgttatagaaacctctattcctaaaattcgtgaacatgcagattttatttttttatccgatttagcattatctccgcctcctgtttcaaaataa

SEQ ID NO: 64557 - protein, 256 aa, Bacillus cereus ATCC 10987
MRKYTIALLILTMFLPSFLFPVEAKAHTNKVAIVIDDFGNNMKGTDKMLSLPIPLTVAVMPFLPSTKEDAIAAHKKGHEVIIHMPMEPIKGKKEWLGPKAITTDLSDEEINNRLEQAIQEVPHAIGMNNHMGSKVTADERIVRLILAACKKHGLFYLDSKTNPKSVVPKIGKELGVPIIENQLFFDDVYTAAHISKQAQLLIKKLQEKPIMVAIGHVGPPGEITSRVIETSIPKIREHADFIFLSDLALSPPPVSK

SEQ ID NO: 64558 - DNA, 1551 bp, Desulfovibrio vulgaris subsp. vulgaris str. Hildenborough
  CDS (1)..(1551): transl_table=11
atggccgccaaacgcccgcagaagaaaagcagcacagccaagggagacggcacgtcaggccgttcacgcggcagtggcaccaagtctggcacccgcaagggaagcaagacccccgcagctacagagaagaccctgacgcgacttgtcatcgtcatcatgggggtgctgtgcctcgtcttcacggtcatggccgggtactggctgtggcagggcggggctgatgccacacggcccgtacccccctcgaagaccgaacgtcagaagacccccgcggcaacctctcccgcgaggccgacgccagcgcagccttccgccacagccgggaaggtgcagtcgggtgaagcctcaaggacgaccggtaagggcgtacacgccgacgcgcagtctgatgcctcgacaccgggtggggacgcggacaaggccgcgccgtccgtgccccgaaacgccacttccgacgccgtggacggtgagggcgcggtgcgtgccccggtcaacgccggggccttgccctacgaggaatccctcgacgccccgctggaagaaggggtgaagcaggtcgactacgcgctggtgcagacgctggtgcgtctcggcatcgcgcgggagaggctgcgcatcgcgagcgtcgagacacgcaacgaacagggcgaaagctaccatttccagcagatgacactgggtgtcggcgacgcccccgaccgtttcgtcaaggcgttcgtcgaagctctttccgtatgggccgagcgtgcgcagatgcgcaagaaggccgatgacctcattgaggtctacgtgggcggggtgctcacgcatgagatcaccctttcgttgtatgagtcggtggaagagccccgtcccggaaccccggtggaaggcgcgttgcttgccatcgtcatcgatgacataggcgagagcatgggggcggtgcgtgacctgctgaagctcgactaccccgtcaccttcgcggtgtggcccagaagctcgcatgcgcgtgaggctgcggaggcggcacaccgcgccggacgtgaggtgatgatccaccagcccatggaaccgctcaagtatccgtcggtgaagccggggccgggtgccatctatgtacggatgggcagtgacgagatagaggcgacgctgcgggacaacctcgcccgggtaccccacgccgtgggcctcaacaaccatatggggtcgcgtttcacgcaggacacccgtggcgtacgcgccgtatgtgacgcgctggagggcaaggggctcttcgtgctcgacagcgtgacgcattccgggtcggtcttctatcgtgaggcgcgcaaggcagggttgcccgccggaaagcgcaacgtgttccttgatgtcatccacgacaagcgcaacatcatgttccagctcgacaaggcggcgcgcgtagcccatgaacagggcgtggctgtcgccatcgggcatcctctcgccgagacagtggcggcactcaaggagtggcagcgtacgcgcgacaagtcggtgcgtatcgtgaccatgcgtcagctgcttgatgcggagacgactgcgcgccgatga

SEQ ID NO: 64559 - protein, 516 aa, Desulfovibrio vulgaris subsp. vulgaris str. Hildenborough
MAAKRPQKKSSTAKGDGTSGRSRGSGTKSGTRKGSKTPAATEKTLTRLVIVIMGVLCLVFTVMAGYWLWQGGADATRPVPPSKTERQKTPAATSPARPTPAQPSATAGKVQSGEASRTTGKGVHADAQSDASTPGGDADKAAPSVPRNATSDAVDGEGAVRAPVNAGALPYEESLDAPLEEGVKQVDYALVQTLVRLGIARERLRIASVETRNEQGESYHFQQMTLGVGDAPDRFVKAFVEALSVWAERAQMRKKADDLIEVYVGGVLTHEITLSLYESVEEPRPGTPVEGALLAIVIDDIGESMGAVRDLLKLDYPVTFAVWPRSSHAREAAEAAHRAGREVMIHQPMEPLKYPSVKPGPGAIYVRMGSDEIEATLRDNLARVPHAVGLNNHMGSRFTQDTRGVRAVCDALEGKGLFVLDSVTHSGSVFYREARKAGLPAGKRNVFLDVIHDKRNIMFQLDKAARVAHEQGVAVAIGHPLAETVAALKEWQRTRDKSVRIVTMRQLLDAETTARR

SEQ ID NO: 64560 - DNA, 780 bp, Bacillus thuringiensis serovar konkukian str. 97-27
  CDS (1)..(780): transl_table=11
atgcacaaatatacgattgcattgcttattttgactatgtttttaccatctttcttgtttcctgttcaagcaaaggcccatacaaacaaagtagctattgttattgatgacttcggtaataatatgaaggggactgataaaatgttatcacttcctattcccctaactgttgctgttatgccttttcttccttccacaaaggaagatgcgatagcggctcataagaaaggacacgaagttattatacatatgccaatggaaccggttaaaggtaaaaaagaatggctcggaccaaaagcaattacaactgatttaagcgacgaagaaataaacaaccgactcgaacaagcaattcaagaagtaccacatgcaattgggatgaataatcatatgggatcaaaagtgactgcagacgaaagaattgtacgacttatacttgcagcttgtaaaaaacacggtttattttatttagatagcaaaacaaaccctaaaagtgtcgttccaaaaatcgggaaagaattaggagtaccaattattgaaaatcaattattttttgatgatgtgtatactgcggcacatatttcaaaacaagcccaattactcataaaaaaacttcaagaaaaaccgattatggtggctattggacatgttggccctccaggtgaaattacatcacgtgttatagaaacttctattcctaaaattcgtgaacacgcagattttatttttttatctgatttagcattatctccgcctcctgtttcgaaatcagatttataa

SEQ ID NO: 64561 - protein, 259 aa, Bacillus thuringiensis serovar konkukian str. 97-27
MHKYTIALLILTMFLPSFLFPVQAKAHTNKVAIVIDDFGNNMKGTDKMLSLPIPLTVAVMPFLPSTKEDAIAAHKKGHEVIIHMPMEPVKGKKEWLGPKAITTDLSDEEINNRLEQAIQEVPHAIGMNNHMGSKVTADERIVRLILAACKKHGLFYLDSKTNPKSVVPKIGKELGVPIIENQLFFDDVYTAAHISKQAQLLIKKLQEKPIMVAIGHVGPPGEITSRVIETSIPKIREHADFIFLSDLALSPPPVSKSDL

SEQ ID NO: 64562 - DNA, 948 bp, Erwinia carotovora subsp. atroseptica SCRI1043
  CDS (1)..(948): transl_table=11
ttgtcttatttaaccaaaacaccgttattggcattgagtctgttcgcgctttctcctttggcactggccggaaaattgtctatcgtgatcgatgatttcggctatcgtccacataatgagaaccagattctggcgatgcctacggcaatttccgtcgcagtattacctaacgcaccatacgcccgtgaaatggcgactaaagcccaccagcaagggcgagaagtgctgatccacctgccgatggcaccgatgagcaagcagccgctggagcgcgacacgttacgcccagatatgagcagcgatgaaattcagctcattattcgccaatcggtcagtaacgtgccttatgccgtagggttgaataaccatatgggcagcgcgatgaccgccagcctgcctggcatgcaaaaagtcatgcaggcgctgagcgcctaccagctctatttcctcgatagtatgaccattggcagcagccaatcgagtcaggccgcagcaggaacgggcgtcaaagttatcaaacgcaaagtctttctggacgattcgcagaacgaagccgagattcgtaaacagtttacccgcgcggtgcaaattgcccgccgcagcggttccgctatcgctattgggcacccacatccttccactatccgcgtcttgcagcagatgctgcctacactggatgccgatatcgtcttagtgcgccccagccagttgctgaatgagcctacgcagcattatgagcctcagccacagaaaccatccaaggcgcgtaatccgttccgtggcataccgcaatgccaggtcaagcagccaccggaaccgataaaagacgatgtgttcttcaggctggtgagcagcagtattcgggacagcgcacccgtgctgtttatcaagcaccgctggcagacctggattgcccctgccgacaccgaaacgcacaagcagccgtaa

SEQ ID NO: 64563 - protein, 315 aa, Erwinia carotovora subsp. atroseptica SCRI1043
MSYLTKTPLLALSLFALSPLALAGKLSIVIDDFGYRPHNENQILAMPTAISVAVLPNAPYAREMATKAHQQGREVLIHLPMAPMSKQPLERDTLRPDMSSDEIQLIIRQSVSNVPYAVGLNNHMGSAMTASLPGMQKVMQALSAYQLYFLDSMTIGSSQSSQAAAGTGVKVIKRKVFLDDSQNEAEIRKQFTRAVQIARRSGSAIAIGHPHPSTIRVLQQMLPTLDADIVLVRPSQLLNEPTQHYEPQPQKPSKARNPFRGIPQCQVKQPPEPIKDDVFFRLVSSSIRDSAPVLFIKHRWQTWIAPADTETHKQP

SEQ ID NO: 64564 - DNA, 1011 bp, Yersinia pseudotuberculosis IP 32953
  CDS (1)..(1011): transl_table=11
ttgcgctacttcaacacacgccaatttatcatcgtaagcacgctattcatcgccagcacagcacaggccggcaaactctctattgttattgacgattttggttatcgcccccaaaacgaaaataagattttacagatgcccctgcccatttcagtggccattctgcctaatgctccttacgccagagagatggcaaccaaagcccataatcaggggcgtgaaatcctgattcacttgccgatggccccacagagtaaacagccactggagcgtgataccttgcagccttcaatgagcagcgaggaaatccagcgcatcatccgccaggccgcgaataacgtcccttatgcgaaaggcatgaataaccatatgggcagtgcgatgaccgccagtttgccaggtatgcagaaagtgatgcaggcactggggagctaccagctctattttctcgacagtgtgactattggtaatagccaggcgagcaaagccgccgaaggcactggtgtcaaagtgatcaagcggaaaatctttttagatgactcacaaaatgaagcagctatccgtcaacaatttaaccgggcagtagcactggcacgccgcaatggctcagcgattgctatcgggcaccctcaccctgcgaccattaaagtattgcaacaaatgttgcctcagttgcctgccgacatcgtcttagtcagacccagtgcgctgctaaatgaaccggtacaaagtctctctccggacaaaacaaaaccacgtgaaccggtgaaaggccaacgtctgcccgctatcaagcaatgtaaagcgaaagccagctatgtgcctgagaaaatctacgctgataagctgtttatcttattgggtgagagcttgatgcaaaacccggcggtcatatttattcagcaacattggcaacaatattttacgccagcgccgccggcaacacctattgatgaacagaaagcgattgaaaatacagagaaattgccacccaagaaggcggcacaataa

SEQ ID NO: 64565 - protein, 336 aa, Yersinia pseudotuberculosis IP 32953
MRYFNTRQFIIVSTLFIASTAQAGKLSIVIDDFGYRPQNENKILQMPLPISVAILPNAPYAREMATKAHNQGREILIHLPMAPQSKQPLERDTLQPSMSSEEIQRIIRQAANNVPYAKGMNNHMGSAMTASLPGMQKVMQALGSYQLYFLDSVTIGNSQASKAAEGTGVKVIKRKIFLDDSQNEAAIRQQFNRAVALARRNGSAIAIGHPHPATIKVLQQMLPQLPADIVLVRPSALLNEPVQSLSPDKTKPREPVKGQRLPAIKQCKAKASYVPEKIYADKLFILLGESLMQNPAVIFIQQHWQQYFTPAPPATPIDEQKAIENTEKLPPKKAAQ

SEQ ID NO: 64566 - DNA, 867 bp, Borrelia garinii PBi
  CDS (1)..(867): transl_table=11
atgtttatattttatattaaaaaaaacaaatttattattgtaatttctattgctattgcaataactcaagcatttgcaagttttttatattttaacgacaatttaaaggttgcaaatgcactacttaaggataggtttcaaaaaacacaaaaagacagcttaataataaataacaaagaaaataaaaaatccagaataaagcctaagttttacttaatcatcgatgacgtaggttatgatgaatttatgttagaacaatttataaaacttaattttgaaataaattatgccattattccatttctaccaaaatcaatgaatttatacaaaaagctaaaaaataataacaaaacaataataatacatttcccaatgcaatcaaaacatagaaattcaatcgaaaaatttcatataaacataaaagataaaaaggaagaaatatacaaaaaaatcgaaaaaacatttaaaatgtaccccgatgcaaaaataatgaataatcacatgggtagcttaatcacttcaaataaagatttgatgaaaatcattttgataaagcttaaagagattgatagatattttttcgacagcgtaactattgcaggaagcgtaccagaaataataggcaaagaaattggagttagagtagaaaaaagagatgtatttcttgataacaaagatacagaagaatccgtactcaaggaacttgaaaaagcaaaaaatattgccagaaaacatggaatagtaaaagtaatcgggcatatttggtctaaaagcacgctaaaagtcctcgaaaaagaaggacctaatttaaaccaggaatttgaatttgacaacttattaaatctgtacgaggaaacaatcagatga

SEQ ID NO: 64567 - protein, 288 aa, Borrelia garinii PBi
MFIFYIKKNKFIIVISIAIAITQAFASFLYFNDNLKVANALLKDRFQKTQKDSLIINNKENKKSRIKPKFYLIIDDVGYDEFMLEQFIKLNFEINYAIIPFLPKSMNLYKKLKNNNKTIIIHFPMQSKHRNSIEKFHINIKDKKEEIYKKIEKTFKMYPDAKIMNNHMGSLITSNKDLMKIILIKLKEIDRYFFDSVTIAGSVPEIIGKEIGVRVEKRDVFLDNKDTEESVLKELEKAKNIARKHGIVKVIGHIWSKSTLKVLEKEGPNLNQEFEFDNLLNLYEETIR

SEQ ID NO: 64568 - DNA, 759 bp, Symbiobacterium thermophilum IAM 14863
  CDS (1)..(759): transl_table=11
gtggtcgccgcgttcgcgccgcaggacggatacggctccgtcttctgcaacgcgcgcccggttcccgggcagcctcccctgctggcgatcgtcatcgacgacctgacgaccggggcgccggggctggaggagatgctgcggctgccgtacccgctcaccttcgcgatcctgcctgaccggcccgacgccggggcgctggcccggcgcatcgccgccctcggacacgaggtcatcctgcacttgcccatggacgcgggagaggtggatccccagtggtacgtgggccggcccatctcctcccgacagtcggacgaggagatccagcagctggtctcggagtggctggccgccgtgccggaggcccggggcatgaacaaccacatgggcacggtggccacgcaggacgagcgcgtggtccgggcggtgctggaggtggcccgccggcatgggaagtacatcctcgacagcatgaccaccgagaacacggttgtgccgcggacggcggtggagatgggcgtcccctgcatgcagcgttcgctgttcctcgaccacgagaacggcgaggaggtggtggccgcccagctctacaagctggccgagtgggcggagacccacggcgccgccatcgggatcggccatgtgggcgtcggccgggagggcaccgctgccgcgctggcggaggtgctgcccgaactggaggcgcgggggatccggctggtcaccctttcgcaactgctctcctatcagcaggaaaattag

SEQ ID NO: 64569 - protein, 252 aa, Symbiobacterium thermophilum IAM 14863
MVAAFAPQDGYGSVFCNARPVPGQPPLLAIVIDDLTTGAPGLEEMLRLPYPLTFAILPDRPDAGALARRIAALGHEVILHLPMDAGEVDPQWYVGRPISSRQSDEEIQQLVSEWLAAVPEARGMNNHMGTVATQDERVVRAVLEVARRHGKYILDSMTTENTVVPRTAVEMGVPCMQRSLFLDHENGEEVVAAQLYKLAEWAETHGAAIGIGHVGVGREGTAAALAEVLPELEARGIRLVTLSQLLSYQQEN

SEQ ID NO: 64570 - DNA, 771 bp, Bacillus cereus E33L
  CDS (1)..(771): transl_table=11
atgcgcaaatatacgattgcattgcttattttgactatgttcttaccatctttcttgtttcctgttcaagcaaaggcccatacaaacaaagtagctattgttattgatgacttcggcaataatatgaaggggactgataaaatgttatcacttcctattcccctaactgttgctgttatgccttttcttccttccacaaaggaagatgcgatagcggctcataaaaaaggacacgaagttattatacatatgccaatggaaccgattaaaggtaaaaaagaatggcttggaccaaaagcaattacaactgatttaagcgacgaagaaataaacaaccgactcgaacaagcgattcaagaagtaccacatgcaattgggatgaataatcatatgggatcaaaagtgactgcggacgaaagaattgtacgacttatacttgcagcttgtaaaaaacacggtttattttatttagatagcaaaacaaatcctaagagtgtcgtcccaaaaatcggaaaagaattaggagtgccaattattgaaaatcaattattttttgatgacgtgtacacagcggcacatatttcaaaacaagcccaattactcattaaaaaacttcaagaaaaaccgattatggtagctatcggacatgttgggcctccaggtgaaattacatcacgtgttatagaaacttctattcctaaaattcgtgaacatgcagattttatttttttatccgatttagcattatctccgcctcctgtttcgaaataa

SEQ ID NO: 64571 - protein, 256 aa, Bacillus cereus E33L
MRKYTIALLILTMFLPSFLFPVQAKAHTNKVAIVIDDFGNNMKGTDKMLSLPIPLTVAVMPFLPSTKEDAIAAHKKGHEVIIHMPMEPIKGKKEWLGPKAITTDLSDEEINNRLEQAIQEVPHAIGMNNHMGSKVTADERIVRLILAACKKHGLFYLDSKTNPKSVVPKIGKELGVPIIENQLFFDDVYTAAHISKQAQLLIKKLQEKPIMVAIGHVGPPGEITSRVIETSIPKIREHADFIFLSDLALSPPPVSK

SEQ ID NO: 64572 - DNA, 846 bp, Mannheimia succiniciproducens MBEL55E
  CDS (1)..(846): transl_table=11
atgattcggcatcaattaaaaagtgcggtaaaaaataccgcacttttatgtttgttattcctgatctcgctaccggcattttcggcgaaattagccattgtgattgatgatttaggttatcatccgagggaagatgcggcaattttggcgatgcctaaagaaatcagtgtagcgattattccttccgcaccttatgcccgtcagcgtaatcagctggcttatgaacaaggacgggatattcttattcacatgccgatgcaacctatcagccaaatgaacattgaggccggcggtttatcgatcggtatggatgcgcaacaagtggcgcataacgtgcaacaggcgaaaaatatcgtttctcatgcaatcggtatgaataaccatatgggcagcgctgcaacggcggataggccgttgatgaccgaattaatggcggaattgcgcaaacagcatttgttctttttggacagtcgtactatcgggcgttcggtggcggaaaaaattgccaaagaaagcggtgttcgcgccttgcaacggcatatttttctggatgacagcgatgtctatggggacgtacaacggcagtttcagcaggcaattcattatgcccgcaagcatggcacggcgattgttatcgggcatccgcgaaaaaatacggtcgccgtgttgaggcaaggtcttgctaatttaccgccggatattcaattggtgagcatgggcagcttatggcgtgacgaaaaagtcgtgccgccggcgccgtttattttaattttcagtgataagcccgccccgacatccgtcgcaccttttgagccggttcctttgttgcgcggtgtgccgagatag

SEQ ID NO: 64573 - protein, 281 aa, Mannheimia succiniciproducens MBEL55E
MIRHQLKSAVKNTALLCLLFLISLPAFSAKLAIVIDDLGYHPREDAAILAMPKEISVAIIPSAPYARQRNQLAYEQGRDILIHMPMQPISQMNIEAGGLSIGMDAQQVAHNVQQAKNIVSHAIGMNNHMGSAATADRPLMTELMAELRKQHLFFLDSRTIGRSVAEKIAKESGVRALQRHIFLDDSDVYGDVQRQFQQAIHYARKHGTAIVIGHPRKNTVAVLRQGLANLPPDIQLVSMGSLWRDEKVVPPAPFILIFSDKPAPTSVAPFEPVPLLRGVPR

SEQ ID NO: 64574 - DNA, 816 bp, Photobacterium profundum SS9
  CDS (1)..(816): transl_table=11
ttgggtatacttatcgggctagattcaaacagtcagcccgacatgatttcgatattcacttcaaggaagaaggctatcaggcaatctactatgcgaaggaacgtagttaaaacagcatcactgattctacttctgttaacatcaaccaatattcacgccgctcaattagcgattgttatcgatgatttaggctatcaggcaatgcctgaattactatcaaaccttcccccagaagtcaccatatccattttaccgaatacgccgtttgatttagctgtcgcagcacaagctaaaaaacaacaccgagagacattgcttcatatgcccatggagccggaacatttagccccactcgaagttaacactttaacctcggcaatgtcgcaacaaaccttacagcacaccttgcgccaagcactgactcgagtcccgaatgcaatcgcaatcaataatcatatggggagtgccctcagccaagatacacaagcgatgggctggataatggcagaactcaaacaacataatctttattatctcgacagccgtactacggctaaatccatcgcacaacaacaagccactagtcatcacgtattgtcattgcgccgccatgtttttctcgaccattatcaaaccaaagaatttgtcacaaagcagttaatgagtgcaataaaacgtgcaaagcaatacggctatgcgattgctattgggcatcctcatccagttaccctatccacattgaatgaattactgccaaatttaacggaagaagatattaccttggtgcggctgtcgacgctttttgcggagatttga

SEQ ID NO: 64575 - protein, 271 aa, Photobacterium profundum SS9
MGILIGLDSNSQPDMISIFTSRKKAIRQSTMRRNVVKTASLILLLLTSTNIHAAQLAIVIDDLGYQAMPELLSNLPPEVTISILPNTPFDLAVAAQAKKQHRETLLHMPMEPEHLAPLEVNTLTSAMSQQTLQHTLRQALTRVPNAIAINNHMGSALSQDTQAMGWIMAELKQHNLYYLDSRTTAKSIAQQQATSHHVLSLRRHVFLDHYQTKEFVTKQLMSAIKRAKQYGYAIAIGHPHPVTLSTLNELLPNLTEEDITLVRLSTLFAEI

SEQ ID NO: 64576 - DNA, 963 bp, Salmonella enterica subsp. enterica serovar Paratyphi A str. ATCC
  CDS (1)..(963): transl_table=11
ttgcctcagtttcgtcgctccattctcacgctggccactttgctggcgtttgcacatcccgttttcgctggcaagctcgccatcgtgattgatgattttggctatcgcccgcacacggaaaaccaggttctggcgctgccgccaaacatctccgtcgccgtactgcccaacgcgccgcatgcgcgcgaaatggcaactaaagcgcacaatagcgggcatgaggtgttaatccatctgccgatggcgccgctaagcaaacagcctctggagaaggatacgctgcgaccagatatgagcagcgatgagatcgagcgcattatccgcgaggcggtaaacaacgtgccgtatgccgttgggcttaataaccacatgggcagcgcaatgacttccagcctgttcggtatgcaaaaagttatgcaggcgctggaacattacaatctctattttctcgacagcatgacgattggcaatagccaggcgatgcgcgcggcatccggtacgggtgtgaaagtgatcaagcgcaaagtgttcctcgacgatacgcaaaacgaggcggatatccgtcgtcagtttaatcgcgctatcgaactggcccgtcgcaacggttccgctatcgcgattggtcatccacatcccgcaacggttcgcgtgctgcaacagatggtttatcgcctgccggcggatatcaccctggtacgcccaggcagcctgctcaacgaaccgcaggtagatacgtcccgacctggtgtgacgccgcagaaaattgacgcgccgcgcaatcccttccgcggcgtgaagatgtgcaagccgaaaaaaccgctgcaaccggtctacgctacgcgctttttcagcgtcatcggcgagagcattacgcaaagttccgtgattgtctggtttcagcaccagtggcaaggctgggggaaaatcgccgcgcctaaaaacgtgagcgctaagacaaattga

SEQ ID NO: 64577 - protein, 320 aa, Salmonella enterica subsp. enterica serovar Paratyphi A str. ATCC
MPQFRRSILTLATLLAFAHPVFAGKLAIVIDDFGYRPHTENQVLALPPNISVAVLPNAPHAREMATKAHNSGHEVLIHLPMAPLSKQPLEKDTLRPDMSSDEIERIIREAVNNVPYAVGLNNHMGSAMTSSLFGMQKVMQALEHYNLYFLDSMTIGNSQAMRAASGTGVKVIKRKVFLDDTQNEADIRRQFNRAIELARRNGSAIAIGHPHPATVRVLQQMVYRLPADITLVRPGSLLNEPQVDTSRPGVTPQKIDAPRNPFRGVKMCKPKKPLQPVYATRFFSVIGESITQSSVIVWFQHQWQGWGKIAAPKNVSAKTN

SEQ ID NO: 64578 - DNA, 756 bp, Idiomarina loihiensis L2TR
  CDS (1)..(756): transl_table=11
atgttgaagcttgtactttctttgggtttactggtgtgcctgatgacgccagcttatgcctctaagatagccattgttatcgatgatataggcaataataaaaacgatttaaaagcagctctgctacctggtaatatcagtttcgcagtgctgccctataccccttatgcccgcgccttcgccttacgcggccatcatcagaaaaaacagatattactgcatatgccaatggaagccgttgaaaataaccgcccgggtcccggtgtggttacggcagatatgaacaatgcacagatcaaactgcaactggttgatgccctggactcaataccttacgttactggtgtcaataatcatatgggcagcaagttaactcagctacacatgccaatgcaggcagtgatggaaacattagcctcccgcaaactcttttttattgatagccggacatctgagttcagcgttgcagaacaaatggcgggagaatttggcgtacggacatcgcacagacatgtgtttcttgataaccaggttgatgagccctatttacagcagcaatttgagcaactgctgagtatagccaaacgtcagggacaagccataggtattggacatccttacccggaaaccctgagctttttgcaaaagcaactaccgcaattacaagaacagggtattgagttggtattcgtatctgagttaaccactgtggctaaccgcaatgggtatcttcttccagtgacgtcagcaaaataa

SEQ ID NO: 64579 - protein, 251 aa, Idiomarina loihiensis L2TR
MLKLVLSLGLLVCLMTPAYASKIAIVIDDIGNNKNDLKAALLPGNISFAVLPYTPYARAFALRGHHQKKQILLHMPMEAVENNRPGPGVVTADMNNAQIKLQLVDALDSIPYVTGVNNHMGSKLTQLHMPMQAVMETLASRKLFFIDSRTSEFSVAEQMAGEFGVRTSHRHVFLDNQVDEPYLQQQFEQLLSIAKRQGQAIGIGHPYPETLSFLQKQLPQLQEQGIELVFVSELTTVANRNGYLLPVTSAK

SEQ ID NO: 64580 - DNA, 963 bp, Salmonella enterica subsp. enterica serovar Choleraesuis str
  CDS (1)..(963): transl_table=11
ttgcctcagtttcgtcgctccattctcacgctggccactttgctggcgtttgcacatcccgttttcgctggcaagctcgccatcgtgattgatgattttggctatcgcccgcatacggaaaaccaggttctggcgctgccgccaaacatctccgtcgccgtactgcccaacgcgccgcacgcgcgcgaaatggcaactaaagcgcacaatagcgggcatgaggtgttaatccatctgccgatggcgccgttaagcaaacagccgctggagaaggatacgctgcgaccagatatgagcagcgatgagatcgagcgcattatccgcgaggcggtaaacaacgtgccgtatgccgttgggcttaataaccacatgggcagcgcaatgacttccagcctgttcggtatgcaaaaagttatgcaggcgctggaacattacaatctctattttctcgacagcatgacgattggcaatagccaggcgatgcgcgcggcatccggtacgggtgtgaaagtgctcaagcgtaaagtgttcctcgacgatacgcaaaacgaggcggatattcgccgtcagtttaatcgcgctatcgaactggcccgtcgcaacggttccgctatcgcgattggtcatccgcatcccgcaacggttcgcgtgctgcaacagatggtttatcgcctgccggcggatatcaccctggtacgtccaggcagcctgctcaacgaaccgcaggtagatacgtcccgaccgggtgtgacgccgcagaaaattgacgcgccgcgcaatccctttcgcggtgtgaagatgtgcaagccgaaaaaaccgctgcaaccggtctacgctacgcgctttttcagcgtcatcggcgagagcattacgcaaagttccgtggttgtctggtttcagcatcagtggcaaggctgggggaaaatcgccgcgcctaaaaacgtgagcgctaagacagattga

SEQ ID NO: 64581 - protein, 320 aa, Salmonella enterica subsp. enterica serovar Choleraesuis str
MPQFRRSILTLATLLAFAHPVFAGKLAIVIDDFGYRPHTENQVLALPPNISVAVLPNAPHAREMATKAHNSGHEVLIHLPMAPLSKQPLEKDTLRPDMSSDEIERIIREAVNNVPYAVGLNNHMGSAMTSSLFGMQKVMQALEHYNLYFLDSMTIGNSQAMRAASGTGVKVLKRKVFLDDTQNEADIRRQFNRAIELARRNGSAIAIGHPHPATVRVLQQMVYRLPADITLVRPGSLLNEPQVDTSRPGVTPQKIDAPRNPFRGVKMCKPKKPLQPVYATRFFSVIGESITQSSVVVWFQHQWQGWGKIAAPKNVSAKTD

SEQ ID NO: 64582 - DNA, 783 bp, Pseudomonas syringae pv. syringae B728a
  CDS (1)..(783): transl_table=11
atgcgctttctaactttgttattgctgaccctctcgatcactggcgctgcccatgcagcgccagccgagaacagcggcaaaccgtccaaggcctacctgagcctgatcatcgatgacctgggccagaatccgcagcgcgacagccgcacactggcgcttcccggcccggtcaccctggcaatcatgcccgacaccccgcatgccaccgagtttgcccgccaggcccatcgcgcaggcaaaacggtcatgctgcacatgcccatggaccccgcgaccggtccttacgcctggcaccccgagctgccactgcctgagctggaaagccgtctcaatgctgccctgctgaaagtgccgtacgcagccggtatcaacaaccacatgggcagccggatgaccgccgagccggtcgccatgacctggctgatggccgagctacagcgtcgtcacctgtttttcgtcgacagccgcaccagcgcgaaaaccgtggcggccgccgaagcgcagcgcatcggtctggccagcgtctcgcgtgacgtattcctggacgacgaacgcactgcagaagccatcacccgccaattgcagaccgcgataaaaatcgcccgcaaatatggctcggccgtggttatcggccacccctaccctgtcacgctggacgtactggaacgcgaactgcccaacctcaaagcgcaaggcgtcgaatggatcgacctgcgcagcatgatcggcgaacgcggcaatcaggcgagtgcggcgcatggcaagaacgggatttatcgctga

SEQ ID NO: 64583 - protein, 260 aa, Pseudomonas syringae pv. syringae B728a
MRFLTLLLLTLSITGAAHAAPAENSGKPSKAYLSLIIDDLGQNPQRDSRTLALPGPVTLAIMPDTPHATEFARQAHRAGKTVMLHMPMDPATGPYAWHPELPLPELESRLNAALLKVPYAAGINNHMGSRMTAEPVAMTWLMAELQRRHLFFVDSRTSAKTVAAAEAQRIGLASVSRDVFLDDERTAEAITRQLQTAIKIARKYGSAVVIGHPYPVTLDVLERELPNLKAQGVEWIDLRSMIGERGNQASAAHGKNGIYR

SEQ ID NO: 64584 - DNA, 843 bp, Haemophilus influenzae 86-028NP
  CDS (1)..(843): transl_table=11
atgaatattctgataaaaagtgcggtaaaaaatttcattgttttttctaccgcactttatacctctttttcttttgctcaaagtaaacttgctattgtgattgatgatgtaggctatcattccaaagaagatgcagcaatttttgcgatgccacgtgaaatttccgtagcaattattcctgctgcgccctatgctcgagcacgtaatcaagaagcaaaatctcaaggtagagatattttaatccatatgccgatgcaaccagtaagtgcagtgaaaatagaagacggtgggctgcatttaggaatgtctgcagcacaagtaaatgatcgcgttaatacggctaaaaatattgtgcgtgatgccatcggtatgaacaatcatatggggagtgcagctacggcagatccccaattaatgacttatttaatgaccgcacttcaagaaaaacatttattctttttagatagtcgaacaataggaaaatctgtagctgggaaaatagcaaaagaacaaggcgtgcgttcattagatcgccatatatttttagatgatagtaacgaattcgcagacgttcaacgtcaatttaaagcagcaattcactatgctagaaaacacggctccgccattgcaataggtcatcctcgccaaaatacgattgcagttttacaagcaggacttcgtaatttacccgaagatattcaattagtcggaatgggaaatttatggcgaaatgaaaaagttattccgcacaagccatttattttattattcagcgaagtgcccgcgccaacttctatagaaccttttgagcctgtaggattattgcgtggaattccaaaataa

SEQ ID NO: 64585 - protein, 280 aa, Haemophilus influenzae 86-028NP
MNILIKSAVKNFIVFSTALYTSFSFAQSKLAIVIDDVGYHSKEDAAIFAMPREISVAIIPAAPYARARNQEAKSQGRDILIHMPMQPVSAVKIEDGGLHLGMSAAQVNDRVNTAKNIVRDAIGMNNHMGSAATADPQLMTYLMTALQEKHLFFLDSRTIGKSVAGKIAKEQGVRSLDRHIFLDDSNEFADVQRQFKAAIHYARKHGSAIAIGHPRQNTIAVLQAGLRNLPEDIQLVGMGNLWRNEKVIPHKPFILLFSEVPAPTSIEPFEPVGLLRGIPK

SEQ ID NO: 64586 - DNA, 807 bp, Pseudomonas fluorescens Pf-5
  CDS (1)..(807): transl_table=11
atgatttcccgctgctcactgctgttgcgctcgctccaggccccgctgctcaccctgctgtgcctcttgcccctcgcgacccaagccgccgaacccacagccgctgcgcccaaggcctacctgagcctgatcatcgacgacctcggccagaacctgccccgtgaccgtcgcgtactggccctgcccggcccggtcaccacggcgatcatgcccgacacgccccacgccgccgaatttgcccgcgaggcccatcgcgccggcaagatcgtcatcctgcacatgcccatggacccggccaccgggccgttcgcctggcaccccgagctgcccatcgaagagctgcaaaaacgcctggaagccgccttccaggccgtgccttacaccagcggtatcaacaaccacatgggcagccgcatgaccgcccaaccccaggccatggcctggctgatggccgacttgcagcggcgacacaaattcttcgtcgacagccgcaccagcgcccagacggtggccgccgccgaagcgcagaagatcggtctggccagtgtttcccgggatgtgttcctggatgacgaacgtaccgaagcggcgatcagccaacagttgcagaccgcgatcaaactggcgcgcaaacagggttcagcggtgatgatcggccacccttatccacagaccctggcagtgctcgaacgtgagctgcccaggctcaaggcccagggcattgagtggatcgatatcaagtcgatgatcagcctgcgcagcaataaggccatggccgggcatggcaagaacggggtttatcgctag

SEQ ID NO: 64587 - protein, 268 aa, Pseudomonas fluorescens Pf-5
MISRCSLLLRSLQAPLLTLLCLLPLATQAAEPTAAAPKAYLSLIIDDLGQNLPRDRRVLALPGPVTTAIMPDTPHAAEFAREAHRAGKIVILHMPMDPATGPFAWHPELPIEELQKRLEAAFQAVPYTSGINNHMGSRMTAQPQAMAWLMADLQRRHKFFVDSRTSAQTVAAAEAQKIGLASVSRDVFLDDERTEAAISQQLQTAIKLARKQGSAVMIGHPYPQTLAVLERELPRLKAQGIEWIDIKSMISLRSNKAMAGHGKNGVYR

SEQ ID NO: 64588 - DNA, 780 bp, Colwellia psychrerythraea 34H
  CDS (1)..(780): transl_table=11
gtgctaaatacttttttaaaaattatctctatacgttcttttataatactttatctaatgctttttagtgttcaaagcattgctcaagcgaaccaagttgctatcgtcattgatgatatggggtatcggtataccgacaaacatgcgttaactttacctggagcaattacctatgcttttctacctcataccacctatggtaaaaaacttgccatgcaagccaatagcactaatcatgatgtgctgattcacataccaatggaatctgaaaatagaaaaaaattaggtcctggtgcgctaacaagtaatatggatgaacaagcatttagtcaaagcttaactaagtccttcgctgaaattccctttgcgattggtattaataatcatatggggagctatctcacacaattatatcaacctatggcttggactatgacgtttttaaaacagcatgatttgttttttttagacagtaaaaccagtcctcattcacaagcacaacaagctgctatcgattttggcgtaccggttaaagcaaggcatatatttttagataatgaattaactgaaaagtatattagtcagcaatttaagcaactcattcatttcgctcaaaaacaccaaacagctattgctatcgcccatcctcatcccgaaactgtggcaacattaaataaactcattcctaccttaaagttacacggtattgagttagttccattatctcgtttatacccaacatcgatcaataaggtaattaactctacagcaactgagtaa

SEQ ID NO: 64589 - protein, 259 aa, Colwellia psychrerythraea 34H
MLNTFLKIISIRSFIILYLMLFSVQSIAQANQVAIVIDDMGYRYTDKHALTLPGAITYAFLPHTTYGKKLAMQANSTNHDVLIHIPMESENRKKLGPGALTSNMDEQAFSQSLTKSFAEIPFAIGINNHMGSYLTQLYQPMAWTMTFLKQHDLFFLDSKTSPHSQAQQAAIDFGVPVKARHIFLDNELTEKYISQQFKQLIHFAQKHQTAIAIAHPHPETVATLNKLIPTLKLHGIELVPLSRLYPTSINKVINSTATE

SEQ ID NO: 64590 - DNA, 783 bp, Pseudomonas syringae pv. phaseolicola 1448A
  CDS (1)..(783): transl_table=11
atgcgcgttctcgctctgttactgctgacactctcgatcactggcgctgcccatgcagcgccagccgaagacaacggcaagccgccgaaggcctatctcagcctgatcatcgacgacctgggtcagaacccggcgcgggatagccgtacactggcgctccccgggccggtaacgctggcgatcatgcctgacactccacacgccaccgaatttgcccgcgaggctcaccgcgcaggcaagacggtcatgctgcacatgccgatggacccggcgaccgggccttacgcctggcatcccgaactgcccttgcctgaactggaaagccgtctcaatgcggcgctgctgaaagtgccttatgcagccggcatcaataaccacatgggcagccggatgaccgccgaaccggtcgcgatggcctggttgatggccgaactgcaacgacgtcatctgtttttcgtggacagccgcaccagcgcgaaaaccgtggcagccgcagaggctcagcgcatcggcctcgcaagcgtctcacgcgacgtgtttctggacgacgagcgcacggccgaagccatcaaccgacaattgcagtcagccatcaaaatcgcccgcaagcatggctcggcagtggtcatcggtcacccctaccctgtcacgctggacgtactggaacgcgagttgcccaaactcaaggatcagggcgtcgaatggatcgacctgcgcagcatgatcagcgaacgcggcaatcaggcgagtgcggcgcatggcaagaatggggtgtatcgctga

SEQ ID NO: 64591 - protein, 260 aa, Pseudomonas syringae pv. phaseolicola 1448A
MRVLALLLLTLSITGAAHAAPAEDNGKPPKAYLSLIIDDLGQNPARDSRTLALPGPVTLAIMPDTPHATEFAREAHRAGKTVMLHMPMDPATGPYAWHPELPLPELESRLNAALLKVPYAAGINNHMGSRMTAEPVAMAWLMAELQRRHLFFVDSRTSAKTVAAAEAQRIGLASVSRDVFLDDERTAEAINRQLQSAIKIARKHGSAVVIGHPYPVTLDVLERELPKLKDQGVEWIDLRSMISERGNQASAAHGKNGVYR

SEQ ID NO: 64592 - DNA, 741 bp, Pseudoalteromonas haloplanktis TAC125
  CDS (1)..(741): transl_table=11
atgaaagtaattatagggctgatattgatgcttggttttgcgtcactcaatgctaaagccaagcaaatagcgatagtaatagacgacataggctatcaccagagagatttagaactgttaactttgcctggccaagtgtcgtattcaattttgcctcacacgccttatgcacaagcttttgccactttagccagtaaaacaaataaagagttattactgcatattcccatgcaagcacttaacggcaaggagcttggccctggcgcacttacgttaaatatgaataaagagcagatacagcaaatacttggcactgctttggccagtttaccgcaagttaaaggggttaataatcacatgggatcggcgctcacccagcaaagccaagctatgaggtggataatggaagtgcttaaaaagcgacatttgtactttttagatagccgcaccactgaattaagccaggcacaaaatgccgctaactttttaggtgttgaaaatattggccgtcatatttttttagataacataaccacaccagaacagttacaactgcgcctagatgagctaaaacaacacgctactgagcataagtttgccattgcaattgcccacccctaccctgaaacaatcgcgtttttacgccacgttttaccacagctcagcaaacaaggttttgaattagtacccgtatctaagctggtagagcgtaaatatatacaactggcagagaagtactaa

SEQ ID NO: 64593 - protein, 246 aa, Pseudoalteromonas haloplanktis TAC125
MKVIIGLILMLGFASLNAKAKQIAIVIDDIGYHQRDLELLTLPGQVSYSILPHTPYAQAFATLASKTNKELLLHIPMQALNGKELGPGALTLNMNKEQIQQILGTALASLPQVKGVNNHMGSALTQQSQAMRWIMEVLKKRHLYFLDSRTTELSQAQNAANFLGVENIGRHIFLDNITTPEQLQLRLDELKQHATEHKFAIAIAHPYPETIAFLRHVLPQLSKQGFELVPVSKLVERKYIQLAEKY

SEQ ID NO: 64594 - DNA, 777 bp, Pseudomonas fluorescens PfO-1
  CDS (1)..(777): transl_table=11
atgtccttgcgtttggtctttgtcctgctgtgctgtctggcgggtgctgctcatgcagaacctgccagacccacacctcaaaaagcctacctgacactgatcatcgacgacctggggcagaacctgccccgggatcgccgggtgctggccctgcccgggccggtcacgaccgcgatcatgcccgacaccccgcacgccaccgagtttgcccgcgaggcccatcgcgccggcaaggtcgtgatcctgcacatgccgatggacccggccactggcccgttcgcctggcatcccgaactgcccatcgaagaactcgagaaacggctgaacgccgcgttcaaaatggtcccctacaccgccggcatcaacaaccatatgggcagtcgcatgactgcgcagccggtggccatggcgtggttgatgggcgagttgcagcgccgccacaagttcttcgtcgacagccggaccagcgcccagactgtcgccgcgcaacaggcacagaagatcgatctggcaagtgtttcgcgggatgtatttctcgatgacgagcgcaccgaagcggcgatcctgactcaattgcagacggcaatcagcctggcgcacaagcagggttcagccgtgatgatcggacacccttatccacagacactggcggtgctggagcgggaactgccaaagttgaaagcccaaggcatcgagtggatcgacatcaagcagatgatcagcgtgcgcagcaatcgcgccacggccgcacacggcaaaaacggtgtctaccgataa

SEQ ID NO: 64595 - protein, 258 aa, Pseudomonas fluorescens PfO-1
MSLRLVFVLLCCLAGAAHAEPARPTPQKAYLTLIIDDLGQNLPRDRRVLALPGPVTTAIMPDTPHATEFAREAHRAGKVVILHMPMDPATGPFAWHPELPIEELEKRLNAAFKMVPYTAGINNHMGSRMTAQPVAMAWLMGELQRRHKFFVDSRTSAQTVAAQQAQKIDLASVSRDVFLDDERTEAAILTQLQTAISLAHKQGSAVMIGHPYPQTLAVLERELPKLKAQGIEWIDIKQMISVRSNRATAAHGKNGVYR

SEQ ID NO: 64596 - DNA, 1188 bp, Pelobacter carbinolicus DSM 2380
  CDS (1)..(1188): transl_table=11
atggctaccaaaaaaaagaccgttcgacgaaaacgccagccgcgaaaaaagcagccggaccgcaccttcaaggttttgctggcctcattgttccttgtgggatttctcgttgtttcccttgtgttgttgacttttgtccagcgaccaccgttgccaaatcggacccccgaggtttcgccgcccgtagcgaaacaaccgccagactcggccgatacgcgggatcaggttctgcgaacctcggtgcagatagagattgaacgtgccttgtggcgtcaggggatttcctttaccgggatggatgtcgtcaccgacgatcatgttatgcattatcatctgccgtcggtgtatccgggacaggcctggtatgacggattggttagggccttggagaagcagtcttcccggctgaagttcgcatttgctgatgctcctgctcctttggtgcgcgtttccgttaacggaattccaagtttcgctctgcatttcaagcgttcccggagcaaacctgccaaagtgcgcccaaaggcccggattgccatcgtggtggatgatctcggtcgcgatcttcgcatgttgcggcggctgctggccattgatctcgatctgaccatggcagtcatgcccgaggaaccgcatacgctgcaatcggcggaactggcgcatcgcgccggtcgcgaagtgctggtgcatatgcccatggaaccggaaagctatccgcgcaacaatcccggcccgggagcgttgctgctcgggcaggatcgtttggagattgagcggcgagtaacgcgcatgtttgaaaatgtgccccatgcagtgggcggcaacaatcatatggggtcgcgttttacccaatatgccgagggcttgcagattgttttcgaggtgatgaaaaaaaacggcttgttctttgtggacagtcgcacaagtcccggatcggtggcttttctcgaagctcgtcgcgccaggattcccgcggtttcaagggatattttcctcgataacagtcagaacgtcgatgccattgcccggcagatacgtgaagcggtgaagatggctcggtcccgtggcaaggtggtggccatctgtcatccttacccacagacggtggaggctctgcagcaggaagcggcgtttttacgccagcaggatgtcgaggtggttcctgtatcgcgcttgttgcggcattga

SEQ ID NO: 64597 - protein, 395 aa, Pelobacter carbinolicus DSM 2380
MATKKKTVRRKRQPRKKQPDRTFKVLLASLFLVGFLVVSLVLLTFVQRPPLPNRTPEVSPPVAKQPPDSADTRDQVLRTSVQIEIERALWRQGISFTGMDVVTDDHVMHYHLPSVYPGQAWYDGLVRALEKQSSRLKFAFADAPAPLVRVSVNGIPSFALHFKRSRSKPAKVRPKARIAIVVDDLGRDLRMLRRLLAIDLDLTMAVMPEEPHTLQSAELAHRAGREVLVHMPMEPESYPRNNPGPGALLLGQDRLEIERRVTRMFENVPHAVGGNNHMGSRFTQYAEGLQIVFEVMKKNGLFFVDSRTSPGSVAFLEARRARIPAVSRDIFLDNSQNVDAIARQIREAVKMARSRGKVVAICHPYPQTVEALQQEAAFLRQQDVEVVPVSRLLRH

SEQ ID NO: 64598 - DNA, 963 bp, Geobacter metallireducens GS-15
  CDS (1)..(963): transl_table=11
gtggctacatctcgaaatggcaaaatcaaggtaaacagaaaaaaaggcggacgtaattctcgtcctcttgttggtttcattattcttgcagtcctggttgttgcggcggtgttccttattgatggcctgcttaatcagaagcgcccagagaaaaaaccggaacctccaaaagtcgtggcacggcataagctcccgccccgggaatccgcggcggaaaaggaacccgttgtccatgaggactatacggcgacagtggtgccgccaccgactgagcggcatgtccgcccacgtcctgccggttccggaaatctcgctatcatcattgacgacatgggaaagggtatgcaagaagcccgatcgatcattgacatcggcgtaccggtgacgttctctattatcccggggcttccgaaggtgcgtcaggttgcccaagaggcacaacggcgcgggatcgaggcaatgatccatcttcccatggagccgaaggggtatccggagcgccgtctcgaggagaacggtcttcttctcagtcagagtaacgatgagattgtggtccggatgaacggttatttcaaggaagtcccccaggcggttggcgccaacaatcacatggggtcggcattcaccgaaaacaaagagaagatggcgatagtgctgagagtgctgaaggagaaggggctgttctttgtcgacagcaagacgtcggcaatatctgtgggagagtcgactgcacgagagatgggcttgagaaccgcgtcacgatccgtctttttggacaatattcaggatgttggatatatttcgaagcagatcaggcaggctgcttccatcgctcgcaaaaggggcagcgccattgccatctgccacccccatcccgccactatccaagccttagctgcagaactgccgaagttgcgggatgagggtgtcacccttgtccccgcgtcatccctggtacactga

SEQ ID NO: 64599 - protein, 320 aa, Geobacter metallireducens GS-15
MATSRNGKIKVNRKKGGRNSRPLVGFIILAVLVVAAVFLIDGLLNQKRPEKKPEPPKVVARHKLPPRESAAEKEPVVHEDYTATVVPPPTERHVRPRPAGSGNLAIIIDDMGKGMQEARSIIDIGVPVTFSIIPGLPKVRQVAQEAQRRGIEAMIHLPMEPKGYPERRLEENGLLLSQSNDEIVVRMNGYFKEVPQAVGANNHMGSAFTENKEKMAIVLRVLKEKGLFFVDSKTSAISVGESTAREMGLRTASRSVFLDNIQDVGYISKQIRQAASIARKRGSAIAICHPHPATIQALAAELPKLRDEGVTLVPASSLVH

SEQ ID NO: 64600 - DNA, 1467 bp, Desulfovibrio desulfuricans G20
  CDS (1)..(1467): transl_table=11
atgacgacgccgtcaggctccggtggcaattttatatcacgcatcaggcgtgttctggacagattcaggtcttccacggcacagcggtccggcggagcagattccgcgggcggcctgctggccaaccgttttgtgctggcagcggtggcgtttgcctgcggcgtgctgctgaccggcgtgctgcttcttgcgtacttcagtctttccggtacggctagcgcccctgccgacgctgaacaggcacagtcgggcgaggctctgccgtctgtccgcgatctgctcgatccttcgagccttccctatgaagaatcgctgggcagctcgctggatcagaccgtcaagcaggtggactatgctttgctgcgcacgctggaacggctggatctgccccgcagggcactggggctgcagcgggtcgaagtacggtcgcacaacggagaggagtatcatttccagcagctggagataagactcggcaacggtcatgatgattttattgccgggttgcgtacggctctggccacatgggttccggccgcgactttgcagcaggccgccggtggcgcatggcgcatttcgcttgacggtgtggtgacgcatgcactggcttttgccgtgctgcaggagcaggagccgcagcttccggtcgacggacagcacagaggcacatcagaggccggcacacccttgccggaggcgcaggatgatgccggcagccccgatgcagctgtcacgggccggcccgaaagcggagccgctgcaacgcagattcaggagcgggaaaacgacctgccccgtcttgccatagtcatagatgacataggtgaaagtatgcgggctgtggagcgtcttgtggcgctggaatatccggtgacgctttccatatggccgcgtgcaacctatgcccgccgcgccgcggattacggctggcagcacgggtgcgagataatgatccaccagcccatggagccggtgggctacccccgtgtgaatccgggaccgggagccttgtttgtctccatgacaccggatcagatacatactgtgctaggcgaaaatctgggtatggtgccccatgccgtaggcataaacaaccatatgggatcgcgctttacgcaggacgatgcgggagtgcaggccgtggtggatgaactgcgcggcagaaagctgtttgtgctggacagtgtgacgcatggcggttctgtgctgtaccgtaaggcggcggcagccggattgcatgcattccggcgttcggtgtttcttgatgtggtgcgtgacaaaaaaagcattatgcaccagctggacaaagctgccggcgtggcactgcgtcagggcacggccattgccatagggcatcccacgcctgaaacgctggccgcgctggaagagtggcagcgggtgcgcagccgcaagattcagattgtcagtgtggcggggcttgataaagtgcggcatcgcaggcaataa

SEQ ID NO: 64601 - protein, 488 aa, Desulfovibrio desulfuricans G20
MTTPSGSGGNFISRIRRVLDRFRSSTAQRSGGADSAGGLLANRFVLAAVAFACGVLLTGVLLLAYFSLSGTASAPADAEQAQSGEALPSVRDLLDPSSLPYEESLGSSLDQTVKQVDYALLRTLERLDLPRRALGLQRVEVRSHNGEEYHFQQLEIRLGNGHDDFIAGLRTALATWVPAATLQQAAGGAWRISLDGVVTHALAFAVLQEQEPQLPVDGQHRGTSEAGTPLPEAQDDAGSPDAAVTGRPESGAAATQIQERENDLPRLAIVIDDIGESMRAVERLVALEYPVTLSIWPRATYARRAADYGWQHGCEIMIHQPMEPVGYPRVNPGPGALFVSMTPDQIHTVLGENLGMVPHAVGINNHMGSRFTQDDAGVQAVVDELRGRKLFVLDSVTHGGSVLYRKAAAAGLHAFRRSVFLDVVRDKKSIMHQLDKAAGVALRQGTAIAIGHPTPETLAALEEWQRVRSRKIQIVSVAGLDKVRHRRQ

SEQ ID NO: 64602 - DNA, 1095 bp, Thiomicrospira denitrificans ATCC 33889
  CDS (1)..(1095): transl_table=11
atgtcaaaaagaaaaaaagccagccctaaaaaaagctcaaattttttaagttatactgtttggagtttagcgtttgtagcaatagttttaagttcgtttgttgctgggtattatataggccatgatagcgcaaaagatgacgctcttaaaaaagagcaatcaaaagagaaaacaaaacaatcaatgataaaaaaactagaacaagagagtattaaaaaaaagagccttgaagatgagcagagcgttagtgatagactaaaagaggttctaaaaaaagagcctgctgtagctgagacattaaaagattcaaatgagagtaataaaagtaatgacagcaatgtgacatcttctctaccaattaaagaggtagtctcagagtatgaaaatgcttcacatgagattgaagaggctgttttgcctaaagctgtagagcgtaaaatagtaaaaagtttaaagagaccaaagctagcaattattattgatgatgttagtgtaaagtcacatgtaaatgctatcaaaggtcttcatttacccataactatgtcatttttgccacctagtaaagctagaccatcttctcatattttagcatctcaagagagtttttatatggttcacttgccaatggaagcacaaagctttaaatcagaagagcctcttactctaagagttgatgattcaaatgaaaaaattgtacaaagagttgtggagataaaaaaactttttccaaaagtaaaatatataaataatcatacagggagcaaatttacagcagatgaggctgctatggataggctcatatccgcactcaagaaatcagatataatctttgttgatagcagaactacaggagagtcaaaagctcaaaaaatttcaaaaaaatatgcgttagagtatataggaagagatgtgtttttggatcataagatggataaagcatatatactctcacagattaaaaaagctattgaagtggcgaaaaaacatggaagtgctatagcaataggacacccacatgcaaacacaatcgcagctataaatgaatcaaagaaactttttgcagatgttgatttagttttagtaaataagctttaa

SEQ ID NO: 64603 - protein, 364 aa, Thiomicrospira denitrificans ATCC 33889
MSKRKKASPKKSSNFLSYTVWSLAFVAIVLSSFVAGYYIGHDSAKDDALKKEQSKEKTKQSMIKKLEQESIKKKSLEDEQSVSDRLKEVLKKEPAVAETLKDSNESNKSNDSNVTSSLPIKEVVSEYENASHEIEEAVLPKAVERKIVKSLKRPKLAIIIDDVSVKSHVNAIKGLHLPITMSFLPPSKARPSSHILASQESFYMVHLPMEAQSFKSEEPLTLRVDDSNEKIVQRVVEIKKLFPKVKYINNHTGSKFTADEAAMDRLISALKKSDIIFVDSRTTGESKAQKISKKYALEYIGRDVFLDHKMDKAYILSQIKKAIEVAKKHGSAIAIGHPHANTIAAINESKKLFADVDLVLVNKL

SEQ ID NO: 64604 - DNA, 1122 bp, Magnetospirillum magnetotacticum MS-1
  CDS (1)..(1122)
atgctgatgggcaacaaggtgccgctgtgggagcgtccctcggttttggtcggcttgatgattgccgttctggtggccggtgtcgggatcggtctggtcctgggcctgtggtcggggaagtcggccaagacgcagatggccggggccgagcaggcgcccgccccggttatctccgagacgacctcgccgcctccgcctccgccgccattgccttcggccaatgaggaggcggatgacggccgtccgctgttgcagccgccgccaccccggcccgatcccggctcgtccgaggcgctggaattcgggcatgcctccgatgtggtttctctggttcccgcgcctgcgcagcccccagccagtccagaggtcaaactgcctccggccggagcggcggtgtggctgcgcaatgcccttcccgtgcccaaaaccgggggcaagccggtcatcgccatcatcatcgacgatctgggcgtcgatcgccgccgcagcgagcgcatggcccagttgaaggggcctttgaccctgtcctacatgacctatgccgaggatgtggcgcgccaatcccatgatgccagggcgcatgggcacgaactgatggtccatgtgcccatgcagccgcaaagcgcttcctatgatcccggcgccgaggtgctggaagtaggcctgccgcccgaagagatccgccgccgtctggattggggcctgtcacgctttgacggctatgtggggatcaacaaccatatgggttcgcgtttcacctccgatgcggcgggcatgcgggtggtgatggccgagttgcgccgccgtggcctggccttcatcgattccgtgacctcggaacatacggtgggtgcggagacggcgcgccattacggtgtgcctttcgcggcgcgccatgtcttcctcgacaacgaccagggtgtggcacatgtgcgcgcccaattggccaagaccgaggcctatgcccgcaagcatggggccgccatcgccatcggccatccccatgacggcaccatcgaggccctggctgggtggctgccggggctggaagcccgcggcttcgcgctggttccggtcagcaccatcatccgcatgggcaacgggacgtcatcttccccttga

SEQ ID NO: 64605 - protein, 373 aa, Magnetospirillum magnetotacticum MS-1
MLMGNKVPLWERPSVLVGLMIAVLVAGVGIGLVLGLWSGKSAKTQMAGAEQAPAPVISETTSPPPPPPPLPSANEEADDGRPLLQPPPPRPDPGSSEALEFGHASDVVSLVPAPAQPPASPEVKLPPAGAAVWLRNALPVPKTGGKPVIAIIIDDLGVDRRRSERMAQLKGPLTLSYMTYAEDVARQSHDARAHGHELMVHVPMQPQSASYDPGAEVLEVGLPPEEIRRRLDWGLSRFDGYVGINNHMGSRFTSDAAGMRVVMAELRRRGLAFIDSVTSEHTVGAETARHYGVPFAARHVFLDNDQGVAHVRAQLAKTEAYARKHGAAIAIGHPHDGTIEALAGWLPGLEARGFALVPVSTIIRMGNGTSSSP

SEQ ID NO: 64606 - DNA, 762 bp, Pseudomonas syringae pv. syringae B728a
  CDS (1)..(762)
ttgctgaccctctcgatcactggcgctgcccatgcagcgccagccgagaacagcggcaaaccgtccaaggcctacctgagcctgatcatcgatgacctgggccagaatccgcagcgcgacagccgcacactggcgcttcccggcccggtcaccctggcaatcatgcccgacaccccgcatgccaccgagtttgcccgccaggcccatcgcgcaggcaaaacggtcatgctgcacatgcccatggaccccgcgaccggtccttacgcctggcaccccgagctgccactgcctgagctggaaagccgtctcaatgctgccctgctgaaagtgccgtacgcagccggtatcaacaaccacatgggcagccggatgaccgccgagccggtcgccatgacctggctgatggccgagctacagcgtcgtcacctgtttttcgtcgacagccgcaccagcgcgaaaaccgtggcggccgccgaagcgcagcgcatcggtctggccagcgtctcgcgtgacgtattcctggacgacgaacgcactgcagaagccatcacccgccaattgcagaccgcgataaaaatcgcccgcaaatatggctcggccgtggttatcggccacccctaccctgtcacgctggacgtactggaacgcgaactgcccaacctcaaagcgcaaggcgtcgaatggatcgacctgcgcagcatgatcggcgaacgcggcaatcaggcgagtgcggcgcatggcaagaacgggatttatcgctga

SEQ ID NO: 64607 - protein, 253 aa, Pseudomonas syringae pv. syringae B728a
MLTLSITGAAHAAPAENSGKPSKAYLSLIIDDLGQNPQRDSRTLALPGPVTLAIMPDTPHATEFARQAHRAGKTVMLHMPMDPATGPYAWHPELPLPELESRLNAALLKVPYAAGINNHMGSRMTAEPVAMTWLMAELQRRHLFFVDSRTSAKTVAAAEAQRIGLASVSRDVFLDDERTAEAITRQLQTAIKIARKYGSAVVIGHPYPVTLDVLERELPNLKAQGVEWIDLRSMIGERGNQASAAHGKNGIYR

SEQ ID NO: 64608 - DNA, 813 bp, Haemophilus somnus 2336
  CDS (1)..(813)
atggggctaatcctgagcattgtatcgtcttttatttatgctcaacataaactggcgattgtaattgatgatattggatatcgtcttaaggaagataatcagatttattctctgccaaaagaagtttctgttgccattattccttccgcacctcatgctaaacaacgtgatcaacaggcaaaacaacaaaacagagatattttaattcatttacctatgcaaccgcttaatcagcaaaaaattgaagatggcggaataaaattaggtatgtcgcagccggaagtttatcagcgagtcagaaatgctaaaagtattttacctaacgctataggtatgaataatcacatgggaagtgcggcgacagccgataaagatttaatgaacaaattaatgaccgcacttttgcaacaaaatttattctttcttgatagccgaaccattgggcgatcagttgcggggaaaatagcgagagagtttggtatacccactttggaacgtcatatttttcttgatgatagtgataaacttagtgatgttcaacgccaatggaatgccgccattcaatatgctcgtaaacggggaacggctattgtgattggacatccgagaaaaaatacgattgcagttttgcaaatggggataaaacaattaccaaaagatattcaattagtgggtattggcagtttgtggcgtaatgagaagataattcctcagaaaccttttatttatctgtttaatgatatacccgcaccgacatcgcaagcaccatttcaaactattcctttgttaagaggagtaccgaccgatatataa

SEQ ID NO: 64609 - protein, 270 aa, Haemophilus somnus 2336
MGLILSIVSSFIYAQHKLAIVIDDIGYRLKEDNQIYSLPKEVSVAIIPSAPHAKQRDQQAKQQNRDILIHLPMQPLNQQKIEDGGIKLGMSQPEVYQRVRNAKSILPNAIGMNNHMGSAATADKDLMNKLMTALLQQNLFFLDSRTIGRSVAGKIAREFGIPTLERHIFLDDSDKLSDVQRQWNAAIQYARKRGTAIVIGHPRKNTIAVLQMGIKQLPKDIQLVGIGSLWRNEKIIPQKPFIYLFNDIPAPTSQAPFQTIPLLRGVPTDI

SEQ ID NO: 64610 - DNA, 774 bp, Pseudomonas aeruginosa UCBPP-PA14
  CDS (1)..(774)
atgtcggcgttccgcgttgtcctgctgggcctgtgcctgctgttcaaccaggcccaggcccgccaggaccccgtcccctaccagcgcccgccgctgctgaccgtggtcatcgacgacctcgggcagaacctggcacgcgaccgccgggtcctcgacctgccccccggcgtaaccctggcaatcatcccggaaaccccgcatgccgccgaactggcccgcgaggcgcaccagcgcgggcgcacggtgatcctgcacatgccgatggacccggccggcggtccctacgcctggcggccggagctgacccaggaagagcgtgcgcggcggctggacgcggcgctggccaaggtgccgttcgtgcagggcctgaacaaccacgagggcagccgcatgaccgcggtgcgcccggcgatggcctggctcgccgaggaactccagcgtcgcggcctgtacctggtcgacagccgcaccagcgccgccaccgtggccgccagcgaggcgcagcggatcggcctggcgagcgtctcgcgcgatgtgttcctcgacaacgaagccacaccggaagcggtctccgcacaactgcaggccggcatcgccctggcccgcaagcagggttcggcgttgctcatcggccacccgcacaaggccaccctcgacgtgctggcgcgggagctgccgaagctgcgcgcccagggcatcgagctggtaccgccgcagatgctcatcggcgagcgcggcaaccgcaacgtcaacccacgccaggcgccgcactga

SEQ ID NO: 64611 - protein, 257 aa, Pseudomonas aeruginosa UCBPP-PA14
MSAFRVVLLGLCLLFNQAQARQDPVPYQRPPLLTVVIDDLGQNLARDRRVLDLPPGVTLAIIPETPHAAELAREAHQRGRTVILHMPMDPAGGPYAWRPELTQEERARRLDAALAKVPFVQGLNNHEGSRMTAVRPAMAWLAEELQRRGLYLVDSRTSAATVAASEAQRIGLASVSRDVFLDNEATPEAVSAQLQAGIALARKQGSALLIGHPHKATLDVLARELPKLRAQGIELVPPQMLIGERGNRNVNPRQAPH

SEQ ID NO: 64612 - DNA, 843 bp, Haemophilus influenzae R2846
  CDS (1)..(843)
atgaatattctgataaaaagtgcggtaaaaaatttcattgttttttctaccgcactttatacctctttttcttttgctcaaagtaaacttgctattgtgattgatgatgtaggctatcattccaaagaagatgcggcaatttttgcgatgccgcgtgaaatttccgtagcaattattcctgctgcgccctatgctcgagcacgtaatcaagaagcaaaatctcaaggtagagatattttaatccatatgccgatgcaaccagtaagtgcagtgaaaatagaagacggtgggctgcatttaggaatgtctgcagcacaagtaaatgatcgcgttaatacggctaaaaatattgtgcgtgatgccatcggtatgaacaatcatatggggagtgcagctacggcagatccccaattaatgacttatttaatgaccgcacttcaagaaaaacatttattctttttagatagtcgaacaataggaaaatctgtagctgggaaaatagcaaaagaacaaggcgtgcgttcattagatcgccatatatttttagatgatagtaacgaattcgcagacgttcaacgtcaatttaaagcagcaattcactatgccagaaaacacggctccgccattgcaataggtcatcctcgtgcaaatacaatagcggtgttacaagcaggtcttaacaatttaccagaagatatccaacttgtcggaatgggcaacttatggcgaaatgaaaaagttattccgcccaagccatttattttattattcagcgaagtgcctgcgccaacttctatagaaccttttgagcctgtaggagtattgcgtggaattccaaaataa

SEQ ID NO: 64613 - protein, 280 aa, Haemophilus influenzae R2846
MNILIKSAVKNFIVFSTALYTSFSFAQSKLAIVIDDVGYHSKEDAAIFAMPREISVAIIPAAPYARARNQEAKSQGRDILIHMPMQPVSAVKIEDGGLHLGMSAAQVNDRVNTAKNIVRDAIGMNNHMGSAATADPQLMTYLMTALQEKHLFFLDSRTIGKSVAGKIAKEQGVRSLDRHIFLDDSNEFADVQRQFKAAIHYARKHGSAIAIGHPRANTIAVLQAGLNNLPEDIQLVGMGNLWRNEKVIPPKPFILLFSEVPAPTSIEPFEPVGVLRGIPK

SEQ ID NO: 64614 - DNA, 843 bp, Haemophilus influenzae R2866
  CDS (1)..(843)
atgaatattttgataaaaagtgcggtaaaaaatttcattgttttttctaccgcactttatacctctttttcttttgctcaaagtaaacttgctattgtgattgatgatgtaggctatcatctcaaagaagatgcagcaatttttgcgatgccacgtgaaatttccgtagcaattattcctgctgcgccctatgctcgagcacgtaatcaagaagcaaaatctcaaggtagagatattttaatccatatgccgatgcaaccagtaagtgcagtgaaaatagaagacggtgggctgcatttaggaatgtctgcagcacaagtaaatgatcgcgttaatacggctaaaaatattgtgcgtgatgccatcggtatgaacaatcatatggggagtgcagctacggcagatccccaattaatgacttatttaatgaccgcacttcaagaaaaacatttattctttttagatagtcgaacaataggaaaatctgtagctggaaaaatagcaaaagaacaaggggtgcgttcattagatcgccatatatttttagatgatagtaacgaattcgcagacgttcaacgtcaatttaaagcagcaattcactatgctagaaaacacggctccgccattgcaataggtcatcctcgccaaaatacgattgcagttttacaagcaggacttcgtaatttacccgaagatattcaattagtcggaatgggaaatttatggcgaaatgaaaaagttattccgcccaagccatttattttattattcagcgaaatgcctgcaccaacttctatagaaccttttgagcctgtaggattattgcgtggaattccaaaataa

SEQ ID NO: 64615 - protein, 280 aa, Haemophilus influenzae R2866
MNILIKSAVKNFIVFSTALYTSFSFAQSKLAIVIDDVGYHLKEDAAIFAMPREISVAIIPAAPYARARNQEAKSQGRDILIHMPMQPVSAVKIEDGGLHLGMSAAQVNDRVNTAKNIVRDAIGMNNHMGSAATADPQLMTYLMTALQEKHLFFLDSRTIGKSVAGKIAKEQGVRSLDRHIFLDDSNEFADVQRQFKAAIHYARKHGSAIAIGHPRQNTIAVLQAGLRNLPEDIQLVGMGNLWRNEKVIPPKPFILLFSEMPAPTSIEPFEPVGLLRGIPK

SEQ ID NO: 64616 - DNA, 849 bp, Actinobacillus pleuropneumoniae serovar 1 str. 4074
  CDS (1)..(849)
atgtggaatttatttcaaagtaagcagtctattttttcggttttttggcaaattttgttgctgatttcaccgcttgctcaagcgggaaaattagcgattgtgatagatgatatcggctatcgtacaaaagaagataatgcgatttacgcattgcctaaagaagtgagtgtggcaatcattcccgttgcaccgtatgcgacggcgagagcgcaaaaagcctacgaacaaaaacgggacgtgttgatccatttaccgatgcaaccgaaaaacagacatcaaccgattgaatcgggggcgctaatggtcggggcaagtaaagaaaacgtcgctcgcttaattcaagccgctcgtaatcaagtgccttatgccatcggtttgaataaccatatgggaagcggtgcgacggcggatcgtcaaacgatggagcatttaatgacggagttgtctaaacaacaacttttctttcttgacagtaaaaccggtccgagcgttgcggcaaaagtcgcccgtgaattaggggtaaacgccttggaaagaaacttatttttagatgataacgatgcgttgcacgaagtgcagaatcagtttcatcttgctttacattacgctcgaaaacacggtagtgcgattttaatcggtcacccgcgtaaaaacagtatcgaggtcttagaaaaaggtttggcaaacttacccgaagatattcaattagtcagtatgggcagcttgtggcgtaatgatactgtcgtgccgaaaacaccgtttattatggtgtttgacgatatgcccgcgccgacttccgtcgccccttttaacgtcgtaccgctattaagaggcgtaccacaagattaa

SEQ ID NO: 64617 - protein, 282 aa, Actinobacillus pleuropneumoniae serovar 1 str. 4074
MWNLFQSKQSIFSVFWQILLLISPLAQAGKLAIVIDDIGYRTKEDNAIYALPKEVSVAIIPVAPYATARAQKAYEQKRDVLIHLPMQPKNRHQPIESGALMVGASKENVARLIQAARNQVPYAIGLNNHMGSGATADRQTMEHLMTELSKQQLFFLDSKTGPSVAAKVARELGVNALERNLFLDDNDALHEVQNQFHLALHYARKHGSAILIGHPRKNSIEVLEKGLANLPEDIQLVSMGSLWRNDTVVPKTPFIMVFDDMPAPTSVAPFNVVPLLRGVPQD

SEQ ID NO: 64618 - DNA, 630 bp, Bacillus cereus G9241
  CDS (1)..(630): transl_table=11
atgttatcacttcctattccactaactgttgctgttatgccttttcttccttccacaaaggaagatgcgatagcggctcataagaaaggacacgaagttattatacatatgccaatggagccgattaaaggtaaaaaagaatggcttggaccaaaagcaattacaactgatttaagcgacgaagaaataaacaaccgactcgaacaagcgattcaagaagtaccacatgcaattgggatgaataatcatatgggatcaaaagtgactgcggacgaaagaattgtacgacttatacttgcagcttgtaaaaaacacggtttattttatttagatagcaaaacaaatcctaagagtgtcgtcccaaaaatcgggaaagaattaggagtgccaattattgaaaatcaattattttttgatgacgtgtacacagcggcacatatttcaaaacaagcccaattactcattaaaaaacttcaagaaaaaccgattatggtagctatcggacatgttgggcctccaggtgaaattacatcacgtgttatagaaacttctattcctaaaattcgtgaacatgcagattttatttttttatccgatttagcattatctccgcctcctgtttcaaaataa

SEQ ID NO: 64619 - protein, 209 aa, Bacillus cereus G9241
MLSLPIPLTVAVMPFLPSTKEDAIAAHKKGHEVIIHMPMEPIKGKKEWLGPKAITTDLSDEEINNRLEQAIQEVPHAIGMNNHMGSKVTADERIVRLILAACKKHGLFYLDSKTNPKSVVPKIGKELGVPIIENQLFFDDVYTAAHISKQAQLLIKKLQEKPIMVAIGHVGPPGEITSRVIETSIPKIREHADFIFLSDLALSPPPVSK

SEQ ID NO: 64620 - DNA, 1299 bp, Rhodospirillum rubrum
  CDS (1)..(1299)
atgcttgatcatcccgaagaccggggagtcctcgatcgcttcgcctttttcgtcgcccgcatggcccccctgaccctggttctggtcgccctcgccaccttggcggtcggattgggcattggtttcgccgttggccgactggcccagggcgacaaggcggcgcctcccgcgcccaccgccctggcggcgatcggtccgctgcccgttgctccggcggccggcgaggcggcccatcagtatcaaccgccgccgctgccccgtcccgccgagaccgcgcccccccttccggccgacgtcgcccccccggtgcaaacggcgcccgccccctcggagacgccggccggcgaaaagggcgcgcttccggccgaatttcgcgacctgctggccagcgacggtccgggcttcgtcatggaggaacgccttcccgacgatgcctatgttcacaagccccaggtcaagccgaccgtcaagaccgccgccctggccccggtcccgcgctttcccgagggaccggcggagtccagcgggctgccctggaagacctatggcgtggcggcgggcaaatggagcaagccggcgatcgccctggtgatcgacgatatggggctggaccgggtgcgtacggaaaaggtccgcaagctggccggacctttgaccctggcctatctcgcctatgccgacgggctggccggacagatgcgcgggggccgcaaggccggccacgagatcttgatgcatatgccgatggagccccttgacgccaaggtcaatcccggacccggggcgttgaaggtcggtttgtccgatgacgagatcctgacccgcctgcgccgcaatcttgacggcggcgccgaattcgtcggtatcaacaaccacatgggcagccgcttcaccgccgacagccggggcatgaccctggtcatgggcgaattgaaaaagcgcgggctgctgtggctggattcgatgacctcggccaattcggtggggctgaccttggccgaaatggccggcgttccccatatcggtcgcacggtgtttttggataacctcaacgatcaggccgcggtcgcccgccagctcgccaagcttgaggccgccgcccgccagcacggcgtggcggtgggcatcggccacccccgcgacggcaccatcggcgcgctgagcgtctggttgcccgccctggccgccaagggcatcaccctggtgccgatcagcgccctggtgacgaccaaggacgccgagctcgcccatgcgcggcccagcggcaagacagcctcgacatccccgtcaaccgactga

SEQ ID NO: 64621 - protein, 432 aa, Rhodospirillum rubrum
MLDHPEDRGVLDRFAFFVARMAPLTLVLVALATLAVGLGIGFAVGRLAQGDKAAPPAPTALAAIGPLPVAPAAGEAAHQYQPPPLPRPAETAPPLPADVAPPVQTAPAPSETPAGEKGALPAEFRDLLASDGPGFVMEERLPDDAYVHKPQVKPTVKTAALAPVPRFPEGPAESSGLPWKTYGVAAGKWSKPAIALVIDDMGLDRVRTEKVRKLAGPLTLAYLAYADGLAGQMRGGRKAGHEILMHMPMEPLDAKVNPGPGALKVGLSDDEILTRLRRNLDGGAEFVGINNHMGSRFTADSRGMTLVMGELKKRGLLWLDSMTSANSVGLTLAEMAGVPHIGRTVFLDNLNDQAAVARQLAKLEAAARQHGVAVGIGHPRDGTIGALSVWLPALAAKGITLVPISALVTTKDAELAHARPSGKTASTSPSTD

SEQ ID NO: 64622 - DNA, 621 bp, Geobacter metallireducens GS-15
  CDS (1)..(621): transl_table=11
atgcaagaagcccgatcgatcattgacatcggcgtaccggtgacgttctctattatcccggggcttccgaaggtgcgtcaggttgcccaagaggcacaacggcgcgggatcgaggcaatgatccatcttcccatggagccgaaggggtatccggagcgccgtctcgaggagaacggtcttcttctcagtcagagtaacgatgagattgtggtccggatgaacggttatttcaaggaagtcccccaggcggttggcgccaacaatcacatggggtcggcattcaccgaaaacaaagagaagatggcgatagtgctgagagtgctgaaggagaaggggctgttctttgtcgacagcaagacgtcggcaatatctgtgggagagtcgactgcacgagagatgggcttgagaaccgcgtcacgatccgtctttttggacaatattcaggatgttggatatatttcgaagcagatcaggcaggctgcttccatcgctcgcaaaaggggcagcgccattgccatctgccacccccatcccgccactatccaagccttagctgcagaactgccgaagttgcgggatgagggtgtcacccttgtccccgcgtcatccctggtacactga

SEQ ID NO: 64623 - protein, 206 aa, Geobacter metallireducens GS-15
MQEARSIIDIGVPVTFSIIPGLPKVRQVAQEAQRRGIEAMIHLPMEPKGYPERRLEENGLLLSQSNDEIVVRMNGYFKEVPQAVGANNHMGSAFTENKEKMAIVLRVLKEKGLFFVDSKTSAISVGESTAREMGLRTASRSVFLDNIQDVGYISKQIRQAASIARKRGSAIAICHPHPATIQALAAELPKLRDEGVTLVPASSLVH

SEQ ID NO: 64624 - DNA, 987 bp, Desulfuromonas acetoxidans DSM 684
  CDS (1)..(987): transl_table=11
atgactcagaaaaaacgtaaaaaagcgccgacaaaaaagaagacagccgcaaaaaaaaaccataacaaccgcctgtcctggctcagtcacccgttaaccgcgctggcgtttctgctgctattgctgcttgtcggcggctatattattacccgctggtcgctccccgagccagtgccacaacagcagccacagccggtcatcacctatccaatggaagagtatcctgcagaagtagacaagccgcaaccgccccagatcactccgccggatcatgtccccaaggtagccatcatcatggatgatatcggcatcaatcgcgcagccgcgcttgacgccctgcaattgcagatgccgctggccctggctatcattcctggcgaagcccattcgacggagattatgaatctggcttatcagcagcacagcgagattttgatccatatcccgatggaaccagtcagttatcccaaaaacaatccaggccccttggggctctttgttcatcaatctgacagtcagatcaaacggcggattgacgatattattaccgccctcccctatgccattggcggcaataaccatatgggctctgagtttacccagcatgctgacaagttgcgcccggtgctgctggccctgaagcaatcagggctgttctttgtcgacagcctcaccagcaaagattccgtcgcctaccaacaggcgcaaaaactgggtctgagctgtgcattgcgcgatgtttttctcgacaatgtgcgccaggtcgaaccaattctttttcaactcgaccgcttggtcaccttggcccaccgtcacggcagtgctatcgccatctgccacccgtacccgcaaacaattgaggcgttgcagcagtttattgccgacccacaacgttttgatgttgaaatcgttccaatcagccaacttgtccatccacctgtgccaagctctgacaaacacactgccgccccggccgttcatcattaa

SEQ ID NO: 64625 - protein, 328 aa, Desulfuromonas acetoxidans DSM 684
MTQKKRKKAPTKKKTAAKKNHNNRLSWLSHPLTALAFLLLLLLVGGYIITRWSLPEPVPQQQPQPVITYPMEEYPAEVDKPQPPQITPPDHVPKVAIIMDDIGINRAAALDALQLQMPLALAIIPGEAHSTEIMNLAYQQHSEILIHIPMEPVSYPKNNPGPLGLFVHQSDSQIKRRIDDIITALPYAIGGNNHMGSEFTQHADKLRPVLLALKQSGLFFVDSLTSKDSVAYQQAQKLGLSCALRDVFLDNVRQVEPILFQLDRLVTLAHRHGSAIAICHPYPQTIEALQQFIADPQRFDVEIVPISQLVHPPVPSSDKHTAAPAVHH

SEQ ID NO: 64626 - DNA, 756 bp, Shewanella baltica OS155
  CDS (1)..(756): transl_table=11
gtgcgcttactttattccttggccctattggccctaagcatttctcaaagtcatgctgcccagattgcgctcattattgatgacataggttatcgtcataccgatcaagccgtgctggcactgcccagcacagtgacgctctctgtgttgcctcatactcctcttggcgaagaactcgccaatgctggccataaaaagggccacgaaatcatgctgcatctgcctatgcaagcacttaatggtaaggcgttagggctgggtggattgaccaatactatgactgaggcacaaatccgcgccagtgttgtcgatgcaattaacagcgttccttttgctaaaggtgccaataaccacatggggagcttactgactcaactcgatgatcctatgctttggattatggaaaccctcaaacaaaagcatctgtattttatcgatagtatgacaacaagattcactaaggcgggagagacagcggatcagttgggcgtgccgttattaaaacgccaactgtttctagacaatgataccagtgctaaagcactcgaaagacaatttaacttaatgataagtcaggcacatactcaaggtaacctagtggcgattgcccatccttatccagaaaccatgcgcttcttaaaggccaatctacaaagactaaaaaccgaggggattgatctagtacctgcatcaagcttactccccatcggcattgcacacaaaaatggaactaatccagctgtaacactgagatag

SEQ ID NO: 64627 - protein, 251 aa, Shewanella baltica OS155
MRLLYSLALLALSISQSHAAQIALIIDDIGYRHTDQAVLALPSTVTLSVLPHTPLGEELANAGHKKGHEIMLHLPMQALNGKALGLGGLTNTMTEAQIRASVVDAINSVPFAKGANNHMGSLLTQLDDPMLWIMETLKQKHLYFIDSMTTRFTKAGETADQLGVPLLKRQLFLDNDTSAKALERQFNLMISQAHTQGNLVAIAHPYPETMRFLKANLQRLKTEGIDLVPASSLLPIGIAHKNGTNPAVTLR

SEQ ID NO: 64628 - DNA, 546 bp, Shewanella amazonensis SB2B
  CDS (1)..(546): transl_table=11
atgctccacctccccatgcaatcattgaacgccagacctttgggtcagggcgggcttaccagtgatatggatgaacaggaaatcaagcgcaaagtggatgatgccatggtgagaattccctttgccaagggggcaaataaccacatgggtagcatgttgacacagctcgacagccatatgctgtgggtgatggagcggctgaaacacaacaatttgtattttgtcgacagcttaacgaccaggtacagcaaggccggggctaaagccgaacaggtgggagtgcctttacttaaacgccacgtgtttctcgataatgacaccagtaaacgcggcctggaaaagcaattcaaacttatgatggagcaggctcaccagcagggatttgtagtggctatcgctcaccctcatcccgcaacggtaaaattcctcaatgccaacctacaccggctccgggatgaagggataaatctggtacctacgtctgagctgctgccatatcgcctcgcccagaagcaagggactagcccagctgtaagattgaaatag

SEQ ID NO: 64629 - protein, 181 aa, Shewanella amazonensis SB2B
MLHLPMQSLNARPLGQGGLTSDMDEQEIKRKVDDAMVRIPFAKGANNHMGSMLTQLDSHMLWVMERLKHNNLYFVDSLTTRYSKAGAKAEQVGVPLLKRHVFLDNDTSKRGLEKQFKLMMEQAHQQGFVVAIAHPHPATVKFLNANLHRLRDEGINLVPTSELLPYRLAQKQGTSPAVRLK

SEQ ID NO: 64630 - DNA, 1542 bp, Magnetococcus sp. MC-1
  CDS (1)..(1542): transl_table=11
ttgaaccctctccaacatgtcacctctgacactggacaacacggtggggtccgctgggatttcctggcgggcaccctcttggtggttggtctggtgggatttcttgcctacctttgggtagctggtccttgggctcaactggagcctgagtataacctacatgcttgggcagaaggttcgttgcccagggcagagttgcggcatgccgttgccagtgcagcggttggccgcacggatgggcttgagcatggcattgttacagcggctttgcagcttaacgcgcgggcggatagcaagagcccagtgcgtggtggggaggctgagcccattgaaagggtgccaagcaaccccgacacgggccaggccgaagagcggctgggtaaggcggttaagggagagcctacaataaccccgactgaggtgccagagagagcacagccgagccaagccaacactcaaggggtcgccgccgatagccaagttgaagaagaggccgatacggttctaaaggcgacacccagcgaggcgagcagcgagcctgccaccaaggctgcaacggatctggagcaggcaaaacccacccccgcagagctggaagagcaacccagcgtagagatagaagcggatggcgaaaagggtggtctagggccgtctgccacaccagcgacacagccgttggtgcccagcgaaacggccaaagcccatggggatgacaaatctcaccccaaatccgagagcaagtcggacattctctacgaagagcatctctccgaagatttggataagcccgaaccccccgctgtggtagaaaaaaagcccgtacctgccaaacatagccacatggtcaagattgccgtcatcattgatgatcttggctataatggtggggtagggcggggcattgtctccttaccggcagatattaccctagcggtcttgccgggcgggccttactcccgtcagctggtgaatatggcccacaaaaaggggcaggagattatactgcaccaacccatgcagccccagggctatccccgtgttaacccaggccctggcgccctgctagagggtatggatgcggatgaaattgcggaggttttaaaccacaatttagagcgctttcctgaagttgtgggtattaataaccatatgggttctgccttgaccgaaaatcgcgtcatcatgaatgatgtgatgaaggtgttggttaaacgggagctctactttattgacagccgtacctcgccccgttcggtggcgtatcgtgcggcgctctcccatggtgtgccgcgtgccaagcgctcggtttttctggataacaaacgcaccgttgccgccattttaaagcgcttgcaagaggccgaagagatcgccaaacggagcggttcggccatcgccattgggcacccttatggggtgacgttgcaagcactcaagcagtggttgccgggcttacaagctcggggtattgtggtggtgcgggcctccaatctgctggtacccgaatcctcacgaaaatggtttaaaccggccagtccctag

SEQ ID NO: 64631 - protein, 513 aa, Magnetococcus sp. MC-1
MNPLQHVTSDTGQHGGVRWDFLAGTLLVVGLVGFLAYLWVAGPWAQLEPEYNLHAWAEGSLPRAELRHAVASAAVGRTDGLEHGIVTAALQLNARADSKSPVRGGEAEPIERVPSNPDTGQAEERLGKAVKGEPTITPTEVPERAQPSQANTQGVAADSQVEEEADTVLKATPSEASSEPATKAATDLEQAKPTPAELEEQPSVEIEADGEKGGLGPSATPATQPLVPSETAKAHGDDKSHPKSESKSDILYEEHLSEDLDKPEPPAVVEKKPVPAKHSHMVKIAVIIDDLGYNGGVGRGIVSLPADITLAVLPGGPYSRQLVNMAHKKGQEIILHQPMQPQGYPRVNPGPGALLEGMDADEIAEVLNHNLERFPEVVGINNHMGSALTENRVIMNDVMKVLVKRELYFIDSRTSPRSVAYRAALSHGVPRAKRSVFLDNKRTVAAILKRLQEAEEIAKRSGSAIAIGHPYGVTLQALKQWLPGLQARGIVVVRASNLLVPESSRKWFKPASP

SEQ ID NO: 64632 - DNA, 738 bp, Shewanella denitrificans OS-217
  CDS (1)..(738): transl_table=11
atgtttattcagcccgtatttggggcaaaacttgcgatcatcattgacgatataggctatcgtcaaaccgatgaagccgtattgtctctaccaaataccatcactctctctgtattgcctcataccccattaggacaaaagttagctcaagatggccataaaaaaggtcatgaaatcatgctgcatttacccatgcaagcgctcaatggcaaagagttaggcccaggtggcctcaccaatgtcatgacagaagggcaaattaaacagcagctccattctgccgttagcagcataccttttgctaaaggggcgaataatcatatgggcagtttactgactcagatgcaggatccaatgcgctgggtaatggaaagtctgaaacaaaacaacttatactttgtcgatagcatgacaacccgcttcaccaaggccactgccagcgcacagtcattgggggtgcccactttaaagcggcagatatttcttgataatgatatcagtgaggccgcgctgcaacgtcagtttaatttgatcatggttaaggcgaaacaagagcaacaagtcatagccattgcccacccacatccagaaaccatacgctttcttaaagccaatttagctcgacttgagcaagcgggaatagaattagtgcacacctcacacttgttgcctgaaatcgatgcaaaccaattaatggcaagtggaagtaacgctaattcaagcttaatattgaaatag

SEQ ID NO: 64633 - protein, 245 aa, Shewanella denitrificans OS-217
MFIQPVFGAKLAIIIDDIGYRQTDEAVLSLPNTITLSVLPHTPLGQKLAQDGHKKGHEIMLHLPMQALNGKELGPGGLTNVMTEGQIKQQLHSAVSSIPFAKGANNHMGSLLTQMQDPMRWVMESLKQNNLYFVDSMTTRFTKATASAQSLGVPTLKRQIFLDNDISEAALQRQFNLIMVKAKQEQQVIAIAHPHPETIRFLKANLARLEQAGIELVHTSHLLPEIDANQLMASGSNANSSLILK

SEQ ID NO: 64634 - DNA, 717 bp, Shewanella frigidimarina NCIMB 400
  CDS (1)..(717): transl_table=11
atgcccgctacagcgactaaattagccattatcattgacgatattggttatcgcctaactgacgaagcagcattgtcattaccaagctcgatcactttatcggtattacctcatactccgctaggacaaaaacttgcgcaagatggttatcataaaggtcatgaaataatgttacacctgccaatgcaagccttaaatggcaaagcgttaggaccaggaggattaaccaatgacatgaatgaggcacaaattaaacaacagttacaaagcgcgttctctaatatcccatttgctaaaggggcgaataatcatatgggcagtttactgactcaaatggatgaaccgatgttatgggtaatgcagagtttaaaacaacagcagttattttttgtcgatagctttaccactaaatacaccaaagccagcagcaaagctatgcagcttggagtgccatcactgagaagacatatatttttagataacgacattggtgagcgtgcacttgaacggcaattccaacaaatgattacgcagtcgaaacaacaaggtaagctggttgttattgcgcatccttacccagaaaccattcgatttttaaacgctaatttagctcgtttaaacgataatgacatcacattagtaccaacatctcaattatttgatgacgtgaatgtggcagtagcaagtcatcctaatccaactgcaacactgaaatag

SEQ ID NO: 64635 - protein, 238 aa, Shewanella frigidimarina NCIMB 400
MPATATKLAIIIDDIGYRLTDEAALSLPSSITLSVLPHTPLGQKLAQDGYHKGHEIMLHLPMQALNGKALGPGGLTNDMNEAQIKQQLQSAFSNIPFAKGANNHMGSLLTQMDEPMLWVMQSLKQQQLFFVDSFTTKYTKASSKAMQLGVPSLRRHIFLDNDIGERALERQFQQMITQSKQQGKLVVIAHPYPETIRFLNANLARLNDNDITLVPTSQLFDDVNVAVASHPNPTATLK

SEQ ID NO: 64636 - DNA, 1293 bp, Syntrophobacter fumaroxidans MPOB
  CDS (1)..(1293): transl_table=11
atgccgtcaaggtcgggaccggctcgaagaggagcctctaaagggcgtggtgtatcctcgcgcaaaggtggagggcgctcgccccggaaaaccctgaggagcgccgggaaagccacccggggaaagtcattctccgcgggtatgccgcggtcccgttttctcccgctgctgaccgtctggtttctggccgttctggctcttgcgtccctgctctactggaacggcgggaccgaaaaaccgcctccgaagccggccgcaaacaaggcaacctccacggggcaatcctccgtcccgaaacctcgaatggccgatccgcccgccaaacagccggaagccggccccgtcgccggcagtcgaacgccttctccgaaaggcggagaaccgggcgggaaggagcctggaacgcgagagcccgccaggacgaccgcgccggcgggaaaaccgctcatcgagcctccgcccccgtttcacagtcgagacatccccatcgaccaaccgaaggagccggctcgcaaacctgattcgataacgctttcggcgctcagaccgggtgttccccccggcacggcgcctcccccgccttcgcctgtacccgcccccgtggcgaaggtggccatcgtcatcgatgatttcggtcagaacctggaagtcgcaaagaagttcctgagcatccccttgccgctctcgtttgcgatcctgccaaatcagcgccacaccgccgaaatcgctgaactggcacatgcgcaccaccgcgaagtgctgctccacctccccatggagccacagggatatcccaagatggatcccggatcgggggcacttctcacctccatgtccaggggcaggctccggcgcactcttctcgccgccctcgattccactccttattttatcggagtgaacaatcacatgggctccaagttcaccgagaacaccccttccatgagagtcgtcatgtcggagctccggcacaggaagctcttctttctggacagcgccaccaccggagacagcgtcggtttcgcgctggcccgggagtacggcatcccggccagaaaacgcgacatttttctcgaccacaccctgacggatgaggccgtgcagtcccaggtcgatcagctcatcaggaaggcgaagatcgaaggaaccgctctggccatcggccatccacacgaggtgaccttgaaggcactcatcgaaggggtggaccgttttaaggaggagaacgtcgccgtggttccttcgagcgaattgatgatcgtcccctcgcgccgggttggaggaagggattga

SEQ ID NO: 64637 - protein, 430 aa, Syntrophobacter fumaroxidans MPOB
MPSRSGPARRGASKGRGVSSRKGGGRSPRKTLRSAGKATRGKSFSAGMPRSRFLPLLTVWFLAVLALASLLYWNGGTEKPPPKPAANKATSTGQSSVPKPRMADPPAKQPEAGPVAGSRTPSPKGGEPGGKEPGTREPARTTAPAGKPLIEPPPPFHSRDIPIDQPKEPARKPDSITLSALRPGVPPGTAPPPPSPVPAPVAKVAIVIDDFGQNLEVAKKFLSIPLPLSFAILPNQRHTAEIAELAHAHHREVLLHLPMEPQGYPKMDPGSGALLTSMSRGRLRRTLLAALDSTPYFIGVNNHMGSKFTENTPSMRVVMSELRHRKLFFLDSATTGDSVGFALAREYGIPARKRDIFLDHTLTDEAVQSQVDQLIRKAKIEGTALAIGHPHEVTLKALIEGVDRFKEENVAVVPSSELMIVPSRRVGGRD

SEQ ID NO: 64638 - DNA, 1029 bp, Pelobacter propionicus DSM 2379
  CDS (1)..(1029): transl_table=11
gtgtctaaaatcagaccaaaccgtaagaaccagagccggggcggcggcccaacctatgccgccctggccatcctggccgttgtcattctcgccgtcatcggttacctgctgctcaccccgcgcaagcgcccgttccagccgctgtccccgccggtggccgggaaagagtcccggcccaaggtgcaccgtcccggtcagcgggcggacctgccggcgcctccccgggttacaccggaaacgctccccgcgacaccgccgtccgtgcctcccgaaacgcctgtaaaaccgcccctgaaaccggagtatccggcggaaccgccgtcagaggtggagaaggcgcccctgcccgccgtggtgccggggggcaaggggaggctggccatcattatcgacgatatgggggccggcatgcgggaagcccgctcccttgccgccatcggcgtgccgctgacgtttgcgatcatccccggtttgcgcagttgtcgtgaggtggccgcctttgccgcgggaaacggcattgaaaccatgatccatctgccgatgcagtccaaggggtggccgcagcagcggctggaatccaacggcctcttggttgccatggaggaagccgacatcagggaacggatggaaggttttgccagggatgttccccatgccgtgggagccaacaaccatatgggctcggagttcaccgagcatgaaccgcagatgtccacggtgctgggggtgttgaaggggagggggctcttcttcatcgacagtgtcaccaccccccggagcgtggggcagcgtctggcgcgggagatgggagtgcgatcggggcggcgcagcgtgttcctggataacgagcagaacggtgcctacataagggggcagctgaaccaagcggtgcgtcaggccaggaaaaacggcggcgccatagccatctgccatccccatccggctacaattgcaaccctggcagctgcgctcccgacattacagcagcagggggtcaccctggtgcccgcctcacggctcgtgagatga

SEQ ID NO: 64639 - protein, 342 aa, Pelobacter propionicus DSM 2379
MSKIRPNRKNQSRGGGPTYAALAILAVVILAVIGYLLLTPRKRPFQPLSPPVAGKESRPKVHRPGQRADLPAPPRVTPETLPATPPSVPPETPVKPPLKPEYPAEPPSEVEKAPLPAVVPGGKGRLAIIIDDMGAGMREARSLAAIGVPLTFAIIPGLRSCREVAAFAAGNGIETMIHLPMQSKGWPQQRLESNGLLVAMEEADIRERMEGFARDVPHAVGANNHMGSEFTEHEPQMSTVLGVLKGRGLFFIDSVTTPRSVGQRLAREMGVRSGRRSVFLDNEQNGAYIRGQLNQAVRQARKNGGAIAICHPHPATIATLAAALPTLQQQGVTLVPASRLVR

SEQ ID NO: 64640 - DNA, 885 bp, Actinobacillus succinogenes 130Z
  CDS (1)..(885): transl_table=11
atgagccgtttattcccgcttccatccgtcaaaagtgcggtcaaaaaaattaccgttttttcgaccgcacttttctccttgtctgtttcggcacaaccagcccgatttgttgcggctcaaccgcacaaacttgccatcgtaatcgatgatataggttatcatccgaaagaagacgcacaaattctcgctatgccgaaagcggtttcggtggcgattattcccgttgcgccttatgcggcacagcgcaaccgacaagcgtggcagcaaggacgggatattttaatccatatgccgatgcagcccgtgaataatatgaaaatcgaagaaggcggtttatcggtcggcatgtcgcaacaggaagtggaacaacgggttcaacgcgccaaacagatcgtcagccatgctatcggcatgaacaatcatatgggcagcgccgctaccgccgatcccacattaatgacccgtttgatgcgtattttgcagcgacaggggctgttctttttggacagtcgaaccatcggaaaaagcgtcgccggcaaaatagcgaagctggagggcgtgagtgtactggaacgtcatgtttttctggatgacagtgataatttcggcgatgttcagcgtcaattccaacgggcattacaacatgcccgtcaacacggcgtagcgattgttatcggccacccgcgtaaaaataccatcgcggtactgcaggcggaattacggcatttaccggcggatatccaattagtcggtatgggacagctgtggcgcaacgaaaaagtcacgccgccgaaaccgtttattttactgttcagcgatttaccggcgcctacttcgcaaccgccgtttaaatacgaacctctgctgcgcggcgtgccgcaataa

SEQ ID NO: 64641 - protein, 294 aa, Actinobacillus succinogenes 130Z
MSRLFPLPSVKSAVKKITVFSTALFSLSVSAQPARFVAAQPHKLAIVIDDIGYHPKEDAQILAMPKAVSVAIIPVAPYAAQRNRQAWQQGRDILIHMPMQPVNNMKIEEGGLSVGMSQQEVEQRVQRAKQIVSHAIGMNNHMGSAATADPTLMTRLMRILQRQGLFFLDSRTIGKSVAGKIAKLEGVSVLERHVFLDDSDNFGDVQRQFQRALQHARQHGVAIVIGHPRKNTIAVLQAELRHLPADIQLVGMGQLWRNEKVTPPKPFILLFSDLPAPTSQPPFKYEPLLRGVPQ

SEQ ID NO: 64642 - DNA, 771 bp, Bacillus thuringiensis serovar israelensis ATCC 35646
  CDS (1)..(771): transl_table=11
atgcgaaaatatacgattacattgttcatcattgttttgtttttaccgtccttcttatttcctattcaagcaaatgctcatacaaataaagttgctattgtcattgatgatttcggcaataatatgaaggggactaatcaaatgttatcacttcccattccgctcactgttgctgttatgccttttcttccttccacaaaagaagatgcaatagctgcccataaaaaaggccatgaagttattatacatatgccaatggaacctattaaaggtaaaaaagaatggcttggaccgaaagcaattacaaccgatttaagcgatgaagaaataaacaaccgacttgaacaagcgattcaagaagttccgcatgcaattggaatgaacaatcatatggggtcaaaagtaacagcggatgaaagaattgttcgccttatacttgctgcttgtaaaaaacacggtttattttacttagatagtaaaactaatcctaatagtgtcgtcccaaaaatcggaaaagaattaggagttcctattattgaaaaccaactattttttgatgatgtgtatacagcaggacatatttcaaaacaagcccaattactcatcaaaaaaattcaagaaaaacctattatggtagctatcgggcatgtgggccccccaggtgaaattacatcacgagttattgaaacttctatccctaaaattcgtgagcatgcagactttatttttttatctgatctagcattatccccgcctcctgtttcaaaataa

SEQ ID NO: 64643 - protein, 256 aa, Bacillus thuringiensis serovar israelensis ATCC 35646
MRKYTITLFIIVLFLPSFLFPIQANAHTNKVAIVIDDFGNNMKGTNQMLSLPIPLTVAVMPFLPSTKEDAIAAHKKGHEVIIHMPMEPIKGKKEWLGPKAITTDLSDEEINNRLEQAIQEVPHAIGMNNHMGSKVTADERIVRLILAACKKHGLFYLDSKTNPNSVVPKIGKELGVPIIENQLFFDDVYTAGHISKQAQLLIKKIQEKPIMVAIGHVGPPGEITSRVIETSIPKIREHADFIFLSDLALSPPPVSK

SEQ ID NO: 64644 - DNA, 948 bp, Pseudoalteromonas atlantica T6c
  CDS (1)..(948): transl_table=11
atggccacaatcaagctttactgcatcaggccggtgataccgtggccgctggtgagcccattgcgcttgttggtcaaagtggcgggcaaacctcccctaatttatattttgaaattcgctacaagggcgaccctgttaaccccacgcaatggattaagctttaatgggcgctctggtcatatgttgaacttttcattccgcctctggtgcatatcgctcttgctgactttgctcccgacttcggcggcgctaagcgcgcagatcgctattatcattgatgacgttggtaacaacagtcatcgagatgcagcagccttggggttacccattaacgttgctatttcgattttgcctcacaagcatctaagccaaaaatacgccctgatggcgcacgagcagcaccgagaattcctactgcacatgccgatggagtcgatggcgggtatcaagcaagagtcaaacgtgttgttggccagtatgagcgataagcggattgtgcaaaccttaaatgatgcgtttgccagtgtgcccaatgcactgggattgaataatcatatggggagtcgtttaacacagttagaaaccccgatgcgcaccaccatgagctacttacatcgtcacgggctcatttttgtcgacagtcgcacaacggcattgacccgagcagaagctattgccaagcaaacgaaggtgccagcactgcggcgacatgtattcttggataacgacttatccgaagcaaaaatagagcgccagtttaatatattggtcaaaagagcgcgtaaatacgggcgctctctggcgattggtcaccctcatatgcagacgattgcctacctgaaaaaaaggctaccaacgttagcccaagacgatgtacagttaattcccctcagtgctatgttgacgccccaagtggataacgctaaaccgctgcatataggtgattag

SEQ ID NO: 64645 - protein, 315 aa, Pseudoalteromonas atlantica T6c
MATIKLYCIRPVIPWPLVSPLRLLVKVAGKPPLIYILKFATRATLLTPRNGLSFNGRSGHMLNFSFRLWCISLLLTLLPTSAALSAQIAIIIDDVGNNSHRDAAALGLPINVAISILPHKHLSQKYALMAHEQHREFLLHMPMESMAGIKQESNVLLASMSDKRIVQTLNDAFASVPNALGLNNHMGSRLTQLETPMRTTMSYLHRHGLIFVDSRTTALTRAEAIAKQTKVPALRRHVFLDNDLSEAKIERQFNILVKRARKYGRSLAIGHPHMQTIAYLKKRLPTLAQDDVQLIPLSAMLTPQVDNAKPLHIGD

SEQ ID NO: 64646 - DNA, 861 bp, Alkaliphilus metalliredigenes QYMF
  CDS (1)..(861): transl_table=11
atgaagaaaaaaggctatattttttacatttcaaaacaaaatttaaattttatacttgtaacctgtcttgtgctaggtttttttactgggggaatgaggattcaaagaaatgagcaaaatcccttgtggatgagtagagaggcaagtgtaattgaggagactgtagcagagacaaaggggatcgtcgcgattgtcattgatgattttggcaataatggtagcggcactgatgaaatgatgaacattatccaaccccttaccttcgcagtcattccctttttaccatactcacaagaagaagctaaaagagctaataaggctggacatgaagtgattgtacatattcctatggaacctaaaaaaggaaatccaaagtggttaggagacaggggcattacatcgaatctaacttcagaggaggtacatagcattgtcttagaagccatagaggatgttcagtatgccgtaggagcaaacaatcatatggggtcaaaaataacagaggacaagaggattatggaagcagtcatgcaagtgttaaaggccaatgatatgtatatgattgacagcaagacaagtcagacatccatagtcaaagaagttgcagatcaatataatgttccggttttagaaagagctatatttttagataatgagaaaaatgtagaggcaattaagagacagattgaaaaattagctgttgtggcattagagagtggaagtgctgtggcaattggtcatgtaggacctgagggagggagaataacagccgaggctatcaagcagatgctcccttacttacaagaaaaaggaatcgagattatgccagcttccaaattactaaataaacccagacaatag

SEQ ID NO: 64647 - protein, 286 aa, Alkaliphilus metalliredigenes QYMF
MKKKGYIFYISKQNLNFILVTCLVLGFFTGGMRIQRNEQNPLWMSREASVIEETVAETKGIVAIVIDDFGNNGSGTDEMMNIIQPLTFAVIPFLPYSQEEAKRANKAGHEVIVHIPMEPKKGNPKWLGDRGITSNLTSEEVHSIVLEAIEDVQYAVGANNHMGSKITEDKRIMEAVMQVLKANDMYMIDSKTSQTSIVKEVADQYNVPVLERAIFLDNEKNVEAIKRQIEKLAVVALESGSAVAIGHVGPEGGRITAEAIKQMLPYLQEKGIEIMPASKLLNKPRQ

SEQ ID NO: 64648 - DNA, 744 bp, Shewanella putrefaciens CN-32
  CDS (1)..(744): transl_table=11
gtgcgtttattttatatctttattgtcttcatcttatatgttgcgccatcttacgcgactaaaattgcactgatcatcgatgacataggctatcgtcaaacagatgaagcagtattgtcactgcctcacacagtaactctttcagtgttacctcatacgcctctaggtgaaaatctcgcaaaagtgggtcaccgtaaagggcatgaaataatgctgcatttaccaatgcaagctattaacggtaaagcattaggtcccggaggcttaaccaagggtatggatgaagcagagatccgcgctaacgtatcgagtgcgattgcgaatatcccttttgctaagggtgcaaataaccatatggggagtttattaacacaactcgattcacacatgctttgggttatggaatgcctaaagcagaatcaactgtattttgtggatagtatgactacaccattttctaaagcgggagagaaagcagatcaattaggtatcccaagtttgaaacgccaactctttctcgataacaacgtcagtaaaaaagcccttgaaaagcaatttaatctcatgattagcaatgcacacatgcaaggaagcctagtggtaatagctcatccgtatcctgaaaccattcgcttcttacaagcgaatttaccactacttgaagcagaaggaatagatctggtacccgtatcagatttattgcctattgatatagctcaggaaaatagactaatccaactgtaa

SEQ ID NO: 64649 - protein, 247 aa, Shewanella putrefaciens CN-32
MRLFYIFIVFILYVAPSYATKIALIIDDIGYRQTDEAVLSLPHTVTLSVLPHTPLGENLAKVGHRKGHEIMLHLPMQAINGKALGPGGLTKGMDEAEIRANVSSAIANIPFAKGANNHMGSLLTQLDSHMLWVMECLKQNQLYFVDSMTTPFSKAGEKADQLGIPSLKRQLFLDNNVSKKALEKQFNLMISNAHMQGSLVVIAHPYPETIRFLQANLPLLEAEGIDLVPVSDLLPIDIAQENRLIQL

SEQ ID NO: 64650 - DNA, 819 bp, Marinobacter aquaeolei VT8
  CDS (1)..(819): transl_table=11
gtgactttgcgttctaccctcgcgctgctggcgcttctggccatcagccctgtcgctgcgtttgcgtcagggccgggtgaaccccaacagcccaccattgccatcattattgatgacatggggcacaaccggcacgagggcgagcggctggcaaggcttgaccagcccctgacactggcctttctgccttaccggcgccatacagttcccttggcgaagctggcccacgcccaatccaaggaaatcatgttgcacgccccgatggccaatacccgcaacttcggcctcggcccgggcggcctgaccccggacatggacgaactggccatcgccaccactctgcgccgggcactgcagtccattccctttgtcagcggtgtgaacaatcacatgggcagcctgctcacccagcaactggaacccatggactgggtaatgaaagagctggaccgctacccggtgtatttcgtcgacagccgcaccattgccaattccatcgccggcagtgtggccgatgcctacaacatcccgagcctgacgcgcgatgtgtttctcgatcacgaacagacggaagagtttgtcgacaaacagttcaaactgctgattcagaccgccagggaaaaaggcacggccatcggtatcggacacccgcacaaggtcaccgtggattatctggagaagcacctgccgatgctggatgaacagggcattgccatcgccacggtcagtggtctctgggccatgcgtaacggtaatcgggagatgtttgcggaaggtgagaagcaggccattcggcctgcctatgcacgcagcaattaa

SEQ ID NO: 64651 - protein, 272 aa, Marinobacter aquaeolei VT8
MTLRSTLALLALLAISPVAAFASGPGEPQQPTIAIIIDDMGHNRHEGERLARLDQPLTLAFLPYRRHTVPLAKLAHAQSKEIMLHAPMANTRNFGLGPGGLTPDMDELAIATTLRRALQSIPFVSGVNNHMGSLLTQQLEPMDWVMKELDRYPVYFVDSRTIANSIAGSVADAYNIPSLTRDVFLDHEQTEEFVDKQFKLLIQTAREKGTAIGIGHPHKVTVDYLEKHLPMLDEQGIAIATVSGLWAMRNGNREMFAEGEKQAIRPAYARSN

SEQ ID NO: 64652 - DNA, 1029 bp, Yersinia bercovieri ATCC 43970
  CDS (1)..(1029)
ttgcgctatttcaacgcacgcctatttatcatcgtcagcaccctcgtgatcgccaacgccgcacaggcgggcaaactttcaatcgtgattgatgactttggttatcgcccccagaatgaaaacaaggtgttgcagatgccgctgcctatttcagtcgctatcctgcctaatgccccctacgcccgagagatggctgtcaaagcccataatcaagggcgtgaaattctgattcacctgcccatggcccccctgagcaagcagccattggagcgcgatacattgcagccatcaatgagtagcgaagagatccagcgcatcatccgccaggcggtgaataatgtcccttatgcgaaggggatgaataaccatatgggcagcgcgatgacctccagtttgccgggtatgcagagagtgatgcaggcgctggaacactatcagctctatttcctcgacagtgtgaccatcggcaatagtcaagccagcagagccgccgaaggcactggcgtcaaagtgattaagcgcaaagtctttctggatgactcacaaaatgaagccgcgatccgccagcagtttaaccgcgcagtagaactggcgcgccgaaatggctccgccattgctatcgggcatccccatcccgctaccattaaagtgctgcaacagatgttgcctcagttgccgtctgacattgtattggtcaaacctagcgcactgctgaatgaaccggtaaacaataatagtggcagtagcacggtctcaccgggcaagtcaaaaccgcgcgaaccggcgaaaaatgatcgcctgaaagccatcaagcagtgcagtgcgaaagccagctatgtgcctgagaaaatctacgccggcaggatgtttagcgtcattggcgagagcttgatgcaaagtccggctgtaagctttattcagcgctattttacctcgtcagcacccatcgcgccggttgatgaaccaaaagtagatgcaccaaaaatagatattccaaaagtggagaagccaaaaacggataatccgtaa

SEQ ID NO: 64653 - protein, 342 aa, Yersinia bercovieri ATCC 43970
MRYFNARLFIIVSTLVIANAAQAGKLSIVIDDFGYRPQNENKVLQMPLPISVAILPNAPYAREMAVKAHNQGREILIHLPMAPLSKQPLERDTLQPSMSSEEIQRIIRQAVNNVPYAKGMNNHMGSAMTSSLPGMQRVMQALEHYQLYFLDSVTIGNSQASRAAEGTGVKVIKRKVFLDDSQNEAAIRQQFNRAVELARRNGSAIAIGHPHPATIKVLQQMLPQLPSDIVLVKPSALLNEPVNNNSGSSTVSPGKSKPREPAKNDRLKAIKQCSAKASYVPEKIYAGRMFSVIGESLMQSPAVSFIQRYFTSSAPIAPVDEPKVDAPKIDIPKVEKPKTDNP

SEQ ID NO: 64654 - DNA, 1059 bp, Yersinia mollaretii ATCC 43969
  CDS (1)..(1059)
ttgcgctatttcaacacacgccgatttatcatcgtaagcaccctactgatcgccaacgccgcacaggcgggcaaactttccatcgttattgatgactttggttatcgccctcagaatgaaaacaaggtgttacagatgccgctacctatttcggtcgccattctgcctaatgccccttatgcccgagagatggcggtcaaagcccataatcagggccgtgaaatcctgattcatctgccaatggcccccctaagcaagcagccgttggagcgcgatacattgcagccgtcaatgagtagcgaagagattcagcgcattattcgccaggcggtcagtaacgtcccttatgcaaaaggcatgaataaccatatgggtagcgcgatgacctccagtttgccgggtatgcagaaagtgatgcaggcgctggagcactatcagctctatttcctcgacagcgtgaccatcggcaatagccaagcgagcagagcggctgaagggactggcgtcaaagtgattaagcgtaaagtctttttggatgactcacaaaatgaagccgcgatccgccagcagtttaaccgcgcagtcgaactggcgcgtcgaaatggctctgccattgctatcgggcacccgcatccggccaccattaaagtgctgcaacagatgctgcctcagttgccgtctgacatcgtattagtccggccgagtgcgctgctcaatgagccacagcaaaataacagtggcgcagtctcgccgggtaaatcaaagccacgtgaaccggttcgcctgaaagccatcaagcaatgtcatgcaaaagccagttatacaccagagaaaatctatgctggcaggatgtttagcgttattggcgagagtctgatggaaagcccggcgatgaactttattcagcgctattttacgccgtcagcacctgtagagccgattgataaactgaatattggtgagccgattattgataaatcgactattgataaaccgaaaatcgatgaactgaaaatagaggctccaacagcggaaaaatcaaaagtggataatccataa

SEQ ID NO: 64655 - protein, 352 aa, Yersinia mollaretii ATCC 43969
MRYFNTRRFIIVSTLLIANAAQAGKLSIVIDDFGYRPQNENKVLQMPLPISVAILPNAPYAREMAVKAHNQGREILIHLPMAPLSKQPLERDTLQPSMSSEEIQRIIRQAVSNVPYAKGMNNHMGSAMTSSLPGMQKVMQALEHYQLYFLDSVTIGNSQASRAAEGTGVKVIKRKVFLDDSQNEAAIRQQFNRAVELARRNGSAIAIGHPHPATIKVLQQMLPQLPSDIVLVRPSALLNEPQQNNSGAVSPGKSKPREPVRLKAIKQCHAKASYTPEKIYAGRMFSVIGESLMESPAMNFIQRYFTPSAPVEPIDKLNIGEPIIDKSTIDKPKIDELKIEAPTAEKSKVDNP

SEQ ID NO: 64656 - DNA, 1014 bp, Yersinia frederiksenii ATCC 33641
  CDS (1)..(1014)
ttgcgttatttcaacacacgtcggtttatcatagtaagcaccctactcatcgccaatgccgcacaggcgggcaaactttcaattgttattgatgactttggttatcgcccgcagaatgaaaataaggtattacagatgccgctaccgatttcggtagcaatcctgcctaatgccccttacgccaaagagatggcggtcaaagctcataatcaagggcgtgaaatcctgattcacctgccgatggcgccgctgagcaaacagccattagagcgcgatactttacagccatccatgagcagcgaagaaatccagcgtatcattcgtcaggcggtgaataatgttccctacgcgaccggtatgaataatcatatgggtagcgcaatgacctccagcttgcctggtatgcagaaagttatgcagacgctggagcattatcagctctatttcctcgacagcgtgaccatcggtaatagtcaggccagcaaggcggccgaagggactggcgtcaaagtaattaagcgaaaagtctttttggatgactcacaaaacgaagcggcgattcgccagcaatttaaccgcgcagtagatttggcgcgtcgcaatggctccgcgattgctatcggccacccacatccagccactattaaagtgctacaacaaatgttgccccagttgcctgctgatatcgtattagtcaggccaagtgcactgcttaatgagccggtaagcaataataatggtagcagcggcgtctcaccaggcaagacaaaaccgcactttccagcgaaaggtgaacgtctgaaagctatcaagcagtgccatgcaaaagccagctatgtaccagaaaaggtctatgccgataggatgtttattgttattggtgagagcctgatacagagcccggcggtagcatttgtgcagcggtattggcaacaatatttcccgccagcaccggtaatgcctgaaagtgaaaaaacagagccaccggcaagcaaatcaacaactcaaaaatag

SEQ ID NO: 64657 - protein, 337 aa, Yersinia frederiksenii ATCC 33641
MRYFNTRRFIIVSTLLIANAAQAGKLSIVIDDFGYRPQNENKVLQMPLPISVAILPNAPYAKEMAVKAHNQGREILIHLPMAPLSKQPLERDTLQPSMSSEEIQRIIRQAVNNVPYATGMNNHMGSAMTSSLPGMQKVMQTLEHYQLYFLDSVTIGNSQASKAAEGTGVKVIKRKVFLDDSQNEAAIRQQFNRAVDLARRNGSAIAIGHPHPATIKVLQQMLPQLPADIVLVRPSALLNEPVSNNNGSSGVSPGKTKPHFPAKGERLKAIKQCHAKASYVPEKVYADRMFIVIGESLIQSPAVAFVQRYWQQYFPPAPVMPESEKTEPPASKSTTQK

SEQ ID NO: 64658 - DNA, 756 bp, Shewanella sp. PV-4
  CDS (1)..(756): transl_table=11
gtgcgcttattactcttattagctgtcttatttaccacaccacactgcttcgccgcccaggtctccatcatcattgacgacataggttatcgtcagactgacgaggcggtgttggcattgccaagcgacatcaccctctccgtattgccccatacccctctgggcgaaaggcttgccgccatcgcccacgacaagggccacgagatcatgttgcacctgcccatgcaggcattaaatggcaaggagatgggccctggcggactgaccaatcagatgagcgaacaggctctcaagcgggcggtcgatgacgcctttaagagtgtcccctacgccaaaggtgtcaacaaccatatggggagtctgctcacacaactagacgcgcccatgacctggctaatggagagcctgaagcagcaagacaactactttgtcgacagcatgaccaccaggtacagcaaagccagcgacgcagccaacaggctggggattccgctattgagaagacaactctttctggataacgatgtatcgccgcaggggcttgagagacaatttaaccagctgatccagctggcaaacaaggaggggcaacttatagtgatcgcccacccctatcccgagaccatcagcttcttaaaggcgaatctatccagactctcggacgaaggcatcgccttggtaaatacatccaggctcttgccctatcgcctcgcacagaaggaacccgcggccagcgacaaggcgcatttaagatag

SEQ ID NO: 64659 - protein, 251 aa, Shewanella sp. PV-4
MRLLLLLAVLFTTPHCFAAQVSIIIDDIGYRQTDEAVLALPSDITLSVLPHTPLGERLAAIAHDKGHEIMLHLPMQALNGKEMGPGGLTNQMSEQALKRAVDDAFKSVPYAKGVNNHMGSLLTQLDAPMTWLMESLKQQDNYFVDSMTTRYSKASDAANRLGIPLLRRQLFLDNDVSPQGLERQFNQLIQLANKEGQLIVIAHPYPETISFLKANLSRLSDEGIALVNTSRLLPYRLAQKEPAASDKAHLR

SEQ ID NO: 64660 - DNA, 756 bp, Shewanella sp. ANA-3
  CDS (1)..(756): transl_table=11
gtgcgtctattttacatattggccctttgggctctgagcattgcgccaagcaatgcggcccaaatcgccttgatcatcgatgatattggctatcgccacaccgacgaagccgtgctgtcactcccaagcgcagtcaccttgtcggtactgccacacacgccgctcagtaataaattagccaaagccgcgcacgccaaaggccacgagattatgctgcacttacccatgcaggcactcaatggcaaagccttaggtgttggtggtttaactaataatatgagcgaagcacagatacgtagcagtgtacttgctgccatcgccagtgtgccctttgctaaaggcgccaacaatcatatgggaagcctactaacgcagctcgatgatcctatgctgtgggtgatggacacgttaaagcagaaacagctctactttgtcgatagtatgacaaccaagttcactaaggcgggagataaggcagattcgctcggcgtgccactgctacgacgcaaactctttctcgataatgacgtcagtgccgcagcattggaaaaacagtttaatttgatgataagtcaggctcactcgcaaggcagtctggtagctatcgcccatccttaccccgaaaccattcacttcttaaaaacgaacttagcgcgcctaaaggcggaagggattgagctagtgccgacgtcaagcttgttgcccatcgaactagcccatgagaaaggcactaatccaactgtaagacagaaatag

SEQ ID NO: 64661 - protein, 251 aa, Shewanella sp. ANA-3
MRLFYILALWALSIAPSNAAQIALIIDDIGYRHTDEAVLSLPSAVTLSVLPHTPLSNKLAKAAHAKGHEIMLHLPMQALNGKALGVGGLTNNMSEAQIRSSVLAAIASVPFAKGANNHMGSLLTQLDDPMLWVMDTLKQKQLYFVDSMTTKFTKAGDKADSLGVPLLRRKLFLDNDVSAAALEKQFNLMISQAHSQGSLVAIAHPYPETIHFLKTNLARLKAEGIELVPTSSLLPIELAHEKGTNPTVRQK

SEQ ID NO: 64662 - DNA, 756 bp, Shewanella sp. MR-7
  CDS (1)..(756): transl_table=11
gtgcgtctattttacatattggccctttgggctctgagcattgcgccaagtaatgcggcccaaatcgccttgatcatcgatgatattggctatcgccacaccgacgaagccgtgctgtcactcccaagcgcagtcaccttgtcggtactgccacatacgccgcttagcaataaattggccaaagcagcgcacgccaaagggcacgagattatgctgcacttacccatgcaggcactcaatggtaaagccttaggtgttggtggtttaacgaataatatgagcgaaacacagatacgtagcagtgtacttgcagccatcgccagtgtgccctttgctaaaggcgccaacaatcatatgggaagcctgctaacgcagctcgatgatcctatgttgtgggtgatggaaacgctaaagcagaagcagctctactttgtcgatagtatgaccaccaagttcactaaggcgggagataaggcggattcgctcggcgtgccactgctacgacgccaactctttctcgataatgacgtcagtgccgcagcattggaaaaacagtttaatttgatgataagtcaggctcactcgcaaggcagtctagttgctatcgcccatccttacccagaaaccattcacttcttaaaaacaaacttagcgcgcctaaaggcggaagggattgagctagtgccgacgtcaagcttgttgcccatcgaactagcccatgagaaagggactaatccaactgtaagacagagatag

SEQ ID NO: 64663 - protein, 251 aa, Shewanella sp. MR-7
MRLFYILALWALSIAPSNAAQIALIIDDIGYRHTDEAVLSLPSAVTLSVLPHTPLSNKLAKAAHAKGHEIMLHLPMQALNGKALGVGGLTNNMSETQIRSSVLAAIASVPFAKGANNHMGSLLTQLDDPMLWVMETLKQKQLYFVDSMTTKFTKAGDKADSLGVPLLRRQLFLDNDVSAAALEKQFNLMISQAHSQGSLVAIAHPYPETIHFLKTNLARLKAEGIELVPTSSLLPIELAHEKGTNPTVRQR

SEQ ID NO: 64664 - DNA, 795 bp, Alkalilimnicola ehrlichei MLHE-1
  CDS (1)..(795): transl_table=11
atggctgcccggacgcgccgagcccctgccggccacctgatcctcctgctctgcggcctgggggccctgctgctgggccaggcgcaggcccggtcggccgatgagccggtgcgggtggcggtggtgatcgacgatctgggggatcacctggccagcggccaacgcacggttgatctgcccgggccggtgacctgttccgttctaccccacaccccccacgcccggcgcctggccgaggcctgccaccgcagcggcaaggaggtcatgctgcacatgccgatgcaggcgaaaaacggcgccgatcgagggccgggcggggtggacatccacatggaccggacggcggtggaggcggcggtccgcaaagacctggacgcggtgccccatgcccgcggggtcaataaccacatgggcagtctctatacacgccacccgggcaacctgcgttgggtcatggacgcactgcggggggagggcgactattacttcgtggacagccggaccacggcacgcagtgtggcggaacaggtggcgcgggaggccggggtgcccgccacccggcggcatgtcttcctggaccacgaccgtgatccggagatgatccgccaccacctcgaacggctggtgcggcacgcgcgccggcatggctacgggctggccatcggccacccctacccggagaccctggcggtgctggaggaggtactgccggagtgggcccgggccggtatcaaactggtgccggcctcgcggctggtggagttgtatggtcaggaggaggagaacgtgccatga

SEQ ID NO: 64665 - protein, 264 aa, Alkalilimnicola ehrlichei MLHE-1
MAARTRRAPAGHLILLLCGLGALLLGQAQARSADEPVRVAVVIDDLGDHLASGQRTVDLPGPVTCSVLPHTPHARRLAEACHRSGKEVMLHMPMQAKNGADRGPGGVDIHMDRTAVEAAVRKDLDAVPHARGVNNHMGSLYTRHPGNLRWVMDALRGEGDYYFVDSRTTARSVAEQVAREAGVPATRRHVFLDHDRDPEMIRHHLERLVRHARRHGYGLAIGHPYPETLAVLEEVLPEWARAGIKLVPASRLVELYGQEEENVP

SEQ ID NO: 64666 - DNA, 756 bp, Shewanella sp. MR-4
  CDS (1)..(756): transl_table=11
gtgcgtttattttatatattggccctttgggccctgtgcattgcgtcaagcaatgcagcccaaatcgccttgatcatcgatgatattggctatcgccacaccgacgaagccgtgctgtcactcccaagcgcagtcaccttgtcggtactgccacacacgccgctcagcaataaattagccaaagccgcgcacgccaagggccacgagattatgctgcacttacccatgcaggcactcaatggtaaagccttaggtgttggtggtttaacgaataatatgagcgaagcacagatacgtagcagtgtacttgctgccatcgccagtgtgccctttgctaaaggcgccaacaatcatatgggaagcctactaacgcagctcgatgatcctatgttgtgggtgatggaaacgctaaagcagaagcagctctactttgtcgacagtatgacaaccaagttcactaaggcgggagataaggcagattcgctcagcgtgccactgctacgacgtcaactctttctcgataatgacgtcagtgccgcagcattggaaaaacagtttaatttgatgataagtcaggctcactcgcaaggcagtttagtggctatcgcccatccttaccccgaaaccattcacttcttaaaaacaaacttagcgcgcctaaaggcggaagggattgagctagtgccgacgtcaagcttgttgcccatcgaactagcccatgagaaaggcactaatccaactgtaagacagaaatag

SEQ ID NO: 64667 - protein, 251 aa, Shewanella sp. MR-4
MRLFYILALWALCIASSNAAQIALIIDDIGYRHTDEAVLSLPSAVTLSVLPHTPLSNKLAKAAHAKGHEIMLHLPMQALNGKALGVGGLTNNMSEAQIRSSVLAAIASVPFAKGANNHMGSLLTQLDDPMLWVMETLKQKQLYFVDSMTTKFTKAGDKADSLSVPLLRRQLFLDNDVSAAALEKQFNLMISQAHSQGSLVAIAHPYPETIHFLKTNLARLKAEGIELVPTSSLLPIELAHEKGTNPTVRQK

SEQ ID NO: 64668 - DNA, 843 bp, Haemophilus influenzae
  CDS (1)..(843): transl_table=11
atgaatattctgataaaaagtgcggtaaaaaatttcattgttttttctaccgcactttatgcctctttttcttttgctcaaagtaaacttgctattgtgattgatgatgtaggctatcatctcaaagaagatgcggcaatttttgcgatgccacgtgaaatttccgtagcaattattcctgctgcgccctatgctcgagcacgtaatcaagaagcaaaatctcaaggtagagatattttaatccatatgccgatgcaaccagtaagtgcagtgaaaatagaagacggtgggctgcatttaggaatgtctgcagcacaagtaaatgatcgcgttaatacggctaaaaatattgtgcgtgatgccatcggtatgaacaatcatatggggagtgcagcaacggcagatccccaattaatgacttatttaatgaccgcacttcaagaaaaacatttattctttttagatagtcgaacaataggaaaatctgtagctgggaaaatagcaaaagaacaaggcgtgcgttcattagatcgccatatatttttagatgatagtaacgaattcgcagacgttcaacgtcaatttaaagcagcaattcactatgctagaaaacacggctccgccattgcaataggtcatcctcgccaaaatacgattgcagttttacaagcaggacttcgtaatttacccgaagatattcaattagtcggaatgggaaatttatggcgaaatgaaaaagttattccgcccaagccatttattttattattcagcgaagtgcctgcgccaacttctatagaaccttttgagcctgtaggattattgcgtggaattccaaaataa

SEQ ID NO: 64669 - protein, 280 aa, Haemophilus influenzae
MNILIKSAVKNFIVFSTALYASFSFAQSKLAIVIDDVGYHLKEDAAIFAMPREISVAIIPAAPYARARNQEAKSQGRDILIHMPMQPVSAVKIEDGGLHLGMSAAQVNDRVNTAKNIVRDAIGMNNHMGSAATADPQLMTYLMTALQEKHLFFLDSRTIGKSVAGKIAKEQGVRSLDRHIFLDDSNEFADVQRQFKAAIHYARKHGSAIAIGHPRQNTIAVLQAGLRNLPEDIQLVGMGNLWRNEKVIPPKPFILLFSEVPAPTSIEPFEPVGLLRGIPK

SEQ ID NO: 64670 - DNA, 843 bp, Haemophilus influenzae
  CDS (1)..(843)
atgaatattctgataaaaagtgcggtaaaaaatttcattgttttttctaccgcactttatacctctttttcttttgctcaaagtaaacttgctattgtgattgatgatgtaggctatcatctcaaagaagatgcagcaatttttgcgatgccacgtgaaatttccgtagcaattattcctgcagcgccctatgctcgagcacgtaatcaagaagcaaaatctcaaggtagagatattttaatccatatgccgatgcaaccagtaagtgcagtgaaaatagaagacggtgggctgcatttaggaatgtctgcggcacaagtaaatgatcgcgttaatacggctaaaaatattgtgcgtgatgccatcggtatgaacaatcatatggggagtgcagctacggcagatccccaattaatgacttatttaatgaccgcacttcaagaaaaacacttgttctttttagatagtcgaacaataggaaaatctgtagctgggaaaatagcaaaagaacaaggcgtgcgttcattagatcgccatatatttttagatgatagtaacgaattcgcagacgttcaacgtcaatttaaagcagcaattcactatgctagaaaacacggctccgccattgcaataggtcatcctcgtccaaatacgattgctgttttacaagcaggtcttcgtaatttacccgaagatattcaattagtcggaatgggcaacttatggcgtaatgaaaaagtaatcccgcccaagccatttattttattattcagcgaagtgcctgcaccaacttctatagaaccttttgagcctgtaggattattgcgtggaattccaaaataa

SEQ ID NO: 64671 - protein, 280 aa, Haemophilus influenzae
MNILIKSAVKNFIVFSTALYTSFSFAQSKLAIVIDDVGYHLKEDAAIFAMPREISVAIIPAAPYARARNQEAKSQGRDILIHMPMQPVSAVKIEDGGLHLGMSAAQVNDRVNTAKNIVRDAIGMNNHMGSAATADPQLMTYLMTALQEKHLFFLDSRTIGKSVAGKIAKEQGVRSLDRHIFLDDSNEFADVQRQFKAAIHYARKHGSAIAIGHPRPNTIAVLQAGLRNLPEDIQLVGMGNLWRNEKVIPPKPFILLFSEVPAPTSIEPFEPVGLLRGIPK

SEQ ID NO: 64672 - DNA, 22 bp, Artificial sequence
  (1)..(22): primer
atgctggcgatgccttccgcta

SEQ ID NO: 64673 - DNA, 25 bp, Artificial sequence
  (1)..(25): primer
ttaatttgcgctagcgttaaacttc

SEQ ID NO: 64674 - protein, 204 aa, Artificial sequence
  Variant (4)..(4): xaa in position 4 is any amino acid
  Variant (6)..(18): xaa in position 6 to 18 is any amino acid
  Variant (19)..(26): xaa in position 19 to 26 is any or no amino acid
  Variant (28)..(29): xaa in position 28 to 29 is any amino acid
  Variant (31)..(37): xaa in position 31 to 37 is any amino acid
  Variant (38)..(38): xaa in position 38 is any or no amino acid
  Variant (40)..(42): xaa in position 40 to 42 is any amino acid
  Variant (44)..(45): xaa in position 44 to 45 is any amino acid
  Variant (46)..(48): xaa in position 46 to 48 is any or no amino acid
  Variant (50)..(50): xaa in position 50 is any amino acid
  Variant (53)..(81): xaa in position 53 to 81 is any amino acid
  Variant (82)..(87): xaa in position 82 to 87 is any or no amino acid
  Variant (89)..(89): xaa in position 89 is any amino acid
  Variant (91)..(91): xaa in position 91 is any amino acid
  Variant (93)..(93): xaa in position 93 is any amino acid
  Variant (100)..(101): xaa in position 100 to 101 is any amino acid
  Variant (103)..(107): xaa in position 103 to 107 is any amino acid
  Variant (109)..(114): xaa in position 109 to 114 is any amino acid
  Variant (116)..(119): xaa in position 116 to 119 is any amino acid
  Variant (120)..(120): xaa in position 120 is any or no amino acid
  Variant (122)..(124): xaa in position 122 to 124 is any amino acid
  Variant (127)..(127): xaa in position 127 is any amino acid
  Variant (129)..(136): xaa in position 129 to 136 is any amino acid
  Variant (137)..(137): xaa in position 137 is any or no amino acid
  Variant (139)..(141): xaa in position 139 to 141 is any amino acid
  Variant (143)..(147): xaa in position 143 to 147 is any amino acid
  Variant (149)..(150): xaa in position 149 to 150 is any amino acid
  Variant (154)..(163): xaa in position 154 to 163 is any amino acid
  Variant (164)..(164): xaa in position 164 is any or no amino acid
  Variant (166)..(172): xaa in position 166 to 172 is any amino acid
  Variant (174)..(176): xaa in position 174 to 176 is any amino acid
  Variant (178)..(181): xaa in position 178 to 181 is any amino acid
  Variant (183)..(183): xaa in position 183 is any amino acid
  Variant (186)..(188): xaa in position 186 to 188 is any amino acid
  Variant (189)..(192): xaa in position 189 to 192 is any or no amino acid
  Variant (194)..(195): xaa in position 194 to 195 is any amino acid
  Variant (196)..(196): xaa in position 196 is any or no amino acid
  Variant (198)..(203): xaa in position 198 to 203 is any amino acid
IDDXGXXXXXXXXXXXXXXXXXXXXXPXXPXXXXXXXXAXXXGXXXXXHXPMXXXXXXXXXXXXXXXXXXXXXXXXXXXXXXXXXXXPXAXGXNNHMGSXXTXXXXXMXXXXXXLXXXXXLXXXDSXTXXXXXXXXXAXXXGXXXXXRXXFLDXXXXXXXXXXXQXXXXXXXAXXXGXXXXIXHPXXXXXXXTXXXLXXXXXXL

SEQ ID NO: 64675 - protein, 10 aa, Artificial sequence
  Variant (2)..(4): xaa in position 2 to 4 is any amino acid
  Variant (5)..(5): xaa in position 5 is Ile, Leu or Met
  Variant (6)..(6): xaa in position 6 is Ile, Leu, Met or Val
  Variant (8)..(8): xaa in position 8 is any amino acid
  Variant (10)..(10): xaa in position 10 is Leu or Met
GXXXXXHXPX

SEQ ID NO: 64676 - protein, 13 aa, Artificial sequence
  Variant (2)..(2): xaa in position 2 is any amino acid
  Variant (3)..(3): xaa in position 3 is Ala, Gly or Ile
  Variant (4)..(4): xaa in position 4 is any amino acid
  Variant (11)..(12): xaa in position 11 to 12 is any amino acid
  Variant (13)..(13): xaa in position 13 is Ser, Thr or Val
AXXXNNHMGSXXX

SEQ ID NO: 64677 - protein, 8 aa, Artificial sequence
  Variant (2)..(3): xaa in position 2 to 3 is any amino acid
  Variant (4)..(4): xaa in position 4 is Ile, Leu or Val
  Variant (7)..(7): xaa in position 7 is any amino acid
LXXXDSXT

SEQ ID NO: 64678 - protein, 9 aa, Artificial sequence
  Variant (2)..(2): xaa in position 2 is any amino acid
  Variant (3)..(3): xaa in position 3 is Ala, Leu or Val
  Variant (4)..(5): xaa in position 4 to 5 is any amino acid
  Variant (7)..(7): xaa in position 7 is Ala, Cys or Gly
  Variant (9)..(9): xaa in position 9 is Ile, Pro or Val
GXXXXIXHX

SEQ ID NO: 64679 - DNA, 1431 bp, Escherichia coli; identical to SEQ ID NO: 14875
  CDS (1)..(1431)

SEQ ID NO: 64680 - protein, 476 aa, Escherichia coli; identical to SEQ ID NO: 14876

SEQ ID NO: 64681 - DNA, 1638 bp, Fusobacterium nucleatum subsp. nucleatum ATCC 25586; identical to SEQ ID NO: 14877
  CDS (1)..(1638): transl_table=11

SEQ ID NO: 64682 - protein, 545 aa, Fusobacterium nucleatum subsp. nucleatum ATCC 25586; identical to SEQ ID NO: 14878

SEQ ID NO: 64683 - DNA, 1392 bp, Clostridium tetani E88; identical to SEQ ID NO: 14879
  CDS (1)..(1392): transl_table=11

SEQ ID NO: 64684 - protein, 463 aa, Clostridium tetani E88; identical to SEQ ID NO: 14880

SEQ ID NO: 64685 - DNA, 1380 bp, Bacteroides thetaiotaomicron VPI-5482; identical to SEQ ID NO: 14881
  CDS (1)..(1380): transl_table=11

SEQ ID NO: 64686 - protein, 459 aa, Bacteroides thetaiotaomicron VPI-5482; identical to SEQ ID NO: 14882

SEQ ID NO: 64687 - DNA, 1380 bp, Porphyromonas gingivalis W83; identical to SEQ ID NO: 14883
  CDS (1)..(1380): transl_table=11

SEQ ID NO: 64688 - protein, 459 aa, Porphyromonas gingivalis W83; identical to SEQ ID NO: 14884

SEQ ID NO: 64689 - DNA, 1449 bp, Rhodopseudomonas palustris CGA009; identical to SEQ ID NO: 14885
  CDS (1)..(1449): transl_table=11

SEQ ID NO: 64690 - protein, 482 aa, Rhodopseudomonas palustris CGA009; identical to SEQ ID NO: 14886

SEQ ID NO: 64691 - DNA, 1380 bp, Treponema denticola ATCC 35405; identical to SEQ ID NO: 14887
  CDS (1)..(1380): transl_table=11

SEQ ID NO: 64692 - protein, 459 aa, Treponema denticola ATCC 35405; identical to SEQ ID NO: 14888

SEQ ID NO: 64693 - DNA, 1380 bp, Treponema denticola ATCC 35405; identical to SEQ ID NO: 14889
  CDS (1)..(1380): transl_table=11

SEQ ID NO: 64694 - protein, 459 aa, Treponema denticola ATCC 35405; identical to SEQ ID NO: 14890

SEQ ID NO: 64695 - DNA, 1617 bp, Entamoeba histolytica HM-1:IMSS; identical to SEQ ID NO: 14891
  CDS (1)..(1617)

SEQ ID NO: 64696 - protein, 538 aa, Entamoeba histolytica HM-1:IMSS; identical to SEQ ID NO: 14892

SEQ ID NO: 64697 - DNA, 1389 bp, Desulfovibrio vulgaris subsp. vulgaris str. Hildenborough; identical to SEQ ID NO: 14893
  CDS (1)..(1389): transl_table=11

SEQ ID NO: 64698 - protein, 462 aa, Desulfovibrio vulgaris subsp. vulgaris str. Hildenborough; identical to SEQ ID NO: 14894

SEQ ID NO: 64699 - DNA, 1377 bp, Propionibacterium acnes KPA171202; identical to SEQ ID NO: 14895
  CDS (1)..(1377): transl_table=11

SEQ ID NO: 64700 - protein, 458 aa, Propionibacterium acnes KPA171202; identical to SEQ ID NO: 14896

SEQ ID NO: 64701 - DNA, 1365 bp, Symbiobacterium thermophilum IAM 14863; identical to SEQ ID NO: 14897
  CDS (1)..(1365): transl_table=11

SEQ ID NO: 64702 - protein, 454 aa, Symbiobacterium thermophilum IAM 14863; identical to SEQ ID NO: 14898

SEQ ID NO: 64703 - DNA, 1416 bp, Symbiobacterium thermophilum IAM 14863; identical to SEQ ID NO: 14899
  CDS (1)..(1416): transl_table=11

SEQ ID NO: 64704 - protein, 471 aa, Symbiobacterium thermophilum IAM 14863; identical to SEQ ID NO: 14900

SEQ ID NO: 64705 - DNA, 1443 bp, Photobacterium profundum SS9; identical to SEQ ID NO: 14901
  CDS (1)..(1443): transl_table=11

SEQ ID NO: 64706 - protein, 480 aa, Photobacterium profundum SS9; identical to SEQ ID NO: 14902

SEQ ID NO: 64707 - DNA, 1467 bp, Photobacterium profundum SS9; identical to SEQ ID NO: 14903
  CDS (1)..(1467): transl_table=11

SEQ ID NO: 64708 - protein, 488 aa, Photobacterium profundum SS9; identical to SEQ ID NO: 14904

SEQ ID NO: 64709 - DNA, 1401 bp, Photobacterium profundum SS9; identical to SEQ ID NO: 14905
  CDS (1)..(1401): transl_table=11

SEQ ID NO: 64710 - protein, 466 aa, Photobacterium profundum SS9; identical to SEQ ID NO: 14906

SEQ ID NO: 64711 - DNA, 1344 bp, Haloarcula marismortui ATCC 43049; identical to SEQ ID NO: 14907
  CDS (1)..(1344): transl_table=11

SEQ ID NO: 64712 - protein, 447 aa, Haloarcula marismortui ATCC 43049; identical to SEQ ID NO: 14908

SEQ ID NO: 64713 - DNA, 1449 bp, Azoarcus sp. EbN1; identical to SEQ ID NO: 14909
  CDS (1)..(1449): transl_table=11

SEQ ID NO: 64714 - protein, 482 aa, Azoarcus sp. EbN1; identical to SEQ ID NO: 14910

SEQ ID NO: 64715 - DNA, 1404 bp, Nostoc punctiforme PCC 73102; identical to SEQ ID NO: 14911
  CDS (1)..(1404)

SEQ ID NO: 64716 - protein, 467 aa, Nostoc punctiforme PCC 73102; identical to SEQ ID NO: 14912

SEQ ID NO: 64717 - DNA, 1416 bp, Haemophilus somnus 129PT; identical to SEQ ID NO: 14913
  CDS (1)..(1416)

SEQ ID NO: 64718 - protein, 471 aa, Haemophilus somnus 129PT; identical to SEQ ID NO: 14914

SEQ ID NO: 64719 - DNA, 1569 bp, Fusobacterium nucleatum subsp. vincentii ATCC 49256; identical to SEQ ID NO: 14915
  CDS (1)..(1569): transl_table=11

SEQ ID NO: 64720 - protein, 522 aa, Fusobacterium nucleatum subsp. vincentii ATCC 49256; identical to SEQ ID NO: 14916

SEQ ID NO: 64721 - DNA, 1383 bp, Fusobacterium nucleatum subsp. vincentii ATCC 49256; identical to SEQ ID NO: 14917
  CDS (1)..(1383): transl_table=11

SEQ ID NO: 64722 - protein, 460 aa, Fusobacterium nucleatum subsp. vincentii ATCC 49256; identical to SEQ ID NO: 14918

SEQ ID NO: 64723 - DNA, 1182 bp, Haemophilus influenzae 86-028NP; identical to SEQ ID NO: 14919
  CDS (1)..(1182)

SEQ ID NO: 64724 - protein, 393 aa, Haemophilus influenzae 86-028NP; identical to SEQ ID NO: 14920

SEQ ID NO: 64725 - DNA, 1347 bp, Solibacter usitatus Ellin6076; identical to SEQ ID NO: 14921
  CDS (1)..(1347): transl_table=11

SEQ ID NO: 64726 - protein, 448 aa, Solibacter usitatus Ellin6076; identical to SEQ ID NO: 14922

SEQ ID NO: 64727 - DNA, 1374 bp, Desulfitobacterium hafniense DCB-2; identical to SEQ ID NO: 14923
  CDS (1)..(1374): transl_table=11

SEQ ID NO: 64728 - protein, 457 aa, Desulfitobacterium hafniense DCB-2; identical to SEQ ID NO: 14924

SEQ ID NO: 64729 - DNA, 1389 bp, Desulfitobacterium hafniense DCB-2; identical to SEQ ID NO: 14925
  CDS (1)..(1389): transl_table=11

SEQ ID NO: 64730 - protein, 462 aa, Desulfitobacterium hafniense DCB-2; identical to SEQ ID NO: 14926

SEQ ID NO: 64731 - DNA, 1443 bp, uncultured bacterium; identical to SEQ ID NO: 14927
  CDS (1)..(1443)

SEQ ID NO: 64732 - protein, 480 aa, uncultured bacterium; identical to SEQ ID NO: 14928

SEQ ID NO: 64733 - DNA, 1365 bp, Symbiobacterium thermophilum; identical to SEQ ID NO: 14929
  CDS (1)..(1365)

SEQ ID NO: 64734 - protein, 454 aa, Symbiobacterium thermophilum; identical to SEQ ID NO: 14930

SEQ ID NO: 64735 - DNA, 1365 bp, Symbiobacterium thermophilum; identical to SEQ ID NO: 14897
  CDS (1)..(1365)

SEQ ID NO: 64736 - protein, 454 aa, Symbiobacterium thermophilum; identical to SEQ ID NO: 14898

SEQ ID NO: 64737 - DNA, 1386 bp, Chromobacterium violaceum; identical to SEQ ID NO: 14933
  CDS (1)..(1386): transl_table=11

SEQ ID NO: 64738 - protein, 461 aa, Chromobacterium violaceum; identical to SEQ ID NO: 14934

SEQ ID NO: 64739 - DNA, 1419 bp, Clostridium tetani; identical to SEQ ID NO: 14935
  CDS (1)..(1419): transl_table=11

SEQ ID NO: 64740 - protein, 472 aa, Clostridium tetani; identical to SEQ ID NO: 14936

SEQ ID NO: 64741 - DNA, 1389 bp, Enterobacter aerogenes; identical to SEQ ID NO: 14937
  CDS (1)..(1389): transl_table=11

SEQ ID NO: 64742 - protein, 462 aa, Enterobacter aerogenes; identical to SEQ ID NO: 14938

SEQ ID NO: 64743 - DNA, 1419 bp, Haemophilus influenzae; identical to SEQ ID NO: 14939
  CDS (1)..(1419): transl_table=11

SEQ ID NO: 64744 - protein, 472 aa, Haemophilus influenzae; identical to SEQ ID NO: 14940

SEQ ID NO: 64745 - DNA, 1347 bp, Halobacterium salinarium; identical to SEQ ID NO: 14941
  CDS (1)..(1347)

SEQ ID NO: 64746 - protein, 448 aa, Halobacterium salinarium; identical to SEQ ID NO: 14942

SEQ ID NO: 64747 - DNA, 1416 bp, Pasteurella multocida; identical to SEQ ID NO: 14943
  CDS (1)..(1416): transl_table=11

SEQ ID NO: 64748 - protein, 471 aa, Pasteurella multocida; identical to SEQ ID NO: 14944

SEQ ID NO: 64749 - DNA, 1401 bp, Photorhabdus luminescens; identical to SEQ ID NO: 14945
  CDS (1)..(1401): transl_table=11

SEQ ID NO: 64750 - protein, 466 aa, Photorhabdus luminescens; identical to SEQ ID NO: 14946

SEQ ID NO: 64751 - DNA, 1398 bp, Proteus inconstans; identical to SEQ ID NO: 14947
  CDS (1)..(1398): transl_table=11

SEQ ID NO: 64752 - protein, 465 aa, Proteus inconstans; identical to SEQ ID NO: 14948

SEQ ID NO: 64753 - DNA, 1404 bp, Proteus vulgaris; identical to SEQ ID NO: 14949
  CDS (1)..(1404): transl_table=11

SEQ ID NO: 64754 - protein, 467 aa, Proteus vulgaris; identical to SEQ ID NO: 14950

SEQ ID NO: 64755 - DNA, 1365 bp, Rhodobacter capsulatus; identical to SEQ ID NO: 14951
  CDS (1)..(1365): transl_table=11

SEQ ID NO: 64756 - protein, 454 aa, Rhodobacter capsulatus; identical to SEQ ID NO: 14952

SEQ ID NO: 64757 - DNA, 1389 bp, Thermoanaerobacter tengcongensis; identical to SEQ ID NO: 14953
  CDS (1)..(1389): transl_table=11

SEQ ID NO: 64758 - protein, 462 aa, Thermoanaerobacter tengcongensis; identical to SEQ ID NO: 14954

SEQ ID NO: 64759 - DNA, 1419 bp, Vibrio cholerae; identical to SEQ ID NO: 14955
  CDS (1)..(1419): transl_table=11

SEQ ID NO: 64760 - protein, 472 aa, Vibrio cholerae; identical to SEQ ID NO: 14956

SEQ ID NO: 64761 - DNA, 1401 bp, Vibrio parahaemolyticus; identical to SEQ ID NO: 14957
  CDS (1)..(1401): transl_table=11

SEQ ID NO: 64762 - protein, 466 aa, Vibrio parahaemolyticus; identical to SEQ ID NO: 14958

SEQ ID NO: 64763 - DNA, 1422 bp, Vibrio vulnificus; identical to SEQ ID NO: 14959
  CDS (1)..(1422): transl_table=11

SEQ ID NO: 64764 - protein, 473 aa, Vibrio vulnificus; identical to SEQ ID NO: 14960

SEQ ID NO: 64765 - DNA, 1371 bp, Citrobacter freundii; identical to SEQ ID NO: 14961
  CDS (1)..(1371): transl_table=11

SEQ ID NO: 64766 - protein, 456 aa, Citrobacter freundii; identical to SEQ ID NO: 14962

SEQ ID NO: 64767 - DNA, 1383 bp, Clostridium tetani; identical to SEQ ID NO: 14963
  CDS (1)..(1383)

SEQ ID NO: 64768 - protein, 460 aa, Clostridium tetani; identical to SEQ ID NO: 14964

SEQ ID NO: 64769 - DNA, 1371 bp, Enterobacter agglomerans; identical to SEQ ID NO: 14965
  CDS (1)..(1371): transl_table=11

SEQ ID NO: 64770 - protein, 456 aa, Enterobacter agglomerans; identical to SEQ ID NO: 14966

SEQ ID NO: 64771 - DNA, 1383 bp, Fusobacterium nucleatum; identical to SEQ ID NO: 14967
  CDS (1)..(1383): transl_table=11

SEQ ID NO: 64772 - protein, 460 aa, Fusobacterium nucleatum; identical to SEQ ID NO: 14968

SEQ ID NO: 64773 - DNA, 1377 bp, Pasteurella multocida; identical to SEQ ID NO: 14969
  CDS (1)..(1377): transl_table=11

SEQ ID NO: 64774 - protein, 458 aa, Pasteurella multocida; identical to SEQ ID NO: 14970

SEQ ID NO: 64775 - DNA, 1377 bp, Symbiobacterium sp; identical to SEQ ID NO: 14971
  CDS (1)..(1377): transl_table=11

SEQ ID NO: 64776 - protein, 458 aa, Symbiobacterium sp; identical to SEQ ID NO: 14972

SEQ ID NO: 64777 - DNA, 27 bp, Artificial sequence
  (1)..(27): primer
atgaaggattatgtaatggaaaacttt

SEQ ID NO: 64778 - DNA, 26 bp, Artificial sequence
  (1)..(26): primer
ttaaacttctttaagttttgcggtga

SEQ ID NO: 64779 - protein, 533 aa, Artificial sequence; identical to SEQ ID NO: 14975
  Variant (2)..(2): xaa in position 2 is any amino acid
  Variant (7)..(7): xaa in position 7 is any amino acid
  Variant (10)..(10): xaa in position 10 is any amino acid
  Variant (12)..(18): xaa in position 12 to 18 is any amino acid
  Variant (20)..(22): xaa in position 20 to 22 is any amino acid
  Variant (24)..(25): xaa in position 24 to 25 is any amino acid
  Variant (27)..(28): xaa in position 27 to 28 is any amino acid
  Variant (30)..(30): xaa in position 30 is any amino acid
  Variant (32)..(32): xaa in position 32 is any amino acid
  Variant (34)..(34): xaa in position 34 is any amino acid
  Variant (36)..(37): xaa in position 36 to 37 is any amino acid
  Variant (49)..(49): xaa in position 49 is any amino acid
  Variant (53)..(54): xaa in position 53 to 54 is any amino acid
  Variant (56)..(56): xaa in position 56 is any or no amino acid
  Variant (61)..(61): xaa in position 61 is any amino acid
  Variant (70)..(71): xaa in position 70 to 71 is any amino acid
  Variant (73)..(74): xaa in position 73 to 74 is any amino acid
  Variant (76)..(78): xaa in position 76 to 78 is any amino acid
  Variant (80)..(80): xaa in position 80 is any amino acid
  Variant (83)..(83): xaa in position 83 is any amino acid
  Variant (86)..(88): xaa in position 86 to 88 is any amino acid
  Variant (89)..(134): xaa in position 89 to 134 is any or no amino acid
  Variant (137)..(137): xaa in position 137 is any amino acid
  Variant (145)..(145): xaa in position 145 is any amino acid
  Variant (147)..(150): xaa in position 147 to 150 is any amino acid
  Variant (153)..(160): xaa in position 153 to 160 is any amino acid
  Variant (161)..(170): xaa in position 161 to 170 is any or no amino acid
  Variant (172)..(173): xaa in position 172 to 173 is any amino acid
  Variant (175)..(175): xaa in position 175 is any amino acid
  Variant (178)..(179): xaa in position 178 to 179 is any amino acid
  Variant (181)..(184): xaa in position 181 to 184 is any amino acid
  Variant (187)..(190): xaa in position 187 to 190 is any amino acid
  Variant (192)..(195): xaa in position 192 to 195 is any amino acid
  Variant (197)..(202): xaa in position 197 to 202 is any amino acid
  Variant (203)..(210): xaa in position 203 to 210 is any or no amino acid
  Variant (214)..(215): xaa in position 214 to 215 is any amino acid
  Variant (218)..(218): xaa in position 218 is any amino acid
  Variant (221)..(223): xaa in position 221 to 223 is any amino acid
  Variant (225)..(227): xaa in position 225 to 227 is any amino acid
  Variant (229)..(230): xaa in position 229 to 230 is any amino acid
  Variant (231)..(231): xaa in position 231 is any or no amino acid
  Variant (233)..(234): xaa in position 233 to 234 is any amino acid
  Variant (236)..(238): xaa in position 236 to 238 is any amino acid
  Variant (241)..(241): xaa in position 241 is any amino acid
  Variant (243)..(244): xaa in position 243 to 244 is any amino acid
  Variant (252)..(252): xaa in position 252 is any amino acid
  Variant (256)..(259): xaa in position 256 to 259 is any amino acid
  Variant (261)..(263): xaa in position 261 to 263 is any amino acid
  Variant (265)..(265): xaa in position 265 is any amino acid
  Variant (267)..(267): xaa in position 267 is any amino acid
  Variant (269)..(270): xaa in position 269 to 270 is any amino acid
  Variant (273)..(273): xaa in position 273 is any amino acid
  Variant (275)..(276): xaa in position 275 to 276 is any amino acid
  Variant (283)..(285): xaa in position 283 to 285 is any amino acid
  Variant (287)..(288): xaa in position 287 to 288 is any amino acid
  Variant (290)..(292): xaa in position 290 to 292 is any amino acid
  Variant (295)..(296): xaa in position 295 to 296 is any amino acid
  Variant (298)..(299): xaa in position 298 to 299 is any amino acid
  Variant (301)..(301): xaa in position 301 is any amino acid
  Variant (303)..(303): xaa in position 303 is any amino acid
  Variant (307)..(309): xaa in position 307 to 309 is any amino acid
  Variant (316)..(316): xaa in position 316 is any amino acid
  Variant (323)..(323): xaa in position 323 is any amino acid
  Variant (325)..(327): xaa in position 325 to 327 is any amino acid
  Variant (329)..(330): xaa in position 329 to 330 is any amino acid
  Variant (331)..(348): xaa in position 331 to 348 is any or no amino acid
  Variant (351)..(357): xaa in position 351 to 357 is any amino acid
  Variant (359)..(360): xaa in position 359 to 360 is any amino acid
  Variant (363)..(364): xaa in position 363 to 364 is any amino acid
  Variant (370)..(370): xaa in position 370 is any amino acid
  Variant (375)..(375): xaa in position 375 is any amino acid
  Variant (379)..(379): xaa in position 379 is any amino acid
  Variant (382)..(382): xaa in position 382 is any amino acid
  Variant (384)..(388): xaa in position 384 to 388 is any amino acid
  Variant (391)..(392): xaa in position 391 to 392 is any amino acid
  Variant (395)..(395): xaa in position 395 is any amino acid
  Variant (398)..(398): xaa in position 398 is any amino acid
  Variant (401)..(403): xaa in position 401 to 403 is any amino acid
  Variant (405)..(407): xaa in position 405 to 407 is any amino acid
  Variant (410)..(413): xaa in position 410 to 413 is any amino acid
  Variant (414)..(414): xaa in position 414 is any or no amino acid
  Variant (416)..(416): xaa in position 416 is any or no amino acid
  Variant (421)..(421): xaa in position 421 is any amino acid
  Variant (426)..(429): xaa in position 426 to 429 is any amino acid
  Variant (431)..(433): xaa in position 431 to 433 is any or no amino acid
  Variant (436)..(439): xaa in position 436 to 439 is any amino acid
  Variant (443)..(444): xaa in position 443 to 444 is any amino acid
  Variant (446)..(448): xaa in position 446 to 448 is any amino acid
  Variant (451)..(453): xaa in position 451 to 453 is any amino acid
  Variant (457)..(458): xaa in position 457 to 458 is any amino acid
  Variant (460)..(460): xaa in position 460 is any amino acid
  Variant (462)..(467): xaa in position 462 to 467 is any amino acid
  Variant (468)..(470): xaa in position 468 to 470 is any or no amino acid
  Variant (472)..(479): xaa in position 472 to 479 is any or no amino acid
  Variant (481)..(482): xaa in position 481 to 482 is any amino acid
  Variant (485)..(485): xaa in position 485 is any amino acid
  Variant (489)..(490): xaa in position 489 to 490 is any amino acid
  Variant (493)..(494): xaa in position 493 to 494 is any amino acid
  Variant (498)..(498): xaa in position 498 is any amino acid
  Variant (500)..(505): xaa in position 500 to 505 is any amino acid
  Variant (507)..(512): xaa in position 507 to 512 is any amino acid
  Variant (514)..(514): xaa in position 514 is any amino acid
  Variant (515)..(515): xaa in position 515 is any or no amino acid
  Variant (518)..(521): xaa in position 518 to 521 is any amino acid
  Variant (524)..(525): xaa in position 524 to 525 is any amino acid
  Variant (526)..(527): xaa in position 526 to 527 is any or no amino acid
  Variant (530)..(530): xaa in position 530 is any amino acid
  Variant (532)..(532): xaa in position 532 is any amino acid

SEQ ID NO: 64780 - protein, 85 aa, Artificial sequence; identical to SEQ ID NO: 14976
  Variant (2)..(2): xaa in position 2 is Pro or Ser
  Variant (3)..(4): xaa in position 3 to 4 is any amino acid
  Variant (5)..(5): xaa in position 5 is Ile, Leu or Met
  Variant (6)..(8): xaa in position 6 to 8 is any amino acid
  Variant (10)..(10): xaa in position 10 is any amino acid
  Variant (11)..(18): xaa in position 11 to 18 is any or no amino acid
  Variant (20)..(25): xaa in position 20 to 25 is any amino acid
  Variant (26)..(26): xaa in position 26 is Ala, Ser or Val
  Variant (27)..(28): xaa in position 27 to 28 is any amino acid
  Variant (30)..(30): xaa in position 30 is any amino acid
  Variant (32)..(32): xaa in position 32 is any amino acid
  Variant (33)..(33): xaa in position 33 is Ile or Leu
  Variant (34)..(34): xaa in position 34 is any amino acid
  Variant (35)..(35): xaa in position 35 is Ala, Gly or Ser
  Variant (36)..(39): xaa in position 36 to 39 is any amino acid
  Variant (49)..(49): xaa in position 49 is Ala, Gly, Asn, Ser or Thr
  Variant (51)..(51): xaa in position 51 is Ile, Met or Val
  Variant (52)..(52): xaa in position 52 is Ser or Thr
  Variant (53)..(53): xaa in position 53 is Asp, Asn, Gln or Ser
  Variant (54)..(56): xaa in position 54 to 56 is any amino acid
  Variant (57)..(57): xaa in position 57 is Ala, Gly or Ser
  Variant (58)..(58): xaa in position 58 is Ala or Gly
  Variant (59)..(59): xaa in position 59 is Ile, Leu, Met or Val
  Variant (60)..(60): xaa in position 60 is Phe, Ile, Leu or Met
  Variant (61)..(61): xaa in position 61 is any amino acid
  Variant (65)..(65): xaa in position 65 is Ala or Ser
  Variant (67)..(67): xaa in position 67 is Ala or Ser
  Variant (69)..(69): xaa in position 69 is Ala, Gly or Ser
  Variant (70)..(70): xaa in position 70 is any amino acid
  Variant (71)..(71): xaa in position 71 is Asn or Ser
  Variant (72)..(72): xaa in position 72 is Phe, Trp or Tyr
  Variant (73)..(74): xaa in position 73 to 74 is any amino acid
  Variant (75)..(75): xaa in position 75 is Phe, Leu or Met
  Variant (76)..(78): xaa in position 76 to 78 is any amino acid
  Variant (79)..(79): xaa in position 79 is Ala, Gly, Ile or Val
  Variant (80)..(83): xaa in position 80 to 83 is any amino acid
  Variant (84)..(84): xaa in position 84 is Asp, Gly, Asn or Pro
  Variant (85)..(85): xaa in position 85 is Phe or Tyr

SEQ ID NO: 64781 - protein, 41 aa, Artificial sequence; identical to SEQ ID NO: 14977
  Variant (2)..(2): xaa in position 2 is Ala or Thr
  Variant (7)..(7): xaa in position 7 is Ala or Gly
  Variant (10)..(10): xaa in position 10 is any amino acid
  Variant (11)..(15): xaa in position 11 to 15 is any or no amino acid
  Variant (17)..(40): xaa in position 17 to 40 is any amino acid
  Variant (41)..(41): xaa in position 41 is Ala, Glu, Gly, Gln or Thr

SEQ ID NO: 64782 - protein, 100 aa, Artificial sequence; identical to SEQ ID NO: 14978
  Variant (2)..(13): xaa in position 2 to 13 is any amino acid
  Variant (14)..(17): xaa in position 14 to 17 is any or no amino acid
  Variant (19)..(19): xaa in position 19 is Cys, Asn, Ser or Val
  Variant (21)..(22): xaa in position 21 to 22 is any amino acid
  Variant (27)..(27): xaa in position 27 is Ile or Val
  Variant (29)..(29): xaa in position 29 is Ile, Leu or Met
  Variant (30)..(30): xaa in position 30 is any amino acid
  Variant (32)..(32): xaa in position 32 is Ile, Leu or Met
  Variant (33)..(33): xaa in position 33 is any amino acid
  Variant (34)..(34): xaa in position 34 is Ala, Asp, Glu, Gly or Ser
  Variant (35)..(37): xaa in position 35 to 37 is any amino acid
  Variant (38)..(38): xaa in position 38 is Ile, Leu, Met or Val
  Variant (39)..(39): xaa in position 39 is Ala, Cys or Thr
  Variant (40)..(43): xaa in position 40 to 43 is any amino acid
  Variant (44)..(44): xaa in position 44 is Ile or Val
  Variant (45)..(45): xaa in position 45 is any amino acid
  Variant (46)..(46): xaa in position 46 is Phe, Ile, Leu, Met or Val
  Variant (47)..(48): xaa in position 47 to 48 is any amino acid
  Variant (50)..(50): xaa in position 50 is Ala, Ser or Val
  Variant (51)..(51): xaa in position 51 is Ala, Cys or Thr
  Variant (53)..(53): xaa in position 53 is any amino acid
  Variant (54)..(54): xaa in position 54 is Ala, Cys, Ser or Val
  Variant (57)..(57): xaa in position 57 is Ala or Cys
  Variant (58)..(58): xaa in position 58 is His, Trp or Tyr
  Variant (60)..(60): xaa in position 60 is Ile or Val
  Variant (61)..(62): xaa in position 61 to 62 is any amino acid
  Variant (63)..(63): xaa in position 63 is Asp, Gln or Arg
  Variant (64)..(64): xaa in position 64 is Asp or Glu
  Variant (65)..(68): xaa in position 65 to 68 is any amino acid
  Variant (69)..(69): xaa in position 69 is Asp, Glu, Gly, Asn or Ser
  Variant (70)..(71): xaa in position 70 to 71 is any amino acid
  Variant (72)..(72): xaa in position 72 is Ile, Leu, Pro or Val
  Variant (73)..(73): xaa in position 73 is any amino acid
  Variant (74)..(74): xaa in position 74 is Asp, Glu, Gln, Ser or Thr
  Variant (75)..(75): xaa in position 75 is Ile or Val
  Variant (76)..(77): xaa in position 76 to 77 is any amino acid
  Variant (78)..(78): xaa in position 78 is Asp, Glu or Lys
  Variant (79)..(83): xaa in position 79 to 83 is any amino acid
  Variant (84)..(84): xaa in position 84 is Asp or Glu
  Variant (85)..(88): xaa in position 85 to 88 is any amino acid
  Variant (90)..(90): xaa in position 90 is Ala, Gly or Ser
  Variant (94)..(94): xaa in position 94 is Ala, Cys, Gly, Pro or Thr
  Variant (95)..(95): xaa in position 95 is Phe, Ile, Leu or Met
  Variant (96)..(96): xaa in position 96 is Ala, Leu or Val
  Variant (97)..(97): xaa in position 97 is Asn, Pro or Gln
  Variant (98)..(98): xaa in position 98 is Ile or Met

SEQ ID NO: 64783 - protein, 84 aa, Artificial sequence; identical to SEQ ID NO: 14979
  Variant (2)..(4): xaa in position 2 to 4 is any amino acid
  Variant (8)..(8): xaa in position 8 is Leu or Met
  Variant (9)..(9): xaa in position 9 is Ala, Glu, Asn, Ser or Thr
  Variant (11)..(11): xaa in position 11 is any amino acid
  Variant (12)..(12): xaa in position 12 is Ala or Asp
  Variant (13)..(13): xaa in position 13 is Ile, Leu or Met
  Variant (14)..(16): xaa in position 14 to 16 is any amino acid
  Variant (18)..(18): xaa in position 18 is any amino acid
  Variant (20)..(20): xaa in position 20 is Phe, Ile or Leu
  Variant (21)..(31): xaa in position 21 to 31 is any amino acid
  Variant (33)..(33): xaa in position 33 is Ile or Val
  Variant (34)..(34): xaa in position 34 is any amino acid
  Variant (36)..(39): xaa in position 36 to 39 is any amino acid
  Variant (40)..(40): xaa in position 40 is Ala, Gly, Asn or Val
  Variant (41)..(42): xaa in position 41 to 42 is any amino acid
  Variant (44)..(46): xaa in position 44 to 46 is any amino acid
  Variant (47)..(47): xaa in position 47 is Asp, Glu, Gly or Asn
  Variant (48)..(48): xaa in position 48 is Ile or Val
  Variant (49)..(49): xaa in position 49 is Ala, Ile, Leu, Pro or Val
  Variant (50)..(52): xaa in position 50 to 52 is any amino acid
  Variant (53)..(53): xaa in position 53 is Ala or Pro
  Variant (54)..(54): xaa in position 54 is any amino acid
  Variant (56)..(56): xaa in position 56 is any or no amino acid
  Variant (58)..(58): xaa in position 58 is Ala, Gly or Thr
  Variant (59)..(60): xaa in position 59 to 60 is any amino acid
  Variant (61)..(61): xaa in position 61 is Ile, Leu or Val
  Variant (62)..(62): xaa in position 62 is Asp or Glu
  Variant (63)..(63): xaa in position 63 is Ala, Gly or Thr
  Variant (64)..(67): xaa in position 64 to 67 is any amino acid
  Variant (68)..(68): xaa in position 68 is Glu, Asn, Pro or Thr
  Variant (69)..(75): xaa in position 69 to 75 is any amino acid
  Variant (76)..(76): xaa in position 76 is Gly, Ile or Pro
  Variant (77)..(77): xaa in position 77 is Ala, Asp, Gly or Ser
  Variant (78)..(80): xaa in position 78 to 80 is any amino acid
  Variant (81)..(81): xaa in position 81 is Ala, Cys, Gly, Asn, Ser, Thr or Val
  Variant (82)..(83): xaa in position 82 to 83 is any amino acid
  Variant (84)..(84): xaa in position 84 is Ile, Leu or Val

SEQ ID NO: 64784 - DNA, 714 bp, Escherichia coli
  CDS (1)..(714)
atgcgcaagatcacacaggcaatcagtgccgtttgcttattgttcgctctaaacagttccgctgttgccctggcctcatctccttcaccgcttaaccctgggactaacgttgccaggcttgctgaacaggcaccaattcattgggtttcggtcgcacaaattgaaaatagcctcgcagggcgtccgccaatggcggtggggtttgatatcgatgacacggtacttttttccagtccggggttctggcgcggcaaaaaaaccttctcgccagaaagcgaagattatctgaaaaatcctgtgttctgggaaaaaatgaataatggctgggatgaattcagcattccaaaagaggtcgctcgccagctgattgatatgcatgtacgccgcggtgacgcgatcttctttgtgactggtcgtagcccgacgaaaacagaaacggtttcaaaaacgctggcggataattttcatattcctgccaccaacatgaatccggtaatctttgcgggcgataaaccagggcaaaatacaaaatcgcaatggctgcaggataaaaatatccgaattttttatggcgattccgataacgatattaccgccgcacgcgatgtcggcgctcgtggtatccgcattctgcgcgcctccaactctacctacaaacccttgccacaagcgggtgcgtttggtgaagaggtgatcgtcaattcagaatactga

SEQ ID NO: 64785 - protein, 237 aa, Escherichia coli
MRKITQAISAVCLLFALNSSAVALASSPSPLNPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDVGARGIRILRASNSTYKPLPQAGAFGEEVIVNSEY

SEQ ID NO: 64786 - DNA, 732 bp, Streptococcus pyogenes MGAS10394
  CDS (1)..(732): transl_table=11
atgaaaaaagaatttaccagtatcctgtttacagttagtttttgtggaatcatagcattgcctgtcgaagctagtggccctaaagttccttatacacaagaaggtataacggccatttcaaatcaggcaacagtaaaattgatttctattgctgatatcgcgagcagtttagaaggacaaaaacctataacggttagttttgatatcgatgatactttgttatttactagccaatattttcagtacggcaaagaatatataactccaggctcatttgattttttgcataagcaaaaattttgggacttagtcgctaaacggggagatcaggattctattccaaaagagtatgcaaagcaactaatcgcaatgcatcaaaaacgaggagataaaattgtctttattactggccgaactcgaggatcgatgtataaaaaaggtgagattgataaaacagctaagtcactggctaaagattttaagttagacaagccaatagctatcaattatacaggagataaagctgtgaagccgtatcagtatgataaaacatattatataaagaaaaacggctcacaaattcattacggagatagtgatgaagatataaatgctgccaaagaggcaggtgcaagacctattcgcattttaagagctcctaattcaaccaatcttcctttgccaaaagctggaggatacggagaagaggttttagaaaattcggcttattag

SEQ ID NO: 64787 - protein, 243 aa, Streptococcus pyogenes MGAS10394
MKKEFTSILFTVSFCGIIALPVEASGPKVPYTQEGITAISNQATVKLISIADIASSLEGQKPITVSFDIDDTLLFTSQYFQYGKEYITPGSFDFLHKQKFWDLVAKRGDQDSIPKEYAKQLIAMHQKRGDKIVFITGRTRGSMYKKGEIDKTAKSLAKDFKLDKPIAINYTGDKAVKPYQYDKTYYIKKNGSQIHYGDSDEDINAAKEAGARPIRILRAPNSTNLPLPKAGGYGEEVLENSAY

SEQ ID NO: 64788 - DNA, 708 bp, Haemophilus influenzae 86-028NP
  CDS (1)..(708): transl_table=11
atgaaaaacggcataaaattatctgtcatcgcacttttaactgcagctgcagttccagcgatggcaggcaaaacagaaccttatactcaatctggcactaatgctcgtgaaatgttacaagagcaagcaattcattggattagtgttgatcaaatcaaacaaagtttagaaggtaaagcaccaattaatgtaagctttgatattgatgataccgtgcttttcagtagcccttgcttttaccacggacaacaaaaattctcaccaggtaaacacgattatttgaaaaaccaagatttctggaatgaagtaaatgcaggttgcgataaatattctattcctaaacaaattgccatagatttaattaatatgcaccaagcacgtggcgaccaagtttactttttcactggccgtactgctggcaaagtggatggtgtaaccccaattttagaaaaaacgttcaatattaagaatatgcacccagttgaatttatgggcagccgtgaacgtacaacaaaatataacaaaacgcctgcaatcatttcacataaagtgagtattcactatggcgacagcgatgatgatgtactagcagctaaagaagcaggtgttcgtggtattcgtttaatgcgtgccgcaaactctacttatcaaccaatgccaactttaggcggctatggcgaagaagtgttaatcaattcaagctattaa

SEQ ID NO: 64789 - protein, 235 aa, Haemophilus influenzae 86-028NP
MKNGIKLSVIALLTAAAVPAMAGKTEPYTQSGTNAREMLQEQAIHWISVDQIKQSLEGKAPINVSFDIDDTVLFSSPCFYHGQQKFSPGKHDYLKNQDFWNEVNAGCDKYSIPKQIAIDLINMHQARGDQVYFFTGRTAGKVDGVTPILEKTFNIKNMHPVEFMGSRERTTKYNKTPAIISHKVSIHYGDSDDDVLAAKEAGVRGIRLMRAANSTYQPMPTLGGYGEEVLINSSY

SEQ ID NO: 64790 - DNA, 738 bp, Streptococcus agalactiae A909
  CDS (1)..(738): transl_table=11
atgaagaaagtgttagtgagtagtcttttggttttagggattacgataacgttacaaacagtagttgaggctaaggggccaaaagtagcttatacacaagagggaatgactgctctttcggacacaaataaagataaagtcactactatttctattgacgagattcaaaaaagcttagaaggtaagaagccgattactgttagttttgatattgatgatacactgcttttcagtagtcaatattttcaatatggtaaagaatatgtaactcctggatcgtttgattttcttcataaacaaaaattctgggatcttgttgcaaaacgaggagatcaagattccattcccaaagaatatgctaaaaaattaattgctatgcatcaaaaacgaggagataaaattgtttttataacaggtaggacaagagggtcaatgtataaggagggcgaggttgataaaacagctaaagccttagctaaagattttaaattagacaaaccaattgctgtaaattatacaggcgataaacctaaaaagccatacaaatatgataaatcatattatattaagaaatatggttcagacattcattatggagatagtgatgacgatattcatgcagctagggaggccggtgctagaccaattagaattttaagagcacctaattctacaaatctacctttaccagaagctggaggctacggtgaagaggttctcgaaaattcagcttactag

SEQ ID NO: 64791 - protein, 245 aa, Streptococcus agalactiae A909
MKKVLVSSLLVLGITITLQTVVEAKGPKVAYTQEGMTALSDTNKDKVTTISIDEIQKSLEGKKPITVSFDIDDTLLFSSQYFQYGKEYVTPGSFDFLHKQKFWDLVAKRGDQDSIPKEYAKKLIAMHQKRGDKIVFITGRTRGSMYKEGEVDKTAKALAKDFKLDKPIAVNYTGDKPKKPYKYDKSYYIKKYGSDIHYGDSDDDIHAAREAGARPIRILRAPNSTNLPLPEAGGYGEEVLENSAY

SEQ ID NO: 64792 - DNA, 708 bp, Haemophilus influenzae R2846
  CDS (1)..(708)
atgaaaaacgtcatgaaattatctgtaatcgcacttttaactgcagctgcagttcctgcgatggcaggcaaaacagaaccttatactcaatctagcactaatgctcgtgaaatgttacaagagcaagcaattcattggattagtgttgatcaaatcaaacaaagtttagaaggtaaagcaccaattaatgtaagctttgatattgatgataccgtgcttttcagtagcccttgcttttaccacggacaacaaaaattctcaccaggtaaacacgattatttgaaaaaccaagatttctggaatgaagtaaatgcaggttgcgataaatattctattcctaaacaaattgccatagatttaattaatatgcaccaagcacgtggcgaccaagtttactttttcactggccgtactgctggcaaagtggatggtgtaacaccaattttagaaaaaacgttcaatattaagaatatgcacccagttgaatttatgggcagccgtgaacgtacaacaaaatataacaaaacgcctgcaatcatttcacataaagtgagtattcactatggcgatagcgatgatgatgtgctagcagctaaagaagcgggtgttcgtggtattcgtttaatgcgtgccgcaaactctacttatcaaccaatgccaactttaggcggctatggcgaagaagtgttaatcaattcaagctattaa

SEQ ID NO: 64793 - protein, 235 aa, Haemophilus influenzae R2846
MKNVMKLSVIALLTAAAVPAMAGKTEPYTQSSTNAREMLQEQAIHWISVDQIKQSLEGKAPINVSFDIDDTVLFSSPCFYHGQQKFSPGKHDYLKNQDFWNEVNAGCDKYSIPKQIAIDLINMHQARGDQVYFFTGRTAGKVDGVTPILEKTFNIKNMHPVEFMGSRERTTKYNKTPAIISHKVSIHYGDSDDDVLAAKEAGVRGIRLMRAANSTYQPMPTLGGYGEEVLINSSY

SEQ ID NO: 64794 - DNA, 708 bp, Haemophilus influenzae R2866
  CDS (1)..(708)
atgaaaaacgtcatgaaattatctgtaatcgcacttttaactgcagctgcagttccagcgatggcaggcaaaacagaaccttatactcaatctggcactaatgctcgtgaaatgttacaagagcaagcaattcattggattagtgttgatcaaatcaaacaaagtttagaaggtaaagcaccaattaatgtaagctttgatattgatgataccgtgcttttcagtagcccttgcttttaccacggacaacaaaaattctcaccaggtaaacacgattatttgaaaaaccaagatttctggaatgaagtaaatgcaggttgcgataaatattctattcctaaacaaattgccatagatttaattaatatgcaccaagcacgtggcgaccaagtttactttttcactggccgtactgctggcaaagtggatggtgtaacaccaattttagaaaaaacgttcaatattaagaatatgcacccagttgaatttatgggcagccgtgaacgtacaacaaaatataacaaaacgcctgcaatcatttcacataaagtgagtattcactatggcgacagcgatgatgatgtactagcagctaaagaagcaggtgttcgtggtattcgtttaatgcgtgccgcaaactctacttatcaaccaatgccaactttaggcggctatggcgaagaagtgttaatcaattcaagctattaa

SEQ ID NO: 64795 - protein, 235 aa, Haemophilus influenzae R2866
MKNVMKLSVIALLTAAAVPAMAGKTEPYTQSGTNAREMLQEQAIHWISVDQIKQSLEGKAPINVSFDIDDTVLFSSPCFYHGQQKFSPGKHDYLKNQDFWNEVNAGCDKYSIPKQIAIDLINMHQARGDQVYFFTGRTAGKVDGVTPILEKTFNIKNMHPVEFMGSRERTTKYNKTPAIISHKVSIHYGDSDDDVLAAKEAGVRGIRLMRAANSTYQPMPTLGGYGEEVLINSSY

SEQ ID NO: 64796 - DNA, 708 bp, Haemophilus influenzae 86-028NP
  CDS (1)..(708): n means a or g or c or t/u, s means g or c
atgaaaaacggcataaaattatctgtcatcgcacttttaactgcagctgcagttccagcgatggcaggcaaaacagaaccttatactcaatctggcactaatgctcgtgaaatgttacaagagcaagcaattcattggattagtgttgatcaaatcaaacaaagtttagaaggtaaagcaccaattaatgtaagctttgatattgatgataccgtgcttttcagtagcccttgcttttaccacggacaacaaaaattctcaccaggtaaacacgattatttgaaaaaccaagatttctggaatgaagtaaatgcaggttgcgataaatattctattcctaaacaaattgccatagatttaattaatatgcaccaagcacgtggcgaccaagtttactttttcactggccgtactgctggcaaagtggatggtgtaaccccaattttagaaaaaacgttcaatattaagaatatgcacccagttgaatttatgggcagccgtgaacgtacaacaaaatataacaaaacgcctgcaatcatttcacataaagtgagtattcactatggcgacagcgatgatgatgtactagcagctaaagaagcaggtgttcgtggtattcgtttaatgcgtgccgcanactctacttatcaaccaatgccaactttaggcggctatggcgaagaagtgttaatcaattcaagctattaa

SEQ ID NO: 64797 - protein, 235 aa, Haemophilus influenzae 86-028NP
  Xaa in position 213 is unknown
MKNGIKLSVIALLTAAAVPAMAGKTEPYTQSGTNAREMLQEQAIHWISVDQIKQSLEGKAPINVSFDIDDTVLFSSPCFYHGQQKFSPGKHDYLKNQDFWNEVNAGCDKYSIPKQIAIDLINMHQARGDQVYFFTGRTAGKVDGVTPILEKTFNIKNMHPVEFMGSRERTTKYNKTPAIISHKVSIHYGDSDDDVLAAKEAGVRGIRLMRAAXSTYQPMPTLGGYGEEVLINSSY

SEQ ID NO: 64798 - DNA, 687 bp, Paracoccus denitrificans PD1222
  CDS (1)..(687): transl_table=11
atgtcgaaacgactgaccatgatcgcgctgctgcttgccgcctggcccgcgctggcagatgacgcctcgaacctcaatcccggggtcaccacctcggagctgctggcgaccgcgccggtgcattgggtctcggtcccgcagatcgcggccagccttgagggacagccgccgatggccgtgggcttcgacgtggacgatacggtgctgttctccacgccctgcttctattacggcaagaacaggtattcgcccggttccgaggattacctcaagatggacgagttctggaccgacatccacaccaacaactgcgaccagtattcgatgccgaaagaggttgcgcgcgaattgctggacatgcatgtggcgcgcggcgacgacatctatttcatcaccggccggaccaagggcagcggcgaggaaaccctgaccgcgacgctgcaaaagaccttcgaccttgaaaagatgcatgacgtggtctttaccgcctcgtcggaaaacaaggtgcagttcctgaaggatcacgggctgaagatctattacggcgacgccgacagcgacatgcgtgcggcgcttgaggcggggatccggcctatccgcgtcatgcgggcgcaaaactccagctacaagcccgacccgcgcaacggcagtttcggcgaagaggtcatcgtcaattcgacccagtag

SEQ ID NO: 64799 - protein, 228 aa, Paracoccus denitrificans PD1222
MSKRLTMIALLLAAWPALADDASNLNPGVTTSELLATAPVHWVSVPQIAASLEGQPPMAVGFDVDDTVLFSTPCFYYGKNRYSPGSEDYLKMDEFWTDIHTNNCDQYSMPKEVARELLDMHVARGDDIYFITGRTKGSGEETLTATLQKTFDLEKMHDVVFTASSENKVQFLKDHGLKIYYGDADSDMRAALEAGIRPIRVMRAQNSSYKPDPRNGSFGEEVIVNSTQ

SEQ ID NO: 64800 - DNA, 525 bp, Shigella boydii BS512
  CDS (1)..(525)
atggcggtggggtttgatatcgatgacacggtacttttttccagcccgggcttctggcgcggcaaaaaaaacttctcgccagaaagcgaagattatctgaaaaatcctgtgttctgggaaaaaatgaacaatggctgggatgaattcagcattccaaaagaggtcgctcgccagctgattgatatgcatgtacgccgcggtgacgcgatcttctttgtgactggtcgtagtccgacgaaaacagaaacggtttcaaaaacgctggcggataattttcatattcctgccaccaacatgaatccggtgatctttgcgggcgataaaccagggcaaaatacaaaatcgcaatggctgcaggataaaaatatccgaattttttatggcgattctgataatgatattaccgccgcacgcgatgtcggcgctcgtggtatccgcattctgcgcgcctccaactctacctacaaacccttgccacaagcgggtgcgtttggtgaagaggtgatcgtcaattcagaatactga

SEQ ID NO: 64801 - protein, 174 aa, Shigella boydii BS512
MAVGFDIDDTVLFSSPGFWRGKKNFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFYGDSDNDITAARDVGARGIRILRASNSTYKPLPQAGAFGEEVIVNSEY

SEQ ID NO: 64802 - DNA, 525 bp, Escherichia coli B7A
  CDS (1)..(525)
atggcggtggggtttgatatcgatgacacggtacttttttccagcccgggcttctggcgcggcaaaaaaaccttctcaccagaaagcgaagattatctgaaaaatcctgtgttctgggaaaaaatgaacaatggctgggatgaattcagcattccaaaagaggtcgctcgccagctgattgatatgcatgtacgccgcggtgacgcgatcttctttgtgactggtcgtagcccgacgaaaacagaaacggtttcaaaaacgctggcggataattttcatattcctgtcaccaacatgaatccggtgatctttgcgggcgataaaccagggcaaaatacaaaatcgcaatggctgcaggataaaaatatccgaattttttatggcgattccgataacgatattaccgccgcacgcgatgtcggcgcttgtggtatccgcattctgcgcgcctccaactctacctacaaacccttgccacaagcgggtgcgtttggtgaagaggtgatcgtcaattcagaatactga

SEQ ID NO: 64803 - protein, 174 aa, Escherichia coli B7A
MAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPVTNMNPVIFAGDKPGQNTKSQWLQDKNIRIFYGDSDNDITAARDVGACGIRILRASNSTYKPLPQAGAFGEEVIVNSEY

SEQ ID NO: 64804 - DNA, 693 bp, Escherichia coli E22
  CDS (1)..(693)
atgcgcaagatcacacaggcaatcagtgccgtttgcttattgtttgctctaaacagttccgctgttgccctggcctcatctccttcaccgcttaaccctgggactaacgttgccaggcttgctgaacaggcacccattcattgggtttcggtcgcacaaattgaaaatagcctcgcagggcgtccgccaatggcggtggggtttgatatcgatgacacggtacttttttccagtccgggcttctggcgcggcaaaaaaaccttctcgccagaaagcgaagattatctgaaaaatcctgtgttctgggaaaaaatgaacaatggctgggatgaattcagcattccaaaagaggtcgctcgccagctgattgatatgcatgtacgccgcggtgacgcgatcttctttgtgactggtcgtagtccgacgaaaacagaaacggtttcaaaaacgctggcggataattttcatattcctgccaccaacatgaatccggtgatctttgcgggcgataaaccagggcaaaatacaaaatcgcaatggctgcaggataaaaatatccgaatttttatggcgattctgataatgatattaccgccgcacgcgatgtcggcgctcgtggtatccgcattctgcgcgcctccaactctacctacaaacccttgccacaagcgggtgcgtttggtgaagaggtga

SEQ ID NO: 64805 - protein, 230 aa, Escherichia coli E22
MRKITQAISAVCLLFALNSSAVALASSPSPLNPGTNVARLAEQAPIHWVSVAQIENSLAGRPPMAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATNMNPVIFAGDKPGQNTKSQWLQDKNIRIFMAILIMILPPHAMSALVVSAFCAPPTLPTNPCHKRVRLVKR

SEQ ID NO: 64806 - DNA, 732 bp, Actinobacillus succinogenes 130Z
  CDS (1)..(732): transl_table=11
atgtcattgattaaatcaagcgtttttatgttcagtatgctgactatcgctgtatctgcaaatgcgaaagggcctaaggtgagttacgatcatgcgggtattaccgctatcgatcataaaaatgaagcacaggtaaaatgggtttcggcggaatccattcaaaaagaattaaagggtaaaccgcctattacggtgagttttgatattgatgataccgtattggtttcttcacaatgtttctattacggcaaacaaactttttcaccggatagtctggattatttacataatcaggcatattgggattttgtagcggacggctgtgacaattattcgattccgaaagaatctgcaaaaaaattaattgatatgcaccaagcacgcggtgatcaggtcatttttattaccggccgtacgccgcatcgattacataaagcagggcaaatggatcaattagcccgcattctcgaacgtgcgtttcatattaaaaatatgaaaccgatcaactatacccatgacaaaccgattgcaccgtataaatacgataaaacccgttttatggttgaaaaccgcgtcagcattcattatggcgacagcaacgatgatatattggctgcacgtgaagccggaattcgcggcatccgtgttattcgatcggcaaccagcactaaccgcccgttaccgctgaacggcggttacggcgaagaagtggtcgaggattcgtcatattaa

SEQ ID NO: 64807 - protein, 243 aa, Actinobacillus succinogenes 130Z
MSLIKSSVFMFSMLTIAVSANAKGPKVSYDHAGITAIDHKNEAQVKWVSAESIQKELKGKPPITVSFDIDDTVLVSSQCFYYGKQTFSPDSLDYLHNQAYWDFVADGCDNYSIPKESAKKLIDMHQARGDQVIFITGRTPHRLHKAGQMDQLARILERAFHIKNMKPINYTHDKPIAPYKYDKTRFMVENRVSIHYGDSNDDILAAREAGIRGIRVIRSATSTNRPLPLNGGYGEEVVEDSSY

SEQ ID NO: 64808 - DNA, 525 bp, Escherichia coli 53638
  CDS (1)..(525)
atggcggtggggtttgatatcgatgacacggtacttttttccagtccgggcttctggcgcggcaaaaaaaccttctcgccagaaagcgaagattatctgaaaaatcctgtgttctgggaaaaaatgaacaatggctgggatgaattcagcattccaaaagaggtcgctcgccagctgattgatatgcatgtacgccgcggtgacgcgatcttctttgtgactggtcgtagcccgacgaaaacagaaacggtttcaaaaacgctggcggataattttcatattcctgccaccagcatgaatccggtgatctttgcgggcgataaaccagggcaaaatacaaaatcgcaatggctgcaggataaaaatatccgaattttttatggcgattccgataacgatattaccgccgcacgcgatgtcggcgctcgtggtatccgcattctgcgcgcctccaactctacctacaaacccttgccacaagcgggtgcgtttggtgaagaggtgatcgtcaattcagaatactga

SEQ ID NO: 64809 - protein, 174 aa, Escherichia coli 53638
MAVGFDIDDTVLFSSPGFWRGKKTFSPESEDYLKNPVFWEKMNNGWDEFSIPKEVARQLIDMHVRRGDAIFFVTGRSPTKTETVSKTLADNFHIPATSMNPVIFAGDKPGQNTKSQWLQDKNIRIFYGDSDNDITAARDVGARGIRILRASNSTYKPLPQAGAFGEEVIVNSEY

SEQ ID NO: 64810 - DNA, 714 bp, Salmonella typhimurium
  CDS (1)..(714): transl_table=11
atgaaaaaaataaccctggcgctgagtgccgtctgtttgttgtttacgctaaaccattccgcgaatgcgttagtatcttccccttcgacgctcaatccgggcactaatgttgcaaaactcgcggaacaagcgcctgtccattgggtctctgtcgcccagattgaaaacagcctcaccggacgcccgccgatggcggtcggctttgatattgacgacaccgtgttattttccagccctggattctggcgcggaaagaaaacctactccccggacagcgacgattatctgaaaaatccggccttttgggaaaaaatgaacaacggctgggatgagttcagtattccaaaagaagcggcccgacagctcattgatatgcatgttcgccgtggcgacagtatttactttgtcactggtcgtagtcagacgaaaacggaaaccgtgtcgaaaacgctggcggataacttccatattccggcggcgaatatgaatccggtgattttcgccggcgataaaccggaacaaaatacgaaagtacagtggctgcaggagaagaacatgcgtatcttctacggcgattcggataacgatattaccgcggcccgtgattgtggtatccgcggtattcgcatcctgcgcgcggctaactccacctacaaaccgctgccgcaggcaggagcgtttggcgaggaagtcattgtcaactcggagtactaa

SEQ ID NO: 64811 - protein, 237 aa, Salmonella typhimurium
MKKITLALSAVCLLFTLNHSANALVSSPSTLNPGTNVAKLAEQAPVHWVSVAQIENSLTGRPPMAVGFDIDDTVLFSSPGFWRGKKTYSPDSDDYLKNPAFWEKMNNGWDEFSIPKEAARQLIDMHVRRGDSIYFVTGRSQTKTETVSKTLADNFHIPAANMNPVIFAGDKPEQNTKVQWLQEKNMRIFYGDSDNDITAARDCGIRGIRILRAANSTYKPLPQAGAFGEEVIVNSEY

SEQ ID NO: 64812 - DNA, 714 bp, Klebsiella pneumoniae
  CDS (1)..(714): transl_table=11
atgcgcaaacttactctcgcccttgcggcggcttctctcctgttcacgctgaacagcgccgtagtagcgcgcgcctccacgccacagccgctgtgggtcggcaccaacgtggcccagctggccgagcaggcgccgatccactgggtttcggtggcgcaaattgagaacagcctgctggggcgtccgccgatagccgtcggctttgatatcgatgacaccgttctcttctccagtcctgggttctcgcgcgggcaaaaaaccttctcccccggcagtgaggattacctgaaaaacccgcagttctgggaaaaaatgaacaacggctgggacgaattcagcatgccaaaagaggtcgcgcgccacctgattgccatgcatgtgaagcgtggcgacagcatctggtttgtgaccggccgcagccagaccaaaacagaaaccgtttctaaaaccctgcaggatgattttcttatcccggccgccaatatgaacccggtgattttcgctggcgataagccgggtcagaataccaagacccagtggctgcaggcgaagcagataaaggttttctatggcgactcggataacgatattaccgccgcccgcgaggcgggcgcccgcgggatccgcgtgctgcgtgccgccaactcctcctataagccgctgccgatggccggcgcgctgggcgaagaagtgatcgtcaattccgaatactga

SEQ ID NO: 64813 - protein, 237 aa, Klebsiella pneumoniae
MRKLTLALAAASLLFTLNSAVVARASTPQPLWVGTNVAQLAEQAPIHWVSVAQIENSLLGRPPIAVGFDIDDTVLFSSPGFSRGQKTFSPGSEDYLKNPQFWEKMNNGWDEFSMPKEVARHLIAMHVKRGDSIWFVTGRSQTKTETVSKTLQDDFLIPAANMNPVIFAGDKPGQNTKTQWLQAKQIKVFYGDSDNDITAAREAGARGIRVLRAANSSYKPLPMAGALGEEVIVNSEY

SEQ ID NO: 64814 - DNA, 711 bp, Morganella morganii
  CDS (1)..(711): transl_table=11
atgcgtaaactgaccctcaccctgagtgccctggcactcgctctgagcctcaacagtgtggctgatgccaaagtgtacatgccggaaaaagtcagtgacggcgtgaccgttgctcagctggcagaacagcatgccattcactggatttcggttgaacagattgaagagagcctgaaagggcagccgatggcggtgggctttgatattgacgacactgtcttattctcaagcccgggcttttaccgcggcaaactggaatactccccgaacgactacagttatctgaaaaacccggaattctgggaaaaaatgaataatgagtgggataaattcagtatgccgaaaaaatccggtatggaactggttcagatgcacctgaaacgtggtgataccgtttatttcatcaccgggcgcagcaaaaccaaaacagaaacggtcaccaaatatgttcaggaagggctgcgtatcccggcagataaaatgaacccggttatttttgccggtgatgaggaagggcagaataataaagtcagctggatgcgtgatcacaaactgaaaatttattacggtgatgcggatgccgatattgccgcagcacgggaactgaatatccgcggtatccgggtattacgcgcttcgaactcctcgtatcagccgctgccgaaagccggtcagttcggcgaggaagtggttattaattccgaatattaa

SEQ ID NO: 64815 - protein, 236 aa, Morganella morganii
MRKLTLTLSALALALSLNSVADAKVYMPEKVSDGVTVAQLAEQHAIHWISVEQIEESLKGQPMAVGFDIDDTVLFSSPGFYRGKLEYSPNDYSYLKNPEFWEKMNNEWDKFSMPKKSGMELVQMHLKRGDTVYFITGRSKTKTETVTKYVQEGLRIPADKMNPVIFAGDEEGQNNKVSWMRDHKLKIYYGDADADIAAARELNIRGIRVLRASNSSYQPLPKAGQFGEEVVINSEY

SEQ ID NO: 64816 - DNA, 714 bp, Salmonella typhi
  CDS (1)..(714): transl_table=11
atgaaaaaaataaccctggcgctgagcgccgtctgtttattgtttacgctaaaccattccgcgaatgcgttagtatcttccccttcgacgctcaatccgggcactaatgttgcaaaactcgcggaacaagcacctgtccattgggtctctgtcgcccagattgaaaacagcctgaccggacgcccgccgatggcggtcggctttgatattgacgacaccgtgttattttccagccccggattctggcgcggaaagaaaacctattccccggacagcgacgattatctgaaaaatccggccttttgggaaaaaatgaacaacggctgggatgagttcagtattccaaaagaagtggcccgacagctcattgatatgcatgttcgccgtggcgacagtatttactttgtcactggtcgtagtcagacgaaaacggaaactgtgtcgaaaacgctggcggataacttccatattccggcggcgaatatgaatccggtgattttcgccggcgataaaccgggacaaaatacgaaagtccagtggctgcaggagaagaacatgcgtatcttctacggcgattcggataacgatattaccgcagctcgtgattgtggtatccgcggtattcgtatcctgcgcgcggctaactccacctacaaaccgctgccgcaggcaggagcgtttggcgaggaagtcattgtcaactcggagtactaa

SEQ ID NO: 64817 - protein, 237 aa, Salmonella typhi
MKKITLALSAVCLLFTLNHSANALVSSPSTLNPGTNVAKLAEQAPVHWVSVAQIENSLTGRPPMAVGFDIDDTVLFSSPGFWRGKKTYSPDSDDYLKNPAFWEKMNNGWDEFSIPKEVARQLIDMHVRRGDSIYFVTGRSQTKTETVSKTLADNFHIPAANMNPVIFAGDKPGQNTKVQWLQEKNMRIFYGDSDNDITAARDCGIRGIRILRAANSTYKPLPQAGAFGEEVIVNSEY

SEQ ID NO: 64818 - DNA, 714 bp, Salmonella typhimurium
  CDS (1)..(714): transl_table=11
atgaaaaaaataaccctggcgctgagtgccgtctgtttgttgtttacgctaaaccattccgcgaatgcgttagtatcttccccttcgacgctcaatccgggcactaatgttgcaaaactcgcggaacaagcgcctgtccattgggtctctgtcgcccagattgaaaacagcctcaccggacgcccgccgatggcggtcggctttgatattgacgacaccgtgttattttccagccccggattctggcgcggaaagaaaacctactccccggacagcgacgattatctgaaaaatccggccttttgggaaaaaatgaacaacggctgggatgagttcagtattccaaaagaagtggcccgacagctcattgatatgcatgttcgccgtggcgacagtatttactttgtcactggtcgtagtcagacgaaaacggaaaccgtgtcgaaaacgctggcggataacttccatattccggcggcgaatatgaatccggtgattttcgccggcgataaaccggaacaaaatacgaaagtacagtggctgcaggagaagaacatgcgtatcttctacggcgattcggataacgatattaccgcggcccgtgattgtggtatccgcggtattcgcatcctgcgcgcggctaactccacctacaaaccgctgccgcaggcaggagcgtttggcgaggaagtcattgtcaactcggagtactaa

SEQ ID NO: 64819 - protein, 237 aa, Salmonella typhimurium
MKKITLALSAVCLLFTLNHSANALVSSPSTLNPGTNVAKLAEQAPVHWVSVAQIENSLTGRPPMAVGFDIDDTVLFSSPGFWRGKKTYSPDSDDYLKNPAFWEKMNNGWDEFSIPKEVARQLIDMHVRRGDSIYFVTGRSQTKTETVSKTLADNFHIPAANMNPVIFAGDKPEQNTKVQWLQEKNMRIFYGDSDNDITAARDCGIRGIRILRAANSTYKPLPQAGAFGEEVIVNSEY

SEQ ID NO: 64820 - DNA, 23 bp, Artificial sequence
  (1)..(23): primer
atgcgcaagatcacacaggcaat

SEQ ID NO: 64821 - DNA, 27 bp, Artificial sequence
  (1)..(27): primer
ttagtattctgaattgacgatcacctc

SEQ ID NO: 64822 - protein, 196 aa, Artificial sequence
  Variant (2)..(4): xaa in position 2 to 4 is any amino acid
  Variant (6)..(8): xaa in position 6 to 8 is any amino acid
  Variant (10)..(10): xaa in position 10 is any amino acid
  Variant (12)..(13): xaa in position 12 to 13 is any amino acid
  Variant (14)..(16): xaa in position 14 to 16 is any or no amino acid
  Variant (18)..(18): xaa in position 18 is any amino acid
  Variant (31)..(31): xaa in position 31 is any amino acid
  Variant (33)..(34): xaa in position 33 to 34 is any amino acid
  Variant (36)..(39): xaa in position 36 to 39 is any amino acid
  Variant (42)..(44): xaa in position 42 to 44 is any amino acid
  Variant (50)..(51): xaa in position 50 to 51 is any amino acid
  Variant (54)..(60): xaa in position 54 to 60 is any amino acid
  Variant (61)..(61): xaa in position 61 is any or no amino acid
  Variant (63)..(64): xaa in position 63 to 64 is any amino acid
  Variant (69)..(70): xaa in position 69 to 70 is any amino acid
  Variant (72)..(73): xaa in position 72 to 73 is any amino acid
  Variant (76)..(76): xaa in position 76 is any amino acid
  Variant (79)..(80): xaa in position 79 to 80 is any amino acid
  Variant (84)..(86): xaa in position 84 to 86 is any amino acid
  Variant (88)..(88): xaa in position 88 is any amino acid
  Variant (92)..(101): xaa in position 92 to 101 is any amino acid
  Variant (102)..(108): xaa in position 102 to 108 is any or no amino acid
  Variant (110)..(112): xaa in position 110 to 112 is any amino acid
  Variant (114)..(114): xaa in position 114 is any amino acid
  Variant (116)..(131): xaa in position 116 to 131 is any amino acid
  Variant (132)..(135): xaa in position 132 to 135 is any or no amino acid
  Variant (137)..(146): xaa in position 137 to 146 is any amino acid
  Variant (148)..(148): xaa in position 148 is any amino acid
  Variant (154)..(154): xaa in position 154 is any amino acid
  Variant (156)..(157): xaa in position 156 to 157 is any amino acid
  Variant (160)..(162): xaa in position 160 to 162 is any amino acid
  Variant (164)..(164): xaa in position 164 is any amino acid
  Variant (166)..(166): xaa in position 166 is any amino acid
  Variant (169)..(170): xaa in position 169 to 170 is any amino acid
  Variant (173)..(173): xaa in position 173 is any amino acid
  Variant (176)..(178): xaa in position 176 to 178 is any amino acid
  Variant (180)..(180): xaa in position 180 is any amino acid
  Variant (182)..(183): xaa in position 182 to 183 is any amino acid
  Variant (185)..(186): xaa in position 185 to 186 is any amino acid
  Variant (191)..(192): xaa in position 191 to 192 is any amino acid
  Variant (195)..(195): xaa in position 195 is any amino acid
SXXXIXXXLXGXXXXXVXFDIDDTVLFSSPXFXXGXXXXSPXXXDYLKNXXFWXXXXXXXXDXXSIPKXXAXXLIXMHXXRGDXXXFXTGRXXXXXXXXXXXXXXXXXLXXXFXIXXXXXXXXXXXXXXXXXXXXKXXXXXXXXXXIXYGDSDXDXXAAXXXGXRXIRXXRAXNSXXXPXPXXGXXGEEVXXNSXY

SEQ ID NO: 64823 - protein, 19 aa, Artificial sequence
  Variant (2)..(2): xaa in position 2 is Gly or Ser
  Variant (5)..(5): xaa in position 5 is Ile or Val
  Variant (13)..(13): xaa in position 13 is Ser or Thr
  Variant (15)..(15): xaa in position 15 is Cys or Gly
  Variant (17)..(18): xaa in position 17 to 18 is any amino acid
VXFDXDDTVLFSXPXFXXG

SEQ ID NO: 64824 - protein, 19 aa, Artificial sequence
  Variant (2)..(2): xaa in position 2 is Pro or Gln
  Variant (3)..(3): xaa in position 3 is any amino acid
  Variant (4)..(4): xaa in position 4 is Phe or Tyr
  Variant (6)..(6): xaa in position 6 is Asp, Glu or Asn
  Variant (7)..(7): xaa in position 7 is any amino acid
  Variant (8)..(8): xaa in position 8 is Met or Val
  Variant (9)..(9): xaa in position 9 is Ala or Asn
  Variant (10)..(10): xaa in position 10 is Ala, Asp or Asn
  Variant (11)..(11): xaa in position 11 is Glu or Gly
  Variant (12)..(12): xaa in position 12 is any amino acid
  Variant (14)..(14): xaa in position 14 is any amino acid
  Variant (15)..(15): xaa in position 15 is Phe or Tyr
  Variant (17)..(17): xaa in position 17 is Ile or Met
NXXXWXXXXXXXDXXSXPK

SEQ ID NO: 64825 - protein, 18 aa, Artificial sequence
  Variant (3)..(3): xaa in position 3 is Ala, Asp or Asn
  Variant (6)..(7): xaa in position 6 to 7 is any amino acid
  Variant (11)..(11): xaa in position 11 is any amino acid
  Variant (12)..(12): xaa in position 12 is Ile or Val
  Variant (13)..(13): xaa in position 13 is any amino acid
  Variant (15)..(15): xaa in position 15 is Phe, Ile or Val
LIXMHXXRGDXXXFXTGR

SEQ ID NO: 64826 - DNA, 1113 bp, Saccharomyces cerevisiae; identical to SEQ ID NO: 1363
  CDS (1)..(1113)

SEQ ID NO: 64827 - protein, 370 aa, Saccharomyces cerevisiae; identical to SEQ ID NO: 1364

SEQ ID NO: 64828 - DNA, 1086 bp, Deinococcus radiodurans; identical to SEQ ID NO: 1327
  CDS (1)..(1086)

SEQ ID NO: 64829 - protein, 361 aa, Deinococcus radiodurans; identical to SEQ ID NO: 1328

SEQ ID NO: 64830 - DNA, 1071 bp, Salmonella enterica subsp. enterica serovar Typhi; identical to SEQ ID NO: 2245
  CDS (1)..(1071)

SEQ ID NO: 64831 - protein, 356 aa, Salmonella enterica subsp. enterica serovar Typhi; identical to SEQ ID NO: 2246

SEQ ID NO: 64832 - DNA, 1071 bp, Yersinia pestis; identical to SEQ ID NO: 2247
  CDS (1)..(1071)

SEQ ID NO: 64833 - protein, 356 aa, Yersinia pestis; identical to SEQ ID NO: 2248

SEQ ID NO: 64834 - DNA, 1047 bp, Yersinia pestis; identical to SEQ ID NO: 1331
  CDS (1)..(1047)

SEQ ID NO: 64835 - protein, 348 aa, Yersinia pestis; identical to SEQ ID NO: 1332

SEQ ID NO: 64836 - DNA, 1053 bp, Escherichia coli; identical to SEQ ID NO: 2251
  CDS (1)..(1053)

SEQ ID NO: 64837 - protein, 350 aa, Escherichia coli; identical to SEQ ID NO: 1580

SEQ ID NO: 64838 - DNA, 1071 bp, Escherichia coli; identical to SEQ ID NO: 1333
  CDS (1)..(1071)

SEQ ID NO: 64839 - protein, 356 aa, Escherichia coli; identical to SEQ ID NO: 1334

SEQ ID NO: 64840 - DNA, 1131 bp, Nostoc sp. PCC 7120; identical to SEQ ID NO: 1335
  CDS (1)..(1131)

SEQ ID NO: 64841 - protein, 376 aa, Nostoc sp. PCC 7120; identical to SEQ ID NO: 1336

SEQ ID NO: 64842 - DNA, 1053 bp, Salmonella enterica subsp. enterica serovar Typhi; identical to SEQ ID NO: 1337
  CDS (1)..(1053)

SEQ ID NO: 64843 - protein, 350 aa, Salmonella enterica subsp. enterica serovar Typhi; identical to SEQ ID NO: 1338

SEQ ID NO: 64844 - DNA, 1077 bp, Pseudomonas aeruginosa; identical to SEQ ID NO: 1339
  CDS (1)..(1077)

SEQ ID NO: 64845 - protein, 358 aa, Pseudomonas aeruginosa; identical to SEQ ID NO: 1340

SEQ ID NO: 64846 - DNA, 1074 bp, Vibrio cholerae; identical to SEQ ID NO: 1343
  CDS (1)..(1074)

SEQ ID NO: 64847 - protein, 357 aa, Vibrio cholerae; identical to SEQ ID NO: 1344

SEQ ID NO: 64848 - DNA, 1038 bp, Lactococcus lactis subsp. lactis; identical to SEQ ID NO: 1345
  CDS (1)..(1038)

SEQ ID NO: 64849 - protein, 345 aa, Lactococcus lactis subsp. lactis; identical to SEQ ID NO: 1346

SEQ ID NO: 64850 - DNA, 1023 bp, Lactococcus lactis subsp. lactis; identical to SEQ ID NO: 1347
  CDS (1)..(1023)

SEQ ID NO: 64851 - protein, 340 aa, Lactococcus lactis subsp. lactis; identical to SEQ ID NO: 1348

SEQ ID NO: 64852 - DNA, 1032 bp, Streptococcus pneumoniae; identical to SEQ ID NO: 1349
  CDS (1)..(1032)

SEQ ID NO: 64853 - protein, 343 aa, Streptococcus pneumoniae; identical to SEQ ID NO: 1350

SEQ ID NO: 64854 - DNA, 1056 bp, Neisseria meningitidis; identical to SEQ ID NO: 2269
  CDS (1)..(1056)

SEQ ID NO: 64855 - protein, 351 aa, Neisseria meningitidis; identical to SEQ ID NO: 2270

SEQ ID NO: 64856 - DNA, 1095 bp, Pseudomonas aeruginosa; identical to SEQ ID NO: 1351
  CDS (1)..(1095)

SEQ ID NO: 64857 - protein, 364 aa, Pseudomonas aeruginosa; identical to SEQ ID NO: 1352

SEQ ID NO: 64858 - DNA, 1032 bp, Streptococcus pneumoniae; identical to SEQ ID NO: 1355
  CDS (1)..(1032)

SEQ ID NO: 64859 - protein, 343 aa, Streptococcus pneumoniae; identical to SEQ ID NO: 1356

SEQ ID NO: 64860 - DNA, 1143 bp, Xylella fastidiosa; identical to SEQ ID NO: 1603
  CDS (1)..(1143)

SEQ ID NO: 64861 - protein, 380 aa, Xylella fastidiosa; identical to SEQ ID NO: 1604

SEQ ID NO: 64862 - DNA, 1047 bp, Buchnera aphidicola; identical to SEQ ID NO: 1357
  CDS (1)..(1047)

SEQ ID NO: 64863 - protein, 348 aa, Buchnera aphidicola; identical to SEQ ID NO: 1358

SEQ ID NO: 64864 - DNA, 1104 bp, Corynebacterium glutamicum; identical to SEQ ID NO: 2279
  CDS (1)..(1104)

SEQ ID NO: 64865 - protein, 367 aa, Corynebacterium glutamicum; identical to SEQ ID NO: 2280

SEQ ID NO: 64866 - DNA, 1089 bp, Haemophilus influenzae; identical to SEQ ID NO: 1359
  CDS (1)..(1089)

SEQ ID NO: 64867 - protein, 362 aa, Haemophilus influenzae; identical to SEQ ID NO: 1360

SEQ ID NO: 64868 - DNA, 1502 bp, Candida albicans; identical to SEQ ID NO: 1361
  CDS (336)..(1442)

SEQ ID NO: 64869 - protein, 368 aa, Candida albicans; identical to SEQ ID NO: 1362

SEQ ID NO: 64870 - DNA, 2048 bp, Saccharomyces cerevisiae; identical to SEQ ID NO: 1365
  CDS (619)..(1731)

SEQ ID NO: 64871 - protein, 370 aa, Saccharomyces cerevisiae; identical to SEQ ID NO: 1366

SEQ ID NO: 64872 - DNA, 1107 bp, Schizosaccharomyces pombe; identical to SEQ ID NO: 1367
  CDS (1)..(1107)

SEQ ID NO: 64873 - protein, 368 aa, Schizosaccharomyces pombe; identical to SEQ ID NO: 1368

SEQ ID NO: 64874 - DNA, 1089 bp, Amycolatopsis orientalis; identical to SEQ ID NO: 1369
  CDS (1)..(1089)

SEQ ID NO: 64875 - protein, 362 aa, Amycolatopsis orientalis; identical to SEQ ID NO: 1370

SEQ ID NO: 64876 - DNA, 1119 bp, Schizosaccharomyces pombe; identical to SEQ ID NO: 1371
  CDS (1)..(1119)

SEQ ID NO: 64877 - protein, 372 aa, Schizosaccharomyces pombe; identical to SEQ ID NO: 1372

SEQ ID NO: 64878 - DNA, 1083 bp, Methylophilus methylotrophus; identical to SEQ ID NO: 1375
  CDS (1)..(1083)

SEQ ID NO: 64879 - protein, 360 aa, Methylophilus methylotrophus; identical to SEQ ID NO: 1376

SEQ ID NO: 64880 - DNA, 1770 bp, Debaryomyces hansenii; identical to SEQ ID NO: 2295
  CDS (1)..(1770)

SEQ ID NO: 64881 - protein, 589 aa, Debaryomyces hansenii; identical to SEQ ID NO: 2296

SEQ ID NO: 64882 - DNA, 1107 bp, Debaryomyces hansenii; identical to SEQ ID NO: 1377
  CDS (1)..(1107)

SEQ ID NO: 64883 - protein, 368 aa, Debaryomyces hansenii; identical to SEQ ID NO: 1378

SEQ ID NO: 64884 - DNA, 1074 bp, Yarrowia lipolytica; identical to SEQ ID NO: 1379
  CDS (1)..(1074)

SEQ ID NO: 64885 - protein, 357 aa, Yarrowia lipolytica; identical to SEQ ID NO: 1380

SEQ ID NO: 64886 - DNA, 1089 bp, Yarrowia lipolytica; identical to SEQ ID NO: 1381
  CDS (1)..(1089)

SEQ ID NO: 64887 - protein, 362 aa, Yarrowia lipolytica; identical to SEQ ID NO: 1382

SEQ ID NO: 64888 - DNA, 1119 bp, Kluyveromyces lactis; identical to SEQ ID NO: 1383
  CDS (1)..(1119)

SEQ ID NO: 64889 - protein, 372 aa, Kluyveromyces lactis; identical to SEQ ID NO: 1384

SEQ ID NO: 64890 - DNA, 1095 bp, Kluyveromyces lactis; identical to SEQ ID NO: 1385
  CDS (1)..(1095)

SEQ ID NO: 64891 - protein, 364 aa, Kluyveromyces lactis; identical to SEQ ID NO: 1386

SEQ ID NO: 64892 - DNA, 1074 bp, Erwinia carotovora subsp; identical to SEQ ID NO: 1387
  CDS (1)..(1074)

SEQ ID NO: 64893 - protein, 357 aa, Erwinia carotovora subsp; identical to SEQ ID NO: 1388

SEQ ID NO: 64894 - DNA, 1047 bp, Erwinia carotovora subsp; identical to SEQ ID NO: 1389
  CDS (1)..(1047)

SEQ ID NO: 64895 - protein, 348 aa, Erwinia carotovora subsp; identical to SEQ ID NO: 1390

SEQ ID NO: 64896 - DNA, 1056 bp, Erwinia carotovora subsp; identical to SEQ ID NO: 1391
  CDS (1)..(1056)

SEQ ID NO: 64897 - protein, 351 aa, Erwinia carotovora subsp; identical to SEQ ID NO: 1392

SEQ ID NO: 64898 - DNA, 1113 bp, Acinetobacter sp; identical to SEQ ID NO: 1393
  CDS (1)..(1113)

SEQ ID NO: 64899 - protein, 370 aa, Acinetobacter sp; identical to SEQ ID NO: 1394

SEQ ID NO: 64900 - DNA, 1056 bp, Acinetobacter sp; identical to SEQ ID NO: 1395
  CDS (1)..(1056)

SEQ ID NO: 64901 - protein, 351 aa, Acinetobacter sp; identical to SEQ ID NO: 1396

SEQ ID NO: 64902 - DNA, 1119 bp, Candida glabrata; identical to SEQ ID NO: 1397
  CDS (1)..(1119)

SEQ ID NO: 64903 - protein, 372 aa, Candida glabrata; identical to SEQ ID NO: 1398

SEQ ID NO: 64904 - DNA, 1071 bp, Candida glabrata; identical to SEQ ID NO: 1399
  CDS (1)..(1071)

SEQ ID NO: 64905 - protein, 356 aa, Candida glabrata; identical to SEQ ID NO: 1400

SEQ ID NO: 64906 - DNA, 1083 bp, Photobacterium profundum; identical to SEQ ID NO: 1401
  CDS (1)..(1083)

SEQ ID NO: 64907 - protein, 360 aa, Photobacterium profundum; identical to SEQ ID NO: 1402

SEQ ID NO: 64908 - DNA, 1053 bp, Photobacterium profundum; identical to SEQ ID NO: 1403
  CDS (1)..(1053)

SEQ ID NO: 64909 - protein, 350 aa, Photobacterium profundum; identical to SEQ ID NO: 1404

SEQ ID NO: 64910 - DNA, 1113 bp, Photobacterium profundum; identical to SEQ ID NO: 1405
  CDS (1)..(1113)

SEQ ID NO: 64911 - protein, 370 aa, Photobacterium profundum; identical to SEQ ID NO: 1406

SEQ ID NO: 64912 - DNA, 1056 bp, Photobacterium profundum; identical to SEQ ID NO: 1407
  CDS (1)..(1056)

SEQ ID NO: 64913 - protein, 351 aa, Photobacterium profundum; identical to SEQ ID NO: 1408

SEQ ID NO: 64914 - DNA, 1092 bp, Parachlamydia sp; identical to SEQ ID NO: 1409
  CDS (1)..(1092)

SEQ ID NO: 64915 - protein, 363 aa, Parachlamydia sp; identical to SEQ ID NO: 1410

SEQ ID NO: 64916 - DNA, 1095 bp, Rhodopseudomonas palustris; identical to SEQ ID NO: 1411
  CDS (1)..(1095)

SEQ ID NO: 64917 - protein, 364 aa, Rhodopseudomonas palustris; identical to SEQ ID NO: 1412

SEQ ID NO: 64918 - DNA, 1100 bp, Amycolatopsis methanolica; identical to SEQ ID NO: 1413
  CDS (1)..(1086)

SEQ ID NO: 64919 - protein, 361 aa, Amycolatopsis methanolica; identical to SEQ ID NO: 1414

SEQ ID NO: 64920 - DNA, 1071 bp, Treponema denticola; identical to SEQ ID NO: 1415
  CDS (1)..(1071)

SEQ ID NO: 64921 - protein, 356 aa, Treponema denticola; identical to SEQ ID NO: 1416

SEQ ID NO: 64922 - DNA, 1068 bp, Geobacter sulfurreducens; identical to SEQ ID NO: 1417
  CDS (1)..(1068)

SEQ ID NO: 64923 - protein, 355 aa, Geobacter sulfurreducens; identical to SEQ ID NO: 1418

SEQ ID NO: 64924 - DNA, 1095 bp, Ashbya gossypii; identical to SEQ ID NO: 1419
  CDS (1)..(1095)

SEQ ID NO: 64925 - protein, 364 aa, Ashbya gossypii; identical to SEQ ID NO: 1420

SEQ ID NO: 64926 - DNA, 1122 bp, Ashbya gossypii; identical to SEQ ID NO: 1421
  CDS (1)..(1122)

SEQ ID NO: 64927 - protein, 373 aa, Ashbya gossypii; identical to SEQ ID NO: 1422

SEQ ID NO: 64928 - DNA, 1098 bp, Amycolatopsis balhimycina; identical to SEQ ID NO: 1423
  CDS (1)..(1098)

SEQ ID NO: 64929 - protein, 365 aa, Amycolatopsis balhimycina; identical to SEQ ID NO: 1424

SEQ ID NO: 64930 - DNA, 1053 bp, Vibrio vulnificus; identical to SEQ ID NO: 2345
  CDS (1)..(1053)

SEQ ID NO: 64931 - protein, 350 aa, Vibrio vulnificus; identical to SEQ ID NO: 2346

SEQ ID NO: 64932 - DNA, 1047 bp, Photorhabdus luminescens; identical to SEQ ID NO: 1427
  CDS (1)..(1047)

SEQ ID NO: 64933 - protein, 348 aa, Photorhabdus luminescens; identical to SEQ ID NO: 1428

SEQ ID NO: 64934 - DNA, 1053 bp, Photorhabdus luminescens; identical to SEQ ID NO: 1429
  CDS (1)..(1053)

SEQ ID NO: 64935 - protein, 350 aa, Photorhabdus luminescens; identical to SEQ ID NO: 1430

SEQ ID NO: 64936 - DNA, 1095 bp, Photorhabdus luminescens; identical to SEQ ID NO: 1431
  CDS (1)..(1095)

SEQ ID NO: 64937 - protein, 364 aa, Photorhabdus luminescens; identical to SEQ ID NO: 1432

SEQ ID NO: 64938 - DNA, 1119 bp, Gloeobacter violaceus; identical to SEQ ID NO: 1433
  CDS (1)..(1119)

SEQ ID NO: 64939 - protein, 372 aa, Gloeobacter violaceus; identical to SEQ ID NO: 1434

SEQ ID NO: 64940 - DNA, 1107 bp, Chromobacterium violaceum; identical to SEQ ID NO: 1435
  CDS (1)..(1107)

SEQ ID NO: 64941 - protein, 368 aa, Chromobacterium violaceum; identical to SEQ ID NO: 1436

SEQ ID NO: 64942 - DNA, 1059 bp, Chromobacterium violaceum; identical to SEQ ID NO: 1437
  CDS (1)..(1059)

SEQ ID NO: 64943 - protein, 352 aa, Chromobacterium violaceum; identical to SEQ ID NO: 1438

SEQ ID NO: 64944 - DNA, 1140 bp, Neurospora crassa; identical to SEQ ID NO: 1439
  CDS (1)..(1140)

SEQ ID NO: 64945 - protein, 379 aa, Neurospora crassa; identical to SEQ ID NO: 1440

SEQ ID NO: 64946 - DNA, 1092 bp, Neurospora crassa; identical to SEQ ID NO: 1441
  CDS (1)..(1092)

SEQ ID NO: 64947 - protein, 363 aa, Neurospora crassa; identical to SEQ ID NO: 1442

SEQ ID NO: 64948 - DNA, 1068 bp, Synechococcus sp; identical to SEQ ID NO: 1443
  CDS (1)..(1068)

SEQ ID NO: 64949 - protein, 355 aa, Synechococcus sp; identical to SEQ ID NO: 1444

SEQ ID NO: 64950 - DNA, 1053 bp, Rhodopirellula baltica; identical to SEQ ID NO: 1445
  CDS (1)..(1053)

SEQ ID NO: 64951 - protein, 350 aa, Rhodopirellula baltica; identical to SEQ ID NO: 1446

SEQ ID NO: 64952 - DNA, 1068 bp, Prochlorococcus marinus subsp; identical to SEQ ID NO: 1447
  CDS (1)..(1068)

SEQ ID NO: 64953 - protein, 355 aa, Prochlorococcus marinus subsp; identical to SEQ ID NO: 1448

SEQ ID NO: 64954 - DNA, 1083 bp, Prochlorococcus marinus; identical to SEQ ID NO: 1449
  CDS (1)..(1083)

SEQ ID NO: 64955 - protein, 360 aa, Prochlorococcus marinus; identical to SEQ ID NO: 1450

SEQ ID NO: 64956 - DNA, 1074 bp, Prochlorococcus marinus; identical to SEQ ID NO: 1451
  CDS (1)..(1074)

SEQ ID NO: 64957 - protein, 357 aa, Prochlorococcus marinus; identical to SEQ ID NO: 1452

SEQ ID NO: 64958 - DNA, 1113 bp, Haemophilus ducreyi; identical to SEQ ID NO: 1453
  CDS (1)..(1113)

SEQ ID NO: 64959 - protein, 370 aa, Haemophilus ducreyi; identical to SEQ ID NO: 1454

SEQ ID NO: 64960 - DNA, 1080 bp, Haemophilus ducreyi; identical to SEQ ID NO: 1455
  CDS (1)..(1080)

SEQ ID NO: 64961 - protein, 359 aa, Haemophilus ducreyi; identical to SEQ ID NO: 1456

SEQ ID NO: 64962 - DNA, 1086 bp, Candidatus Blochmannia floridanus; identical to SEQ ID NO: 1457
  CDS (1)..(1086)

SEQ ID NO: 64963 - protein, 361 aa, Candidatus Blochmannia floridanus; identical to SEQ ID NO: 1458

SEQ ID NO: 64964 - DNA, 1074 bp, Bordetella pertussis; identical to SEQ ID NO: 2379
  CDS (1)..(1074)

SEQ ID NO: 64965 - protein, 357 aa, Bordetella pertussis; identical to SEQ ID NO: 1460

SEQ ID NO: 64966 - DNA, 1119 bp, Bordetella bronchiseptica; identical to SEQ ID NO: 1461
  CDS (1)..(1119)

SEQ ID NO: 64967 - protein, 372 aa, Bordetella bronchiseptica; identical to SEQ ID NO: 1462

SEQ ID NO: 64968 - DNA, 1179 bp, Nitrosomonas europaea; identical to SEQ ID NO: 1463
  CDS (1)..(1179)

SEQ ID NO: 64969 - protein, 392 aa, Nitrosomonas europaea; identical to SEQ ID NO: 1464

SEQ ID NO: 64970 - DNA, 1083 bp, Coxiella burnetii; identical to SEQ ID NO: 1465
  CDS (1)..(1083)

SEQ ID NO: 64971 - protein, 360 aa, Coxiella burnetii; identical to SEQ ID NO: 1466

SEQ ID NO: 64972 - DNA, 1053 bp, Vibrio parahaemolyticus; identical to SEQ ID NO: 1471
  CDS (1)..(1053)

SEQ ID NO: 64973 - protein, 350 aa, Vibrio parahaemolyticus; identical to SEQ ID NO: 1472

SEQ ID NO: 64974 - DNA, 1053 bp, Vibrio parahaemolyticus; identical to SEQ ID NO: 1473
  CDS (1)..(1053)

SEQ ID NO: 64975 - protein, 350 aa, Vibrio parahaemolyticus; identical to SEQ ID NO: 1474

SEQ ID NO: 64976 - DNA, 1074 bp, Vibrio parahaemolyticus; identical to SEQ ID NO: 1475
  CDS (1)..(1074)

SEQ ID NO: 64977 - protein, 357 aa, Vibrio parahaemolyticus; identical to SEQ ID NO: 1476

SEQ ID NO: 64978 - DNA, 1083 bp, Pseudomonas syringae; identical to SEQ ID NO: 1477
  CDS (1)..(1083)

SEQ ID NO: 64979 - protein, 360 aa, Pseudomonas syringae; identical to SEQ ID NO: 1478

SEQ ID NO: 64980 - DNA, 1077 bp, Pseudomonas syringae; identical to SEQ ID NO: 1479
  CDS (1)..(1077)

SEQ ID NO: 64981 - protein, 358 aa, Pseudomonas syringae; identical to SEQ ID NO: 1480

SEQ ID NO: 64982 - DNA, 1062 bp, Pseudomonas putida; identical to SEQ ID NO: 1481
  CDS (1)..(1062)

SEQ ID NO: 64983 - protein, 353 aa, Pseudomonas putida; identical to SEQ ID NO: 1482

SEQ ID NO: 64984 - DNA, 1113 bp, Pseudomonas putida; identical to SEQ ID NO: 1483
  CDS (1)..(1113)

SEQ ID NO: 64985 - protein, 370 aa, Pseudomonas putida; identical to SEQ ID NO: 1484

SEQ ID NO: 64986 - DNA, 1086 bp, Bradyrhizobium japonicum; identical to SEQ ID NO: 1485
  CDS (1)..(1086)

SEQ ID NO: 64987 - protein, 361 aa, Bradyrhizobium japonicum; identical to SEQ ID NO: 1486

SEQ ID NO: 64988 - DNA, 1053 bp, Yersinia pestis; identical to SEQ ID NO: 1487
  CDS (1)..(1053)

SEQ ID NO: 64989 - protein, 350 aa, Yersinia pestis; identical to SEQ ID NO: 1488

SEQ ID NO: 64990 - DNA, 1038 bp, Wigglesworthia glossinidia brevipalpis; identical to SEQ ID NO: 1491
  CDS (1)..(1038)

SEQ ID NO: 64991 - protein, 345 aa, Wigglesworthia glossinidia brevipalpis; identical to SEQ ID NO: 1492

SEQ ID NO: 64992 - DNA, 1071 bp, Vibrio vulnificus; identical to SEQ ID NO: 1739
  CDS (1)..(1071)

SEQ ID NO: 64993 - protein, 356 aa, Vibrio vulnificus; identical to SEQ ID NO: 1740

SEQ ID NO: 64994 - DNA, 1053 bp, Vibrio vulnificus; identical to SEQ ID NO: 1493
  CDS (1)..(1053)

SEQ ID NO: 64995 - protein, 350 aa, Vibrio vulnificus; identical to SEQ ID NO: 1494

SEQ ID NO: 64996 - DNA, 1071 bp, Vibrio vulnificus; identical to SEQ ID NO: 1497
  CDS (1)..(1071)

SEQ ID NO: 64997 - protein, 356 aa, Vibrio vulnificus; identical to SEQ ID NO: 1498

SEQ ID NO: 64998 - DNA, 1062 bp, Synechococcus elongatus; identical to SEQ ID NO: 1499
  CDS (1)..(1062)

SEQ ID NO: 64999 - protein, 353 aa, Synechococcus elongatus; identical to SEQ ID NO: 1500

SEQ ID NO: 65000 - DNA, 1032 bp, Streptococcus mutans; identical to SEQ ID NO: 1501
  CDS (1)..(1032)

SEQ ID NO: 65001 - protein, 343 aa, Streptococcus mutans; identical to SEQ ID NO: 1502

SEQ ID NO: 65002 - DNA, 1035 bp, Streptococcus mutans; identical to SEQ ID NO: 1503
  CDS (1)..(1035)

SEQ ID NO: 65003 - protein, 344 aa, Streptococcus mutans; identical to SEQ ID NO: 1504

SEQ ID NO: 65004 - DNA, 1008 bp, Streptococcus agalactiae; identical to SEQ ID NO: 1505
  CDS (1)..(1008)

SEQ ID NO: 65005 - protein, 335 aa, Streptococcus agalactiae; identical to SEQ ID NO: 1506

SEQ ID NO: 65006 - DNA, 1065 bp, Shewanella oneidensis; identical to SEQ ID NO: 1507
  CDS (1)..(1065)

SEQ ID NO: 65007 - protein, 354 aa, Shewanella oneidensis; identical to SEQ ID NO: 1508

SEQ ID NO: 65008 - DNA, 1092 bp, Shewanella oneidensis; identical to SEQ ID NO: 1509
  CDS (1)..(1092)

SEQ ID NO: 65009 - protein, 363 aa, Shewanella oneidensis; identical to SEQ ID NO: 1510

SEQ ID NO: 65010 - DNA, 1059 bp, Shewanella oneidensis; identical to SEQ ID NO: 1511
  CDS (1)..(1059)

SEQ ID NO: 65011 - protein, 352 aa, Shewanella oneidensis; identical to SEQ ID NO: 1512

SEQ ID NO: 65012 - DNA, 1170 bp, Corynebacterium efficiens; identical to SEQ ID NO: 1515
  CDS (1)..(1170)

SEQ ID NO: 65013 - protein, 389 aa, Corynebacterium efficiens; identical to SEQ ID NO: 1516

SEQ ID NO: 65014 - DNA, 1134 bp, Bifidobacterium longum; identical to SEQ ID NO: 1517
  CDS (1)..(1134)

SEQ ID NO: 65015 - protein, 377 aa, Bifidobacterium longum; identical to SEQ ID NO: 1518

SEQ ID NO: 65016 - DNA, 1233 bp, Bifidobacterium longum; identical to SEQ ID NO: 1519
  CDS (1)..(1233)

SEQ ID NO: 65017 - protein, 410 aa, Bifidobacterium longum; identical to SEQ ID NO: 1520

SEQ ID NO: 65018 - DNA, 1221 bp, Phytophthora infestans; identical to SEQ ID NO: 1521
  CDS (20)..(1153)

SEQ ID NO: 65019 - protein, 377 aa, Phytophthora infestans; identical to SEQ ID NO: 1522

SEQ ID NO: 65020 - DNA, 1062 bp, Chlorobium tepidum; identical to SEQ ID NO: 1523
  CDS (1)..(1062)

SEQ ID NO: 65021 - protein, 353 aa, Chlorobium tepidum; identical to SEQ ID NO: 1524

SEQ ID NO: 65022 - DNA, 1074 bp, Xanthomonas campestris; identical to SEQ ID NO: 1525
  CDS (1)..(1074)

SEQ ID NO: 65023 - protein, 357 aa, Xanthomonas campestris; identical to SEQ ID NO: 1526

SEQ ID NO: 65024 - DNA, 1074 bp, Xanthomonas axonopodis; identical to SEQ ID NO: 1527
  CDS (1)..(1074)

SEQ ID NO: 65025 - protein, 357 aa, Xanthomonas axonopodis; identical to SEQ ID NO: 1528

SEQ ID NO: 65026 - DNA, 1080 bp, Ralstonia solanacearum; identical to SEQ ID NO: 1529
  CDS (1)..(1080)

SEQ ID NO: 65027 - protein, 359 aa, Ralstonia solanacearum; identical to SEQ ID NO: 1530

SEQ ID NO: 65028 - DNA, 1179 bp, Ralstonia solanacearum; identical to SEQ ID NO: 1531
  CDS (1)..(1179)

SEQ ID NO: 65029 - protein, 392 aa, Ralstonia solanacearum; identical to SEQ ID NO: 1532

SEQ ID NO: 65030 - DNA, 1065 bp, Synechococcus sp; identical to SEQ ID NO: 1533
  CDS (1)..(1065)

SEQ ID NO: 65031 - protein, 354 aa, Synechococcus sp; identical to SEQ ID NO: 1534

SEQ ID NO: 65032 - DNA, 1035 bp, Escherichia coli; identical to SEQ ID NO: 1535
  CDS (1)..(1035)

SEQ ID NO: 65033 - protein, 344 aa, Escherichia coli; identical to SEQ ID NO: 1536

SEQ ID NO: 65034 - DNA, 1200 bp, Stigmatella aurantiaca; identical to SEQ ID NO: 1537
  CDS (62)..(1147)

SEQ ID NO: 65035 - protein, 361 aa, Stigmatella aurantiaca; identical to SEQ ID NO: 1538

SEQ ID NO: 65036 - DNA, 1083 bp, Amycolatopsis mediterranei; identical to SEQ ID NO: 1541
  CDS (1)..(1083)

SEQ ID NO: 65037 - protein, 360 aa, Amycolatopsis mediterranei; identical to SEQ ID NO: 1542

SEQ ID NO: 65038 - DNA, 1053 bp, Pasteurella multocida; identical to SEQ ID NO: 1543
  CDS (1)..(1053)

SEQ ID NO: 65039 - protein, 350 aa, Pasteurella multocida; identical to SEQ ID NO: 1544

SEQ ID NO: 65040 - DNA, 1086 bp, Pasteurella multocida; identical to SEQ ID NO: 1545
  CDS (1)..(1086)

SEQ ID NO: 65041 - protein, 361 aa, Pasteurella multocida; identical to SEQ ID NO: 1546

SEQ ID NO: 65042 - DNA, 1125 bp, Emericella nidulans; identical to SEQ ID NO: 1547
  CDS (1)..(1125)

SEQ ID NO: 65043 - protein, 374 aa, Emericella nidulans; identical to SEQ ID NO: 1548

SEQ ID NO: 65044 - DNA, 1089 bp, Emericella nidulans; identical to SEQ ID NO: 1549
  CDS (1)..(1089)

SEQ ID NO: 65045 - protein, 362 aa, Emericella nidulans; identical to SEQ ID NO: 1550

SEQ ID NO: 65046 - DNA, 1239 bp, Vibrio cholerae; identical to SEQ ID NO: 1551
  CDS (114)..(1175)

SEQ ID NO: 65047 - protein, 353 aa, Vibrio cholerae; identical to SEQ ID NO: 1552

SEQ ID NO: 65048 - DNA, 2184 bp, Candida albicans; identical to SEQ ID NO: 1553
  CDS (461)..(1573)

SEQ ID NO: 65049 - protein, 370 aa, Candida albicans; identical to SEQ ID NO: 1554

SEQ ID NO: 65050 - DNA, 1047 bp, Buchnera aphidicola; identical to SEQ ID NO: 1555
  CDS (1)..(1047)

SEQ ID NO: 65051 - protein, 348 aa, Buchnera aphidicola; identical to SEQ ID NO: 1556

SEQ ID NO: 65052 - DNA, 1047 bp, Buchnera aphidicola; identical to SEQ ID NO: 1557
  CDS (1)..(1047)

SEQ ID NO: 65053 - protein, 348 aa, Buchnera aphidicola; identical to SEQ ID NO: 1558

SEQ ID NO: 65054 - DNA, 1047 bp, Erwinia herbicola; identical to SEQ ID NO: 1559
  CDS (1)..(1047)

SEQ ID NO: 65055 - protein, 348 aa, Erwinia herbicola; identical to SEQ ID NO: 1560

SEQ ID NO: 65056 - DNA, 1047 bp, Salmonella typhimurium; identical to SEQ ID NO: 1561
  CDS (1)..(1047)

SEQ ID NO: 65057 - protein, 348 aa, Salmonella typhimurium; identical to SEQ ID NO: 1562

SEQ ID NO: 65058 - DNA, 1047 bp, Shigella flexneri; identical to SEQ ID NO: 2473
  CDS (1)..(1047)

SEQ ID NO: 65059 - protein, 348 aa, Shigella flexneri; identical to SEQ ID NO: 2474

SEQ ID NO: 65060 - DNA, 25 bp, Artificial sequence
  (1)..(25): primer
atgttcattaaaaacgatcacgccg

SEQ ID NO: 65061 - DNA, 25 bp, Artificial sequence
  (1)..(25): primer
ctattttttcaaggcctttcttctg

SEQ ID NO: 65062 - protein, 353 aa, Artificial sequence; identical to SEQ ID NO: 24922
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(37): xaa in position 37 is any amino acid
  Variant (39)..(46): xaa in position 39 to 46 is any amino acid
  Variant (51)..(51): xaa in position 51 is any amino acid
  Variant (54)..(56): xaa in position 54 to 56 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(130): xaa in position 121 to 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(168): xaa in position 166 to 168 is any amino acid
  Variant (171)..(171): xaa in position 171 is any amino acid
  Variant (174)..(174): xaa in position 174 is any amino acid
  Variant (176)..(176): xaa in position 176 is any amino acid
  Variant (181)..(181): xaa in position 181 is any amino acid
  Variant (183)..(183): xaa in position 183 is any amino acid
  Variant (185)..(188): xaa in position 185 to 188 is any amino acid
  Variant (190)..(191): xaa in position 190 to 191 is any amino acid
  Variant (193)..(195): xaa in position 193 to 195 is any amino acid
  Variant (197)..(199): xaa in position 197 to 199 is any amino acid
  Variant (201)..(201): xaa in position 201 is any amino acid
  Variant (203)..(208): xaa in position 203 to 208 is any amino acid
  Variant (210)..(215): xaa in position 210 to 215 is any amino acid
  Variant (217)..(217): xaa in position 217 is any amino acid
  Variant (220)..(222): xaa in position 220 to 222 is any amino acid
  Variant (224)..(225): xaa in position 224 to 225 is any amino acid
  Variant (230)..(238): xaa in position 230 to 238 is any amino acid
  Variant (241)..(269): xaa in position 241 to 269 is any amino acid
  Variant (271)..(271): xaa in position 271 is any amino acid
  Variant (274)..(274): xaa in position 274 is any amino acid
  Variant (277)..(277): xaa in position 277 is any amino acid
  Variant (279)..(282): xaa in position 279 to 282 is any amino acid
  Variant (284)..(285): xaa in position 284 to 285 is any amino acid
  Variant (287)..(292): xaa in position 287 to 292 is any amino acid
  Variant (294)..(296): xaa in position 294 to 296 is any amino acid
  Variant (298)..(305): xaa in position 298 to 305 is any amino acid
  Variant (307)..(307): xaa in position 307 is any amino acid
  Variant (309)..(309): xaa in position 309 is any amino acid
  Variant (312)..(315): xaa in position 312 to 315 is any amino acid
  Variant (317)..(317): xaa in position 317 is any amino acid
  Variant (319)..(334): xaa in position 319 to 334 is any amino acid
  Variant (337)..(337): xaa in position 337 is any amino acid
  Variant (339)..(339): xaa in position 339 is any amino acid
  Variant (342)..(342): xaa in position 342 is any amino acid
  Variant (344)..(345): xaa in position 344 to 345 is any amino acid
  Variant (347)..(348): xaa in position 347 to 348 is any amino acid
  Variant (350)..(352): xaa in position 350 to 352 is any amino acid

SEQ ID NO: 65063 - protein, 72 aa, Artificial sequence; identical to SEQ ID NO: 2906
  Variant (5)..(5): xaa in position 5 is Ile, Val, Ser or Leu
  Variant (6)..(6): xaa in position 6 is His or Asp
  Variant (7)..(7): xaa in position 7 is Asp or Asn
  Variant (8)..(10): xaa in position 8 to 10 is any amino acid
  Variant (11)..(11): xaa in position 11 is Ala, Val or Gly
  Variant (12)..(12): xaa in position 12 is any amino acid
  Variant (13)..(13): xaa in position 13 is Glu, Asp, Ala or Gln
  Variant (15)..(15): xaa in position 15 is Ala, Gly or Cys
  Variant (16)..(17): xaa in position 16 to 17 is any amino acid
  Variant (18)..(18): xaa in position 18 is Leu, Ile or Phe
  Variant (19)..(28): xaa in position 19 to 28 is any amino acid
  Variant (29)..(30): xaa in position 29 to 30 is any or no amino acid
  Variant (31)..(31): xaa in position 31 is Leu, Ile, Phe or Met
  Variant (32)..(32): xaa in position 32 is any amino acid
  Variant (33)..(33): xaa in position 33 is Ile, Val, Leu or Met
  Variant (34)..(34): xaa in position 34 is Val, Ile or Leu
  Variant (37)..(37): xaa in position 37 is Val, Ala or Thr
  Variant (39)..(39): xaa in position 39 is Phe, Leu, Thr or Val
  Variant (40)..(40): xaa in position 40 is Glu or Ala
  Variant (45)..(46): xaa in position 45 to 46 is any amino acid
  Variant (47)..(47): xaa in position 47 is any or no amino acid
  Variant (49)..(49): xaa in position 49 is Trp or Tyr
  Variant (50)..(50): xaa in position 50 is Lys or Arg
  Variant (52)..(52): xaa in position 52 is Leu, Phe, Met or Tyr
  Variant (53)..(53): xaa in position 53 is Ile, Val, Ala or Leu
  Variant (54)..(54): xaa in position 54 is any amino acid
  Variant (55)..(55): xaa in position 55 is Asp, Glu or Gln
  Variant (57)..(57): xaa in position 57 is any amino acid
  Variant (58)..(58): xaa in position 58 is Leu, Met, Ile, Val, Ala or Thr
  Variant (59)..(59): xaa in position 59 is Asp, Asn or Ser
  Variant (60)..(63): xaa in position 60 to 63 is any amino acid
  Variant (64)..(64): xaa in position 64 is Ile, Val, Leu or Met
  Variant (65)..(66): xaa in position 65 to 66 is any amino acid
  Variant (68)..(68): xaa in position 68 is Leu, Ile, Met or Val
  Variant (69)..(70): xaa in position 69 to 70 is any amino acid
  Variant (71)..(71): xaa in position 71 is Ala, Ser, Gly, Val or Thr

SEQ ID NO: 65064 - protein, 76 aa, Artificial sequence; identical to SEQ ID NO: 2907
  Variant (1)..(1): xaa in position 1 is Ala or Ser
  Variant (2)..(2): xaa in position 2 is Ile or Val
  Variant (6)..(6): xaa in position 6 is Thr, Ser or Asn
  Variant (7)..(7): xaa in position 7 is Thr, Val, Ala, Ser or Ile
  Variant (8)..(8): xaa in position 8 is Glu or Ala
  Variant (9)..(9): xaa in position 9 is Ser, Asp or Asn
  Variant (11)..(11): xaa in position 11 is any amino acid
  Variant (14)..(14): xaa in position 14 is Glu, Gln, Phe or Met
  Variant (15)..(15): xaa in position 15 is Leu, Met, Val, Phe or Ile
  Variant (16)..(16): xaa in position 16 is Ala, Ser, Thr, Cys or Val
  Variant (18)..(18): xaa in position 18 is Gly, Ala or Asn
  Variant (19)..(21): xaa in position 19 to 21 is any amino acid
  Variant (22)..(22): xaa in position 22 is Pro or Ala
  Variant (23)..(23): xaa in position 23 is Val, Ile, Thr or Leu
  Variant (25)..(25): xaa in position 25 is Phe, Met, Tyr or Ile
  Variant (28)..(28): xaa in position 28 is any amino acid
  Variant (29)..(29): xaa in position 29 is Thr, Ser or Arg
  Variant (30)..(30): xaa in position 30 is any amino acid
  Variant (32)..(35): xaa in position 32 to 35 is any amino acid
  Variant (36)..(36): xaa in position 36 is Ala or Met
  Variant (37)..(37): xaa in position 37 is any amino acid
  Variant (38)..(38): xaa in position 38 is Asp, Asn or Glu
  Variant (39)..(39): xaa in position 39 is Ala or Gly
  Variant (40)..(41): xaa in position 40 to 41 is any amino acid
  Variant (42)..(42): xaa in position 42 is Ala or Ser
  Variant (43)..(43): xaa in position 43 is Ala, Ser, Val or Thr
  Variant (44)..(46): xaa in position 44 to 46 is any amino acid
  Variant (47)..(47): xaa in position 47 is His or Gln
  Variant (48)..(48): xaa in position 48 is any amino acid
  Variant (49)..(49): xaa in position 49 is Phe, Tyr, His or Val
  Variant (50)..(51): xaa in position 50 to 51 is any amino acid
  Variant (52)..(55): xaa in position 52 to 55 is any or no amino acid
  Variant (57)..(60): xaa in position 57 to 60 is any amino acid
  Variant (61)..(62): xaa in position 61 to 62 is any or no amino acid
  Variant (63)..(63): xaa in position 63 is Thr or Ser
  Variant (64)..(64): xaa in position 64 is any amino acid
  Variant (67)..(69): xaa in position 67 to 69 is any amino acid
  Variant (70)..(70): xaa in position 70 is His or Phe
  Variant (71)..(71): xaa in position 71 is Val, Ile, Leu or Ala
  Variant (72)..(72): xaa in position 72 is Ile or Val
  Variant (73)..(73): xaa in position 73 is Leu or Met
  Variant (76)..(76): xaa in position 76 is Gly, Ala or Ser

SEQ ID NO: 65065 - protein, 83 aa, Artificial sequence; identical to SEQ ID NO: 2908
  Variant (1)..(1): xaa in position 1 is Leu, Ile or Val
  Variant (2)..(2): xaa in position 2 is Met, Val, Ile or Leu
  Variant (3)..(3): xaa in position 3 is Ile or Val
  Variant (5)..(5): xaa in position 5 is Cys, Phe, Ala, Thr or Tyr
  Variant (6)..(6): xaa in position 6 is Ser, Asn or Ala
  Variant (8)..(8): xaa in position 8 is Gly, Ala or Asp
  Variant (10)..(10): xaa in position 10 is Ser or Cys
  Variant (11)..(11): xaa in position 11 is any amino acid
  Variant (13)..(15): xaa in position 13 to 15 is any amino acid
  Variant (16)..(16): xaa in position 16 is Arg, Asn, Lys, Leu or Glu
  Variant (18)..(19): xaa in position 18 to 19 is any amino acid
  Variant (20)..(20): xaa in position 20 is Val or Ile
  Variant (21)..(26): xaa in position 21 to 26 is any amino acid
  Variant (27)..(27): xaa in position 27 is Gln, Asn or Arg
  Variant (28)..(28): xaa in position 28 is Ile, Leu, Val, Arg or Met
  Variant (29)..(30): xaa in position 29 to 30 is any amino acid
  Variant (31)..(31): xaa in position 31 is Gly, Asn or Asp
  Variant (32)..(32): xaa in position 32 is any amino acid
  Variant (33)..(37): xaa in position 33 to 37 is any or no amino acid
  Variant (38)..(38): xaa in position 38 is Ile, Val or Leu
  Variant (39)..(39): xaa in position 39 is any amino acid
  Variant (41)..(41): xaa in position 41 is any amino acid
  Variant (43)..(43): xaa in position 43 is Ile, Leu, Val, Ala or Met
  Variant (46)..(46): xaa in position 46 is His, Phe, Asn or Tyr
  Variant (47)..(47): xaa in position 47 is Leu or Ile
  Variant (48)..(49): xaa in position 48 to 49 is any amino acid
  Variant (51)..(51): xaa in position 51 is any amino acid
  Variant (53)..(57): xaa in position 53 to 57 is any amino acid
  Variant (58)..(69): xaa in position 58 to 69 is any or no amino acid
  Variant (71)..(71): xaa in position 71 is any amino acid
  Variant (73)..(73): xaa in position 73 is Ile or Val
  Variant (76)..(76): xaa in position 76 is any amino acid
  Variant (78)..(78): xaa in position 78 is Ile, Leu or Val
  Variant (79)..(79): xaa in position 79 is any amino acid
  Variant (80)..(80): xaa in position 80 is Trp, Ile, Leu or Phe
  Variant (81)..(82): xaa in position 81 to 82 is any amino acid
  Variant (83)..(83): xaa in position 83 is Thr or Ser

SEQ ID NO: 65066 - DNA, 1431 bp, Escherichia coli; identical to SEQ ID NO: 14875
  CDS (1)..(1431)

SEQ ID NO: 65067 - protein, 476 aa, Escherichia coli; identical to SEQ ID NO: 14876

SEQ ID NO: 65068 - DNA, 1638 bp, Fusobacterium nucleatum subsp. nucleatum ATCC 25586; identical to SEQ ID NO: 14877
  CDS (1)..(1638): transl_table=11

SEQ ID NO: 65069 - protein, 545 aa, Fusobacterium nucleatum subsp. nucleatum ATCC 25586; identical to SEQ ID NO: 14878

SEQ ID NO: 65070 - DNA, 1392 bp, Clostridium tetani E88; identical to SEQ ID NO: 14879
  CDS (1)..(1392): transl_table=11

SEQ ID NO: 65071 - protein, 463 aa, Clostridium tetani E88; identical to SEQ ID NO: 14880

SEQ ID NO: 65072 - DNA, 1380 bp, Bacteroides thetaiotaomicron VPI-5482; identical to SEQ ID NO: 14881
  CDS (1)..(1380): transl_table=11

SEQ ID NO: 65073 - protein, 459 aa, Bacteroides thetaiotaomicron VPI-5482; identical to SEQ ID NO: 14882

SEQ ID NO: 65074 - DNA, 1380 bp, Porphyromonas gingivalis W83; identical to SEQ ID NO: 14883
  CDS (1)..(1380): transl_table=11

SEQ ID NO: 65075 - protein, 459 aa, Porphyromonas gingivalis W83; identical to SEQ ID NO: 14884

SEQ ID NO: 65076 - DNA, 1449 bp, Rhodopseudomonas palustris CGA009; identical to SEQ ID NO: 14885
  CDS (1)..(1449): transl_table=11

SEQ ID NO: 65077 - protein, 482 aa, Rhodopseudomonas palustris CGA009; identical to SEQ ID NO: 14886

SEQ ID NO: 65078 - DNA, 1380 bp, Treponema denticola ATCC 35405; identical to SEQ ID NO: 14887
  CDS (1)..(1380): transl_table=11

SEQ ID NO: 65079 - protein, 459 aa, Treponema denticola ATCC 35405; identical to SEQ ID NO: 14888

SEQ ID NO: 65080 - DNA, 1380 bp, Treponema denticola ATCC 35405; identical to SEQ ID NO: 14889
  CDS (1)..(1380): transl_table=11

SEQ ID NO: 65081 - protein, 459 aa, Treponema denticola ATCC 35405; identical to SEQ ID NO: 14890

SEQ ID NO: 65082 - DNA, 1617 bp, Entamoeba histolytica HM-1:IMSS; identical to SEQ ID NO: 14891
  CDS (1)..(1617)

SEQ ID NO: 65083 - protein, 538 aa, Entamoeba histolytica HM-1:IMSS; identical to SEQ ID NO: 14892

SEQ ID NO: 65084 - DNA, 1389 bp, Desulfovibrio vulgaris subsp. vulgaris str. Hildenborough; identical to SEQ ID NO: 14893
  CDS (1)..(1389): transl_table=11

SEQ ID NO: 65085 - protein, 462 aa, Desulfovibrio vulgaris subsp. vulgaris str. Hildenborough; identical to SEQ ID NO: 14894

SEQ ID NO: 65086 - DNA, 1377 bp, Propionibacterium acnes KPA171202; identical to SEQ ID NO: 14895
  CDS (1)..(1377): transl_table=11

SEQ ID NO: 65087 - protein, 458 aa, Propionibacterium acnes KPA171202; identical to SEQ ID NO: 14896

SEQ ID NO: 65088 - DNA, 1365 bp, Symbiobacterium thermophilum IAM 14863; identical to SEQ ID NO: 14897
  CDS (1)..(1365): transl_table=11

SEQ ID NO: 65089 - protein, 454 aa, Symbiobacterium thermophilum IAM 14863; identical to SEQ ID NO: 14898

SEQ ID NO: 65090 - DNA, 1416 bp, Symbiobacterium thermophilum IAM 14863; identical to SEQ ID NO: 14899
  CDS (1)..(1416): transl_table=11

SEQ ID NO: 65091 - protein, 471 aa, Symbiobacterium thermophilum IAM 14863; identical to SEQ ID NO: 14900

SEQ ID NO: 65092 - DNA, 1443 bp, Photobacterium profundum SS9; identical to SEQ ID NO: 14901
  CDS (1)..(1443): transl_table=11

SEQ ID NO: 65093 - protein, 480 aa, Photobacterium profundum SS9; identical to SEQ ID NO: 14902

SEQ ID NO: 65094 - DNA, 1467 bp, Photobacterium profundum SS9; identical to SEQ ID NO: 14903
  CDS (1)..(1467): transl_table=11

SEQ ID NO: 65095 - protein, 488 aa, Photobacterium profundum SS9; identical to SEQ ID NO: 14904

SEQ ID NO: 65096 - DNA, 1401 bp, Photobacterium profundum SS9; identical to SEQ ID NO: 14905
  CDS (1)..(1401): transl_table=11

SEQ ID NO: 65097 - protein, 466 aa, Photobacterium profundum SS9; identical to SEQ ID NO: 14906

SEQ ID NO: 65098 - DNA, 1344 bp, Haloarcula marismortui ATCC 43049; identical to SEQ ID NO: 14907
  CDS (1)..(1344): transl_table=11

SEQ ID NO: 65099 - protein, 447 aa, Haloarcula marismortui ATCC 43049; identical to SEQ ID NO: 14908

SEQ ID NO: 65100 - DNA, 1449 bp, Azoarcus sp. EbN1; identical to SEQ ID NO: 14909
  CDS (1)..(1449): transl_table=11

SEQ ID NO: 65101 - protein, 482 aa, Azoarcus sp. EbN1; identical to SEQ ID NO: 14910

SEQ ID NO: 65102 - DNA, 1404 bp, Nostoc punctiforme PCC 73102; identical to SEQ ID NO: 14911
  CDS (1)..(1404)

SEQ ID NO: 65103 - protein, 467 aa, Nostoc punctiforme PCC 73102; identical to SEQ ID NO: 14912

SEQ ID NO: 65104 - DNA, 1416 bp, Haemophilus somnus 129PT; identical to SEQ ID NO: 14913
  CDS (1)..(1416)

SEQ ID NO: 65105 - protein, 471 aa, Haemophilus somnus 129PT; identical to SEQ ID NO: 14914

SEQ ID NO: 65106 - DNA, 1569 bp, Fusobacterium nucleatum subsp. vincentii ATCC 49256; identical to SEQ ID NO: 14915
  CDS (1)..(1569): transl_table=11

SEQ ID NO: 65107 - protein, 522 aa, Fusobacterium nucleatum subsp. vincentii ATCC 49256; identical to SEQ ID NO: 14916

SEQ ID NO: 65108 - DNA, 1383 bp, Fusobacterium nucleatum subsp. vincentii ATCC 49256; identical to SEQ ID NO: 14917
  CDS (1)..(1383): transl_table=11

SEQ ID NO: 65109 - protein, 460 aa, Fusobacterium nucleatum subsp. vincentii ATCC 49256; identical to SEQ ID NO: 14918

SEQ ID NO: 65110 - DNA, 1182 bp, Haemophilus influenzae 86-028NP; identical to SEQ ID NO: 14919
  CDS (1)..(1182)

SEQ ID NO: 65111 - protein, 393 aa, Haemophilus influenzae 86-028NP; identical to SEQ ID NO: 14920

SEQ ID NO: 65112 - DNA, 1347 bp, Solibacter usitatus Ellin6076; identical to SEQ ID NO: 14921
  CDS (1)..(1347): transl_table=11

SEQ ID NO: 65113 - protein, 448 aa, Solibacter usitatus Ellin6076; identical to SEQ ID NO: 14922

SEQ ID NO: 65114 - DNA, 1374 bp, Desulfitobacterium hafniense DCB-2; identical to SEQ ID NO: 14923
  CDS (1)..(1374): transl_table=11

SEQ ID NO: 65115 - protein, 457 aa, Desulfitobacterium hafniense DCB-2; identical to SEQ ID NO: 14924

SEQ ID NO: 65116 - DNA, 1389 bp, Desulfitobacterium hafniense DCB-2; identical to SEQ ID NO: 14925
  CDS (1)..(1389): transl_table=11

SEQ ID NO: 65117 - protein, 462 aa, Desulfitobacterium hafniense DCB-2; identical to SEQ ID NO: 14926

SEQ ID NO: 65118 - DNA, 1443 bp, uncultured bacterium; identical to SEQ ID NO: 14927
  CDS (1)..(1443)

SEQ ID NO: 65119 - protein, 480 aa, uncultured bacterium; identical to SEQ ID NO: 14928

SEQ ID NO: 65120 - DNA, 1365 bp, Symbiobacterium thermophilum; identical to SEQ ID NO: 14929
  CDS (1)..(1365)

SEQ ID NO: 65121 - protein, 454 aa, Symbiobacterium thermophilum; identical to SEQ ID NO: 14930

SEQ ID NO: 65122 - DNA, 1365 bp, Symbiobacterium thermophilum; identical to SEQ ID NO: 14897
  CDS (1)..(1365)

SEQ ID NO: 65123 - protein, 454 aa, Symbiobacterium thermophilum; identical to SEQ ID NO: 14898

SEQ ID NO: 65124 - DNA, 1386 bp, Chromobacterium violaceum; identical to SEQ ID NO: 14933
  CDS (1)..(1386): transl_table=11

SEQ ID NO: 65125 - protein, 461 aa, Chromobacterium violaceum; identical to SEQ ID NO: 14934

SEQ ID NO: 65126 - DNA, 1419 bp, Clostridium tetani; identical to SEQ ID NO: 14935
  CDS (1)..(1419): transl_table=11

SEQ ID NO: 65127 - protein, 472 aa, Clostridium tetani; identical to SEQ ID NO: 14936

SEQ ID NO: 65128 - DNA, 1389 bp, Enterobacter aerogenes; identical to SEQ ID NO: 14937
  CDS (1)..(1389): transl_table=11

SEQ ID NO: 65129 - protein, 462 aa, Enterobacter aerogenes; identical to SEQ ID NO: 14938

SEQ ID NO: 65130 - DNA, 1419 bp, Haemophilus influenzae; identical to SEQ ID NO: 14939
  CDS (1)..(1419): transl_table=11

SEQ ID NO: 65131 - protein, 472 aa, Haemophilus influenzae; identical to SEQ ID NO: 14940

SEQ ID NO: 65132 - DNA, 1347 bp, Halobacterium salinarium; identical to SEQ ID NO: 14941
  CDS (1)..(1347)

SEQ ID NO: 65133 - protein, 448 aa, Halobacterium salinarium; identical to SEQ ID NO: 14942

SEQ ID NO: 65134 - DNA, 1416 bp, Pasteurella multocida; identical to SEQ ID NO: 14943
  CDS (1)..(1416): transl_table=11

SEQ ID NO: 65135 - protein, 471 aa, Pasteurella multocida; identical to SEQ ID NO: 14944

SEQ ID NO: 65136 - DNA, 1401 bp, Photorhabdus luminescens; identical to SEQ ID NO: 14945
  CDS (1)..(1401): transl_table=11

SEQ ID NO: 65137 - protein, 466 aa, Photorhabdus luminescens; identical to SEQ ID NO: 14946

SEQ ID NO: 65138 - DNA, 1398 bp, Proteus inconstans; identical to SEQ ID NO: 14947
  CDS (1)..(1398): transl_table=11

SEQ ID NO: 65139 - protein, 465 aa, Proteus inconstans; identical to SEQ ID NO: 14948

SEQ ID NO: 65140 - DNA, 1404 bp, Proteus vulgaris; identical to SEQ ID NO: 14949
  CDS (1)..(1404): transl_table=11

SEQ ID NO: 65141 - protein, 467 aa, Proteus vulgaris; identical to SEQ ID NO: 14950

SEQ ID NO: 65142 - DNA, 1365 bp, Rhodobacter capsulatus; identical to SEQ ID NO: 14951
  CDS (1)..(1365): transl_table=11

SEQ ID NO: 65143 - protein, 454 aa, Rhodobacter capsulatus; identical to SEQ ID NO: 14952

SEQ ID NO: 65144 - DNA, 1389 bp, Thermoanaerobacter tengcongensis; identical to SEQ ID NO: 14953
  CDS (1)..(1389): transl_table=11

SEQ ID NO: 65145 - protein, 462 aa, Thermoanaerobacter tengcongensis; identical to SEQ ID NO: 14954

SEQ ID NO: 65146 - DNA, 1419 bp, Vibrio cholerae; identical to SEQ ID NO: 14955
  CDS (1)..(1419): transl_table=11

SEQ ID NO: 65147 - protein, 472 aa, Vibrio cholerae; identical to SEQ ID NO: 14956

SEQ ID NO: 65148 - DNA, 1401 bp, Vibrio parahaemolyticus; identical to SEQ ID NO: 14957
  CDS (1)..(1401): transl_table=11

SEQ ID NO: 65149 - protein, 466 aa, Vibrio parahaemolyticus; identical to SEQ ID NO: 14958

SEQ ID NO: 65150 - DNA, 1422 bp, Vibrio vulnificus; identical to SEQ ID NO: 14959
  CDS (1)..(1422): transl_table=11

SEQ ID NO: 65151 - protein, 473 aa, Vibrio vulnificus; identical to SEQ ID NO: 14960

SEQ ID NO: 65152 - DNA, 1371 bp, Citrobacter freundii; identical to SEQ ID NO: 14961
  CDS (1)..(1371): transl_table=11

SEQ ID NO: 65153 - protein, 456 aa, Citrobacter freundii; identical to SEQ ID NO: 14962

SEQ ID NO: 65154 - DNA, 1383 bp, Clostridium tetani; identical to SEQ ID NO: 14963
  CDS (1)..(1383)

SEQ ID NO: 65155 - protein, 460 aa, Clostridium tetani; identical to SEQ ID NO: 14964

SEQ ID NO: 65156 - DNA, 1371 bp, Enterobacter agglomerans; identical to SEQ ID NO: 14965
  CDS (1)..(1371): transl_table=11

SEQ ID NO: 65157 - protein, 456 aa, Enterobacter agglomerans; identical to SEQ ID NO: 14966

SEQ ID NO: 65158 - DNA, 1383 bp, Fusobacterium nucleatum; identical to SEQ ID NO: 14967
  CDS (1)..(1383): transl_table=11

SEQ ID NO: 65159 - protein, 460 aa, Fusobacterium nucleatum; identical to SEQ ID NO: 14968

SEQ ID NO: 65160 - DNA, 1377 bp, Pasteurella multocida; identical to SEQ ID NO: 14969
  CDS (1)..(1377): transl_table=11

SEQ ID NO: 65161 - protein, 458 aa, Pasteurella multocida; identical to SEQ ID NO: 14970

SEQ ID NO: 65162 - DNA, 1377 bp, Symbiobacterium sp; identical to SEQ ID NO: 14971
  CDS (1)..(1377): transl_table=11

SEQ ID NO: 65163 - protein, 458 aa, Symbiobacterium sp; identical to SEQ ID NO: 14972

SEQ ID NO: 65164 - DNA, 27 bp, Artificial sequence
  (1)..(27): primer
atgaaggattatgtaatggaaaacttt

SEQ ID NO: 65165 - DNA, 26 bp, Artificial sequence
  (1)..(26): primer
ttaaacttctttaagttttgcggtga

SEQ ID NO: 65166 - protein, 533 aa, Artificial sequence; identical to SEQ ID NO: 14975
  Variant (2)..(2): xaa in position 2 is any amino acid
  Variant (7)..(7): xaa in position 7 is any amino acid
  Variant (10)..(10): xaa in position 10 is any amino acid
  Variant (12)..(18): xaa in position 12 to 18 is any amino acid
  Variant (20)..(22): xaa in position 20 to 22 is any amino acid
  Variant (24)..(25): xaa in position 24 to 25 is any amino acid
  Variant (27)..(28): xaa in position 27 to 28 is any amino acid
  Variant (30)..(30): xaa in position 30 is any amino acid
  Variant (32)..(32): xaa in position 32 is any amino acid
  Variant (34)..(34): xaa in position 34 is any amino acid
  Variant (36)..(37): xaa in position 36 to 37 is any amino acid
  Variant (49)..(49): xaa in position 49 is any amino acid
  Variant (53)..(54): xaa in position 53 to 54 is any amino acid
  Variant (56)..(56): xaa in position 56 is any or no amino acid
  Variant (61)..(61): xaa in position 61 is any amino acid
  Variant (70)..(71): xaa in position 70 to 71 is any amino acid
  Variant (73)..(74): xaa in position 73 to 74 is any amino acid
  Variant (76)..(78): xaa in position 76 to 78 is any amino acid
  Variant (80)..(80): xaa in position 80 is any amino acid
  Variant (83)..(83): xaa in position 83 is any amino acid
  Variant (86)..(88): xaa in position 86 to 88 is any amino acid
  Variant (89)..(134): xaa in position 89 to 134 is any or no amino acid
  Variant (137)..(137): xaa in position 137 is any amino acid
  Variant (145)..(145): xaa in position 145 is any amino acid
  Variant (147)..(150): xaa in position 147 to 150 is any amino acid
  Variant (153)..(160): xaa in position 153 to 160 is any amino acid
  Variant (161)..(170): xaa in position 161 to 170 is any or no amino acid
  Variant (172)..(173): xaa in position 172 to 173 is any amino acid
  Variant (175)..(175): xaa in position 175 is any amino acid
  Variant (178)..(179): xaa in position 178 to 179 is any amino acid
  Variant (181)..(184): xaa in position 181 to 184 is any amino acid
  Variant (187)..(190): xaa in position 187 to 190 is any amino acid
  Variant (192)..(195): xaa in position 192 to 195 is any amino acid
  Variant (197)..(202): xaa in position 197 to 202 is any amino acid
  Variant (203)..(210): xaa in position 203 to 210 is any or no amino acid
  Variant (214)..(215): xaa in position 214 to 215 is any amino acid
  Variant (218)..(218): xaa in position 218 is any amino acid
  Variant (221)..(223): xaa in position 221 to 223 is any amino acid
  Variant (225)..(227): xaa in position 225 to 227 is any amino acid
  Variant (229)..(230): xaa in position 229 to 230 is any amino acid
  Variant (231)..(231): xaa in position 231 is any or no amino acid
  Variant (233)..(234): xaa in position 233 to 234 is any amino acid
  Variant (236)..(238): xaa in position 236 to 238 is any amino acid
  Variant (241)..(241): xaa in position 241 is any amino acid
  Variant (243)..(244): xaa in position 243 to 244 is any amino acid
  Variant (252)..(252): xaa in position 252 is any amino acid
  Variant (256)..(259): xaa in position 256 to 259 is any amino acid
  Variant (261)..(263): xaa in position 261 to 263 is any amino acid
  Variant (265)..(265): xaa in position 265 is any amino acid
  Variant (267)..(267): xaa in position 267 is any amino acid
  Variant (269)..(270): xaa in position 269 to 270 is any amino acid
  Variant (273)..(273): xaa in position 273 is any amino acid
  Variant (275)..(276): xaa in position 275 to 276 is any amino acid
  Variant (283)..(285): xaa in position 283 to 285 is any amino acid
  Variant (287)..(288): xaa in position 287 to 288 is any amino acid
  Variant (290)..(292): xaa in position 290 to 292 is any amino acid
  Variant (295)..(296): xaa in position 295 to 296 is any amino acid
  Variant (298)..(299): xaa in position 298 to 299 is any amino acid
  Variant (301)..(301): xaa in position 301 is any amino acid
  Variant (303)..(303): xaa in position 303 is any amino acid
  Variant (307)..(309): xaa in position 307 to 309 is any amino acid
  Variant (316)..(316): xaa in position 316 is any amino acid
  Variant (323)..(323): xaa in position 323 is any amino acid
  Variant (325)..(327): xaa in position 325 to 327 is any amino acid
  Variant (329)..(330): xaa in position 329 to 330 is any amino acid
  Variant (331)..(348): xaa in position 331 to 348 is any or no amino acid
  Variant (351)..(357): xaa in position 351 to 357 is any amino acid
  Variant (359)..(360): xaa in position 359 to 360 is any amino acid
  Variant (363)..(364): xaa in position 363 to 364 is any amino acid
  Variant (370)..(370): xaa in position 370 is any amino acid
  Variant (375)..(375): xaa in position 375 is any amino acid
  Variant (379)..(379): xaa in position 379 is any amino acid
  Variant (382)..(382): xaa in position 382 is any amino acid
  Variant (384)..(388): xaa in position 384 to 388 is any amino acid
  Variant (391)..(392): xaa in position 391 to 392 is any amino acid
  Variant (395)..(395): xaa in position 395 is any amino acid
  Variant (398)..(398): xaa in position 398 is any amino acid
  Variant (401)..(403): xaa in position 401 to 403 is any amino acid
  Variant (405)..(407): xaa in position 405 to 407 is any amino acid
  Variant (410)..(413): xaa in position 410 to 413 is any amino acid
  Variant (414)..(414): xaa in position 414 is any or no amino acid
  Variant (416)..(416): xaa in position 416 is any or no amino acid
  Variant (421)..(421): xaa in position 421 is any amino acid
  Variant (426)..(429): xaa in position 426 to 429 is any amino acid
  Variant (431)..(433): xaa in position 431 to 433 is any or no amino acid
  Variant (436)..(439): xaa in position 436 to 439 is any amino acid
  Variant (443)..(444): xaa in position 443 to 444 is any amino acid
  Variant (446)..(448): xaa in position 446 to 448 is any amino acid
  Variant (451)..(453): xaa in position 451 to 453 is any amino acid
  Variant (457)..(458): xaa in position 457 to 458 is any amino acid
  Variant (460)..(460): xaa in position 460 is any amino acid
  Variant (462)..(467): xaa in position 462 to 467 is any amino acid
  Variant (468)..(470): xaa in position 468 to 470 is any or no amino acid
  Variant (472)..(479): xaa in position 472 to 479 is any or no amino acid
  Variant (481)..(482): xaa in position 481 to 482 is any amino acid
  Variant (485)..(485): xaa in position 485 is any amino acid
  Variant (489)..(490): xaa in position 489 to 490 is any amino acid
  Variant (493)..(494): xaa in position 493 to 494 is any amino acid
  Variant (498)..(498): xaa in position 498 is any amino acid
  Variant (500)..(505): xaa in position 500 to 505 is any amino acid
  Variant (507)..(512): xaa in position 507 to 512 is any amino acid
  Variant (514)..(514): xaa in position 514 is any amino acid
  Variant (515)..(515): xaa in position 515 is any or no amino acid
  Variant (518)..(521): xaa in position 518 to 521 is any amino acid
  Variant (524)..(525): xaa in position 524 to 525 is any amino acid
  Variant (526)..(527): xaa in position 526 to 527 is any or no amino acid
  Variant (530)..(530): xaa in position 530 is any amino acid
  Variant (532)..(532): xaa in position 532 is any amino acid

SEQ ID NO: 65167 - protein, 85 aa, Artificial sequence; identical to SEQ ID NO: 14976
  Variant (2)..(2): xaa in position 2 is Pro or Ser
  Variant (3)..(4): xaa in position 3 to 4 is any amino acid
  Variant (5)..(5): xaa in position 5 is Ile, Leu or Met
  Variant (6)..(8): xaa in position 6 to 8 is any amino acid
  Variant (10)..(10): xaa in position 10 is any amino acid
  Variant (11)..(18): xaa in position 11 to 18 is any or no amino acid
  Variant (20)..(25): xaa in position 20 to 25 is any amino acid
  Variant (26)..(26): xaa in position 26 is Ala, Ser or Val
  Variant (27)..(28): xaa in position 27 to 28 is any amino acid
  Variant (30)..(30): xaa in position 30 is any amino acid
  Variant (32)..(32): xaa in position 32 is any amino acid
  Variant (33)..(33): xaa in position 33 is Ile or Leu
  Variant (34)..(34): xaa in position 34 is any amino acid
  Variant (35)..(35): xaa in position 35 is Ala, Gly or Ser
  Variant (36)..(39): xaa in position 36 to 39 is any amino acid
  Variant (49)..(49): xaa in position 49 is Ala, Gly, Asn, Ser or Thr
  Variant (51)..(51): xaa in position 51 is Ile, Met or Val
  Variant (52)..(52): xaa in position 52 is Ser or Thr
  Variant (53)..(53): xaa in position 53 is Asp, Asn, Gln or Ser
  Variant (54)..(56): xaa in position 54 to 56 is any amino acid
  Variant (57)..(57): xaa in position 57 is Ala, Gly or Ser
  Variant (58)..(58): xaa in position 58 is Ala or Gly
  Variant (59)..(59): xaa in position 59 is Ile, Leu, Met or Val
  Variant (60)..(60): xaa in position 60 is Phe, Ile, Leu or Met
  Variant (61)..(61): xaa in position 61 is any amino acid
  Variant (65)..(65): xaa in position 65 is Ala or Ser
  Variant (67)..(67): xaa in position 67 is Ala or Ser
  Variant (69)..(69): xaa in position 69 is Ala, Gly or Ser
  Variant (70)..(70): xaa in position 70 is any amino acid
  Variant (71)..(71): xaa in position 71 is Asn or Ser
  Variant (72)..(72): xaa in position 72 is Phe, Trp or Tyr
  Variant (73)..(74): xaa in position 73 to 74 is any amino acid
  Variant (75)..(75): xaa in position 75 is Phe, Leu or Met
  Variant (76)..(78): xaa in position 76 to 78 is any amino acid
  Variant (79)..(79): xaa in position 79 is Ala, Gly, Ile or Val
  Variant (80)..(83): xaa in position 80 to 83 is any amino acid
  Variant (84)..(84): xaa in position 84 is Asp, Gly, Asn or Pro
  Variant (85)..(85): xaa in position 85 is Phe or Tyr

SEQ ID NO: 65168 - protein, 41 aa, Artificial sequence; identical to SEQ ID NO: 14977
  Variant (2)..(2): xaa in position 2 is Ala or Thr
  Variant (7)..(7): xaa in position 7 is Ala or Gly
  Variant (10)..(10): xaa in position 10 is any amino acid
  Variant (11)..(15): xaa in position 11 to 15 is any or no amino acid
  Variant (17)..(40): xaa in position 17 to 40 is any amino acid
  Variant (41)..(41): xaa in position 41 is Ala, Glu, Gly, Gln or Thr

SEQ ID NO: 65169 - protein, 100 aa, Artificial sequence; identical to SEQ ID NO: 14978
  Variant (2)..(13): xaa in position 2 to 13 is any amino acid
  Variant (14)..(17): xaa in position 14 to 17 is any or no amino acid
  Variant (19)..(19): xaa in position 19 is Cys, Asn, Ser or Val
  Variant (21)..(22): xaa in position 21 to 22 is any amino acid
  Variant (27)..(27): xaa in position 27 is Ile or Val
  Variant (29)..(29): xaa in position 29 is Ile, Leu or Met
  Variant (30)..(30): xaa in position 30 is any amino acid
  Variant (32)..(32): xaa in position 32 is Ile, Leu or Met
  Variant (33)..(33): xaa in position 33 is any amino acid
  Variant (34)..(34): xaa in position 34 is Ala, Asp, Glu, Gly or Ser
  Variant (35)..(37): xaa in position 35 to 37 is any amino acid
  Variant (38)..(38): xaa in position 38 is Ile, Leu, Met or Val
  Variant (39)..(39): xaa in position 39 is Ala, Cys or Thr
  Variant (40)..(43): xaa in position 40 to 43 is any amino acid
  Variant (44)..(44): xaa in position 44 is Ile or Val
  Variant (45)..(45): xaa in position 45 is any amino acid
  Variant (46)..(46): xaa in position 46 is Phe, Ile, Leu, Met or Val
  Variant (47)..(48): xaa in position 47 to 48 is any amino acid
  Variant (50)..(50): xaa in position 50 is Ala, Ser or Val
  Variant (51)..(51): xaa in position 51 is Ala, Cys or Thr
  Variant (53)..(53): xaa in position 53 is any amino acid
  Variant (54)..(54): xaa in position 54 is Ala, Cys, Ser or Val
  Variant (57)..(57): xaa in position 57 is Ala or Cys
  Variant (58)..(58): xaa in position 58 is His, Trp or Tyr
  Variant (60)..(60): xaa in position 60 is Ile or Val
  Variant (61)..(62): xaa in position 61 to 62 is any amino acid
  Variant (63)..(63): xaa in position 63 is Asp, Gln or Arg
  Variant (64)..(64): xaa in position 64 is Asp or Glu
  Variant (65)..(68): xaa in position 65 to 68 is any amino acid
  Variant (69)..(69): xaa in position 69 is Asp, Glu, Gly, Asn or Ser
  Variant (70)..(71): xaa in position 70 to 71 is any amino acid
  Variant (72)..(72): xaa in position 72 is Ile, Leu, Pro or Val
  Variant (73)..(73): xaa in position 73 is any amino acid
  Variant (74)..(74): xaa in position 74 is Asp, Glu, Gln, Ser or Thr
  Variant (75)..(75): xaa in position 75 is Ile or Val
  Variant (76)..(77): xaa in position 76 to 77 is any amino acid
  Variant (78)..(78): xaa in position 78 is Asp, Glu or Lys
  Variant (79)..(83): xaa in position 79 to 83 is any amino acid
  Variant (84)..(84): xaa in position 84 is Asp or Glu
  Variant (85)..(88): xaa in position 85 to 88 is any amino acid
  Variant (90)..(90): xaa in position 90 is Ala, Gly or Ser
  Variant (94)..(94): xaa in position 94 is Ala, Cys, Gly, Pro or Thr
  Variant (95)..(95): xaa in position 95 is Phe, Ile, Leu or Met
  Variant (96)..(96): xaa in position 96 is Ala, Leu or Val
  Variant (97)..(97): xaa in position 97 is Asn, Pro or Gln
  Variant (98)..(98): xaa in position 98 is Ile or Met

SEQ ID NO: 65170 - protein, 84 aa, Artificial sequence; identical to SEQ ID NO: 14979
  Variant (2)..(4): xaa in position 2 to 4 is any amino acid
  Variant (8)..(8): xaa in position 8 is Leu or Met
  Variant (9)..(9): xaa in position 9 is Ala, Glu, Asn, Ser or Thr
  Variant (11)..(11): xaa in position 11 is any amino acid
  Variant (12)..(12): xaa in position 12 is Ala or Asp
  Variant (13)..(13): xaa in position 13 is Ile, Leu or Met
  Variant (14)..(16): xaa in position 14 to 16 is any amino acid
  Variant (18)..(18): xaa in position 18 is any amino acid
  Variant (20)..(20): xaa in position 20 is Phe, Ile or Leu
  Variant (21)..(31): xaa in position 21 to 31 is any amino acid
  Variant (33)..(33): xaa in position 33 is Ile or Val
  Variant (34)..(34): xaa in position 34 is any amino acid
  Variant (36)..(39): xaa in position 36 to 39 is any amino acid
  Variant (40)..(40): xaa in position 40 is Ala, Gly, Asn or Val
  Variant (41)..(42): xaa in position 41 to 42 is any amino acid
  Variant (44)..(46): xaa in position 44 to 46 is any amino acid
  Variant (47)..(47): xaa in position 47 is Asp, Glu, Gly or Asn
  Variant (48)..(48): xaa in position 48 is Ile or Val
  Variant (49)..(49): xaa in position 49 is Ala, Ile, Leu, Pro or Val
  Variant (50)..(52): xaa in position 50 to 52 is any amino acid
  Variant (53)..(53): xaa in position 53 is Ala or Pro
  Variant (54)..(54): xaa in position 54 is any amino acid
  Variant (56)..(56): xaa in position 56 is any or no amino acid
  Variant (58)..(58): xaa in position 58 is Ala, Gly or Thr
  Variant (59)..(60): xaa in position 59 to 60 is any amino acid
  Variant (61)..(61): xaa in position 61 is Ile, Leu or Val
  Variant (62)..(62): xaa in position 62 is Asp or Glu
  Variant (63)..(63): xaa in position 63 is Ala, Gly or Thr
  Variant (64)..(67): xaa in position 64 to 67 is any amino acid
  Variant (68)..(68): xaa in position 68 is Glu, Asn, Pro or Thr
  Variant (69)..(75): xaa in position 69 to 75 is any amino acid
  Variant (76)..(76): xaa in position 76 is Gly, Ile or Pro
  Variant (77)..(77): xaa in position 77 is Ala, Asp, Gly or Ser
  Variant (78)..(80): xaa in position 78 to 80 is any amino acid
  Variant (81)..(81): xaa in position 81 is Ala, Cys, Gly, Asn, Ser, Thr or Val
  Variant (82)..(83): xaa in position 82 to 83 is any amino acid
  Variant (84)..(84): xaa in position 84 is Ile, Leu or Val

SEQ ID NO: 65171 - DNA, 612 bp, Escherichia coli; identical to SEQ ID NO: 15395
  CDS (1)..(612)

SEQ ID NO: 65172 - protein, 203 aa, Escherichia coli; identical to SEQ ID NO: 15396

SEQ ID NO: 65173 - DNA, 558 bp, Mesorhizobium loti MAFF303099; identical to SEQ ID NO: 15397
  CDS (1)..(558): transl_table=11

SEQ ID NO: 65174 - protein, 185 aa, Mesorhizobium loti MAFF303099; identical to SEQ ID NO: 15398

SEQ ID NO: 65175 - DNA, 591 bp, Mesorhizobium loti MAFF303099; identical to SEQ ID NO: 15399
  CDS (1)..(591): transl_table=11

SEQ ID NO: 65176 - protein, 196 aa, Mesorhizobium loti MAFF303099; identical to SEQ ID NO: 15400

SEQ ID NO: 65177 - DNA, 558 bp, Mesorhizobium loti MAFF303099; identical to SEQ ID NO: 15401
  CDS (1)..(558): transl_table=11

SEQ ID NO: 65178 - protein, 185 aa, Mesorhizobium loti MAFF303099; identical to SEQ ID NO: 15402

SEQ ID NO: 65179 - DNA, 579 bp, Vibrio cholerae O1 biovar eltor str. N16961; identical to SEQ ID NO: 15403
  CDS (1)..(579): transl_table=11

SEQ ID NO: 65180 - protein, 192 aa, Vibrio cholerae O1 biovar eltor str. N16961; identical to SEQ ID NO: 15404

SEQ ID NO: 65181 - DNA, 561 bp, Bacillus halodurans C-125; identical to SEQ ID NO: 15405
  CDS (1)..(561): transl_table=11

SEQ ID NO: 65182 - protein, 186 aa, Bacillus halodurans C-125; identical to SEQ ID NO: 15406

SEQ ID NO: 65183 - DNA, 612 bp, Pasteurella multocida subsp. multocida str. Pm70; identical to SEQ ID NO: 15407
  CDS (1)..(612): transl_table=11

SEQ ID NO: 65184 - protein, 203 aa, Pasteurella multocida subsp. multocida str. Pm70; identical to SEQ ID NO: 15408

SEQ ID NO: 65185 - DNA, 771 bp, Lactococcus lactis subsp. lactis Il1403; identical to SEQ ID NO: 15409
  CDS (1)..(771): transl_table=11

SEQ ID NO: 65186 - protein, 256 aa, Lactococcus lactis subsp. lactis Il1403; identical to SEQ ID NO: 15410

SEQ ID NO: 65187 - DNA, 612 bp, Lactococcus lactis subsp. lactis Il1403; identical to SEQ ID NO: 15411
  CDS (1)..(612): transl_table=11

SEQ ID NO: 65188 - protein, 203 aa, Lactococcus lactis subsp. lactis Il1403; identical to SEQ ID NO: 15412

SEQ ID NO: 65189 - DNA, 603 bp, Lactococcus lactis subsp. lactis Il1403; identical to SEQ ID NO: 15413
  CDS (1)..(603): transl_table=11

SEQ ID NO: 65190 - protein, 200 aa, Lactococcus lactis subsp. lactis Il1403; identical to SEQ ID NO: 15414

SEQ ID NO: 65191 - DNA, 612 bp, Lactococcus lactis subsp. lactis Il1403; identical to SEQ ID NO: 15415
  CDS (1)..(612): transl_table=11

SEQ ID NO: 65192 - protein, 203 aa, Lactococcus lactis subsp. lactis Il1403; identical to SEQ ID NO: 15416

SEQ ID NO: 65193 - DNA, 462 bp, Lactococcus lactis subsp. lactis Il1403; identical to SEQ ID NO: 15417
  CDS (1)..(462): transl_table=11

SEQ ID NO: 65194 - protein, 153 aa, Lactococcus lactis subsp. lactis Il1403; identical to SEQ ID NO: 15418

SEQ ID NO: 65195 - DNA, 567 bp, Streptococcus pyogenes M1 GAS; identical to SEQ ID NO: 15419
  CDS (1)..(567): transl_table=11

SEQ ID NO: 65196 - protein, 188 aa, Streptococcus pyogenes M1 GAS; identical to SEQ ID NO: 15420

SEQ ID NO: 65197 - DNA, 513 bp, Neisseria meningitidis Z2491; identical to SEQ ID NO: 15421
  CDS (1)..(513): transl_table=11

SEQ ID NO: 65198 - protein, 170 aa, Neisseria meningitidis Z2491; identical to SEQ ID NO: 15422

SEQ ID NO: 65199 - DNA, 549 bp, Escherichia coli O157:H7; identical to SEQ ID NO: 15423
  CDS (1)..(549): transl_table=11

SEQ ID NO: 65200 - protein, 182 aa, Escherichia coli O157:H7; identical to SEQ ID NO: 15424

SEQ ID NO: 65201 - DNA, 558 bp, Streptococcus pneumoniae TIGR4; identical to SEQ ID NO: 15425
  CDS (1)..(558): transl_table=11

SEQ ID NO: 65202 - protein, 185 aa, Streptococcus pneumoniae TIGR4; identical to SEQ ID NO: 15426

SEQ ID NO: 65203 - DNA, 561 bp, Clostridium acetobutylicum ATCC 824; identical to SEQ ID NO: 15427
  CDS (1)..(561): transl_table=11

SEQ ID NO: 65204 - protein, 186 aa, Clostridium acetobutylicum ATCC 824; identical to SEQ ID NO: 15428

SEQ ID NO: 65205 - DNA, 615 bp, Clostridium acetobutylicum ATCC 824; identical to SEQ ID NO: 15429
  CDS (1)..(615): transl_table=11

SEQ ID NO: 65206 - protein, 204 aa, Clostridium acetobutylicum ATCC 824; identical to SEQ ID NO: 15430

SEQ ID NO: 65207 - DNA, 600 bp, Staphylococcus aureus subsp. aureus Mu50; identical to SEQ ID NO: 15431
  CDS (1)..(600): transl_table=11

SEQ ID NO: 65208 - protein, 199 aa, Staphylococcus aureus subsp. aureus Mu50; identical to SEQ ID NO: 15432

SEQ ID NO: 65209 - DNA, 552 bp, Escherichia coli K12; identical to SEQ ID NO: 15433
  CDS (1)..(552): transl_table=11

SEQ ID NO: 65210 - protein, 183 aa, Escherichia coli K12; identical to SEQ ID NO: 15434

SEQ ID NO: 65211 - DNA, 615 bp, Sinorhizobium meliloti 1021; identical to SEQ ID NO: 15435
  CDS (1)..(615): transl_table=11

SEQ ID NO: 65212 - protein, 204 aa, Sinorhizobium meliloti 1021; identical to SEQ ID NO: 15436

SEQ ID NO: 65213 - DNA, 552 bp, Salmonella typhimurium LT2; identical to SEQ ID NO: 15437
  CDS (1)..(552): transl_table=11

SEQ ID NO: 65214 - protein, 183 aa, Salmonella typhimurium LT2; identical to SEQ ID NO: 15438

SEQ ID NO: 65215 - DNA, 564 bp, Listeria monocytogenes EGD-e; identical to SEQ ID NO: 15439
  CDS (1)..(564): transl_table=11

SEQ ID NO: 65216 - protein, 187 aa, Listeria monocytogenes EGD-e; identical to SEQ ID NO: 15440

SEQ ID NO: 65217 - DNA, 570 bp, Listeria innocua Clip11262; identical to SEQ ID NO: 15441
  CDS (1)..(570): transl_table=11

SEQ ID NO: 65218 - protein, 189 aa, Listeria innocua Clip11262; identical to SEQ ID NO: 15442

SEQ ID NO: 65219 - DNA, 564 bp, Listeria innocua Clip11262; identical to SEQ ID NO: 15443
  CDS (1)..(564): transl_table=11

SEQ ID NO: 65220 - protein, 187 aa, Listeria innocua Clip11262; identical to SEQ ID NO: 15444

SEQ ID NO: 65221 - DNA, 579 bp, Nostoc sp. PCC 7120; identical to SEQ ID NO: 15445
  CDS (1)..(579): transl_table=11

SEQ ID NO: 65222 - protein, 192 aa, Nostoc sp. PCC 7120; identical to SEQ ID NO: 15446

SEQ ID NO: 65223 - DNA, 828 bp, Nostoc sp. PCC 7120; identical to SEQ ID NO: 15447
  CDS (1)..(828): transl_table=11

SEQ ID NO: 65224 - protein, 275 aa, Nostoc sp. PCC 7120; identical to SEQ ID NO: 15448

SEQ ID NO: 65225 - DNA, 513 bp, Ralstonia solanacearum GMI1000; identical to SEQ ID NO: 15449
  CDS (1)..(513): transl_table=11

SEQ ID NO: 65226 - protein, 170 aa, Ralstonia solanacearum GMI1000; identical to SEQ ID NO: 15450

SEQ ID NO: 65227 - DNA, 618 bp, Agrobacterium tumefaciens str. C58; identical to SEQ ID NO: 15451
  CDS (1)..(618): transl_table=11

SEQ ID NO: 65228 - protein, 205 aa, Agrobacterium tumefaciens str. C58; identical to SEQ ID NO: 15452

SEQ ID NO: 65229 - DNA, 561 bp, Agrobacterium tumefaciens str. C58; identical to SEQ ID NO: 15453
  CDS (1)..(561): transl_table=11

SEQ ID NO: 65230 - protein, 186 aa, Agrobacterium tumefaciens str. C58; identical to SEQ ID NO: 15454

SEQ ID NO: 65231 - DNA, 633 bp, Agrobacterium tumefaciens str. C58; identical to SEQ ID NO: 15455
  CDS (1)..(633): transl_table=11

SEQ ID NO: 65232 - protein, 210 aa, Agrobacterium tumefaciens str. C58; identical to SEQ ID NO: 15456

SEQ ID NO: 65233 - DNA, 687 bp, Brucella melitensis 16M; identical to SEQ ID NO: 15457
  CDS (1)..(687): transl_table=11

SEQ ID NO: 65234 - protein, 228 aa, Brucella melitensis 16M; identical to SEQ ID NO: 15458

SEQ ID NO: 65235 - DNA, 681 bp, Pyrobaculum aerophilum str. IM2; identical to SEQ ID NO: 15459
  CDS (1)..(681): transl_table=11

SEQ ID NO: 65236 - protein, 226 aa, Pyrobaculum aerophilum str. IM2; identical to SEQ ID NO: 15460

SEQ ID NO: 65237 - DNA, 585 bp, Clostridium perfringens str. 13; identical to SEQ ID NO: 15461
  CDS (1)..(585): transl_table=11

SEQ ID NO: 65238 - protein, 194 aa, Clostridium perfringens str. 13; identical to SEQ ID NO: 15462

SEQ ID NO: 65239 - DNA, 501 bp, Pyrococcus furiosus DSM 3638; identical to SEQ ID NO: 15463
  CDS (1)..(501): transl_table=11

SEQ ID NO: 65240 - protein, 166 aa, Pyrococcus furiosus DSM 3638; identical to SEQ ID NO: 15464

SEQ ID NO: 65241 - DNA, 687 bp, Corynebacterium glutamicum ATCC 13032; identical to SEQ ID NO: 15465
  CDS (1)..(687): transl_table=11

SEQ ID NO: 65242 - protein, 228 aa, Corynebacterium glutamicum ATCC 13032; identical to SEQ ID NO: 15466

SEQ ID NO: 65243 - DNA, 576 bp, Methanosarcina acetivorans C2A; identical to SEQ ID NO: 15467
  CDS (1)..(576): transl_table=11

SEQ ID NO: 65244 - protein, 191 aa, Methanosarcina acetivorans C2A; identical to SEQ ID NO: 15468

SEQ ID NO: 65245 - DNA, 600 bp, Methanosarcina acetivorans C2A; identical to SEQ ID NO: 15469
  CDS (1)..(600): transl_table=11

SEQ ID NO: 65246 - protein, 199 aa, Methanosarcina acetivorans C2A; identical to SEQ ID NO: 15470

SEQ ID NO: 65247 - DNA, 525 bp, Methanosarcina acetivorans C2A; identical to SEQ ID NO: 15471
  CDS (1)..(525): transl_table=11

SEQ ID NO: 65248 - protein, 174 aa, Methanosarcina acetivorans C2A; identical to SEQ ID NO: 15472

SEQ ID NO: 65249 - DNA, 555 bp, Methanosarcina acetivorans C2A; identical to SEQ ID NO: 15473
  CDS (1)..(555): transl_table=11

SEQ ID NO: 65250 - protein, 184 aa, Methanosarcina acetivorans C2A; identical to SEQ ID NO: 15474

SEQ ID NO: 65251 - DNA, 663 bp, Thermoanaerobacter tengcongensis MB4; identical to SEQ ID NO: 15475
  CDS (1)..(663): transl_table=11

SEQ ID NO: 65252 - protein, 220 aa, Thermoanaerobacter tengcongensis MB4; identical to SEQ ID NO: 15476

SEQ ID NO: 65253 - DNA, 528 bp, Streptomyces coelicolor A3(2); identical to SEQ ID NO: 15477
  CDS (1)..(528)

SEQ ID NO: 65254 - protein, 175 aa, Streptomyces coelicolor A3(2); identical to SEQ ID NO: 15478

SEQ ID NO: 65255 - DNA, 804 bp, Streptomyces coelicolor A3(2); identical to SEQ ID NO: 15479
  CDS (1)..(804)

SEQ ID NO: 65256 - protein, 267 aa, Streptomyces coelicolor A3(2); identical to SEQ ID NO: 15480

SEQ ID NO: 65257 - DNA, 582 bp, Streptomyces coelicolor A3(2); identical to SEQ ID NO: 15481
  CDS (1)..(582)

SEQ ID NO: 65258 - protein, 193 aa, Streptomyces coelicolor A3(2); identical to SEQ ID NO: 15482

SEQ ID NO: 65259 - DNA, 564 bp, Methanosarcina mazei Go1; identical to SEQ ID NO: 15483
  CDS (1)..(564): transl_table=11

SEQ ID NO: 65260 - protein, 187 aa, Methanosarcina mazei Go1; identical to SEQ ID NO: 15484

SEQ ID NO: 65261 - DNA, 702 bp, Methanosarcina mazei Go1; identical to SEQ ID NO: 15485
  CDS (1)..(702): transl_table=11

SEQ ID NO: 65262 - protein, 233 aa, Methanosarcina mazei Go1; identical to SEQ ID NO: 15486

SEQ ID NO: 65263 - DNA, 579 bp, Xanthomonas campestris pv. campestris str. ATCC 33913; identical to SEQ ID NO: 15487
  CDS (1)..(579): transl_table=11

SEQ ID NO: 65264 - protein, 192 aa, Xanthomonas campestris pv. campestris str. ATCC 33913; identical to SEQ ID NO: 15488

SEQ ID NO: 65265 - DNA, 579 bp, Xanthomonas axonopodis pv. citri str. 306; identical to SEQ ID NO: 15489
  CDS (1)..(579): transl_table=11

SEQ ID NO: 65266 - protein, 192 aa, Xanthomonas axonopodis pv. citri str. 306; identical to SEQ ID NO: 15490

SEQ ID NO: 65267 - DNA, 639 bp, Streptococcus agalactiae 2603V/R; identical to SEQ ID NO: 15491
  CDS (1)..(639): transl_table=11

SEQ ID NO: 65268 - protein, 212 aa, Streptococcus agalactiae 2603V/R; identical to SEQ ID NO: 15492

SEQ ID NO: 65269 - DNA, 549 bp, Streptococcus agalactiae 2603V/R; identical to SEQ ID NO: 15493
  CDS (1)..(549): transl_table=11

SEQ ID NO: 65270 - protein, 182 aa, Streptococcus agalactiae 2603V/R; identical to SEQ ID NO: 15494

SEQ ID NO: 65271 - DNA, 540 bp, Oceanobacillus iheyensis HTE831; identical to SEQ ID NO: 15495
  CDS (1)..(540): transl_table=11

SEQ ID NO: 65272 - protein, 179 aa, Oceanobacillus iheyensis HTE831; identical to SEQ ID NO: 15496

SEQ ID NO: 65273 - DNA, 675 bp, Bifidobacterium longum NCC2705; identical to SEQ ID NO: 15497
  CDS (1)..(675): transl_table=11

SEQ ID NO: 65274 - protein, 224 aa, Bifidobacterium longum NCC2705; identical to SEQ ID NO: 15498

SEQ ID NO: 65275 - DNA, 678 bp, Bifidobacterium longum NCC2705; identical to SEQ ID NO: 15499
  CDS (1)..(678): transl_table=11

SEQ ID NO: 65276 - protein, 225 aa, Bifidobacterium longum NCC2705; identical to SEQ ID NO: 15500

SEQ ID NO: 65277 - DNA, 597 bp, Leptospira interrogans serovar Lai str. 56601; identical to SEQ ID NO: 15501
  CDS (1)..(597): transl_table=11

SEQ ID NO: 65278 - protein, 198 aa, Leptospira interrogans serovar Lai str. 56601; identical to SEQ ID NO: 15502

SEQ ID NO: 65279 - DNA, 579 bp, Shewanella oneidensis MR-1; identical to SEQ ID NO: 15503
  CDS (1)..(579): transl_table=11

SEQ ID NO: 65280 - protein, 192 aa, Shewanella oneidensis MR-1; identical to SEQ ID NO: 15504

SEQ ID NO: 65281 - DNA, 630 bp, Shewanella oneidensis MR-1; identical to SEQ ID NO: 15505
  CDS (1)..(630): transl_table=11

SEQ ID NO: 65282 - protein, 209 aa, Shewanella oneidensis MR-1; identical to SEQ ID NO: 15506

SEQ ID NO: 65283 - DNA, 699 bp, Streptococcus mutans UA159; identical to SEQ ID NO: 15507
  CDS (1)..(699): transl_table=11

SEQ ID NO: 65284 - protein, 232 aa, Streptococcus mutans UA159; identical to SEQ ID NO: 15508

SEQ ID NO: 65285 - DNA, 648 bp, Streptomyces coelicolor A3(2); identical to SEQ ID NO: 15509
  CDS (1)..(648)

SEQ ID NO: 65286 - protein, 215 aa, Streptomyces coelicolor A3(2); identical to SEQ ID NO: 15510

SEQ ID NO: 65287 - DNA, 567 bp, Pseudomonas putida KT2440; identical to SEQ ID NO: 15511
  CDS (1)..(567): transl_table=11

SEQ ID NO: 65288 - protein, 188 aa, Pseudomonas putida KT2440; identical to SEQ ID NO: 15512

SEQ ID NO: 65289 - DNA, 552 bp, Escherichia coli CFT073; identical to SEQ ID NO: 15513
  CDS (1)..(552): transl_table=11

SEQ ID NO: 65290 - protein, 183 aa, Escherichia coli CFT073; identical to SEQ ID NO: 15514

SEQ ID NO: 65291 - DNA, 549 bp, Escherichia coli CFT073; identical to SEQ ID NO: 15515
  CDS (1)..(549): transl_table=11

SEQ ID NO: 65292 - protein, 182 aa, Escherichia coli CFT073; identical to SEQ ID NO: 15516

SEQ ID NO: 65293 - DNA, 588 bp, Mycoplasma penetrans HF-2; identical to SEQ ID NO: 15517
  CDS (1)..(588): transl_table=4

SEQ ID NO: 65294 - protein, 195 aa, Mycoplasma penetrans HF-2; identical to SEQ ID NO: 15518

SEQ ID NO: 65295 - DNA, 771 bp, Vibrio vulnificus CMCP6; identical to SEQ ID NO: 15519
  CDS (1)..(771): transl_table=11

SEQ ID NO: 65296 - protein, 256 aa, Vibrio vulnificus CMCP6; identical to SEQ ID NO: 15520

SEQ ID NO: 65297 - DNA, 594 bp, Vibrio vulnificus CMCP6; identical to SEQ ID NO: 15521
  CDS (1)..(594): transl_table=11

SEQ ID NO: 65298 - protein, 197 aa, Vibrio vulnificus CMCP6; identical to SEQ ID NO: 15522

SEQ ID NO: 65299 - DNA, 549 bp, Vibrio vulnificus CMCP6; identical to SEQ ID NO: 15523
  CDS (1)..(549): transl_table=11

SEQ ID NO: 65300 - protein, 182 aa, Vibrio vulnificus CMCP6; identical to SEQ ID NO: 15524

SEQ ID NO: 65301 - DNA, 621 bp, Bradyrhizobium japonicum USDA 110; identical to SEQ ID NO: 15525
  CDS (1)..(621)

SEQ ID NO: 65302 - protein, 206 aa, Bradyrhizobium japonicum USDA 110; identical to SEQ ID NO: 15526

SEQ ID NO: 65303 - DNA, 564 bp, Clostridium tetani E88; identical to SEQ ID NO: 15527
  CDS (1)..(564): transl_table=11

SEQ ID NO: 65304 - protein, 187 aa, Clostridium tetani E88; identical to SEQ ID NO: 15528

SEQ ID NO: 65305 - DNA, 618 bp, Lactobacillus plantarum WCFS1; identical to SEQ ID NO: 15529
  CDS (1)..(618): transl_table=11

SEQ ID NO: 65306 - protein, 205 aa, Lactobacillus plantarum WCFS1; identical to SEQ ID NO: 15530

SEQ ID NO: 65307 - DNA, 609 bp, Lactobacillus plantarum WCFS1; identical to SEQ ID NO: 15531
  CDS (1)..(609): transl_table=11

SEQ ID NO: 65308 - protein, 202 aa, Lactobacillus plantarum WCFS1; identical to SEQ ID NO: 15532

SEQ ID NO: 65309 - DNA, 555 bp, Lactobacillus plantarum WCFS1; identical to SEQ ID NO: 15533
  CDS (1)..(555): transl_table=11

SEQ ID NO: 65310 - protein, 184 aa, Lactobacillus plantarum WCFS1; identical to SEQ ID NO: 15534

SEQ ID NO: 65311 - DNA, 603 bp, Lactobacillus plantarum WCFS1; identical to SEQ ID NO: 15535
  CDS (1)..(603): transl_table=11

SEQ ID NO: 65312 - protein, 200 aa, Lactobacillus plantarum WCFS1; identical to SEQ ID NO: 15536

SEQ ID NO: 65313 - DNA, 621 bp, Lactobacillus plantarum WCFS1; identical to SEQ ID NO: 15537
  CDS (1)..(621): transl_table=11

SEQ ID NO: 65314 - protein, 206 aa, Lactobacillus plantarum WCFS1; identical to SEQ ID NO: 15538

SEQ ID NO: 65315 - DNA, 570 bp, Lactobacillus plantarum WCFS1; identical to SEQ ID NO: 15539
  CDS (1)..(570): transl_table=11

SEQ ID NO: 65316 - protein, 189 aa, Lactobacillus plantarum WCFS1; identical to SEQ ID NO: 15540

SEQ ID NO: 65317 - DNA, 561 bp, Lactobacillus plantarum WCFS1; identical to SEQ ID NO: 15541
  CDS (1)..(561): transl_table=11

SEQ ID NO: 65318 - protein, 186 aa, Lactobacillus plantarum WCFS1; identical to SEQ ID NO: 15542

SEQ ID NO: 65319 - DNA, 555 bp, Vibrio parahaemolyticus RIMD 2210633; identical to SEQ ID NO: 15543
  CDS (1)..(555): transl_table=11

SEQ ID NO: 65320 - protein, 184 aa, Vibrio parahaemolyticus RIMD 2210633; identical to SEQ ID NO: 15544

SEQ ID NO: 65321 - DNA, 549 bp, Vibrio parahaemolyticus RIMD 2210633; identical to SEQ ID NO: 15545
  CDS (1)..(549): transl_table=11

SEQ ID NO: 65322 - protein, 182 aa, Vibrio parahaemolyticus RIMD 2210633; identical to SEQ ID NO: 15546

SEQ ID NO: 65323 - DNA, 552 bp, Salmonella enterica subsp. enterica serovar Typhi Ty2; identical to SEQ ID NO: 15547
  CDS (1)..(552): transl_table=11

SEQ ID NO: 65324 - protein, 183 aa, Salmonella enterica subsp. enterica serovar Typhi Ty2; identical to SEQ ID NO: 15548

SEQ ID NO: 65325 - DNA, 759 bp, Bacteroides thetaiotaomicron VPI-5482; identical to SEQ ID NO: 15549
  CDS (1)..(759): transl_table=11

SEQ ID NO: 65326 - protein, 252 aa, Bacteroides thetaiotaomicron VPI-5482; identical to SEQ ID NO: 15550

SEQ ID NO: 65327 - DNA, 624 bp, Bacteroides thetaiotaomicron VPI-5482; identical to SEQ ID NO: 15551
  CDS (1)..(624): transl_table=11

SEQ ID NO: 65328 - protein, 207 aa, Bacteroides thetaiotaomicron VPI-5482; identical to SEQ ID NO: 15552

SEQ ID NO: 65329 - DNA, 564 bp, Bacteroides thetaiotaomicron VPI-5482; identical to SEQ ID NO: 15553
  CDS (1)..(564): transl_table=11

SEQ ID NO: 65330 - protein, 187 aa, Bacteroides thetaiotaomicron VPI-5482; identical to SEQ ID NO: 15554

SEQ ID NO: 65331 - DNA, 606 bp, Bacteroides thetaiotaomicron VPI-5482; identical to SEQ ID NO: 15555
  CDS (1)..(606): transl_table=11

SEQ ID NO: 65332 - protein, 201 aa, Bacteroides thetaiotaomicron VPI-5482; identical to SEQ ID NO: 15556

SEQ ID NO: 65333 - DNA, 552 bp, Bacteroides thetaiotaomicron VPI-5482; identical to SEQ ID NO: 15557
  CDS (1)..(552): transl_table=11

SEQ ID NO: 65334 - protein, 183 aa, Bacteroides thetaiotaomicron VPI-5482; identical to SEQ ID NO: 15558

SEQ ID NO: 65335 - DNA, 846 bp, Enterococcus faecalis V583; identical to SEQ ID NO: 15559
  CDS (1)..(846): transl_table=11

SEQ ID NO: 65336 - protein, 281 aa, Enterococcus faecalis V583; identical to SEQ ID NO: 15560

SEQ ID NO: 65337 - DNA, 639 bp, Enterococcus faecalis V583; identical to SEQ ID NO: 15561
  CDS (1)..(639): transl_table=11

SEQ ID NO: 65338 - protein, 212 aa, Enterococcus faecalis V583; identical to SEQ ID NO: 15562

SEQ ID NO: 65339 - DNA, 582 bp, Enterococcus faecalis V583; identical to SEQ ID NO: 15563
  CDS (1)..(582): transl_table=11

SEQ ID NO: 65340 - protein, 193 aa, Enterococcus faecalis V583; identical to SEQ ID NO: 15564

SEQ ID NO: 65341 - DNA, 723 bp, Bacillus cereus ATCC 14579; identical to SEQ ID NO: 15565
  CDS (1)..(723): transl_table=11

SEQ ID NO: 65342 - protein, 240 aa, Bacillus cereus ATCC 14579; identical to SEQ ID NO: 15566

SEQ ID NO: 65343 - DNA, 561 bp, Bacillus cereus ATCC 14579; identical to SEQ ID NO: 15567
  CDS (1)..(561): transl_table=11

SEQ ID NO: 65344 - protein, 186 aa, Bacillus cereus ATCC 14579; identical to SEQ ID NO: 15568

SEQ ID NO: 65345 - DNA, 666 bp, Bacillus anthracis str. Ames; identical to SEQ ID NO: 15569
  CDS (1)..(666): transl_table=11

SEQ ID NO: 65346 - protein, 221 aa, Bacillus anthracis str. Ames; identical to SEQ ID NO: 15570

SEQ ID NO: 65347 - DNA, 564 bp, Bacillus anthracis str. Ames; identical to SEQ ID NO: 15571
  CDS (1)..(564): transl_table=11

SEQ ID NO: 65348 - protein, 187 aa, Bacillus anthracis str. Ames; identical to SEQ ID NO: 15572

SEQ ID NO: 65349 - DNA, 723 bp, Bacillus anthracis str. Ames; identical to SEQ ID NO: 15573
  CDS (1)..(723): transl_table=11

SEQ ID NO: 65350 - protein, 240 aa, Bacillus anthracis str. Ames; identical to SEQ ID NO: 15574

SEQ ID NO: 65351 - DNA, 618 bp, Helicobacter hepaticus ATCC 51449; identical to SEQ ID NO: 15575
  CDS (1)..(618): transl_table=11

SEQ ID NO: 65352 - protein, 205 aa, Helicobacter hepaticus ATCC 51449; identical to SEQ ID NO: 15576

SEQ ID NO: 65353 - DNA, 555 bp, Rhodopirellula baltica SH 1; identical to SEQ ID NO: 15577
  CDS (1)..(555): transl_table=11

SEQ ID NO: 65354 - protein, 184 aa, Rhodopirellula baltica SH 1; identical to SEQ ID NO: 15578

SEQ ID NO: 65355 - DNA, 522 bp, Chromobacterium violaceum ATCC 12472; identical to SEQ ID NO: 15579
  CDS (1)..(522): transl_table=11

SEQ ID NO: 65356 - protein, 173 aa, Chromobacterium violaceum ATCC 12472; identical to SEQ ID NO: 15580

SEQ ID NO: 65357 - DNA, 561 bp, Gloeobacter violaceus PCC 7421; identical to SEQ ID NO: 15581
  CDS (1)..(561): transl_table=11

SEQ ID NO: 65358 - protein, 186 aa, Gloeobacter violaceus PCC 7421; identical to SEQ ID NO: 15582

SEQ ID NO: 65359 - DNA, 771 bp, Vibrio vulnificus YJ016; identical to SEQ ID NO: 15583
  CDS (1)..(771): transl_table=11

SEQ ID NO: 65360 - protein, 256 aa, Vibrio vulnificus YJ016; identical to SEQ ID NO: 15584

SEQ ID NO: 65361 - DNA, 558 bp, Vibrio vulnificus YJ016; identical to SEQ ID NO: 15585
  CDS (1)..(558): transl_table=11

SEQ ID NO: 65362 - protein, 185 aa, Vibrio vulnificus YJ016; identical to SEQ ID NO: 15586

SEQ ID NO: 65363 - DNA, 657 bp, Vibrio vulnificus YJ016; identical to SEQ ID NO: 15587
  CDS (1)..(657): transl_table=11

SEQ ID NO: 65364 - protein, 218 aa, Vibrio vulnificus YJ016; identical to SEQ ID NO: 15588

SEQ ID NO: 65365 - DNA, 621 bp, Vibrio vulnificus YJ016; identical to SEQ ID NO: 15589
  CDS (1)..(621): transl_table=11

SEQ ID NO: 65366 - protein, 206 aa, Vibrio vulnificus YJ016; identical to SEQ ID NO: 15590

SEQ ID NO: 65367 - DNA, 570 bp, Corynebacterium diphtheriae NCTC 13129; identical to SEQ ID NO: 15591
  CDS (1)..(570): transl_table=11

SEQ ID NO: 65368 - protein, 189 aa, Corynebacterium diphtheriae NCTC 13129; identical to SEQ ID NO: 15592

SEQ ID NO: 65369 - DNA, 573 bp, Rhodopseudomonas palustris CGA009; identical to SEQ ID NO: 15593
  CDS (1)..(573): transl_table=11

SEQ ID NO: 65370 - protein, 190 aa, Rhodopseudomonas palustris CGA009; identical to SEQ ID NO: 15594

SEQ ID NO: 65371 - DNA, 615 bp, Lactobacillus johnsonii NCC 533; identical to SEQ ID NO: 15595
  CDS (1)..(615): transl_table=11

SEQ ID NO: 65372 - protein, 204 aa, Lactobacillus johnsonii NCC 533; identical to SEQ ID NO: 15596

SEQ ID NO: 65373 - DNA, 564 bp, Bacillus cereus ATCC 10987; identical to SEQ ID NO: 15597
  CDS (1)..(564): transl_table=11

SEQ ID NO: 65374 - protein, 187 aa, Bacillus cereus ATCC 10987; identical to SEQ ID NO: 15598

SEQ ID NO: 65375 - DNA, 2154 bp, Neurospora crassa; identical to SEQ ID NO: 15599
  CDS (1)..(2154)

SEQ ID NO: 65376 - protein, 717 aa, Neurospora crassa; identical to SEQ ID NO: 15600

SEQ ID NO: 65377 - DNA, 660 bp, Magnaporthe grisea 70-15; identical to SEQ ID NO: 15601
  CDS (1)..(660)

SEQ ID NO: 65378 - protein, 219 aa, Magnaporthe grisea 70-15; identical to SEQ ID NO: 15602

SEQ ID NO: 65379 - DNA, 699 bp, Gibberella zeae PH-1; identical to SEQ ID NO: 15603
  CDS (1)..(699)

SEQ ID NO: 65380 - protein, 232 aa, Gibberella zeae PH-1; identical to SEQ ID NO: 15604

SEQ ID NO: 65381 - DNA, 699 bp, Gibberella zeae PH-1; identical to SEQ ID NO: 15605
  CDS (1)..(699)

SEQ ID NO: 65382 - protein, 232 aa, Gibberella zeae PH-1; identical to SEQ ID NO: 15606

SEQ ID NO: 65383 - DNA, 690 bp, Ustilago maydis 521; identical to SEQ ID NO: 15607
  CDS (1)..(690)

SEQ ID NO: 65384 - protein, 229 aa, Ustilago maydis 521; identical to SEQ ID NO: 15608

SEQ ID NO: 65385 - DNA, 702 bp, Aspergillus nidulans FGSC A4; identical to SEQ ID NO: 15609
  CDS (1)..(702)

SEQ ID NO: 65386 - protein, 233 aa, Aspergillus nidulans FGSC A4; identical to SEQ ID NO: 15610

SEQ ID NO: 65387 - DNA, 618 bp, Aspergillus nidulans FGSC A4; identical to SEQ ID NO: 15611
  CDS (1)..(618)

SEQ ID NO: 65388 - protein, 205 aa, Aspergillus nidulans FGSC A4; identical to SEQ ID NO: 15612

SEQ ID NO: 65389 - DNA, 573 bp, Candida glabrata CBS138; identical to SEQ ID NO: 15613
  CDS (1)..(573)

SEQ ID NO: 65390 - protein, 190 aa, Candida glabrata CBS138; identical to SEQ ID NO: 15614

SEQ ID NO: 65391 - DNA, 570 bp, Kluyveromyces lactis NRRL Y-1140; identical to SEQ ID NO: 15615
  CDS (1)..(570)

SEQ ID NO: 65392 - protein, 189 aa, Kluyveromyces lactis NRRL Y-1140; identical to SEQ ID NO: 15616

SEQ ID NO: 65393 - DNA, 693 bp, Debaryomyces hansenii CBS767; identical to SEQ ID NO: 15617
  CDS (1)..(693)

SEQ ID NO: 65394 - protein, 230 aa, Debaryomyces hansenii CBS767; identical to SEQ ID NO: 15618

SEQ ID NO: 65395 - DNA, 690 bp, Debaryomyces hansenii CBS767; identical to SEQ ID NO: 15619
  CDS (1)..(690)

SEQ ID NO: 65396 - protein, 229 aa, Debaryomyces hansenii CBS767; identical to SEQ ID NO: 15620

SEQ ID NO: 65397 - DNA, 666 bp, Yarrowia lipolytica CLIB99; identical to SEQ ID NO: 15621
  CDS (1)..(666)

SEQ ID NO: 65398 - protein, 221 aa, Yarrowia lipolytica CLIB99; identical to SEQ ID NO: 15622

SEQ ID NO: 65399 - DNA, 840 bp, Yarrowia lipolytica CLIB99; identical to SEQ ID NO: 15623
  CDS (1)..(840)

SEQ ID NO: 65400 - protein, 279 aa, Yarrowia lipolytica CLIB99; identical to SEQ ID NO: 15624

SEQ ID NO: 65401 - DNA, 642 bp, Cryptococcus neoformans var. neoformans JEC21; identical to SEQ ID NO: 15625
  CDS (1)..(642)

SEQ ID NO: 65402 - protein, 213 aa, Cryptococcus neoformans var. neoformans JEC21; identical to SEQ ID NO: 15626

SEQ ID NO: 65403 - DNA, 546 bp, Dictyostelium discoideum; identical to SEQ ID NO: 15627
  CDS (1)..(546)

SEQ ID NO: 65404 - protein, 181 aa, Dictyostelium discoideum; identical to SEQ ID NO: 15628

SEQ ID NO: 65405 - DNA, 576 bp, Dictyostelium discoideum; identical to SEQ ID NO: 15629
  CDS (1)..(576)

SEQ ID NO: 65406 - protein, 191 aa, Dictyostelium discoideum; identical to SEQ ID NO: 15630

SEQ ID NO: 65407 - DNA, 591 bp, Dictyostelium discoideum; identical to SEQ ID NO: 15631
  CDS (1)..(591)

SEQ ID NO: 65408 - protein, 196 aa, Dictyostelium discoideum; identical to SEQ ID NO: 15632

SEQ ID NO: 65409 - DNA, 573 bp, Dictyostelium discoideum; identical to SEQ ID NO: 15633
  CDS (1)..(573)

SEQ ID NO: 65410 - protein, 190 aa, Dictyostelium discoideum; identical to SEQ ID NO: 15634

SEQ ID NO: 65411 - DNA, 459 bp, Entamoeba histolytica HM-1:IMSS; identical to SEQ ID NO: 15635
  CDS (1)..(459)

SEQ ID NO: 65412 - protein, 152 aa, Entamoeba histolytica HM-1:IMSS; identical to SEQ ID NO: 15636

SEQ ID NO: 65413 - DNA, 609 bp, Entamoeba histolytica HM-1:IMSS; identical to SEQ ID NO: 15637
  CDS (1)..(609)

SEQ ID NO: 65414 - protein, 202 aa, Entamoeba histolytica HM-1:IMSS; identical to SEQ ID NO: 15638

SEQ ID NO: 65415 - DNA, 609 bp, Entamoeba histolytica HM-1:IMSS; identical to SEQ ID NO: 15639
  CDS (1)..(609)

SEQ ID NO: 65416 - protein, 202 aa, Entamoeba histolytica HM-1:IMSS; identical to SEQ ID NO: 15640

SEQ ID NO: 65417 - DNA, 549 bp, Entamoeba histolytica HM-1:IMSS; identical to SEQ ID NO: 15641
  CDS (1)..(549)

SEQ ID NO: 65418 - protein, 182 aa, Entamoeba histolytica HM-1:IMSS; identical to SEQ ID NO: 15642

SEQ ID NO: 65419 - DNA, 612 bp, Entamoeba histolytica HM-1:IMSS; identical to SEQ ID NO: 15643
  CDS (1)..(612)

SEQ ID NO: 65420 - protein, 203 aa, Entamoeba histolytica HM-1:IMSS; identical to SEQ ID NO: 15644

SEQ ID NO: 65421 - DNA, 615 bp, Entamoeba histolytica HM-1:IMSS; identical to SEQ ID NO: 15645
  CDS (1)..(615)

SEQ ID NO: 65422 - protein, 204 aa, Entamoeba histolytica HM-1:IMSS; identical to SEQ ID NO: 15646

SEQ ID NO: 65423 - DNA, 924 bp, Candida albicans SC5314; identical to SEQ ID NO: 15647
  CDS (1)..(924): transl_table=12

SEQ ID NO: 65424 - protein, 307 aa, Candida albicans SC5314; identical to SEQ ID NO: 15648

SEQ ID NO: 65425 - DNA, 888 bp, Thermus thermophilus HB27; identical to SEQ ID NO: 15649
  CDS (1)..(888): transl_table=11

SEQ ID NO: 65426 - protein, 295 aa, Thermus thermophilus HB27; identical to SEQ ID NO: 15650

SEQ ID NO: 65427 - DNA, 594 bp, Desulfovibrio vulgaris subsp. vulgaris str. Hildenborough; identical to SEQ ID NO: 15651
  CDS (1)..(594): transl_table=11

SEQ ID NO: 65428 - protein, 197 aa, Desulfovibrio vulgaris subsp. vulgaris str. Hildenborough; identical to SEQ ID NO: 15652

SEQ ID NO: 65429 - DNA, 570 bp, Listeria monocytogenes str. 4b F2365; identical to SEQ ID NO: 15653
  CDS (1)..(570): transl_table=11

SEQ ID NO: 65430 - protein, 189 aa, Listeria monocytogenes str. 4b F2365; identical to SEQ ID NO: 15654

SEQ ID NO: 65431 - DNA, 564 bp, Listeria monocytogenes str. 4b F2365; identical to SEQ ID NO: 15655
  CDS (1)..(564): transl_table=11

SEQ ID NO: 65432 - protein, 187 aa, Listeria monocytogenes str. 4b F2365; identical to SEQ ID NO: 15656

SEQ ID NO: 65433 - DNA, 564 bp, Bacillus thuringiensis serovar konkukian str. 97-27; identical to SEQ ID NO: 15657
  CDS (1)..(564): transl_table=11

SEQ ID NO: 65434 - protein, 187 aa, Bacillus thuringiensis serovar konkukian str. 97-27; identical to SEQ ID NO: 15658

SEQ ID NO: 65435 - DNA, 486 bp, Staphylococcus aureus subsp. aureus MRSA252; identical to SEQ ID NO: 15659
  CDS (1)..(486): transl_table=11

SEQ ID NO: 65436 - protein, 161 aa, Staphylococcus aureus subsp. aureus MRSA252; identical to SEQ ID NO: 15660

SEQ ID NO: 65437 - DNA, 600 bp, Staphylococcus aureus subsp. aureus MRSA252; identical to SEQ ID NO: 15661
  CDS (1)..(600): transl_table=11

SEQ ID NO: 65438 - protein, 199 aa, Staphylococcus aureus subsp. aureus MRSA252; identical to SEQ ID NO: 15662

SEQ ID NO: 65439 - DNA, 627 bp, Erwinia carotovora subsp. atroseptica SCRI1043; identical to SEQ ID NO: 15663
  CDS (1)..(627)

SEQ ID NO: 65440 - protein, 208 aa, Erwinia carotovora subsp. atroseptica SCRI1043; identical to SEQ ID NO: 15664

SEQ ID NO: 65441 - DNA, 573 bp, Propionibacterium acnes KPA171202; identical to SEQ ID NO: 15665
  CDS (1)..(573): transl_table=11

SEQ ID NO: 65442 - protein, 190 aa, Propionibacterium acnes KPA171202; identical to SEQ ID NO: 15666

SEQ ID NO: 65443 - DNA, 510 bp, Desulfotalea psychrophila LSv54; identical to SEQ ID NO: 15667
  CDS (1)..(510): transl_table=11

SEQ ID NO: 65444 - protein, 169 aa, Desulfotalea psychrophila LSv54; identical to SEQ ID NO: 15668

SEQ ID NO: 65445 - DNA, 579 bp, Bacillus licheniformis ATCC 14580; identical to SEQ ID NO: 15669
  CDS (1)..(579): transl_table=11

SEQ ID NO: 65446 - protein, 192 aa, Bacillus licheniformis ATCC 14580; identical to SEQ ID NO: 15670

SEQ ID NO: 65447 - DNA, 564 bp, Bacillus cereus E33L; identical to SEQ ID NO: 15671
  CDS (1)..(564): transl_table=11

SEQ ID NO: 65448 - protein, 187 aa, Bacillus cereus E33L; identical to SEQ ID NO: 15672

SEQ ID NO: 65449 - DNA, 603 bp, Mannheimia succiniciproducens MBEL55E; identical to SEQ ID NO: 15673
  CDS (1)..(603): transl_table=11

SEQ ID NO: 65450 - protein, 200 aa, Mannheimia succiniciproducens MBEL55E; identical to SEQ ID NO: 15674

SEQ ID NO: 65451 - DNA, 597 bp, Mannheimia succiniciproducens MBEL55E; identical to SEQ ID NO: 15675
  CDS (1)..(597): transl_table=11

SEQ ID NO: 65452 - protein, 198 aa, Mannheimia succiniciproducens MBEL55E; identical to SEQ ID NO: 15676

SEQ ID NO: 65453 - DNA, 606 bp, Bacteroides fragilis YCH46; identical to SEQ ID NO: 15677
  CDS (1)..(606): transl_table=11

SEQ ID NO: 65454 - protein, 201 aa, Bacteroides fragilis YCH46; identical to SEQ ID NO: 15678

SEQ ID NO: 65455 - DNA, 630 bp, Bacteroides fragilis YCH46; identical to SEQ ID NO: 15679
  CDS (1)..(630): transl_table=11

SEQ ID NO: 65456 - protein, 209 aa, Bacteroides fragilis YCH46; identical to SEQ ID NO: 15680

SEQ ID NO: 65457 - DNA, 627 bp, Bacteroides fragilis YCH46; identical to SEQ ID NO: 15681
  CDS (1)..(627): transl_table=11

SEQ ID NO: 65458 - protein, 208 aa, Bacteroides fragilis YCH46; identical to SEQ ID NO: 15682

SEQ ID NO: 65459 - DNA, 591 bp, Methylococcus capsulatus str. Bath; identical to SEQ ID NO: 15683
  CDS (1)..(591): transl_table=11

SEQ ID NO: 65460 - protein, 196 aa, Methylococcus capsulatus str. Bath; identical to SEQ ID NO: 15684

SEQ ID NO: 65461 - DNA, 648 bp, Photobacterium profundum SS9; identical to SEQ ID NO: 15685
  CDS (1)..(648): transl_table=11

SEQ ID NO: 65462 - protein, 215 aa, Photobacterium profundum SS9; identical to SEQ ID NO: 15686

SEQ ID NO: 65463 - DNA, 549 bp, Photobacterium profundum SS9; identical to SEQ ID NO: 15687
  CDS (1)..(549): transl_table=11

SEQ ID NO: 65464 - protein, 182 aa, Photobacterium profundum SS9; identical to SEQ ID NO: 15688

SEQ ID NO: 65465 - DNA, 564 bp, Photobacterium profundum SS9; identical to SEQ ID NO: 15689
  CDS (1)..(564): transl_table=11

SEQ ID NO: 65466 - protein, 187 aa, Photobacterium profundum SS9; identical to SEQ ID NO: 15690

SEQ ID NO: 65467 - DNA, 561 bp, Haloarcula marismortui ATCC 43049; identical to SEQ ID NO: 15691
  CDS (1)..(561): transl_table=11

SEQ ID NO: 65468 - protein, 186 aa, Haloarcula marismortui ATCC 43049; identical to SEQ ID NO: 15692

SEQ ID NO: 65469 - DNA, 675 bp, Geobacillus kaustophilus HTA426; identical to SEQ ID NO: 15693
  CDS (1)..(675): transl_table=11

SEQ ID NO: 65470 - protein, 224 aa, Geobacillus kaustophilus HTA426; identical to SEQ ID NO: 15694

SEQ ID NO: 65471 - DNA, 558 bp, Geobacillus kaustophilus HTA426; identical to SEQ ID NO: 15695
  CDS (1)..(558): transl_table=11

SEQ ID NO: 65472 - protein, 185 aa, Geobacillus kaustophilus HTA426; identical to SEQ ID NO: 15696

SEQ ID NO: 65473 - DNA, 552 bp, Azoarcus sp. EbN1; identical to SEQ ID NO: 15697
  CDS (1)..(552): transl_table=11

SEQ ID NO: 65474 - protein, 183 aa, Azoarcus sp. EbN1; identical to SEQ ID NO: 15698

SEQ ID NO: 65475 - DNA, 600 bp, Zymomonas mobilis subsp. mobilis ZM4; identical to SEQ ID NO: 15699
  CDS (1)..(600): transl_table=11

SEQ ID NO: 65476 - protein, 199 aa, Zymomonas mobilis subsp. mobilis ZM4; identical to SEQ ID NO: 15700

SEQ ID NO: 65477 - DNA, 693 bp, Dehalococcoides ethenogenes 195; identical to SEQ ID NO: 15701
  CDS (1)..(693): transl_table=11

SEQ ID NO: 65478 - protein, 230 aa, Dehalococcoides ethenogenes 195; identical to SEQ ID NO: 15702

SEQ ID NO: 65479 - DNA, 486 bp, Staphylococcus aureus subsp. aureus COL; identical to SEQ ID NO: 15703
  CDS (1)..(486): transl_table=11

SEQ ID NO: 65480 - protein, 161 aa, Staphylococcus aureus subsp. aureus COL; identical to SEQ ID NO: 15704

SEQ ID NO: 65481 - DNA, 600 bp, Staphylococcus aureus subsp. aureus COL; identical to SEQ ID NO: 15705
  CDS (1)..(600): transl_table=11

SEQ ID NO: 65482 - protein, 199 aa, Staphylococcus aureus subsp. aureus COL; identical to SEQ ID NO: 15706

SEQ ID NO: 65483 - DNA, 615 bp, Lactobacillus acidophilus NCFM; identical to SEQ ID NO: 15707
  CDS (1)..(615): transl_table=11

SEQ ID NO: 65484 - protein, 204 aa, Lactobacillus acidophilus NCFM; identical to SEQ ID NO: 15708

SEQ ID NO: 65485 - DNA, 600 bp, Vibrio fischeri ES114; identical to SEQ ID NO: 15709
  CDS (1)..(600): transl_table=11

SEQ ID NO: 65486 - protein, 199 aa, Vibrio fischeri ES114; identical to SEQ ID NO: 15710

SEQ ID NO: 65487 - DNA, 546 bp, Vibrio fischeri ES114; identical to SEQ ID NO: 15711
  CDS (1)..(546): transl_table=11

SEQ ID NO: 65488 - protein, 181 aa, Vibrio fischeri ES114; identical to SEQ ID NO: 15712

SEQ ID NO: 65489 - DNA, 552 bp, Vibrio fischeri ES114; identical to SEQ ID NO: 15713
  CDS (1)..(552): transl_table=11

SEQ ID NO: 65490 - protein, 183 aa, Vibrio fischeri ES114; identical to SEQ ID NO: 15714

SEQ ID NO: 65491 - DNA, 756 bp, Vibrio fischeri ES114; identical to SEQ ID NO: 15715
  CDS (1)..(756): transl_table=11

SEQ ID NO: 65492 - protein, 251 aa, Vibrio fischeri ES114; identical to SEQ ID NO: 15716

SEQ ID NO: 65493 - DNA, 522 bp, Bacteroides fragilis NCTC 9343; identical to SEQ ID NO: 15717
  CDS (1)..(522): transl_table=11

SEQ ID NO: 65494 - protein, 173 aa, Bacteroides fragilis NCTC 9343; identical to SEQ ID NO: 15718

SEQ ID NO: 65495 - DNA, 600 bp, Bacteroides fragilis NCTC 9343; identical to SEQ ID NO: 15719
  CDS (1)..(600): transl_table=11

SEQ ID NO: 65496 - protein, 199 aa, Bacteroides fragilis NCTC 9343; identical to SEQ ID NO: 15720

SEQ ID NO: 65497 - DNA, 630 bp, Bacteroides fragilis NCTC 9343; identical to SEQ ID NO: 15721
  CDS (1)..(630): transl_table=11

SEQ ID NO: 65498 - protein, 209 aa, Bacteroides fragilis NCTC 9343; identical to SEQ ID NO: 15722

SEQ ID NO: 65499 - DNA, 624 bp, Bacteroides fragilis NCTC 9343; identical to SEQ ID NO: 15723
  CDS (1)..(624): transl_table=11

SEQ ID NO: 65500 - protein, 207 aa, Bacteroides fragilis NCTC 9343; identical to SEQ ID NO: 15724

SEQ ID NO: 65501 - DNA, 552 bp, Bacteroides fragilis NCTC 9343; identical to SEQ ID NO: 15725
  CDS (1)..(552): transl_table=11

SEQ ID NO: 65502 - protein, 183 aa, Bacteroides fragilis NCTC 9343; identical to SEQ ID NO: 15726

SEQ ID NO: 65503 - DNA, 588 bp, Bacteroides fragilis NCTC 9343; identical to SEQ ID NO: 15727
  CDS (1)..(588): transl_table=11

SEQ ID NO: 65504 - protein, 195 aa, Bacteroides fragilis NCTC 9343; identical to SEQ ID NO: 15728

SEQ ID NO: 65505 - DNA, 690 bp, Brucella abortus biovar 1 str. 9-941; identical to SEQ ID NO: 15729
  CDS (1)..(690): transl_table=11

SEQ ID NO: 65506 - protein, 229 aa, Brucella abortus biovar 1 str. 9-941; identical to SEQ ID NO: 15730

SEQ ID NO: 65507 - DNA, 690 bp, Chloroflexus aurantiacus; identical to SEQ ID NO: 15731
  CDS (1)..(690)

SEQ ID NO: 65508 - protein, 229 aa, Chloroflexus aurantiacus; identical to SEQ ID NO: 15732

SEQ ID NO: 65509 - DNA, 564 bp, Chloroflexus aurantiacus; identical to SEQ ID NO: 15733
  CDS (1)..(564)

SEQ ID NO: 65510 - protein, 187 aa, Chloroflexus aurantiacus; identical to SEQ ID NO: 15734

SEQ ID NO: 65511 - DNA, 615 bp, Lactobacillus gasseri; identical to SEQ ID NO: 15735
  CDS (1)..(615)

SEQ ID NO: 65512 - protein, 204 aa, Lactobacillus gasseri; identical to SEQ ID NO: 15736

SEQ ID NO: 65513 - DNA, 606 bp, Magnetospirillum magnetotacticum MS-1; identical to SEQ ID NO: 15737
  CDS (1)..(606)

SEQ ID NO: 65514 - protein, 201 aa, Magnetospirillum magnetotacticum MS-1; identical to SEQ ID NO: 15738

SEQ ID NO: 65515 - DNA, 702 bp, Leuconostoc mesenteroides subsp. mesenteroides ATCC 8293; identical to SEQ ID NO: 15739
  CDS (1)..(702)

SEQ ID NO: 65516 - protein, 233 aa, Leuconostoc mesenteroides subsp. mesenteroides ATCC 8293; identical to SEQ ID NO: 15740

SEQ ID NO: 65517 - DNA, 561 bp, Nostoc punctiforme PCC 73102; identical to SEQ ID NO: 15741
  CDS (1)..(561)

SEQ ID NO: 65518 - protein, 186 aa, Nostoc punctiforme PCC 73102; identical to SEQ ID NO: 15742

SEQ ID NO: 65519 - DNA, 594 bp, Nostoc punctiforme PCC 73102; identical to SEQ ID NO: 15743
  CDS (1)..(594)

SEQ ID NO: 65520 - protein, 197 aa, Nostoc punctiforme PCC 73102; identical to SEQ ID NO: 15744

SEQ ID NO: 65521 - DNA, 702 bp, Nostoc punctiforme PCC 73102; identical to SEQ ID NO: 15745
  CDS (1)..(702)

SEQ ID NO: 65522 - protein, 233 aa, Nostoc punctiforme PCC 73102; identical to SEQ ID NO: 15746

SEQ ID NO: 65523 - DNA, 675 bp, Bifidobacterium longum DJO10A; identical to SEQ ID NO: 15747
  CDS (1)..(675)

SEQ ID NO: 65524 - protein, 224 aa, Bifidobacterium longum DJO10A; identical to SEQ ID NO: 15748

SEQ ID NO: 65525 - DNA, 633 bp, Bifidobacterium longum DJO10A; identical to SEQ ID NO: 15749
  CDS (1)..(633)

SEQ ID NO: 65526 - protein, 210 aa, Bifidobacterium longum DJO10A; identical to SEQ ID NO: 15750

SEQ ID NO: 65527 - DNA, 609 bp, Desulfovibrio desulfuricans G20; identical to SEQ ID NO: 15751
  CDS (1)..(609)

SEQ ID NO: 65528 - protein, 202 aa, Desulfovibrio desulfuricans G20; identical to SEQ ID NO: 15752

SEQ ID NO: 65529 - DNA, 558 bp, Desulfovibrio desulfuricans G20; identical to SEQ ID NO: 15753
  CDS (1)..(558)

SEQ ID NO: 65530 - protein, 185 aa, Desulfovibrio desulfuricans G20; identical to SEQ ID NO: 15754

SEQ ID NO: 65531 - DNA, 576 bp, Anabaena variabilis ATCC 29413; identical to SEQ ID NO: 15755
  CDS (1)..(576)

SEQ ID NO: 65532 - protein, 191 aa, Anabaena variabilis ATCC 29413; identical to SEQ ID NO: 15756

SEQ ID NO: 65533 - DNA, 561 bp, Anabaena variabilis ATCC 29413; identical to SEQ ID NO: 15757
  CDS (1)..(561)

SEQ ID NO: 65534 - protein, 186 aa, Anabaena variabilis ATCC 29413; identical to SEQ ID NO: 15758

SEQ ID NO: 65535 - DNA, 576 bp, Actinobacillus pleuropneumoniae serovar 1 str. 4074; identical to SEQ ID NO: 15759
  CDS (1)..(576)

SEQ ID NO: 65536 - protein, 191 aa, Actinobacillus pleuropneumoniae serovar 1 str. 4074; identical to SEQ ID NO: 15760

SEQ ID NO: 65537 - DNA, 501 bp, Burkholderia cepacia R18194; identical to SEQ ID NO: 15761
  CDS (1)..(501)

SEQ ID NO: 65538 - protein, 166 aa, Burkholderia cepacia R18194; identical to SEQ ID NO: 15762

SEQ ID NO: 65539 - DNA, 609 bp, Burkholderia cepacia R18194; identical to SEQ ID NO: 15763
  CDS (1)..(609)

SEQ ID NO: 65540 - protein, 202 aa, Burkholderia cepacia R18194; identical to SEQ ID NO: 15764

SEQ ID NO: 65541 - DNA, 528 bp, Listeria monocytogenes str. 4b H7858; identical to SEQ ID NO: 15765
  CDS (1)..(528): transl_table=11

SEQ ID NO: 65542 - protein, 175 aa, Listeria monocytogenes str. 4b H7858; identical to SEQ ID NO: 15766

SEQ ID NO: 65543 - DNA, 570 bp, Listeria monocytogenes str. 4b H7858; identical to SEQ ID NO: 15767
  CDS (1)..(570): transl_table=11

SEQ ID NO: 65544 - protein, 189 aa, Listeria monocytogenes str. 4b H7858; identical to SEQ ID NO: 15768

SEQ ID NO: 65545 - DNA, 564 bp, Bacillus cereus G9241; identical to SEQ ID NO: 15769
  CDS (1)..(564): transl_table=11

SEQ ID NO: 65546 - protein, 187 aa, Bacillus cereus G9241; identical to SEQ ID NO: 15770

SEQ ID NO: 65547 - DNA, 558 bp, Bacillus cereus G9241; identical to SEQ ID NO: 15771
  CDS (1)..(558): transl_table=11

SEQ ID NO: 65548 - protein, 185 aa, Bacillus cereus G9241; identical to SEQ ID NO: 15772

SEQ ID NO: 65549 - DNA, 588 bp, Burkholderia fungorum LB400; identical to SEQ ID NO: 15773
  CDS (1)..(588)

SEQ ID NO: 65550 - protein, 195 aa, Burkholderia fungorum LB400; identical to SEQ ID NO: 15774

SEQ ID NO: 65551 - DNA, 555 bp, Thermobifida fusca; identical to SEQ ID NO: 15775
  CDS (1)..(555)

SEQ ID NO: 65552 - protein, 184 aa, Thermobifida fusca; identical to SEQ ID NO: 15776

SEQ ID NO: 65553 - DNA, 513 bp, Cytophaga hutchinsonii; identical to SEQ ID NO: 15777
  CDS (1)..(513)

SEQ ID NO: 65554 - protein, 170 aa, Cytophaga hutchinsonii; identical to SEQ ID NO: 15778

SEQ ID NO: 65555 - DNA, 654 bp, Cytophaga hutchinsonii; identical to SEQ ID NO: 15779
  CDS (1)..(654)

SEQ ID NO: 65556 - protein, 217 aa, Cytophaga hutchinsonii; identical to SEQ ID NO: 15780

SEQ ID NO: 65557 - DNA, 744 bp, Microbulbifer degradans 2-40; identical to SEQ ID NO: 15781
  CDS (1)..(744)

SEQ ID NO: 65558 - protein, 247 aa, Microbulbifer degradans 2-40; identical to SEQ ID NO: 15782

SEQ ID NO: 65559 - DNA, 549 bp, Microbulbifer degradans 2-40; identical to SEQ ID NO: 15783
  CDS (1)..(549)

SEQ ID NO: 65560 - protein, 182 aa, Microbulbifer degradans 2-40; identical to SEQ ID NO: 15784

SEQ ID NO: 65561 - DNA, 417 bp, Oenococcus oeni PSU-1; identical to SEQ ID NO: 15785
  CDS (1)..(417)

SEQ ID NO: 65562 - protein, 138 aa, Oenococcus oeni PSU-1; identical to SEQ ID NO: 15786

SEQ ID NO: 65563 - DNA, 567 bp, Pediococcus pentosaceus ATCC 25745; identical to SEQ ID NO: 15787
  CDS (1)..(567)

SEQ ID NO: 65564 - protein, 188 aa, Pediococcus pentosaceus ATCC 25745; identical to SEQ ID NO: 15788

SEQ ID NO: 65565 - DNA, 555 bp, Pediococcus pentosaceus ATCC 25745; identical to SEQ ID NO: 15789
  CDS (1)..(555)

SEQ ID NO: 65566 - protein, 184 aa, Pediococcus pentosaceus ATCC 25745; identical to SEQ ID NO: 15790

SEQ ID NO: 65567 - DNA, 552 bp, Pediococcus pentosaceus ATCC 25745; identical to SEQ ID NO: 15791
  CDS (1)..(552)

SEQ ID NO: 65568 - protein, 183 aa, Pediococcus pentosaceus ATCC 25745; identical to SEQ ID NO: 15792

SEQ ID NO: 65569 - DNA, 465 bp, Streptococcus suis 89/1591; identical to SEQ ID NO: 15793
  CDS (1)..(465)

SEQ ID NO: 65570 - protein, 154 aa, Streptococcus suis 89/1591; identical to SEQ ID NO: 15794

SEQ ID NO: 65571 - DNA, 606 bp, Desulfovibrio desulfuricans G20; identical to SEQ ID NO: 15795
  CDS (1)..(606)

SEQ ID NO: 65572 - protein, 201 aa, Desulfovibrio desulfuricans G20; identical to SEQ ID NO: 15796

SEQ ID NO: 65573 - DNA, 543 bp, Chloroflexus aurantiacus; identical to SEQ ID NO: 15797
  CDS (1)..(543)

SEQ ID NO: 65574 - protein, 180 aa, Chloroflexus aurantiacus; identical to SEQ ID NO: 15798

SEQ ID NO: 65575 - DNA, 186 bp, Brevibacterium linens BL2; identical to SEQ ID NO: 15799
  CDS (1)..(186)

SEQ ID NO: 65576 - protein, 61 aa, Brevibacterium linens BL2; identical to SEQ ID NO: 15800

SEQ ID NO: 65577 - DNA, 612 bp, Lactococcus lactis subsp. cremoris SK11; identical to SEQ ID NO: 15801
  CDS (1)..(612)

SEQ ID NO: 65578 - protein, 203 aa, Lactococcus lactis subsp. cremoris SK11; identical to SEQ ID NO: 15802

SEQ ID NO: 65579 - DNA, 588 bp, Lactococcus lactis subsp. cremoris SK11; identical to SEQ ID NO: 15803
  CDS (1)..(588)

SEQ ID NO: 65580 - protein, 195 aa, Lactococcus lactis subsp. cremoris SK11; identical to SEQ ID NO: 15804

SEQ ID NO: 65581 - DNA, 597 bp, Lactobacillus casei ATCC 334; identical to SEQ ID NO: 15805
  CDS (1)..(597)

SEQ ID NO: 65582 - protein, 198 aa, Lactobacillus casei ATCC 334; identical to SEQ ID NO: 15806

SEQ ID NO: 65583 - DNA, 705 bp, Lactobacillus casei ATCC 334; identical to SEQ ID NO: 15807
  CDS (1)..(705)

SEQ ID NO: 65584 - protein, 234 aa, Lactobacillus casei ATCC 334; identical to SEQ ID NO: 15808

SEQ ID NO: 65585 - DNA, 591 bp, Lactobacillus delbrueckii subsp. bulgaricus ATCC BAA-365; identical to SEQ ID NO: 15809
  CDS (1)..(591)

SEQ ID NO: 65586 - protein, 196 aa, Lactobacillus delbrueckii subsp. bulgaricus ATCC BAA-365; identical to SEQ ID NO: 15810

SEQ ID NO: 65587 - DNA, 609 bp, Bacillus anthracis str. A2012; identical to SEQ ID NO: 15811
  CDS (1)..(609): n means a or g or c or t/u, s means g or c

SEQ ID NO: 65588 - protein, 202 aa, Bacillus anthracis str. A2012; identical to SEQ ID NO: 15812
  Xaa in position 136 is unknown

SEQ ID NO: 65589 - DNA, 534 bp, Anaeromyxobacter dehalogenans 2CP-C; identical to SEQ ID NO: 15813
  CDS (1)..(534): transl_table=11

SEQ ID NO: 65590 - protein, 177 aa, Anaeromyxobacter dehalogenans 2CP-C; identical to SEQ ID NO: 15814

SEQ ID NO: 65591 - DNA, 663 bp, Streptococcus pneumoniae TIGR4; identical to SEQ ID NO: 15815
  CDS (1)..(663)

SEQ ID NO: 65592 - protein, 220 aa, Streptococcus pneumoniae TIGR4; identical to SEQ ID NO: 15816

SEQ ID NO: 65593 - DNA, 558 bp, Burkholderia vietnamiensis G4; identical to SEQ ID NO: 15817
  CDS (1)..(558): transl_table=11

SEQ ID NO: 65594 - protein, 185 aa, Burkholderia vietnamiensis G4; identical to SEQ ID NO: 15818

SEQ ID NO: 65595 - DNA, 576 bp, Crocosphaera watsonii WH 8501; identical to SEQ ID NO: 15819
  CDS (1)..(576): transl_table=11

SEQ ID NO: 65596 - protein, 191 aa, Crocosphaera watsonii WH 8501; identical to SEQ ID NO: 15820

SEQ ID NO: 65597 - DNA, 555 bp, Chlorobium phaeobacteroides DSM 266; identical to SEQ ID NO: 15821
  CDS (1)..(555): transl_table=11

SEQ ID NO: 65598 - protein, 184 aa, Chlorobium phaeobacteroides DSM 266; identical to SEQ ID NO: 15822

SEQ ID NO: 65599 - DNA, 618 bp, Chlorobium phaeobacteroides BS1; identical to SEQ ID NO: 15823
  CDS (1)..(618): transl_table=11

SEQ ID NO: 65600 - protein, 205 aa, Chlorobium phaeobacteroides BS1; identical to SEQ ID NO: 15824

SEQ ID NO: 65601 - DNA, 576 bp, Exiguobacterium sp. 255-15; identical to SEQ ID NO: 15825
  CDS (1)..(576): transl_table=11

SEQ ID NO: 65602 - protein, 191 aa, Exiguobacterium sp. 255-15; identical to SEQ ID NO: 15826

SEQ ID NO: 65603 - DNA, 552 bp, Exiguobacterium sp. 255-15; identical to SEQ ID NO: 15827
  CDS (1)..(552): transl_table=11

SEQ ID NO: 65604 - protein, 183 aa, Exiguobacterium sp. 255-15; identical to SEQ ID NO: 15828

SEQ ID NO: 65605 - DNA, 702 bp, Exiguobacterium sp. 255-15; identical to SEQ ID NO: 15829
  CDS (1)..(702): transl_table=11

SEQ ID NO: 65606 - protein, 233 aa, Exiguobacterium sp. 255-15; identical to SEQ ID NO: 15830

SEQ ID NO: 65607 - DNA, 642 bp, Methanosarcina barkeri str. fusaro; identical to SEQ ID NO: 15831
  CDS (1)..(642): transl_table=11

SEQ ID NO: 65608 - protein, 213 aa, Methanosarcina barkeri str. fusaro; identical to SEQ ID NO: 15832

SEQ ID NO: 65609 - DNA, 600 bp, Methanosarcina barkeri str. fusaro; identical to SEQ ID NO: 15833
  CDS (1)..(600): transl_table=11

SEQ ID NO: 65610 - protein, 199 aa, Methanosarcina barkeri str. fusaro; identical to SEQ ID NO: 15834

SEQ ID NO: 65611 - DNA, 549 bp, Methanosarcina barkeri str. fusaro; identical to SEQ ID NO: 15835
  CDS (1)..(549): transl_table=11

SEQ ID NO: 65612 - protein, 182 aa, Methanosarcina barkeri str. fusaro; identical to SEQ ID NO: 15836

SEQ ID NO: 65613 - DNA, 609 bp, Methanosarcina barkeri str. fusaro; identical to SEQ ID NO: 15837
  CDS (1)..(609): transl_table=11

SEQ ID NO: 65614 - protein, 202 aa, Methanosarcina barkeri str. fusaro; identical to SEQ ID NO: 15838

SEQ ID NO: 65615 - DNA, 531 bp, Desulfuromonas acetoxidans DSM 684; identical to SEQ ID NO: 15839
  CDS (1)..(531): transl_table=11

SEQ ID NO: 65616 - protein, 176 aa, Desulfuromonas acetoxidans DSM 684; identical to SEQ ID NO: 15840

SEQ ID NO: 65617 - DNA, 555 bp, Jannaschia sp. CCS1; identical to SEQ ID NO: 15841
  CDS (1)..(555): transl_table=11

SEQ ID NO: 65618 - protein, 184 aa, Jannaschia sp. CCS1; identical to SEQ ID NO: 15842

SEQ ID NO: 65619 - DNA, 630 bp, Frankia sp. EAN1pec; identical to SEQ ID NO: 15843
  CDS (1)..(630): transl_table=11

SEQ ID NO: 65620 - protein, 209 aa, Frankia sp. EAN1pec; identical to SEQ ID NO: 15844

SEQ ID NO: 65621 - DNA, 555 bp, Shewanella baltica OS155; identical to SEQ ID NO: 15845
  CDS (1)..(555): transl_table=11

SEQ ID NO: 65622 - protein, 184 aa, Shewanella baltica OS155; identical to SEQ ID NO: 15846

SEQ ID NO: 65623 - DNA, 585 bp, Shewanella baltica OS155; identical to SEQ ID NO: 15847
  CDS (1)..(585): transl_table=11

SEQ ID NO: 65624 - protein, 194 aa, Shewanella baltica OS155; identical to SEQ ID NO: 15848

SEQ ID NO: 65625 - DNA, 726 bp, Ralstonia metallidurans CH34; identical to SEQ ID NO: 15849
  CDS (1)..(726): transl_table=11

SEQ ID NO: 65626 - protein, 241 aa, Ralstonia metallidurans CH34; identical to SEQ ID NO: 15850

SEQ ID NO: 65627 - DNA, 549 bp, Paracoccus denitrificans PD1222; identical to SEQ ID NO: 15851
  CDS (1)..(549): transl_table=11

SEQ ID NO: 65628 - protein, 182 aa, Paracoccus denitrificans PD1222; identical to SEQ ID NO: 15852

SEQ ID NO: 65629 - DNA, 615 bp, Shewanella frigidimarina NCIMB 400; identical to SEQ ID NO: 15853
  CDS (1)..(615): transl_table=11

SEQ ID NO: 65630 - protein, 204 aa, Shewanella frigidimarina NCIMB 400; identical to SEQ ID NO: 15854

SEQ ID NO: 65631 - DNA, 777 bp, Escherichia coli; identical to SEQ ID NO: 15855
  CDS (1)..(777): transl_table=11

SEQ ID NO: 65632 - protein, 258 aa, Escherichia coli; identical to SEQ ID NO: 15856

SEQ ID NO: 65633 - DNA, 651 bp, Pseudomonas fluorescens; identical to SEQ ID NO: 15857
  CDS (1)..(651): transl_table=11

SEQ ID NO: 65634 - protein, 216 aa, Pseudomonas fluorescens; identical to SEQ ID NO: 15858

SEQ ID NO: 65635 - DNA, 579 bp, Staphylococcus haemolyticus; identical to SEQ ID NO: 15859
  CDS (1)..(579): transl_table=11

SEQ ID NO: 65636 - protein, 192 aa, Staphylococcus haemolyticus; identical to SEQ ID NO: 15860

SEQ ID NO: 65637 - DNA, 648 bp, Aspergillus fumigatus Af293; identical to SEQ ID NO: 15861
  CDS (1)..(648)

SEQ ID NO: 65638 - protein, 215 aa, Aspergillus fumigatus Af293; identical to SEQ ID NO: 15862

SEQ ID NO: 65639 - DNA, 747 bp, Aspergillus fumigatus Af293; identical to SEQ ID NO: 15863
  CDS (1)..(747)

SEQ ID NO: 65640 - protein, 248 aa, Aspergillus fumigatus Af293; identical to SEQ ID NO: 15864

SEQ ID NO: 65641 - DNA, 687 bp, Aspergillus fumigatus Af293; identical to SEQ ID NO: 15865
  CDS (1)..(687)

SEQ ID NO: 65642 - protein, 228 aa, Aspergillus fumigatus Af293; identical to SEQ ID NO: 15866

SEQ ID NO: 65643 - DNA, 603 bp, Lactobacillus crispatus; identical to SEQ ID NO: 15867
  CDS (1)..(603): transl_table=11

SEQ ID NO: 65644 - protein, 200 aa, Lactobacillus crispatus; identical to SEQ ID NO: 15868

SEQ ID NO: 65645 - DNA, 642 bp, Cryptococcus neoformans var; identical to SEQ ID NO: 15869
  CDS (1)..(642)

SEQ ID NO: 65646 - protein, 213 aa, Cryptococcus neoformans var; identical to SEQ ID NO: 15870

SEQ ID NO: 65647 - DNA, 513 bp, Klebsiella pneumoniae; identical to SEQ ID NO: 15871
  CDS (1)..(513): transl_table=11

SEQ ID NO: 65648 - protein, 170 aa, Klebsiella pneumoniae; identical to SEQ ID NO: 15872

SEQ ID NO: 65649 - DNA, 555 bp, Vibrio cholerae non; identical to SEQ ID NO: 15873
  CDS (1)..(555): transl_table=11

SEQ ID NO: 65650 - protein, 184 aa, Vibrio cholerae non; identical to SEQ ID NO: 15874

SEQ ID NO: 65651 - DNA, 645 bp, Rhizobium etli; identical to SEQ ID NO: 15875
  CDS (1)..(645): transl_table=11

SEQ ID NO: 65652 - protein, 214 aa, Rhizobium etli; identical to SEQ ID NO: 15876

SEQ ID NO: 65653 - DNA, 558 bp, Bacillus stearothermophilus; identical to SEQ ID NO: 15877
  CDS (1)..(558): transl_table=11

SEQ ID NO: 65654 - protein, 185 aa, Bacillus stearothermophilus; identical to SEQ ID NO: 15878

SEQ ID NO: 65655 - DNA, 594 bp, Rhizobium leguminosarum bv; identical to SEQ ID NO: 15879
  CDS (1)..(594): transl_table=11

SEQ ID NO: 65656 - protein, 197 aa, Rhizobium leguminosarum bv; identical to SEQ ID NO: 15880

SEQ ID NO: 65657 - DNA, 573 bp, Dictyostelium discoideum; identical to SEQ ID NO: 15881
  CDS (1)..(573)

SEQ ID NO: 65658 - protein, 190 aa, Dictyostelium discoideum; identical to SEQ ID NO: 15882

SEQ ID NO: 65659 - DNA, 657 bp, Physcomitrella patens; identical to SEQ ID NO: 15883
  CDS (1)..(657)

SEQ ID NO: 65660 - protein, 218 aa, Physcomitrella patens; identical to SEQ ID NO: 15884

SEQ ID NO: 65661 - DNA, 636 bp, Aeromonas hydrophila; identical to SEQ ID NO: 15885
  CDS (1)..(636): transl_table=11

SEQ ID NO: 65662 - protein, 211 aa, Aeromonas hydrophila; identical to SEQ ID NO: 15886

SEQ ID NO: 65663 - DNA, 600 bp, Aeromonas hydrophila; identical to SEQ ID NO: 15887
  CDS (1)..(600): transl_table=11

SEQ ID NO: 65664 - protein, 199 aa, Aeromonas hydrophila; identical to SEQ ID NO: 15888

SEQ ID NO: 65665 - DNA, 678 bp, Corynebacterium glutamicum; identical to SEQ ID NO: 15889
  CDS (1)..(678): transl_table=11

SEQ ID NO: 65666 - protein, 225 aa, Corynebacterium glutamicum; identical to SEQ ID NO: 15890

SEQ ID NO: 65667 - DNA, 624 bp, Lactococcus lactis; identical to SEQ ID NO: 15891
  CDS (1)..(624): transl_table=11

SEQ ID NO: 65668 - protein, 207 aa, Lactococcus lactis; identical to SEQ ID NO: 15892

SEQ ID NO: 65669 - DNA, 621 bp, Candida albicans; identical to SEQ ID NO: 15893
  CDS (1)..(621): transl_table=12

SEQ ID NO: 65670 - protein, 206 aa, Candida albicans; identical to SEQ ID NO: 15894

SEQ ID NO: 65671 - DNA, 519 bp, Staphylococcus aureus; identical to SEQ ID NO: 15895
  CDS (1)..(519): transl_table=11

SEQ ID NO: 65672 - protein, 172 aa, Staphylococcus aureus; identical to SEQ ID NO: 15896

SEQ ID NO: 65673 - DNA, 555 bp, Bacillus subtilis; identical to SEQ ID NO: 15897
  CDS (1)..(555): transl_table=11

SEQ ID NO: 65674 - protein, 184 aa, Bacillus subtilis; identical to SEQ ID NO: 15898

SEQ ID NO: 65675 - DNA, 552 bp, Escherichia coli; identical to SEQ ID NO: 15433
  CDS (1)..(552)

SEQ ID NO: 65676 - protein, 183 aa, Escherichia coli; identical to SEQ ID NO: 15434

SEQ ID NO: 65677 - DNA, 573 bp, Rhizobium leguminosarum bv; identical to SEQ ID NO: 15901
  CDS (1)..(573): transl_table=11

SEQ ID NO: 65678 - protein, 190 aa, Rhizobium leguminosarum bv; identical to SEQ ID NO: 15902

SEQ ID NO: 65679 - DNA, 552 bp, Rhizobium meliloti; identical to SEQ ID NO: 15903
  CDS (1)..(552): transl_table=11

SEQ ID NO: 65680 - protein, 183 aa, Rhizobium meliloti; identical to SEQ ID NO: 15904

SEQ ID NO: 65681 - DNA, 624 bp, Lactococcus lactis subsp; identical to SEQ ID NO: 15905
  CDS (1)..(624): transl_table=11

SEQ ID NO: 65682 - protein, 207 aa, Lactococcus lactis subsp; identical to SEQ ID NO: 15906

SEQ ID NO: 65683 - DNA, 645 bp, Methanococcus jannaschii; identical to SEQ ID NO: 15907
  CDS (1)..(645): transl_table=11

SEQ ID NO: 65684 - protein, 214 aa, Methanococcus jannaschii; identical to SEQ ID NO: 15908

SEQ ID NO: 65685 - DNA, 624 bp, Schizosaccharomyces pombe; identical to SEQ ID NO: 15909
  CDS (1)..(624)

SEQ ID NO: 65686 - protein, 207 aa, Schizosaccharomyces pombe; identical to SEQ ID NO: 15910

SEQ ID NO: 65687 - DNA, 591 bp, Saccharomyces cerevisiae; identical to SEQ ID NO: 15911
  CDS (1)..(591)

SEQ ID NO: 65688 - protein, 196 aa, Saccharomyces cerevisiae; identical to SEQ ID NO: 15912

SEQ ID NO: 65689 - DNA, 25 bp, Artificial sequence
  (1)..(25): primer
atgaacatgccaatgaccgaaagaa

SEQ ID NO: 65690 - DNA, 28 bp, Artificial sequence
  (1)..(28): primer
ttaaactgacgattcaactttataatct

SEQ ID NO: 65691 - protein, 204 aa, Artificial sequence; identical to SEQ ID NO: 15915
  Variant (2)..(4): xaa in position 2 to 4 is any amino acid
  Variant (5)..(9): xaa in position 5 to 9 is any or no amino acid
  Variant (11)..(26): xaa in position 11 to 26 is any or no amino acid
  Variant (28)..(28): xaa in position 28 is any amino acid
  Variant (31)..(41): xaa in position 31 to 41 is any amino acid
  Variant (42)..(92): xaa in position 42 to 92 is any or no amino acid
  Variant (94)..(94): xaa in position 94 is any or no amino acid
  Variant (97)..(97): xaa in position 97 is any amino acid
  Variant (98)..(101): xaa in position 98 to 101 is any or no amino acid
  Variant (103)..(106): xaa in position 103 to 106 is any amino acid
  Variant (108)..(109): xaa in position 108 to 109 is any amino acid
  Variant (110)..(112): xaa in position 110 to 112 is any or no amino acid
  Variant (114)..(119): xaa in position 114 to 119 is any amino acid
  Variant (120)..(152): xaa in position 120 to 152 is any or no amino acid
  Variant (154)..(154): xaa in position 154 is any amino acid
  Variant (156)..(159): xaa in position 156 to 159 is any amino acid
  Variant (163)..(166): xaa in position 163 to 166 is any or no amino acid
  Variant (168)..(169): xaa in position 168 to 169 is any or no amino acid
  Variant (172)..(172): xaa in position 172 is any or no amino acid
  Variant (175)..(177): xaa in position 175 to 177 is any or no amino acid
  Variant (188)..(188): xaa in position 188 is any amino acid
  Variant (191)..(193): xaa in position 191 to 193 is any amino acid
  Variant (195)..(196): xaa in position 195 to 196 is any amino acid
  Variant (198)..(198): xaa in position 198 is any amino acid
  Variant (200)..(200): xaa in position 200 is any amino acid

SEQ ID NO: 65692 - protein, 12 aa, Artificial sequence
  Variant (2)..(2): xaa in position 2 is any or no amino acid
  Variant (4)..(5): xaa in position 4 to 5 is any amino acid
  Variant (6)..(6): xaa in position 6 is Ala, Cys, Thr or Val
  Variant (7)..(7): xaa in position 7 is any amino acid
  Variant (8)..(8): xaa in position 8 is Phe, Ile, Leu, Met or Val
  Variant (9)..(11): xaa in position 9 to 11 is any amino acid
  Variant (12)..(12): xaa in position 12 is Ala, Cys, Asp, Gly, Asn, Ser, Thr or Val
IXGXXXXXXXXX

SEQ ID NO: 65693 - protein, 43 aa, Artificial sequence; identical to SEQ ID NO: 15917
  Variant (2)..(2): xaa in position 2 is any amino acid
  Variant (3)..(4): xaa in position 3 to 4 is any or no amino acid
  Variant (6)..(10): xaa in position 6 to 10 is any amino acid
  Variant (11)..(12): xaa in position 11 to 12 is any or no amino acid
  Variant (14)..(14): xaa in position 14 is Ala, Ile or Val
  Variant (15)..(15): xaa in position 15 is any amino acid
  Variant (16)..(16): xaa in position 16 is Ile, Leu or Val
  Variant (17)..(17): xaa in position 17 is Asp, Gly or Thr
  Variant (18)..(19): xaa in position 18 to 19 is any amino acid
  Variant (20)..(20): xaa in position 20 is Ala, Cys, Gly, Ser, Thr or Val
  Variant (21)..(21): xaa in position 21 is any amino acid
  Variant (22)..(22): xaa in position 22 is Ala, Ile, Leu or Val
  Variant (23)..(23): xaa in position 23 is Ala, Gly or Ser
  Variant (24)..(25): xaa in position 24 to 25 is any amino acid
  Variant (26)..(26): xaa in position 26 is Ala, Cys, Ser or Thr
  Variant (27)..(27): xaa in position 27 is any amino acid
  Variant (28)..(28): xaa in position 28 is Ala, Ile or Val
  Variant (29)..(31): xaa in position 29 to 31 is any amino acid
  Variant (32)..(32): xaa in position 32 is Phe, Ile, Leu, Met or Val
  Variant (33)..(39): xaa in position 33 to 39 is any amino acid
  Variant (41)..(41): xaa in position 41 is any amino acid
  Variant (43)..(43): xaa in position 43 is Ala, Cys or Gly

SEQ ID NO: 65694 - DNA, 1215 bp, Escherichia coli K12
  CDS (1)..(1215): transl_table=11
atgccggaggggcgcaccacacccgccggcaattcgcaccattatggtgcgcttgcacacattcaatgccggagagcagccgtgaatgacgctatccctcgcccgcaggcgaaaacccgtaaggcgctgacgccgctattagaaatccgcaacctgaccaaatcctacgatggtcaacatgcggtggatgatgtcagcctgaccatctacaaaggtgaaatcttcgcgctgctgggcgcatccggctgtggcaagtccacgctgctgcgtatgctggcaggtttcgaacaaccttctgccggacagataatgcttgatggcgtcgatttgtcacaggttccgccttacctgcgccccatcaatatgatgtttcagtcttacgcgctgtttccgcatatgaccgtggaacagaacatcgcttttggcctgaaacaggacaaactaccgaaagcggaaattgccagccgggtcaatgagatgctcggcctggtgcatatgcaggagttcgccaaacgcaaaccgcatcagctttccggtggtcagcgacaacgtgtggccctggcccgaagccttgcgaagcgcccgaaactattactgctcgatgagccgatgggcgcgctggataaaaagctgcgtgacaggatgcagcttgaagtggtggatattctggagcgcgtcggtgtgacttgtgtgatggtcacccacgatcaggaagaggcgatgaccatggcggggcgcatcgccattatgaatcgtgggaaatttgtccagattggcgaaccggaagagatctacgagcatccgactacccgctatagcgccgaatttattggctcggtaaacgtctttgaaggcgtactcaaagagcgtcaggaagatggcctggtgcttgattcgccggggctggtgcatccactgaaagtcgacgcggatgcctcggtggtcgataacgtgccggtacatgtggcgctgcgcccggaaaaaatcatgctttgcgaagagccgcccgccaatggttgtaacttcgcggtgggggaggtgatacacattgcctatctcggcgatctttcggtgtatcacgttcgtctgaaaagtgggcagatgattagcgcccagctacaaaacgcccatcgtcatcgtaaagggttaccgacctggggcgacgaagtgcgtttgtgctgggaagtggacagctgtgtggtgctgacggtttaa

SEQ ID NO: 65695 - protein, 404 aa, Escherichia coli K12
MPEGRTTPAGNSHHYGALAHIQCRRAAVNDAIPRPQAKTRKALTPLLEIRNLTKSYDGQHAVDDVSLTIYKGEIFALLGASGCGKSTLLRMLAGFEQPSAGQIMLDGVDLSQVPPYLRPINMMFQSYALFPHMTVEQNIAFGLKQDKLPKAEIASRVNEMLGLVHMQEFAKRKPHQLSGGQRQRVALARSLAKRPKLLLLDEPMGALDKKLRDRMQLEVVDILERVGVTCVMVTHDQEEAMTMAGRIAIMNRGKFVQIGEPEEIYEHPTTRYSAEFIGSVNVFEGVLKERQEDGLVLDSPGLVHPLKVDADASVVDNVPVHVALRPEKIMLCEEPPANGCNFAVGEVIHIAYLGDLSVYHVRLKSGQMISAQLQNAHRHRKGLPTWGDEVRLCWEVDSCVVLTV

SEQ ID NO: 65696 - DNA, 1080 bp, Agrobacterium tumefaciens
  CDS (1)..(1080): transl_table=11
atgatcgatcagccgcttcccgccgtatcgtttcagggtgtcacgcggcgcttcggccctgtcaccgccgttgacaacgtcagcctcgatatctcgcagggtgagttcttcgccctgctgggttcgagcggctctggcaaaacaacacttctcacgttgcttgccgggttcgacaatccgaacgaaggccaggtgttgatgtcgggtgtgtccgtttcggatgtcccacctcacaagcggcagataggtgtggtgttccagaattatgctctcttcccgcatctgacagctgccgagaatgtggcctatcccttgaggatgcgtggagtggctcgtcacgagcgcgaagaacgcgtcaaagccgcactcgcgctggtcaatctttccgatcggctcggtgcttatccgatccagctttcgggtggtcagcaacagcgggtagcgctcgcacgagcgcttgtcttcagtcccgccatcttgctgatggacgaaccgctgggcgcgctcgaccggcgcctccgcgaccagatgcaacaggaattgaaacgcatccagcatgagttgggcatcacggttatctatgtgactcatgatcagtccgaagcaatggctatggcggaccgcatcgggatcatgtctgccgggcgtctccttcaggtcgccgatcccgaggcaatctatgcagcgccatccagtcacttcgttgcacgcttcatcggagagtgttcgatcctgcgggtcagtggcaccaatgaaggcaggggttacgaaatcgcaggagcgcgccagtcactgccctcccccgccaatgggccattcgatatcgtcgttagaccggaagacgtcgcgatccggtccccatcgacagcatccatcgactctttcggtgtttccgccacgatccgggaggtgacttacctcggcgccggatggcgcgtggcgttgcaactatccgacgggcagtcgttgctcgccaatgtcatgcgaggagacgatctagctggaagcctcgctcccggctcgtcggtgaacgcaacttggcagccggcatctgccgctgttcttccgactgaaggatga

SEQ ID NO: 65697 - protein, 359 aa, Agrobacterium tumefaciens
MIDQPLPAVSFQGVTRRFGPVTAVDNVSLDISQGEFFALLGSSGSGKTTLLTLLAGFDNPNEGQVLMSGVSVSDVPPHKRQIGVVFQNYALFPHLTAAENVAYPLRMRGVARHEREERVKAALALVNLSDRLGAYPIQLSGGQQQRVALARALVFSPAILLMDEPLGALDRRLRDQMQQELKRIQHELGITVIYVTHDQSEAMAMADRIGIMSAGRLLQVADPEAIYAAPSSHFVARFIGECSILRVSGTNEGRGYEIAGARQSLPSPANGPFDIVVRPEDVAIRSPSTASIDSFGVSATIREVTYLGAGWRVALQLSDGQSLLANVMRGDDLAGSLAPGSSVNATWQPASAAVLPTEG

SEQ ID NO: 65698 - DNA, 1038 bp, Archaeoglobus fulgidus DSM 4304
  CDS (1)..(1038): transl_table=11
gtggttggctacgctgtcgaacttgagggcatttcaaagagctacgacagcactacggtgctcgaagacataaatctcaggattcagcagggtgagttcttctccctgcttggcccaagtggttccgggaaaaccacaatcatacggataattgcgggacttacctttcccgatcagggttttgtgaggattaacggggaggattgcacctctttaccgccctacaggcgcaacgtcggtatggtgtttcagaatctcgccctcttcccccatcttaacgtttttgaaaacgtcgcctacgggttgaggctgagaaagattcccgaaggtgagataaaggatagggtttaccgctacctcgaactcgtcaacctcgaccctgagatttacgcaaaaaggaaggtagagcagctatctggagggcagcagcagagggttgcaattgcgagggctctggttaccgagccttccatcctgctcctcgacgagccgctcggcgctctggatttaaagataaggcagcacatgatttccgaacttaaaagaatccagaagacgctgggaacgaccttcatttacgtcacccacgaccagagcgaggctttgctgctttccgacaggttggccgtcctcaatgaaggcagaatccaccagattgggacgccaagggaaatctacgagaggccaaaaacgaggttcgtcgcctcattcataggcgaaaccaactttctggaggcaagggtcgtgaacggagaggtcatcaccgaaatcggaaaggtgagggttttcggccttgatggggcgagggagttctgcatatccatccgccctgaaaagcttaaaatcaaccagcaggctgagaacacctttgaggctgtcgttgaggaaattggctacctcggaagctttttgatgctgaagctgagggctggcgatgttgtagtgaaggccttcgccccgccgcaggaaaatgttagggaaggggaaagggtgattgttggttgggatagtagggatgcggtaatcttggaggcatga

SEQ ID NO: 65699 - protein, 345 aa, Archaeoglobus fulgidus DSM 4304
MVGYAVELEGISKSYDSTTVLEDINLRIQQGEFFSLLGPSGSGKTTIIRIIAGLTFPDQGFVRINGEDCTSLPPYRRNVGMVFQNLALFPHLNVFENVAYGLRLRKIPEGEIKDRVYRYLELVNLDPEIYAKRKVEQLSGGQQQRVAIARALVTEPSILLLDEPLGALDLKIRQHMISELKRIQKTLGTTFIYVTHDQSEALLLSDRLAVLNEGRIHQIGTPREIYERPKTRFVASFIGETNFLEARVVNGEVITEIGKVRVFGLDGAREFCISIRPEKLKINQQAENTFEAVVEEIGYLGSFLMLKLRAGDVVVKAFAPPQENVREGERVIVGWDSRDAVILEA

SEQ ID NO: 65700 - DNA, 1080 bp, Mesorhizobium loti MAFF303099
  CDS (1)..(1080): transl_table=11
atggaacagaatcctgtccttgagatccgcaacctctcacgcacctttgctcatggtgctgtgagggcagtcgaccatatcgatctggacgtgctaccgggcgagatcatgtcaatcctcggtccctccggctgcggcaagacgacgatcatgcgcatcattgcgggattggattcgccgacttccggagaggttcgcattctcggcaaagacgttgcgggaaagccgccgcacaagcgcaatgtcggtttggtcttccagtcgttggcaatctttcctcacatgagcgtcaaacagaatgtcgcctttggcctgcgcatgaagggtctcgccagcaacctgatcgaaaccaaagtcgccaaagcgttggaactcgtacagctttcgccggaaagatttgcaggacgacggccaagcgagctgagcggagggcagcttcagcgggtagctttggcacggacattggtgactgaaccggcgctggtccttttcgacgagccaatggcggcactcgaccggcgccttcgcgattacatggcggtggaactcagggctatccaaaagcagctcggcattgcggcagtctatgttacgcacgaccaggaaacggcttctatgatgtcggaccgcgtcatcatcatgagtgccggcaagatcctgcaagccgggaccccggaggaaatctacgaggcaccgaattctaggtttgtttccgattttctcggcgacaccaacacccttcgcatcgcgcgcgtgctccatcaggcggacgggacatcgctggtacagaccgatgccgggctggcaattcgtgtcgcaaactgcagcgacatagctgaaggagcgtttgtgatttttcgacccgagcagacaatcgttcattccgccgaccccggcggcgcttttgagggcagggtggtgtcgtcgcaatttcgcagcggtctccaccgctggcagatcgcacttcccggtggcaacacgctcattgcgcagtcgaccgaaaacagacttgcctcatccgccggcgagaccgcttgggttacgattgactccggcaaagcgagaatcgttagccaatga

SEQ ID NO: 65701 - protein, 359 aa, Mesorhizobium loti MAFF303099
MEQNPVLEIRNLSRTFAHGAVRAVDHIDLDVLPGEIMSILGPSGCGKTTIMRIIAGLDSPTSGEVRILGKDVAGKPPHKRNVGLVFQSLAIFPHMSVKQNVAFGLRMKGLASNLIETKVAKALELVQLSPERFAGRRPSELSGGQLQRVALARTLVTEPALVLFDEPMAALDRRLRDYMAVELRAIQKQLGIAAVYVTHDQETASMMSDRVIIMSAGKILQAGTPEEIYEAPNSRFVSDFLGDTNTLRIARVLHQADGTSLVQTDAGLAIRVANCSDIAEGAFVIFRPEQTIVHSADPGGAFEGRVVSSQFRSGLHRWQIALPGGNTLIAQSTENRLASSAGETAWVTIDSGKARIVSQ

SEQ ID NO: 65702 - DNA, 1065 bp, Mesorhizobium loti MAFF303099
  CDS (1)..(1065): transl_table=11
atggccggcgtgcaggtagcgaacgtctcgcgcagctttggcgcgcacaaggcgctggacgatgtctccatcgatttcgccgatggcggcttctatgcgctgctcggaccgtcgggcagcggcaagaccactttgctcaggcagatcgcgggcttcgattttccggacagtggtcgcatttccatcggcggcgagagtgtcgagcgtgtgccggtcgagaaaaggcgcatcggcatggtgttccagaactatgcgctgtttcccaatatgagcgtcgccgacaatgtcgccttcggcctttcggtgcgcggcgaggccaaggcggtgattgcagcggaagtgcagcgcgcgctcgacctggtgcaattgggcaagctcggcggccggcgtccgcaccagctctccggcggccagcggcagcgcgtggcgctggcgcgcgccatcgtcaccaagccgcgcgtgctgttgctcgacgagccgctcggcgcgctcgacaaggcgctgcgcgtcgacatgcagatcgagttgaagcgcatccagcgcgagatcggcatcacgaccatcttcgtcacccatgaccaggaagaagcgctgacgatgagcgaccgcatcggcatcctgcgcgacggcaggcttgtgcaggaagggccgccggaggaaatctacgaccggccgaaaagcgaattcgccgccaccttcctcggcgacgccaacatctttcgcggcgatacgaccggcaacggcatccgcctgccggacggcacggcgattgccgcaggtgcgggcgcgacgcttgccgccggcgccaaggcgagctgcgccgtacggcccgagcgcattcggattgccaccgatgccggagcttcggatggcgatgccaacacgctgaagggtcaggtttccaagcgcatcttcgccggcaacaacagcacctatttcgtcgagcgtgacggccagacgctgaaggtcatcgtgcagaacaccggcgccgacaggctggcggaaggacaggatgtcgtgctgcgctggtcgccggagagcacggtgttgattgctgcgagctga

SEQ ID NO: 65703 - protein, 354 aa, Mesorhizobium loti MAFF303099
MAGVQVANVSRSFGAHKALDDVSIDFADGGFYALLGPSGSGKTTLLRQIAGFDFPDSGRISIGGESVERVPVEKRRIGMVFQNYALFPNMSVADNVAFGLSVRGEAKAVIAAEVQRALDLVQLGKLGGRRPHQLSGGQRQRVALARAIVTKPRVLLLDEPLGALDKALRVDMQIELKRIQREIGITTIFVTHDQEEALTMSDRIGILRDGRLVQEGPPEEIYDRPKSEFAATFLGDANIFRGDTTGNGIRLPDGTAIAAGAGATLAAGAKASCAVRPERIRIATDAGASDGDANTLKGQVSKRIFAGNNSTYFVERDGQTLKVIVQNTGADRLAEGQDVVLRWSPESTVLIAAS

SEQ ID NO: 65704 - DNA, 1095 bp, Mesorhizobium loti MAFF303099
  CDS (1)..(1095): transl_table=11
gtgccggacaaaccggatcggaatgcgattgaagtagtaaacgtcagtaaaattttcggatcaggtgaggggcaggtcgctgccctcgacaaggtctcggtatccattcgcgagaacgagttcttcacgctgctgggaccgtccggctgcggcaagaccacccttctgcggctgatcgccggcttcgactttccgaccgccggtgagatcctgctctacggtcaggacatcgcgccgctgccgcccttcaagcggccggtcaacaccgtcttccagtcctacgcactgttcccgcacatgacggtggccgacaatatcggcttcggcctggagatgctcggcaagcccaaggccgagatcaaggcgcgcgtcgccgagatgctcaagctggtcaagatggaggcgctggccggtcgccgcacggcccagatttccggtggccagcagcagcgcgtggcgctggccagggcgctggcgccgcagccgaaagtgctgttgctcgacgaaccgctctcggcgctcgactacaagctgcgcaaagagatgcagatcgagttgaagcggctgcagcacgagaccggtatcaccttcatcttcgtcacccatgaccaggaagaagcgctgaccatgtcggaccgcatcgcggtgatgtcgtcgggcaagatcctgcaggtcggctcgccctgggacatctacgacaagccggccgagcgcttcgtcgccgacttcatcggcgagaccaacttcctcaccgccgccatatcgggcaccggcaacggcaagacgcgcgcgacgctcaaatccggaacgaccatcgaggcgaccgttgccgaagggttccagccgaaggacaacgccaccgtggtggtgcggcccgagcatgccaagctgaccaaggacaagggcgacctgtcgggcacggtcgaaaacatcgtctattttggcaccgacacgcatatccatgtccagctcgacagcggcgaggccttcaccgtgcgccagcagaacacgcgcagcgcaggctgcggtttcgatcgcggcgacaaggtcggcatcctgatcggcaacgacgccgcgcaagtgctgagggactga

SEQ ID NO: 65705 - protein, 364 aa, Mesorhizobium loti MAFF303099
MPDKPDRNAIEVVNVSKIFGSGEGQVAALDKVSVSIRENEFFTLLGPSGCGKTTLLRLIAGFDFPTAGEILLYGQDIAPLPPFKRPVNTVFQSYALFPHMTVADNIGFGLEMLGKPKAEIKARVAEMLKLVKMEALAGRRTAQISGGQQQRVALARALAPQPKVLLLDEPLSALDYKLRKEMQIELKRLQHETGITFIFVTHDQEEALTMSDRIAVMSSGKILQVGSPWDIYDKPAERFVADFIGETNFLTAAISGTGNGKTRATLKSGTTIEATVAEGFQPKDNATVVVRPEHAKLTKDKGDLSGTVENIVYFGTDTHIHVQLDSGEAFTVRQQNTRSAGCGFDRGDKVGILIGNDAAQVLRD

SEQ ID NO: 65706 - DNA, 1116 bp, Mesorhizobium loti MAFF303099
  CDS (1)..(1116): transl_table=11
atgaagcctgcacaggagagcaagggcgcggcgatcgatctcgaatcgatcagcaaggcctatggcggcttcaaggcgctggacggcgtgtcgctgcgcatcgagcccggcgagttcatgacgctgctcggcccgagcggttccggcaagaccacgacgctgaatgtcgtggccggcttcaccgacgtgaccagcggcaagctgctggtcggcggcaagaacgtcgtcggcctgcccgcgcacaagcgcaacatcggcgtcgtcttccagcactacgcgctattcccgcatatgagcgtcggccgcaatgtcgcctatcccctgacgctgcgcggcatcgaccaggctgaacgaaaggcgcgcgtgacaagggcgctcgacatggtcaagatgggcgatttcgcgcatcgctatcccagcgaactgtcgggcggccagcagcagcgtgtggcgctggcccgcgccatcgtcttcgatccgccgctgttgctgatggacgagccgctcggcgcgctcgacaagaagctgcgcgaatggctgcagctcgagatcaagcgcatccaccgcgaacttggcaccaccttcgtctatgtgacgcacgaccaggaagaggcgctggtcctgtcggaccgcatcgccgtgttcaatcgcggacggatcgagcaggtcggcaccggtcgcgaactctatgatgaaccgacgacgctgttcgtcggccgcttcatcggcgattccacggtgctgcgcggagaggcgcgaagcgacggcgtgagcacagcattgcgcattgccggcgagacggtgacggcgccgcgccggatcgcgggcgaagccagcccggtcatgttgctgcgccccgaaaagctcgccatccgccggcccggccatgacacggcaagcaccaccaaccggctgccggggacgatcgcggaagccatctatctcggctcgggatcgaaatacgaagtcaggctcgccgacggctcgacggcgatcgtgcgctcgccgctgaccggcgacagctttggccttggcgacaaggtggagctctgcttcgacggtgccgacgccaagcttctggccgacgacagctcagccgacgcgacgctaacctga

SEQ ID NO: 65707 - protein, 371 aa, Mesorhizobium loti MAFF303099
MKPAQESKGAAIDLESISKAYGGFKALDGVSLRIEPGEFMTLLGPSGSGKTTTLNVVAGFTDVTSGKLLVGGKNVVGLPAHKRNIGVVFQHYALFPHMSVGRNVAYPLTLRGIDQAERKARVTRALDMVKMGDFAHRYPSELSGGQQQRVALARAIVFDPPLLLMDEPLGALDKKLREWLQLEIKRIHRELGTTFVYVTHDQEEALVLSDRIAVFNRGRIEQVGTGRELYDEPTTLFVGRFIGDSTVLRGEARSDGVSTALRIAGETVTAPRRIAGEASPVMLLRPEKLAIRRPGHDTASTTNRLPGTIAEAIYLGSGSKYEVRLADGSTAIVRSPLTGDSFGLGDKVELCFDGADAKLLADDSSADATLT

SEQ ID NO: 65708 - DNA, 1065 bp, Mesorhizobium loti MAFF303099
  CDS (1)..(1065): transl_table=11
atggccgatccgtttctctccatccagcacgtgcgaaaatccttcggtgccaccacggtggtggaggatttcaatctcgacgtcgagccgggtgaattcgtctcgttcctcgggccgtccggctgcggcaaaaccaccgtgctgcgcatggtggccggcttcgaggagccgacagccggcaagatcgtcgtagctggcaaggacatcacccggctgaagcccaaccagcgtaatgtcggcatggtgttccaggcctacgcgctgttcccgaaccttaccgtggcgcaaaatataggcttcggcctgaaggtcgccggcatgcccagggcggacatcgatgcccgtgtcgccgagatgctcggcatcatcaagctgccgcagatggcggaccgctatccctaccaactctcgggcggccagcagcagcgcatcgcgctggcgcgcgcgatcgcgccgaagccgaagctgcttttgctcgacgagccgctgtcggcgctggacgccaaggtgcgcgtgtcgctgcgtgaggaaatccgctcgatccagaagaagctcggcatcaccaccatcttcgtcacgcacgatcaggaagaggcgctgtcgatctccgaccgcatcgccgtcatgtatggcggcaaggccgagcaggtcggcacgccgttcgagatctacaaccggccggcgaccaaattcgtcgccaattttgtcggcacgctcaacgtgctcgaaggcaaggtcaccgatgccgcggccggcacggttcaggtcaacacgcaggaagtctcgctcaagggcaagctcaacggctcgaagtccggcgacacgctgtcgctggccctgcggccggaagcgatctcgcttggccgccagcctggccgtgactccagcctgaccggagagatatccgaagtgcatttcctcggctcggtgatccgggtccgcgtcggcatcggcggcaatacggtgtcgctcgacacgttcaacaactcggccaccccgccgcccgccgtcggcgagaaggccgagatttcgttctcttcgggcgacatgctggtgctgcactag

SEQ ID NO: 65709 - protein, 354 aa, Mesorhizobium loti MAFF303099
MADPFLSIQHVRKSFGATTVVEDFNLDVEPGEFVSFLGPSGCGKTTVLRMVAGFEEPTAGKIVVAGKDITRLKPNQRNVGMVFQAYALFPNLTVAQNIGFGLKVAGMPRADIDARVAEMLGIIKLPQMADRYPYQLSGGQQQRIALARAIAPKPKLLLLDEPLSALDAKVRVSLREEIRSIQKKLGITTIFVTHDQEEALSISDRIAVMYGGKAEQVGTPFEIYNRPATKFVANFVGTLNVLEGKVTDAAAGTVQVNTQEVSLKGKLNGSKSGDTLSLALRPEAISLGRQPGRDSSLTGEISEVHFLGSVIRVRVGIGGNTVSLDTFNNSATPPPAVGEKAEISFSSGDMLVLH

SEQ ID NO: 65710 - DNA, 1074 bp, Mesorhizobium loti MAFF303099
  CDS (1)..(1074): transl_table=11
atgatcgagatccgcaacgtcacccgcagctatggatcgttcaaggcactggacgatgcctccctgaccataagggagggcgaattcttctcgctgctcggcccgtccggctgcggcaagaccacgcttttgcgcatgatcgccggcttcgacaacccgaccagcggatcgatcgcggtcggcggccagccgatggaaggcattccggccaaccgccggccgaccaacatggtgttccagagctacgcgatcttcccgcacctcaatgtcgagcagaacgtcgcctatgggctgaagcggctgaagctgcagggcggcgaggagaaacgccgcgtcgaggaggcgctggcgcaggtgtcgctgacggggctcggcaagcggctggcgacagaattgtccggcggccaacgccagcgcgtggcgctcgcccgcgcgctggtcatgcggcccaaggtgctgctgctcgacgaaccgctgtcggcgctcgacaagaagctgcgcgagcagatgcaggtcgagctccggcgcctgcagcaggccgtcggcatcaccttcgtgctggtcactcacgaccagtatgaggcgctcgccatgtccgaccgcatcgcggtgatgttcggcggcaggatcgctcaggtcgcctcgcccaaggaaatctaccagcgcccggtcaaccgccaggtcgccgacttcctcggcggcatgaactttgtgaaagccgagatcgtcgaggagaacggcgcgtcgctgatcgtcgacacgctcggcttcggccgcgtcaagaccgacaagccgaaggccttcgtgcgcaatggcggcggcgctacactcggcataagacccgagcgtctgcgcgtgctgtgggacaatgcgacggcaaaattcgaggtcgccggcaaggtggtcgaacgccattatttcggcgagatcacccatctgatcgtcgagatacccggcttggaaaaaccgctctcggtgaccgagaccaacgatttcggcgccgacgacattccggtcggcaccacgatccgacttgcctacgatcccgaggcgctggtggcgatgggggattga

SEQ ID NO: 65711 - protein, 357 aa, Mesorhizobium loti MAFF303099
MIEIRNVTRSYGSFKALDDASLTIREGEFFSLLGPSGCGKTTLLRMIAGFDNPTSGSIAVGGQPMEGIPANRRPTNMVFQSYAIFPHLNVEQNVAYGLKRLKLQGGEEKRRVEEALAQVSLTGLGKRLATELSGGQRQRVALARALVMRPKVLLLDEPLSALDKKLREQMQVELRRLQQAVGITFVLVTHDQYEALAMSDRIAVMFGGRIAQVASPKEIYQRPVNRQVADFLGGMNFVKAEIVEENGASLIVDTLGFGRVKTDKPKAFVRNGGGATLGIRPERLRVLWDNATAKFEVAGKVVERHYFGEITHLIVEIPGLEKPLSVTETNDFGADDIPVGTTIRLAYDPEALVAMGD

SEQ ID NO: 65712 - DNA, 1074 bp, Mesorhizobium loti MAFF303099
  CDS (1)..(1074): transl_table=11
atgagcgaaccgcgcacgctgttggccatcgatcatgtttcgaagaatttcggccgggtcactgccgtcgatggcatctcgcttgatatccgcgagaacgaattcttcgcgctgctcggcccttccggctgcggcaagaccacgctgttgcgcatgctggccggtttcgagacgccgagcgacggccgcattctgctcgacggcaaggacatcgcccgaaccccgcccaacaagcggccggtcaacctgatgttccagtcctacgcgctattcccgcatatgagcgtgcgcgccaatgtctcctatgggctggagatggagcgcttgccggttaaggatatccgcacccgcgtcgacgccatcctggcgaccaccgaactcgtccccttcgccgaccgcaagccggagcaattgtcgggcggccagaagcagcgcgtcgcgctcgcccgcgcgctggtcaaacggccaaggctgctgctgctcgacgagccgctcggcgcgctcgacaaaaagttgcgcggcgccatgcaactggaattgaaacgcctgcagcacgaggtcggcatcactttcgtcatcgtcacccacgaccaggaggaatcgctcgtcatggccgaccgcatggcggtgctcaaggatggcaaactattgcaatgcgacacgccgcacgcggtctacgagcatcccgccgaccgcttcgtcgccgacttcatcggcgtgatgaatttcatcccgggcaagacctcagccgatggcgtgttggccgcgaacggcgcgcgtattgccggcaaacttccggcggcgctttcgcccggcgcgccagcagtggcttcggtgcggccggaacgtatccggctgtttcccgaggctcagaccgccaaccgcacgaccggcacggtcgaggcgctggcctatcacggcctcgatctgcagctgcatgtccgcacgccgctgtcgccaaaaccgttcctggtgcgcgtcaccgcagatgcagccgaccgccggccggtgtcgtcggccgaccgggtcgaactcggctgggatgccgccgatgtcagaattttcgcagaatag

SEQ ID NO: 65713 - protein, 357 aa, Mesorhizobium loti MAFF303099
MSEPRTLLAIDHVSKNFGRVTAVDGISLDIRENEFFALLGPSGCGKTTLLRMLAGFETPSDGRILLDGKDIARTPPNKRPVNLMFQSYALFPHMSVRANVSYGLEMERLPVKDIRTRVDAILATTELVPFADRKPEQLSGGQKQRVALARALVKRPRLLLLDEPLGALDKKLRGAMQLELKRLQHEVGITFVIVTHDQEESLVMADRMAVLKDGKLLQCDTPHAVYEHPADRFVADFIGVMNFIPGKTSADGVLAANGARIAGKLPAALSPGAPAVASVRPERIRLFPEAQTANRTTGTVEALAYHGLDLQLHVRTPLSPKPFLVRVTADAADRRPVSSADRVELGWDAADVRIFAE

SEQ ID NO: 65714 - DNA, 999 bp, Mesorhizobium loti MAFF303099
  CDS (1)..(999): transl_table=11
atgacatcagccgtctccttccagaaagtctcgcgccatttcggcagcgtgcgcgcggtcgacgcggtcgacctcgacatcgcgccgggcgagttcttcgccatgcttgggccttccgggtccggcaagacgacatgcctgcgcctcatcgccggtttcgagcagccgacttcgggttcgctctcgatcttcggcgaacgcgccgagggcgtgccgccctatcgccgcaacgtcaacactgtcttccaggactatgcgctgttcccgcatctcaatgtgcttgataacgtcgcttatgggctgatggtcaagggcgtcggcaaggcagcgcggcacaaggcggccgaggaagcactgtcgctcgtcaggttgcccggctacggcgcccgccgccccggccagctttccggcggccagcgccagcgtgtcgcgctcgcccgcgctctggtcaaccagcccaaggtgctgctgctcgacgagccgctcggcgcgctcgacctgaagctgcgcgagaacatgcaggaggagctgaaatcgctgcagaaggcgctcggcatcaccttcgtcttcgtcacccatgaccagggcgaggcgctgtcgatggccgaccgcgtcgccgtcttcaacgacggcaggatcatgcagatcggcacgccggaggatatctatcagcggccgagaacccgcttcgtcgccgatttcgtcggctcctccaacgtgctgccgccggatttcgtccagcgctattccggccagcatcgctggggcagtctgcgccctgaatccattcgcgtcagccgcgcggcaaccggcgaaggcgtcgccgcccgcctcgtctcgaccaactatctcggcgccaccactaggctggcgctcgatgccgacggattgaagctgcacgccgtggtcccggctggcacggtgctgcctgccgagggcgaagcggtggtgctcaccttcaaccgcgagcacctgcatctgatggatgagccggcatga

SEQ ID NO: 65715 - protein, 332 aa, Mesorhizobium loti MAFF303099
MTSAVSFQKVSRHFGSVRAVDAVDLDIAPGEFFAMLGPSGSGKTTCLRLIAGFEQPTSGSLSIFGERAEGVPPYRRNVNTVFQDYALFPHLNVLDNVAYGLMVKGVGKAARHKAAEEALSLVRLPGYGARRPGQLSGGQRQRVALARALVNQPKVLLLDEPLGALDLKLRENMQEELKSLQKALGITFVFVTHDQGEALSMADRVAVFNDGRIMQIGTPEDIYQRPRTRFVADFVGSSNVLPPDFVQRYSGQHRWGSLRPESIRVSRAATGEGVAARLVSTNYLGATTRLALDADGLKLHAVVPAGTVLPAEGEAVVLTFNREHLHLMDEPA

SEQ ID NO: 65716 - DNA, 1050 bp, Mesorhizobium loti MAFF303099
  CDS (1)..(1050): transl_table=11
ttggagcagaactcaattcccgctcagattgaatttcgaaacgttaccaagatgtacgggcaggtcgccgccgtacaggacctgtcactgacagttcgtcgcggcgagttcttaaccattctcggtccgagcggttcaggcaagaccacggcgctcatgctgcttgccgggttcgtagcggccagtaagggcgacattttgatcgccggaaattctgtggccgcagtcccatcctatcggcgcgaccaaggcattgtgttccaaagctatgcgctgtttccgcacctcacggtacgtcggaatctggaattcccgctcgaaatgcggggcgtcaagacggccgacagagcaaagcgggtcgatcgcatcctcgagcgtgtgcatctcaaggacttcggccgtcgtatgccgtcgcaactgagcggcggccaacagcagcgcgtggcgcttgcccgtgcgctcatcgctgatccgccgttcctcctgctcgacgagcctctcggcgccctcgaccgcaaccttcgcgagcagatgcagatcgaaatgaagaaccttcacaaagagttcaacatcaccaccatatgcgtgacgcacgaccaggaggaggcgcttacactgtcagatcgcatcgttgtcatgcgtgccgggcggattgaacagaccgattcgccggaagccctttacgatcggccagcatcccgctttgtagcgaattttctcggtgaggccaacattctcgaaaatctcgattgtgatgtggaatccgatgtggcgcagccgtccggcaccgtgcccatgatcaggccagagcgtatccgcgcctccgcgccggcggcgccgaagagggccgatgcgagccagtgccagtccgttaccggcactgtcgacgatatgatctatgccggaccgttgcggaaataccatgtgcgcgtcggaagcaaagtgctcgtcgcgcgcgaacatgccgcctcggggcagcagatcttccaacccggcgacacagtgcggcttgattggctgcggtccgacgttcgcttcgtagcggcgtga

SEQ ID NO: 65717 - protein, 349 aa, Mesorhizobium loti MAFF303099
MEQNSIPAQIEFRNVTKMYGQVAAVQDLSLTVRRGEFLTILGPSGSGKTTALMLLAGFVAASKGDILIAGNSVAAVPSYRRDQGIVFQSYALFPHLTVRRNLEFPLEMRGVKTADRAKRVDRILERVHLKDFGRRMPSQLSGGQQQRVALARALIADPPFLLLDEPLGALDRNLREQMQIEMKNLHKEFNITTICVTHDQEEALTLSDRIVVMRAGRIEQTDSPEALYDRPASRFVANFLGEANILENLDCDVESDVAQPSGTVPMIRPERIRASAPAAPKRADASQCQSVTGTVDDMIYAGPLRKYHVRVGSKVLVAREHAASGQQIFQPGDTVRLDWLRSDVRFVAA

SEQ ID NO: 65718 - DNA, 1164 bp, Mesorhizobium loti MAFF303099
  CDS (1)..(1164): transl_table=11
atgattaagggtgaatcgctgcaattgcggcgcgtctgtaagcaatatggcgactaccacgcgatcaaagacgtttcggttcaaatcgaggctggagagttcgtgtcgttcttggggccgagcggctccggcaagacgacgacgctgatgatgattgctggtttcgaaacgccaacttcaggcgaaataattgttggcgaccgagcaatcaccagcctcccggtgcataggcgcaatatcggcgtcgtttttcagaactacgcactgttcccgcatttgtcggttttcgagaacgttgcatttgccctgaagatgagggccgtcgcgcgcgacgagatcagccgaggcgttgcggaggcgctaaacctcgtgcagctctctggctatgaaacccgaatgccacacgaactttcgggaggacagcagcagcgggtggcgctggcgcgctcgctagtatttcgtcctggagtaattctcatggacgaacccctcggcgctctagacaaacaacttcgcgagcacatgcaggttgaactcaagcgtcttcagcgctctttgggtacaactgtaatatttgttactcatgaccagagcgaagctttgacaatgtcagatcgcattgttgtaatgaacgaaggtcgaatagctcaggttgggacgccggaagagatctacgaggctcccagcagtcgcttcgtagctagcttcataggggaatcaaacttccttcaagcaacgatcattgaggcgtctaaaaatgggcccttactggatgtacatgggctacgcgtacgcgccacatgggcccaagggaagcgacctaaaggctctgctggcactctgatggtgcggccagaaaagataatccccctgggctcgtccggcaaagcggacaatgagtttgagggagtagtccaagaggcaatctactggggaaatatcatcaaatatcgcgttcacctccgtgaagcgaagtctgtctctctgaccgtagcgctcccctatcattcatcctcgcctaagtttcaactaaacgaaacaattcgagttggctgggatgctcgagattcccgccttctcgtcgatgaaagcgaacgtcaagctggaaatgcgccagaacccgaactgctcatcggtcaggggattgagcgggtggtttcatga

SEQ ID NO: 65719 - protein, 387 aa, Mesorhizobium loti MAFF303099
MIKGESLQLRRVCKQYGDYHAIKDVSVQIEAGEFVSFLGPSGSGKTTTLMMIAGFETPTSGEIIVGDRAITSLPVHRRNIGVVFQNYALFPHLSVFENVAFALKMRAVARDEISRGVAEALNLVQLSGYETRMPHELSGGQQQRVALARSLVFRPGVILMDEPLGALDKQLREHMQVELKRLQRSLGTTVIFVTHDQSEALTMSDRIVVMNEGRIAQVGTPEEIYEAPSSRFVASFIGESNFLQATIIEASKNGPLLDVHGLRVRATWAQGKRPKGSAGTLMVRPEKIIPLGSSGKADNEFEGVVQEAIYWGNIIKYRVHLREAKSVSLTVALPYHSSSPKFQLNETIRVGWDARDSRLLVDESERQAGNAPEPELLIGQGIERVVS

SEQ ID NO: 65720 - DNA, 1143 bp, Mesorhizobium loti MAFF303099
  CDS (1)..(1143): transl_table=11
atgaaatcgcttggcagcatccgtagggatttcgcgccatggaacgacccgaacgccaagccatacatccagttcgacaacgtcaccaagaagttcggtgacttcaccgccgtcaacaatctgtcgctgaccatcttcgagcgcgagttcttcgccttgctcggcgcctcgggttgcggcaagtcgacgctgctgcggatgcttgccggcttcgaggaaccgacggccggccgtatcctgctcgatggccaggatctgcgtggcatcccgccctatcgccggccggtcaacatgatgttccagtcctatgcgctgttcccgcatatgacggtggagaacaacatcgccttcggcctcaagcaggaaggcatgcctaagcccgatatcgaaaagcgcgtcgccgagatgctgaagctggtcaagttggagcagttcgccaagcgcaagccgcaccagctctccggtggccagcgccagcgcgtcgctctcgcccgctcggtcgccaagcggccgaaagtgctgctgctcgacgagccgctcggcgcgctcgacaaaaagctgcgcgaggaaacccagttcgaactgatggatttgcagcaggagctcggtctcaccttcgtcgtcgtcacccacgaccaggaagaagcgatgaccatggccgatcgcatcgccatcatggacaagggcgaggtcatgcaggtggcgacgccggcggaagtctatgaagccccggcctcgcgcttcgtcgcccatttcgtcggcaatgtgaacatgttcgagggcaaggtctccgagcggtcggccaacaccacccgcatcaccggagcgagcggagcccagatcgtggtcgagaatggtggtgccgcggccgcggccaatgccgatatcgtcttcgccatcaggccggagaagatcaaggtgtcgtcgaagaagccggcagatgccgtcaacgcgctggaaggcgaggtctatgacgtcgcctatctcggcgacatgaccgtctaccacatcaggctcgacgatgggcagatcgtgcgggcaagcgccttgaacgcggcgcgcgtgaccgaggatccactgacctggaacgaccgcgcctgggtgtccttccggcctgatgccggcgtcgtgctggcgcggtag

SEQ ID NO: 65721 - protein, 380 aa, Mesorhizobium loti MAFF303099
MKSLGSIRRDFAPWNDPNAKPYIQFDNVTKKFGDFTAVNNLSLTIFEREFFALLGASGCGKSTLLRMLAGFEEPTAGRILLDGQDLRGIPPYRRPVNMMFQSYALFPHMTVENNIAFGLKQEGMPKPDIEKRVAEMLKLVKLEQFAKRKPHQLSGGQRQRVALARSVAKRPKVLLLDEPLGALDKKLREETQFELMDLQQELGLTFVVVTHDQEEAMTMADRIAIMDKGEVMQVATPAEVYEAPASRFVAHFVGNVNMFEGKVSERSANTTRITGASGAQIVVENGGAAAAANADIVFAIRPEKIKVSSKKPADAVNALEGEVYDVAYLGDMTVYHIRLDDGQIVRASALNAARVTEDPLTWNDRAWVSFRPDAGVVLAR

SEQ ID NO: 65722 - DNA, 1134 bp, Mesorhizobium loti MAFF303099
  CDS (1)..(1134): transl_table=11
gtgattcattttggggacactatgaaagatgaatctacgccgggcgtagccatccgcttgaaccaggttaccaagacctacggttcgggaaacgccgtcgtcaccgcggtcaaaagcacgacgctggacatcttcaacaatgagtttttcacattgcttgggccatcgggctgcggaaaaaccactctattgcgcctgataggcggtttcgaatatccgacggccggcaccatccttctcggtggcgaggacattgcatcggtccctccgttccaacggcccatcaacaccgtcttccagaactatgctcttttcccgcacatgacggttgcgcagaacatcggctttgggctgcggatgctcaaacggccccgccacgaaatcgctgcccgtgtcgatgagatgttgaaactcgtgcgactggagaatctgtccgatcggcgaacaagtcagatatcgggcggccaacagcagcgggtcgcgctggcgcgcgcgctcgcatccgagccgaaggtcttgcttctcgacgagtcactttcagcgctggactacaaactccgcaaggaaatgcagatggagctcaagtcactccaggctgcgacggggatcactttcattttcgtgacgcatgaccaggaggaggctttgacgatgtccgatcgcgtcgctgtgctgtcttcaggcgagatcatgcaagtcggaaccccgcacgaagtctacatcaagcctgcaaatcacttcgtcgcgaacttcgtcggtgagacgaatttcctgcacgggcgggggctcaactcggatgaccgcggggctgtgatcgatgttcgaggggtcggcgccgtcgctatcccgacgaaggacagggttgcgcccggccaactggtgaacatcgtcgtgcggcccgagcatttgcgaattctaccgttggcccaggagccggccggccaacttaccggttctgtgaaagcggtaagcttctgcggtgccgaaacgcagtacacagtcgaattgagccgaggcgccgctgttgtcacggtccgtaagtataatacgccggaggaaaatctccccatcgtgatcggcgacgaggtctcggtgaatttcacaccgaactcagcccagatcctgcccggttga

SEQ ID NO: 65723 - protein, 377 aa, Mesorhizobium loti MAFF303099
MIHFGDTMKDESTPGVAIRLNQVTKTYGSGNAVVTAVKSTTLDIFNNEFFTLLGPSGCGKTTLLRLIGGFEYPTAGTILLGGEDIASVPPFQRPINTVFQNYALFPHMTVAQNIGFGLRMLKRPRHEIAARVDEMLKLVRLENLSDRRTSQISGGQQQRVALARALASEPKVLLLDESLSALDYKLRKEMQMELKSLQAATGITFIFVTHDQEEALTMSDRVAVLSSGEIMQVGTPHEVYIKPANHFVANFVGETNFLHGRGLNSDDRGAVIDVRGVGAVAIPTKDRVAPGQLVNIVVRPEHLRILPLAQEPAGQLTGSVKAVSFCGAETQYTVELSRGAAVVTVRKYNTPEENLPIVIGDEVSVNFTPNSAQILPG

SEQ ID NO: 65724 - DNA, 1086 bp, Mesorhizobium loti MAFF303099
  CDS (1)..(1086): transl_table=11
atggcgcctgatccactggtccggttgcaggcggtctccaaggtttttcccggcggcatcgtcgggctcgatgccgtcgatctcgacattgtcagcggcgagttcatcacgctgctcggaccgtcgggctgcggcaagaccaccagcctgcgcgtcatcgcgggcttcgaaagcccgtcgagcggcaaggtcttgctcgacggccgcgacatcacggcgctccggcctttcgaccggccggtcaatacggtgttccaggattacgcgctgttcccgcatatggacgtcgccgaaaatgtcggcttcggcctgtcgctacgaaaactgtcgggcgccgagcaggcaaagcgtgtcggtgaagccctcgacatggtcggtctcgccgacaagcttcgcgcccgtgtcccagaactctcgggcggccagcgccagcgcgtggcgctcgctcgcgccatcgtctgcgagccgcgcgtgctcttgctcgacgagccgctgtcggcgctcgatgcgcatctgcgcgaacagatgcaggtcgagttgaagcggctgcaatcgcggctcggcaccaccttcgtcatggtcacccacgaccagaccgaggcgctgtcgatctccgatcgcatcgtcgtcatgaacaagggccgcatcgagcagatcgcgccgccggcgacgctctatgaccggcctgcgacgaagttcgtggcgagcttcatcggcaccatgaacctgctgcagtcgcgctttgtcggccgcgatggcgatcgtttgcgtttcaccgccggcaccttgccgctggaggctacctccgaaaccggccagtcacccggcgaaggcgaggtgcgcaccatcggcgtgcgtccggaggatttgctggcagccaccgaggcgaccgaaggaaccgcgccggcgcgggtaaacagcatagtcttccacggccgtaccttgcggctgcatgctgaactggggcagggattgccggtggtgatcgatgcgccgcgccaggccgaggggtttcaattcagcattggcgacgtagcgcatgtcagcctgcgccgtggcgccaactgccccatgctgccgagctag

SEQ ID NO: 65725 - protein, 361 aa, Mesorhizobium loti MAFF303099
MAPDPLVRLQAVSKVFPGGIVGLDAVDLDIVSGEFITLLGPSGCGKTTSLRVIAGFESPSSGKVLLDGRDITALRPFDRPVNTVFQDYALFPHMDVAENVGFGLSLRKLSGAEQAKRVGEALDMVGLADKLRARVPELSGGQRQRVALARAIVCEPRVLLLDEPLSALDAHLREQMQVELKRLQSRLGTTFVMVTHDQTEALSISDRIVVMNKGRIEQIAPPATLYDRPATKFVASFIGTMNLLQSRFVGRDGDRLRFTAGTLPLEATSETGQSPGEGEVRTIGVRPEDLLAATEATEGTAPARVNSIVFHGRTLRLHAELGQGLPVVIDAPRQAEGFQFSIGDVAHVSLRRGANCPMLPS

SEQ ID NO: 65726 - DNA, 993 bp, Pyrococcus horikoshii OT3
  CDS (1)..(993): transl_table=11
atggtgagcattgaacttagggatataatcaagaggtttggggagttcgagttaaaggttagcttaagcgttaaagatggtgaactactcacccttttaggcccgagcggatgtggtaagacaacaaccctaaggataatagctgggcttgagaagccggataaaggtagggtgtactttgatggtagggatattacggatcttcccccttacgagaggaacatcggattagtcttccaggattatgccctcttcccccatatgacagtattcaaaaacgtagcctttggcttggaagttagacgggtacccaggatggaaatagaaaagagggttagggaagttctagacttagttgggctgagaggatttgaaaatagactacctgaggaactgagtggagggcaacagcagagggttgccctggcgagggcccttgtaatagagcccgatgtactgctcctcgatgagccccttagtaatctcgatgcgaaggtcagggaaaagcttaggggggaaattaagaggatagtgaaggagctcggcataacgacaatttacgttacccacgatcaggaagaggccatggtgctaagcgataggatagcggttatgaactttggaaggatagagcaggttggtgaaccttacgatctttactataacccgaaaaacgagttcgtcgcgaatttcctggggataagtaatatagtggaacttgaagctaaggaaggaagagcatgcttgggtgatctttgctttgaagttggtagggaggggaaggggaagatattctttaggcctgagaacgtagcggttggagaagggattgaggccgaggttataggttatgagctccttccagggagggtaaggctgaggttatcaatcgaggggagggagataatagctgaggaacttttgagtaggattggaaagaaaattccaaaaaaggttagaattagagttagagaattcaagatacttccttag

SEQ ID NO: 65727 - protein, 330 aa, Pyrococcus horikoshii OT3
MVSIELRDIIKRFGEFELKVSLSVKDGELLTLLGPSGCGKTTTLRIIAGLEKPDKGRVYFDGRDITDLPPYERNIGLVFQDYALFPHMTVFKNVAFGLEVRRVPRMEIEKRVREVLDLVGLRGFENRLPEELSGGQQQRVALARALVIEPDVLLLDEPLSNLDAKVREKLRGEIKRIVKELGITTIYVTHDQEEAMVLSDRIAVMNFGRIEQVGEPYDLYYNPKNEFVANFLGISNIVELEAKEGRACLGDLCFEVGREGKGKIFFRPENVAVGEGIEAEVIGYELLPGRVRLRLSIEGREIIAEELLSRIGKKIPKKVRIRVREFKILP

SEQ ID NO: 65728 - DNA, 1077 bp, Aeropyrum pernix K1
  CDS (1)..(1077): transl_table=11
gtggccgggatacggctcgagagcgttacgaaaaggttcggtaacactgttgcccttgatagagtgagcctgaatataagcgacggggagatcttcaccctcctaggccccagcggctgcggaaagacgactaccctaagggttatagcgggcttcgagacgcccgacgaggggagggtctacatagggtccagggatgttacgatgctgaagccttatgagaggaacacagccatggttttccaaaactacgctctctggccccatatgagggtgttcgacaatatagcgtacggcctcaagctcaggaagctccctaggagtgagattgttaggcgtgttaggtgggctgcggagctcttggagattgaccatcttttggatcgttacccccaccagctgagcggggggcagcagcagagggttgcagtggccagggccatagtgacggagcccgaggtcctcctcatggacgaacccctaagcaacctagacgcccacctgaggctgaaaatgcgtgaagaaatagttaggcttcagaagaggctcggggtcaccatagtatacgtaacccacgaccaggaggaggcccttagcataagccacagagtcgcagttatgaatagggggagggttgagcaggtcggcactcccatggaggtgtacgagaaaccggctacatacttcgttgcgacattcataggcaggtccaccgtgctggatggcagggtgtctgaggtcctcggcagcggaatggtcagggttgccttggaggggggattgtcaatagtgggtacagacatggaggggggtctcaggcagggtgagagggtgaaggtcgtgataaggcctgagagggtgaaggtcggccacgagtacaacggggagaacgtgttcgagggcaaagtctccctagccatgtttctcggctggaggacacagctcaaggtagaggttggcgggcaagagatcacaatctactcagacccgcgtagagcacccctccccggccagccggtgaggttctacatagaccccgaagaggccaaggtctacaggcaggctggcagcgcctag

SEQ ID NO: 65729 - protein, 358 aa, Aeropyrum pernix K1
MAGIRLESVTKRFGNTVALDRVSLNISDGEIFTLLGPSGCGKTTTLRVIAGFETPDEGRVYIGSRDVTMLKPYERNTAMVFQNYALWPHMRVFDNIAYGLKLRKLPRSEIVRRVRWAAELLEIDHLLDRYPHQLSGGQQQRVAVARAIVTEPEVLLMDEPLSNLDAHLRLKMREEIVRLQKRLGVTIVYVTHDQEEALSISHRVAVMNRGRVEQVGTPMEVYEKPATYFVATFIGRSTVLDGRVSEVLGSGMVRVALEGGLSIVGTDMEGGLRQGERVKVVIRPERVKVGHEYNGENVFEGKVSLAMFLGWRTQLKVEVGGQEITIYSDPRRAPLPGQPVRFYIDPEEAKVYRQAGSA

SEQ ID NO: 65730 - DNA, 1044 bp, Borrelia burgdorferi B31
  CDS (1)..(1044): transl_table=11
ttggataattgtatcctagagattaaaaatctaagtcattattatgataacaatggaaacaaaactttagataacataaatttaaaaattaaaaaaaatgagtttatcacactactaggcccatccggatgtggaaaaacaacattgataaaaatattgggtggttttttaagccaaaaaaatggagaaatttatttcttttctaaagaaatatctaaaaccagtccaaacaaaagagaaattaatactgtatttcaaaattatgcacttttcccacatatgaatgtttttgacaatatttcatttggacttagaatgaaaaaaacgccaaaagatataatcaaagaaaaagtaaaaacatcgctttcgctgataggaatgccaaaatacgcatacagaaatattaacgaactatcgggggggcaaaagcaaagagttgcaatagcaagagcaatggtaatggaacctaagcttttactcctagatgaaccactttccgcgcttgatttgaaaatgcgacaagagatgcaaaaagaattaaaaaaaatacagcgtcagcttggaatcacattcatatatgttactcacgatcaagaagaggcattgacaatgagtgacagaatcgttgtaatgaatgaaggaataattctgcaaataggaacacctgaggaaatttacaatgagcctaaaacaaagtttgtagccgattttattggagaaagcaatatttttgatggaacatataaaaaagagctggttgtaagtttgcttggtcatgaatttgaatgccttgacaaaggatttgaagctgaagaagcagttgaccttgtaatacgcccagaagatgtaaaactacttccaaaaggaaaaggacatttaagcggaactataacatcagcaatttttcaaggagttcattacgaaatgactctagaaatccaaaaaacaaattggatagttcaaagcacaagacttacaaaagttggagaagaagttgatatatttttagaacctgatgatattcatgttatgcataaggaataa

SEQ ID NO: 65731 - protein, 347 aa, Borrelia burgdorferi B31
MDNCILEIKNLSHYYDNNGNKTLDNINLKIKKNEFITLLGPSGCGKTTLIKILGGFLSQKNGEIYFFSKEISKTSPNKREINTVFQNYALFPHMNVFDNISFGLRMKKTPKDIIKEKVKTSLSLIGMPKYAYRNINELSGGQKQRVAIARAMVMEPKLLLLDEPLSALDLKMRQEMQKELKKIQRQLGITFIYVTHDQEEALTMSDRIVVMNEGIILQIGTPEEIYNEPKTKFVADFIGESNIFDGTYKKELVVSLLGHEFECLDKGFEAEEAVDLVIRPEDVKLLPKGKGHLSGTITSAIFQGVHYEMTLEIQKTNWIVQSTRLTKVGEEVDIFLEPDDIHVMHKE

SEQ ID NO: 65732 - DNA, 1140 bp, Treponema pallidum subsp. pallidum str. Nichols
  CDS (1)..(1140): transl_table=11
gtgcgacagaccgtgaaaggatgcgccgtcaccatcgaccaggtctcaaaagcatacggtcactgcctcgccgttgaccgtgccaccgttcacattcggcagggagagtttttctccatcctcggtccttcaggctgcggaaagaccacgcttttgcgtatcattgcagggtttgaacagccggactcaggagacttgaccttcgaccacgtgagtgtgctcggtgttggtgcaaataagcggaggtctaacaccgttttccagtcgtatgccctctttcctcacctttccgtgtacgagaacatcgccttccccctcaggctcaaacgcctctcaaagaacctcatccgcgagcgcgtgcacgagtaccttcacctggtacagctggacgagcacctgcacaagaaaccccatcagctgtcaggtggccaacaacagcgcgtcgccattgcccgtgcactcgtgtgcgagccaggggtgctcctgcttgacgagccgctttctgccctggatgcaaaacttcgctccaatttgctcatagagctcgatacactccacgatcagacgggcattaccttcgtttttatcacccatgaccagagcgaggctctgtccgtctccgaccgcatcgccgtcatgaacaaaggaaagatcctgcagatcggtactccctacgagatttatgagcaacctgcgactgactttgtcgctaagtttattggggaaactaatagcttcctgtcaactgtcgtctcctgcaccgccattgaaaacgaagagtttatgctcagtctccaggttccggaacttgaccgtacgctcaccgtaaccgccgataaccctatcgatcctggcaggcgggtgtgtttcaccgttcgcccagagaagatccacatttcccttgaagagccgggtaccaccagtgcgccgctcaatgtttttcgcggttttgtagaggagcctgtatatgcagggttccaatctaagtttttcgtccagttagaaagtggcgctattatccaagtgtttcagcaacaccagaagtatctcgacactggccctgagattgcgtggaaggacactgtttacgtgtcctggtctgcacacgacggctacgtggttgaggacatcgagtcgtga

SEQ ID NO: 65733 - protein, 379 aa, Treponema pallidum subsp. pallidum str. Nichols
MRQTVKGCAVTIDQVSKAYGHCLAVDRATVHIRQGEFFSILGPSGCGKTTLLRIIAGFEQPDSGDLTFDHVSVLGVGANKRRSNTVFQSYALFPHLSVYENIAFPLRLKRLSKNLIRERVHEYLHLVQLDEHLHKKPHQLSGGQQQRVAIARALVCEPGVLLLDEPLSALDAKLRSNLLIELDTLHDQTGITFVFITHDQSEALSVSDRIAVMNKGKILQIGTPYEIYEQPATDFVAKFIGETNSFLSTVVSCTAIENEEFMLSLQVPELDRTLTVTADNPIDPGRRVCFTVRPEKIHISLEEPGTTSAPLNVFRGFVEEPVYAGFQSKFFVQLESGAIIQVFQQHQKYLDTGPEIAWKDTVYVSWSAHDGYVVEDIES

SEQ ID NO: 65734 - DNA, 1068 bp, Thermotoga maritima MSB8
  CDS (1)..(1068): transl_table=11
ttggcgcaggtgaaaatagacggagtgaagaaatatttcgggaatgtgagggctctcgatggaatcgaccttgtcgtgaacgaaggggagttcctcgttcttctcggtccatctggttgtggaaagacgacccttctgaggtgtatagcgggtctcgaacaggtgaccgggggaaagatctttttcaacgatcgcgacgtgacgaaccttcctccaaaggacaggaacatttcgatggtcttccagagctacgcggtgtggccccacatgaaggtgtacgacaacatcgcgtatcctctgaaactgaaaaaagtcccgaaagaggagatagaaaagagggtaaagtgggcagcggatctccttcacatctccgaactcctcgacaggtaccccgcacagctctccggaggtcagagacagagggttgccgttgcccgagcgatcgttcacgaacccgaagtactcctgatggacgagcctctttccaatctggacgcacttttgagggtgaagatgagaagcgagctgaaaaagcttcaggaaagaattggagtcaccaccatctatgtgactcatgaccagacagaggccatgacgatgggagacagaatcgcggtgatgaaccagggaaagcttcagcaggttggaacgccctctgagatctatcaccatccggtgaacatcttcgtcgctggttttgtgggatcaccgcagatgaacttcttagagatggaagtgagatcggaaggaaatagcgttgtcctccaaaacggtgagataaagattcccgcgaagaccgatccaggtgcaaaaaaggtgatccttggtattcgaccggagaacgtctatctggaggaaaagccgaacactttgaagctggaaggagaggtttatttcgccgagaaactcatgtcggatacgattctccatctcaacgttggaagtgagaagatcgtcgcaaaaattccaggggatgtggatttcagaagcggtgagaagatcacgtttttcctggacgttgaaaagatccatctctttcaccctgagacgggagagagaatctcatga

SEQ ID NO: 65735 - protein, 355 aa, Thermotoga maritima MSB8
MAQVKIDGVKKYFGNVRALDGIDLVVNEGEFLVLLGPSGCGKTTLLRCIAGLEQVTGGKIFFNDRDVTNLPPKDRNISMVFQSYAVWPHMKVYDNIAYPLKLKKVPKEEIEKRVKWAADLLHISELLDRYPAQLSGGQRQRVAVARAIVHEPEVLLMDEPLSNLDALLRVKMRSELKKLQERIGVTTIYVTHDQTEAMTMGDRIAVMNQGKLQQVGTPSEIYHHPVNIFVAGFVGSPQMNFLEMEVRSEGNSVVLQNGEIKIPAKTDPGAKKVILGIRPENVYLEEKPNTLKLEGEVYFAEKLMSDTILHLNVGSEKIVAKIPGDVDFRSGEKITFFLDVEKIHLFHPETGERIS

SEQ ID NO: 65736 - DNA, 1107 bp, Thermotoga maritima MSB8
  CDS (1)..(1107): transl_table=11
ttgatcggaggagaagtttcaataaagaacgtcagcaaatttttcgatgatttccaggttttgaagaacgtttccctggatataaagaaaggagagtttttctccatactcggcccatcgggttgtggaaaaacaacgcttcttcgtgtgatagcgggcttcgagggtgtggaaagtggagatgttctcctggatggaaagtcgatactgaatttgcctccgaacaaaaggcccgtgaacatcatatttcagaactacgctctgttccctcatctcacagtttttgaaaacatcgcgttccccttgaaactcaaaaaactatccgagaacgaaataaatcagagagtgaacgaactgctttcgctcataagaatggaagaacacgctcagaaaatgccttcccaactgtctggtggtcagaagcagagagtggcgatagcgagggccctcgccaacgagccgagggtcctccttctcgatgaaccgctgagcgctctcgacgcaaaactgagacaggaactccttgtcgagctcgacaaccttcatgacagagtcggtatcaccttcatttacgtaacacacgatcaggctgaagcaatcagtgtttcagacagagtcgccctcatgaacgaaggagaaatcgttcaggttggaactccctacgaggtgtatgagagcccggtcaacgtctttgcagcgactttcatcggagaaacgaacctcatgaaagccgaggttgttgaagtggaagatgaatattacgtcgtagaaagtccgggaatcggccagttcaggtgttacagagacaaggaagcaaagaagggtgatagattgctcatcacccttagacccgaaaagatcagaatctcaaggaaacagtttcgttccgaggaaaccttcaatgtatttcacggagttgtggatgaggaaatatacatggggcaccagacgaagtacttcgttcgactcgacgaaggctacataatgaaagtttacaagcaacatgcaaggtacatactcgatgagccgatcataaaatgggaagatgaagtgttcatcacatggaatccagatgacagcttcattgtagaggtgcttgaagaatga

SEQ ID NO: 65737 - protein, 368 aa, Thermotoga maritima MSB8
MIGGEVSIKNVSKFFDDFQVLKNVSLDIKKGEFFSILGPSGCGKTTLLRVIAGFEGVESGDVLLDGKSILNLPPNKRPVNIIFQNYALFPHLTVFENIAFPLKLKKLSENEINQRVNELLSLIRMEEHAQKMPSQLSGGQKQRVAIARALANEPRVLLLDEPLSALDAKLRQELLVELDNLHDRVGITFIYVTHDQAEAISVSDRVALMNEGEIVQVGTPYEVYESPVNVFAATFIGETNLMKAEVVEVEDEYYVVESPGIGQFRCYRDKEAKKGDRLLITLRPEKIRISRKQFRSEETFNVFHGVVDEEIYMGHQTKYFVRLDEGYIMKVYKQHARYILDEPIIKWEDEVFITWNPDDSFIVEVLEE

SEQ ID NO: 65738 - DNA, 1134 bp, Vibrio cholerae O1 biovar eltor str. N16961
  CDS (1)..(1134): transl_table=11
gtgggagaaatacagacgttgaacgaacaacattcagtaggaaagccagtcattcgtttatctggcattagcaaaagtttcgatggtaaggaaatcattggtaacctaaatcttgatgtgaatcatggcgagttcttaaccatcctaggtccatcgggctgtggtaaaacgacggtgttaagaatgattgctggttttgaaactgcagatcaaggtcagattctgctagatgatcaagacgttactcaagttcctgctgaacaacgacacgtcaatacggtcttccaaagctatgctctattcccccacatgacagtgttcgaaaacgtcgcttttggtttgcgcatgcaaaaagtccctcaaagcgaaatcgaacctcgtgttatggaagcactacgcatggtgcgccttgccgaaatggcacagcgtaaaccgcatcaactttctggtggccagcagcaacgtatcgctattgcgcgcgcagtggttaacaaacctaaagtactgctacttgacgaatcgctctccgctttggattacaaattgcgtaaacaaatgcagagcgagctcaaacaactacaacgtcaattaggcattacctttatcttcgttactcacgatcaagaagaagcgctgtctatgtcagatcgcatcatcgttatgcgttcaggcaaaattgaacaagacggctctcctcgtgaaatctacgaagatccaaaaaatctctttgttgctcgttttatcggcgaaatcaacgtcttccaagcaacgactatcgatcgtatcgacgaaaaacgcatccgcgttgacatcgaaggtatcgagtcgattgtttactatgaagatgaagtgaaggctggtgacaagctgcaagtgctcctccgtcctgaagacttacgtatcgaagaaatcaaagagtcagaagaaaaaggcattgtgggtcacgtgactgaccgtacctacaaaggcatgactctggaatcagtggtagaactggaatccggtatgtgtgtgatggttagcgaattctttaacgaagatgatccagatgttgatcactctatcggacagaaagttgccgtcacttgggttgaaagctgggaggtagtcctcaatgatgagcaaaaagcttaa

SEQ ID NO: 65739 - protein, 377 aa, Vibrio cholerae O1 biovar eltor str. N16961
MGEIQTLNEQHSVGKPVIRLSGISKSFDGKEIIGNLNLDVNHGEFLTILGPSGCGKTTVLRMIAGFETADQGQILLDDQDVTQVPAEQRHVNTVFQSYALFPHMTVFENVAFGLRMQKVPQSEIEPRVMEALRMVRLAEMAQRKPHQLSGGQQQRIAIARAVVNKPKVLLLDESLSALDYKLRKQMQSELKQLQRQLGITFIFVTHDQEEALSMSDRIIVMRSGKIEQDGSPREIYEDPKNLFVARFIGEINVFQATTIDRIDEKRIRVDIEGIESIVYYEDEVKAGDKLQVLLRPEDLRIEEIKESEEKGIVGHVTDRTYKGMTLESVVELESGMCVMVSEFFNEDDPDVDHSIGQKVAVTWVESWEVVLNDEQKA

SEQ ID NO: 65740 - DNA, 1143 bp, Pasteurella multocida subsp. multocida str. Pm70
  CDS (1)..(1143): transl_table=11
attggtacattagggagaaaaccaaagctagtggaaagttcagttcaaaacaagcctattattgagcttcgttctattactaaatcttatggtgataaaactatcattgaaaactttaacttaacaatcaacaatggtgagtttttaaccattcttggtccttcaggttgtggtaaaacaacagttttacgtttacttgcagggttagaagaattagattcaggcaatattattcttgacggagaggacattactcatgtccctgcagaacagcgtcacgtcaatactgttttccaaagttatgccttattcccacatatgacaatttttgaaaatgtggcatttggcttacgcatgcaaaaagtaccgaatgaggaaattaaacctcgcgtgttagaagcattacgtatggtacaacttgaagaatatgcgtacagtaaacctgctcaattatcgggtggtcaacaacaacgtattgccattgcgcgtgcggtggttaacaaaccgaaagtgttgctactggatgaatccctttccgcattagattataaattgcgtaaacaaatgcaaaatgaattaaaggcattgcaacgtaaattgggcattacctttatttttgtgactcacgatcaagaagaagctcttacgatgtctgatcgtattattgtgttacgtaaaggtcatatacaacaagatggttccccgcgtgaaatttatgaagagccaaaaaatctgtttgttgccaaatttattggtgaaatcaatatcttcaatgcaacggtattaacgcgtgtcgatgagaaacgtgttcgcgccaatgtggaaggacgcgtttgcgatatttataccaatcttgatgttgttgctgagcaaaaactcaaagttttattacgtccggaagatatcttaattgaagaattggatgaaaaccaaagttcaaaagcgattattggtcacgtggcagatcgtaactataaaggaatgacgttagaatcaaacatcacgctagaccataatggaatgaccgtgcttgttagcgaattctttaacgaagacgatccaaatatcgatcactctttaggtcaaaaagtggcattaacatggcacgaaggctgggaggtagtgttgagcgatgaagaataa

SEQ ID NO: 65741 - protein, 380 aa, Pasteurella multocida subsp. multocida str. Pm70
MGTLGRKPKLVESSVQNKPIIELRSITKSYGDKTIIENFNLTINNGEFLTILGPSGCGKTTVLRLLAGLEELDSGNIILDGEDITHVPAEQRHVNTVFQSYALFPHMTIFENVAFGLRMQKVPNEEIKPRVLEALRMVQLEEYAYSKPAQLSGGQQQRIAIARAVVNKPKVLLLDESLSALDYKLRKQMQNELKALQRKLGITFIFVTHDQEEALTMSDRIIVLRKGHIQQDGSPREIYEEPKNLFVAKFIGEINIFNATVLTRVDEKRVRANVEGRVCDIYTNLDVVAEQKLKVLLRPEDILIEELDENQSSKAIIGHVADRNYKGMTLESNITLDHNGMTVLVSEFFNEDDPNIDHSLGQKVALTWHEGWEVVLSDEE

SEQ ID NO: 65742 - DNA, 1113 bp, Pseudomonas aeruginosa PAO1
  CDS (1)..(1113): transl_table=11
atgagtgccctgcattcgctgcgtacccatgcagtgtccatccgcgcggtacgcaaggtgtacggcgatcccgagagcggcccggtggcactgaagcgcgtcgacctggatatccgcgacaatgagttcttcaccctcctcggcccgtctggctgcggcaagaccaccctgctgcggatgatcgccggcttcgagtttcccacggagggcgagatcctcctctacggcgagaacatcgccgcgcgaccgcccttcgagcgcccggtgaacaccgtgttccagcactatgcgctgttcccgcacatgagcatcgccgagaacctcgccttcggcctcgaatcgcgcccactgggacgcagcctgggcaaggcggagatcgccgagcgggtccgcgagatgctcgccctggtgcagatggaacgtttcgccgatcgccgtcccgggcagctttcaggaggccagcagcaacgcgtggcactggcccgtgcgctggcgccgcaaccgcgggtgctgctgctcgacgaaccgctctcggccctcgacctgaagctgcgccaggcgatgcgcgaggaactcaaggcgatccaagcgaagaccgggatcaccttcattttcgtcacccacgaccaggaggaggcgctgaccatgtccgatcgcatcgccgtgctctccgagggccaggtgcaacaggtcggaccgccggaagagatctacgagcgccccggcaaccgctttgtcgccgacttcattggcgagaccaatttcatcgaagccgagctgctccagcgcgacggcccgctggcgctgtaccgcggtcccggcggtgaagcgttcgaggccgccgcgcgcgacggcctggcagccggagcccgggtctgcctgtcgatccgcccggaacgcctggacctgctggcggccaacaccggcggcggcctgccctgcacggtggaaagccaggtctacctcggcaccgacctgcaataccgggtgcgcctggccgacggcagcctgctgacggtgcgcacaccgaacggcacggcacggcgcttcgccaccggtgaagctgcctgcctggccgtggccaaagacagcgccagcgtcctgctggattga

SEQ ID NO: 65743 - protein, 370 aa, Pseudomonas aeruginosa PAO1
MSALHSLRTHAVSIRAVRKVYGDPESGPVALKRVDLDIRDNEFFTLLGPSGCGKTTLLRMIAGFEFPTEGEILLYGENIAARPPFERPVNTVFQHYALFPHMSIAENLAFGLESRPLGRSLGKAEIAERVREMLALVQMERFADRRPGQLSGGQQQRVALARALAPQPRVLLLDEPLSALDLKLRQAMREELKAIQAKTGITFIFVTHDQEEALTMSDRIAVLSEGQVQQVGPPEEIYERPGNRFVADFIGETNFIEAELLQRDGPLALYRGPGGEAFEAAARDGLAAGARVCLSIRPERLDLLAANTGGGLPCTVESQVYLGTDLQYRVRLADGSLLTVRTPNGTARRFATGEAACLAVAKDSASVLLD

SEQ ID NO: 65744 - DNA, 1155 bp, Pseudomonas aeruginosa PAO1
  CDS (1)..(1155): transl_table=11
atggcgatagcctccggtgcctacaagaaagccctagagggcaaccagcagccgaaagaggtgctggtaaagatcgaccgggtaaccaagcagttcgacgagacgctggcggtggacaccgtgtccctgaccatcaacaagggcgagatcttcgccctgctcggcggctccggctcgggtaaatccaccctgttacgcatgctcgccggtttcgagcggcccaccgaggggcggatcttcctcgatggccaggacatcaccgacctgccgccctacgagcggccgatcaacatgatgttccagtcctatgcgctgttcccgcacatgagcgtggcgcagaacatcgccttcggcctcaagcaggacggcctgcccaaggccgagatcgacgagcgcgtggccgagatgctcaagctggtgcacatgacccagtacgccaagcgcaagccgcaccagctctccggcggccagcgccagcgggtggccctggctcgttcgctggccaagcggccgaagctgctgctgctcgacgagccgatgggcgcgctggacaagaagctgcgctcgcagatgcaactggaactggtggagatcatcgagcgcgtcggcgtgacctgcgtgatggtgacccacgaccaggaagaggccatgaccatggcccagcgcatcgccatcatgcacctgggctgcatcgagcagatcggcagcccgatggacatctacgagaccccggcgagccgcctggtctgcgagttcatcggcaacgtcaacctgttcgacggcgtgctggtggaggacgtgcaggaccatgcggtgatcgcctgcccgcagctggagaacccgatctacatcggccacggcatcagcacccgcgccgaggacaagcgcatcacctacgcgctgcggccggagaaagtgatgatcagcgcgcagaagccggacaacctggaacacgccgggcacaactgggcccagggcaccgtctacgacatcgcctaccttggcggccactcggtgtactacatcaagctggcgtccgggatgatcgtccaggccttcatggccaacgccgagcgccacgtcgcccggccgacctgggaccagtcggtgtacatcagctggtacgacgacagcggcgtggtactgcagtcatga

SEQ ID NO: 65745 - protein, 384 aa, Pseudomonas aeruginosa PAO1
MAIASGAYKKALEGNQQPKEVLVKIDRVTKQFDETLAVDTVSLTINKGEIFALLGGSGSGKSTLLRMLAGFERPTEGRIFLDGQDITDLPPYERPINMMFQSYALFPHMSVAQNIAFGLKQDGLPKAEIDERVAEMLKLVHMTQYAKRKPHQLSGGQRQRVALARSLAKRPKLLLLDEPMGALDKKLRSQMQLELVEIIERVGVTCVMVTHDQEEAMTMAQRIAIMHLGCIEQIGSPMDIYETPASRLVCEFIGNVNLFDGVLVEDVQDHAVIACPQLENPIYIGHGISTRAEDKRITYALRPEKVMISAQKPDNLEHAGHNWAQGTVYDIAYLGGHSVYYIKLASGMIVQAFMANAERHVARPTWDQSVYISWYDDSGVVLQS

SEQ ID NO: 65746 - DNA, 1050 bp, Pseudomonas aeruginosa PAO1
  CDS (1)..(1050): transl_table=11
atgaccagcgcgatagccatcgagcggatctgcatggaattcggtacccccggccaaggcctgaaggcccttgacgatgtgtccctggatatccacgccaacgaattcttcaccctcctcggcccttccggctgcggcaagaccaccctcctccgcctcatcgccggcttcgaacagcccagttccggcagcatccgcctctatggcgaacacatggaaggcctgccgccgttccgccgcccggtcaacacggtgttccagagttatgcgctgttcccgcacatgagcgtcgccgacaacatcggcttcggcctggagatgcagggccgcccgcgcagcgagatcgacgccaccgtgagccgcatgctcgacctggtgaagctgccggaggtcggcaagcgccgcgccgaccagttgtccggtggccagcagcaacgcatcgccctggcccgcgcgctggccagccggcccaaggtgctgctgctcgacgagtcgctgtcggcgctggacctgaagctgcgcaaggaaatgcagatcgagctgaagcgcctgcagcacgagaccgggatcaccttcatcttcgtcacccacgaccaggaggaagcgctgaccatgtccgaccgcatcgcggtgatgagcaagggcaaggtgttgcaggtcggcacgcccagcgacatctacgaggcgccgctgaaccgggcggtcgccgacttcatcggcgaaaccaacttcctcgagggccaggccgacgccgacggcgtgcgcctggcggacggccagcggctggccgcgacgaccccgggcagcggcgctgtgaccttggcgatccgcccggagcgcaccgaactggccgccgacggccagttggaaggcgtgctggaaaacatcgtctatgtcggcaccgataccgtctaccacctgaacgtggccggacagccgggcttccgcgtgcgccagcagaaccgcgacggcgcacgctgcccgcacagtccgggggcgaaggtgcgggtgcggattcccgccgccgccatccgggtgctcgccgaatga

SEQ ID NO: 65747 - protein, 349 aa, Pseudomonas aeruginosa PAO1
MTSAIAIERICMEFGTPGQGLKALDDVSLDIHANEFFTLLGPSGCGKTTLLRLIAGFEQPSSGSIRLYGEHMEGLPPFRRPVNTVFQSYALFPHMSVADNIGFGLEMQGRPRSEIDATVSRMLDLVKLPEVGKRRADQLSGGQQQRIALARALASRPKVLLLDESLSALDLKLRKEMQIELKRLQHETGITFIFVTHDQEEALTMSDRIAVMSKGKVLQVGTPSDIYEAPLNRAVADFIGETNFLEGQADADGVRLADGQRLAATTPGSGAVTLAIRPERTELAADGQLEGVLENIVYVGTDTVYHLNVAGQPGFRVRQQNRDGARCPHSPGAKVRVRIPAAAIRVLAE

SEQ ID NO: 65748 - DNA, 1110 bp, Pseudomonas aeruginosa PAO1
  CDS (1)..(1110): transl_table=11
atggccgagactcaaggcggcgatgtgctggtcagcttccgtggcgtgcagaaaagctacgacggcgagaccctcatcgtgaaggatctcaacctggacattcgcaagggcgaattcctcaccctgctcggcccctccgggtccggcaagaccaccagcctgatgatgctggccggtttcgaaacccccaccgccggcgaaatcctcctggccggtcgctcgatcaacaatgtccctccgcacaagcgcgacatcggcatggtgttccagaactatgcgctgttcccgcacatgaccgtggccgagaacctggcctttcccctcagcgtccgtggcatgagcaagaccgacgtgaaggaaagggtcaagcgcgcgttgtcgatggtccagctcgacgccttcgccgggcgttatccggcgcagctttccggtggccagcagcagcgcgtggcgctggcccgcgcgctggtcttcgagccgcaactggtgctgatggacgagcccctgggagcgctggacaagcaacttcgcgagcacatgcagatggaaatcaagcatctgcaccagcgcctcggtgtcaccgtggtctacgtcacccacgaccagggcgaggcgctgaccatgtccgaccgggtggcggtgttccaccagggcgaaatccagcagatcgagccgccgcgcaatctctacgagcagccgcgcaacaccttcgtggccaacttcatcggtgagaacaaccgtctatccgggcagcttctcagttgcgacggcgagcgctgcgtggtcggactgccgcgcggcgagaaggtcgaggcgctggcggtcaacgtcggccagccgggcgagccggtgaccttgtcgatccgccccgagcgggtgcgcctgaacggtgccagcgagtcttgcgtcaaccgtttctccggccgcgtggccgagttcgtctacctgggcgaccacgtgcgtgtgcgcctggaggtctgcggccgcgacgacttcttcgtcaagcagccgatcgccgagctggacccgacgctgagcgtcggtgatgtggttccgctgggctggcaggtcgagcatgtgagggcgctcgaccctctgccggcggcgtga

SEQ ID NO: 65749 - protein, 369 aa, Pseudomonas aeruginosa PAO1
MAETQGGDVLVSFRGVQKSYDGETLIVKDLNLDIRKGEFLTLLGPSGSGKTTSLMMLAGFETPTAGEILLAGRSINNVPPHKRDIGMVFQNYALFPHMTVAENLAFPLSVRGMSKTDVKERVKRALSMVQLDAFAGRYPAQLSGGQQQRVALARALVFEPQLVLMDEPLGALDKQLREHMQMEIKHLHQRLGVTVVYVTHDQGEALTMSDRVAVFHQGEIQQIEPPRNLYEQPRNTFVANFIGENNRLSGQLLSCDGERCVVGLPRGEKVEALAVNVGQPGEPVTLSIRPERVRLNGASESCVNRFSGRVAEFVYLGDHVRVRLEVCGRDDFFVKQPIAELDPTLSVGDVVPLGWQVEHVRALDPLPAA

SEQ ID NO: 65750 - DNA, 996 bp, Pseudomonas aeruginosa PAO1
  CDS (1)..(996): transl_table=11
atgtcgttcgtcagcgtcgaacagctcgacaagagctacggtgccaccagcatcttccgcgatatcgacttcgccgccgcccgcggcgagttcgtcaccctgctcggccccagcggctgcggcaagtccaccctgctgcgctgcatcgccgggctgaccgaggtcgacagcgggcgcatcctcatcgacggcgaggatgtggtgcctttgccgccgcagaagcgcgggatcgccatggtgttccagagctacgcgctgttccccaacatgaccgtgcaacagaacgtcgccttcggcctgcgcatgcagaaggtgcctgcggcggaactgaagcagcgggtcgccgaagccatcgaactggtggaactgggcgagtacgccgcacgctacccgcaccaactctccggcggccagtgccagcgcgtggcgctggcccgctcgctggtgacgcgcccgcgcctgctgctgctcgacgagccgctgtcggccctcgacgcgcgcatccgcaagcacctgcgcgaacagatccgccgcatccagcaggagctggggctgaccacggtgttcgtcacccatgaccaggaggaagcgctgaccctgtccgaccgcatcgtcctgatgaacgccggacgcatcgtccagagcggcgacgcggagaccctctacaccgcgccggaaaacgccttcgccgccggcttcatcggcaactacaacctgctcgacgccgaacaggccagccgcctgctcggccagtcctgcgcgcaacaggtggcgatccgcccggaatccctgcgcctgggcaacgaaccgagcgaaggcgtgccggcgctggtacgctcgcacagtctgctcggcaacgtgatccgttaccgcgtcgaggccgccggggtggaactcaccgtcgacgtcctcaaccgcagcgcagaccgcctgtatccggccggcagtcagctgacgctggtcatcgatcgcaacagtattcgagaggtagcttga

SEQ ID NO: 65751 - protein, 331 aa, Pseudomonas aeruginosa PAO1
MSFVSVEQLDKSYGATSIFRDIDFAAARGEFVTLLGPSGCGKSTLLRCIAGLTEVDSGRILIDGEDVVPLPPQKRGIAMVFQSYALFPNMTVQQNVAFGLRMQKVPAAELKQRVAEAIELVELGEYAARYPHQLSGGQCQRVALARSLVTRPRLLLLDEPLSALDARIRKHLREQIRRIQQELGLTTVFVTHDQEEALTLSDRIVLMNAGRIVQSGDAETLYTAPENAFAAGFIGNYNLLDAEQASRLLGQSCAQQVAIRPESLRLGNEPSEGVPALVRSHSLLGNVIRYRVEAAGVELTVDVLNRSADRLYPAGSQLTLVIDRNSIREVA

SEQ ID NO: 65752 - DNA, 1092 bp, Pseudomonas aeruginosa PAO1
  CDS (1)..(1092): transl_table=11
gtgacgccccccttgctcgagatccgcaacgtgacccgccgcttcggcgacttcaccgccgtcgacaatgtcagcctgacgatcaacaccggcgaattcttcaccctcctcggcccttccgggtgcggcaagaccaccctcctgcgcatgctcgccggcttcgaccagccggacagcggcgagatccgcctcaacggccaggacctcgccggcgtcgagccggagaagcgcccggtgcatacggtgttccagagctacgcgctgttcccgcacatgagcgtagcgcagaacatcgccttcccgctgaagatggccggagtggcgaagagcgagatcgacgcccgcgtcgaacaggccctgaaggacgtacgcctggcggacaagggcgggcgcatgccgacacagctttccggcggccagcgccagcgcgtggcgatcgcccgcgcgctggtcaaccggccgcgcctgctgctgctcgacgaaccgctgtcggcgctggacgccaagctgcgcgaagaaatgcagatcgaactgatcaacctgcagaaggacgtcggcatcaccttcgtctatgtcacccacgatcagggcgaagccctggcgctgtcgcaccgcatcgcagtgatgaaccagggccgggtggagcaactggacgccccggaaaccatctacagcttcccgcgcagtcgtttcgtcgccgacttcatcggccagtgcaacctgctcgacgccacggtcgaggcggtcgacggcgaacgcgtgcgcatcgacctccggggcctgggcgaggtccaggcgctgaaatccttcgacgcccagcccggcgaggcctgcgtgctgaccctgcggccggagaagatccgcctggcgcagagcgtcaccgccgacagcgacgaggtgcacttccgcggtcgcgtcgccgaactgctctacctgggcgacgtgaccctgtacatcgtcgagctggagaacggcgagcgcctggaaaccctgctgcccaacgccacgcccggccgagccaagttcttcgaggtgggcgacgcggtggaagccgcctggcgcttcgatgccggccatctggtcagggcctga

SEQ ID NO: 65753 - protein, 363 aa, Pseudomonas aeruginosa PAO1
MTPPLLEIRNVTRRFGDFTAVDNVSLTINTGEFFTLLGPSGCGKTTLLRMLAGFDQPDSGEIRLNGQDLAGVEPEKRPVHTVFQSYALFPHMSVAQNIAFPLKMAGVAKSEIDARVEQALKDVRLADKGGRMPTQLSGGQRQRVAIARALVNRPRLLLLDEPLSALDAKLREEMQIELINLQKDVGITFVYVTHDQGEALALSHRIAVMNQGRVEQLDAPETIYSFPRSRFVADFIGQCNLLDATVEAVDGERVRIDLRGLGEVQALKSFDAQPGEACVLTLRPEKIRLAQSVTADSDEVHFRGRVAELLYLGDVTLYIVELENGERLETLLPNATPGRAKFFEVGDAVEAAWRFDAGHLVRA

SEQ ID NO: 65754 - DNA, 1260 bp, Neisseria meningitidis MC58
  CDS (1)..(1260): transl_table=11
atgctgcccgtgcgctttacaagagtttcagacggcatcaaacgtttaactcccgccagcaatcaaacagctttttatcacccattcgaaaatccgttttgccggtactcgtctttttattggagtattgccattatgaccgcaaccactgcgtcttcagccaaaccttatctcaaaatccaaggtttggtgaaaaagtttggtgacaattacgctgtcgataacatcgacttggacatttatcaacacgaaatcttcgcccttttgggcagttccggcagcggaaaatctacactgctgcgtatgctggcgggtatggaaagtcccaatcagggaaaaattatccttgatggtcaggatattaccaaacttgcaccctatgatcgccccatcaatatgatgttccaaagttacgcgctttttccgcatatgaccgtagaacaaaacattgccttcggtctgaaacaggacaaaatgcctaaaggcgaaatcgccgcgcgcgtcgaagaaatgctccgcctggttcagatgaccaaatttgctaaacgcaaaccgcaccaattgtccggcggtcagcagcagcgcattgctttggcacgcagtctggcaaaacgtccgaaaattctactgctggatgagcccctcggtgcattggacaaaaaactgcgccaacaaacccagcttgagttggtcaatacgctggaacaagtcggcgtaacctgtattatggttacgcacgaccaagaagaggcgatgacgatggcgacccgcatcgccattatgtctgacggtcagttgcagcaagtcggcacacccagcgacgtgtacgactatcccaacagccgcttcactgccgagtttatcggcgaaaccaacatctttgacggtgtggtgattgaagatcatgccgactatgccgttatcgaatgcgaaggtttggaaaaccacgtccgcatcgatcacggtttgggtggtccgagcgagcaggacctttgggttagtattcgaccagaggatattgatttatataaagaaaaacccgaatatttgggcgactacaactgggcgaaaggcacggtaaaagaaatcgcctatttgggcagcttcgccatttaccatatcaagctcggcaacgggcgcgtcgtcaaaagccaagtccccgccccttactggtatgtgcgcaacattacaccgccgacttgggacgaaaccgtctatatcagctggccggaaaaccaaccgactccgttgttccgttga

SEQ ID NO: 65755 - protein, 419 aa, Neisseria meningitidis MC58
MLPVRFTRVSDGIKRLTPASNQTAFYHPFENPFCRYSSFYWSIAIMTATTASSAKPYLKIQGLVKKFGDNYAVDNIDLDIYQHEIFALLGSSGSGKSTLLRMLAGMESPNQGKIILDGQDITKLAPYDRPINMMFQSYALFPHMTVEQNIAFGLKQDKMPKGEIAARVEEMLRLVQMTKFAKRKPHQLSGGQQQRIALARSLAKRPKILLLDEPLGALDKKLRQQTQLELVNTLEQVGVTCIMVTHDQEEAMTMATRIAIMSDGQLQQVGTPSDVYDYPNSRFTAEFIGETNIFDGVVIEDHADYAVIECEGLENHVRIDHGLGGPSEQDLWVSIRPEDIDLYKEKPEYLGDYNWAKGTVKEIAYLGSFAIYHIKLGNGRVVKSQVPAPYWYVRNITPPTWDETVYISWPENQPTPLFR

SEQ ID NO: 65756 - DNA, 1125 bp, Neisseria meningitidis Z2491
  CDS (1)..(1125): transl_table=11
atgaccgcaaccactgcgtcttcaaccaagccttatctgcaaatccaaggtttggtgaaaaagtttggtgacaattacgctgtcgataacatcgacttggacatttatcaacacgaaatcttcgcccttttgggcagttccggcagcggaaaatctacactgctgcgtatgctggcgggtatggaaaatcccaatcagggaaaaattatccttgatggtcaggatattaccaaacttgcaccctatgatcgccccatcaatatgatgttccaaagttacgcgctttttccgcatatgaccgtagaacaaaacattgccttcggtctgaaacaggacaaaatgcctaaaggcgaaatcgccgcgcgcgtcgaagaaatgctccgcctggttcagatgaccaaatttgctaaacgcaaaccgcaccaattgtccggcggtcagcagcagcgcattgctttggcacgcagtctggcaaaacgtccgaaaattctactgctggatgagcccctcggtgcattggacaaaaaactgcgccaacaaacccagcttgagttggtcaatacgctggaacaagtcggcgtaacctgtattatggttacgcacgaccaagaagaggcgatgacgatggcgacccgcatcgccattatgtctgacggtcagttgcagcaagtcggcacacccagcgacgtgtacgactatcccaacagccgcttcactgccgagtttatcggcgaaaccaacatctttgacggtgtggtgattgaagatcatgccgactatgccgttatcgaatgcgaaggtttggaaaaccacgtccgcatcgatcacggtttgggtggtccgagcgagcaggacctttgggttagtattcgaccagaggatattgatttatataaagaaaaacccgaatatttgggcgactacaactgggcgaaaggcacggtaaaagaaatcgcctatttgggcagcttcgccatataccatatcaaactcgccaacgggcgcgtcgtcaagagccaagtccccgccccttactggtatgtgcgcaacattacaccgccaacttgggacgaaaccgtctatatcagctggccggaaaaccagcctacgccactgttccgttga

SEQ ID NO: 65757 - protein, 374 aa, Neisseria meningitidis Z2491
MTATTASSTKPYLQIQGLVKKFGDNYAVDNIDLDIYQHEIFALLGSSGSGKSTLLRMLAGMENPNQGKIILDGQDITKLAPYDRPINMMFQSYALFPHMTVEQNIAFGLKQDKMPKGEIAARVEEMLRLVQMTKFAKRKPHQLSGGQQQRIALARSLAKRPKILLLDEPLGALDKKLRQQTQLELVNTLEQVGVTCIMVTHDQEEAMTMATRIAIMSDGQLQQVGTPSDVYDYPNSRFTAEFIGETNIFDGVVIEDHADYAVIECEGLENHVRIDHGLGGPSEQDLWVSIRPEDIDLYKEKPEYLGDYNWAKGTVKEIAYLGSFAIYHIKLANGRVVKSQVPAPYWYVRNITPPTWDETVYISWPENQPTPLFR

SEQ ID NO: 65758 - DNA, 1089 bp, Deinococcus radiodurans R1
  CDS (1)..(1089): transl_table=11
gtgagcgtggtggacgtgttcaagagctaccgcaatgcggcgggcgccgagacgccggtgctgaaagacatcgacctcgacatccggcgcggcgagtttttcagcttgttggggccgtcgggctgcggcaagaccacgctcttgcggattctggcgggcttcgagcaggccgattcgggcgcggtggtcatcggtgggcgcgacatgaccggcattccggcgcaccgccgtccggtcaacaccgtgtttcaaagctacgcgctgtttccgcatctgtcggtggccgacaatgtggcctttggcctcaagcaaaaaggcgtgcgcggtgcggagttgcgccaacgggtcgagcgggcgatggaaacggtgcagattggacagttcggcaaccgcaagcccgaccagctctcgggcgggcagcggcaacgggtggccctcgcccgcgccatcgtcaaccagccggaagtgctgctgctggacgaacctctttcggcgctcgacctcaagctgcgcaagcagttgcaggtggaactgagcaatttgcaggaagacctcggcatcaccttcgtgttcgtgacccacgaccaggaagaagcgctggtcatgagtgaccgcatcgccgtgatgaaccagggccgcatcgagcaactcgggcgcgccgaggacctctacgagcgcccgcgcaccgcctttgtcgccaactttctgggcagctccaacctgctcgcgggccgggtcgccgagctgcacggcaccgaggccaccgtccagaccgagttcggcccgctgcggaccctgcacggcgcaggcctgagcgtgggccaggaagtcacgctgagtattcgcccggaaaaacttcgcatggagcgcgacgacgaaaccgagggcaacgaggtgcgcgcccgggtggacgacatcgtgtacaccggcgccgagaaccagtatctgctcgaagcacatgggcagcgactggtggccttccagctcaatgccgacatcggggccgacgaggacttcgactacgacgaggaagtggcgctgtacctgccgcccgcgagcttggttgtgctggaggagggggaagcatga

SEQ ID NO: 65759 - protein, 362 aa, Deinococcus radiodurans R1
MSVVDVFKSYRNAAGAETPVLKDIDLDIRRGEFFSLLGPSGCGKTTLLRILAGFEQADSGAVVIGGRDMTGIPAHRRPVNTVFQSYALFPHLSVADNVAFGLKQKGVRGAELRQRVERAMETVQIGQFGNRKPDQLSGGQRQRVALARAIVNQPEVLLLDEPLSALDLKLRKQLQVELSNLQEDLGITFVFVTHDQEEALVMSDRIAVMNQGRIEQLGRAEDLYERPRTAFVANFLGSSNLLAGRVAELHGTEATVQTEFGPLRTLHGAGLSVGQEVTLSIRPEKLRMERDDETEGNEVRARVDDIVYTGAENQYLLEAHGQRLVAFQLNADIGADEDFDYDEEVALYLPPASLVVLEEGEA

SEQ ID NO: 65760 - DNA, 1134 bp, Escherichia coli O157:H7
  CDS (1)..(1134): transl_table=11
gtgaatgacgctatccctcgcccccaggcgaaaacccgtaaggcgctgaccccgctattagaaatccgcaatctgaccaaatcctacgatggtcagcatgcggttgatgatgtcagcctgaccatctacaaaggtgaaatctttgcgctgctgggcgcatccggctgtggcaagtccacgctgctgcgtatgctggcaggtttcgaacaaccttcagccgggcagattatgcttgatggcgtcgatttgtcacaggtgccgccttacctgcgccccatcaatatgatgtttcagtcttacgcgctgtttccgcatatgaccgtggaacagaacatcgcttttggcctgaaacaggacaaactaccgaaagcggaaattgccagccgggtcaatgagatgctcggccttgtgcatatgcaggagttcgccaaacgcaaaccgcatcagctttccggtggtcagcgacagcgtgtggcactggcccgaagccttgccaagcgcccgaaactattactgctcgacgagccgatgggcgcgctggataaaaagctgcgtgaccggatgcagcttgaagtggtggatattctggaacgcgtcggtgtgacttgtgtgatggtcacccacgatcaggaagaggcgatgaccatggcggggcgtatcgccattatgaatcgtgggaaatttgtccagattggcgaaccggaagagatctacgagcatccgactacccgctatagcgccgaatttattggctcggttaatgtctttgaaggtgtactcaaagagcgtcaggaagatggtctggtgctttattcgccggggctggtgcatccactgaaagtcgatgcggatgcttcagtggtcgataacgtgccggtacacgtagcgctgcgtccggaaaaaatcatgctttgcgaagagccgcccgccaatggttgtaacttcgcggtgggggaggtgatacacattgcctatctcggcgatctttcggtgtatcacgttcgtctgaaaagtgggcagatgattagcgcccagctacaaaacgcccatcgtcatcgtaaagggttaccgacctggggcgacgaagtgcgtttgtgctgggaagtggacagctgtgtggtgctgacggtttaa

SEQ ID NO: 65761 - protein, 377 aa, Escherichia coli O157:H7
MNDAIPRPQAKTRKALTPLLEIRNLTKSYDGQHAVDDVSLTIYKGEIFALLGASGCGKSTLLRMLAGFEQPSAGQIMLDGVDLSQVPPYLRPINMMFQSYALFPHMTVEQNIAFGLKQDKLPKAEIASRVNEMLGLVHMQEFAKRKPHQLSGGQRQRVALARSLAKRPKLLLLDEPMGALDKKLRDRMQLEVVDILERVGVTCVMVTHDQEEAMTMAGRIAIMNRGKFVQIGEPEEIYEHPTTRYSAEFIGSVNVFEGVLKERQEDGLVLYSPGLVHPLKVDADASVVDNVPVHVALRPEKIMLCEEPPANGCNFAVGEVIHIAYLGDLSVYHVRLKSGQMISAQLQNAHRHRKGLPTWGDEVRLCWEVDSCVVLTV

SEQ ID NO: 65762 - DNA, 1092 bp, Streptococcus pneumoniae TIGR4
  CDS (1)..(1092): transl_table=11
atgagtgagatcaaaattattaacgccaaaaaaatctaccacgatgtccctgttattgagaatttgaacattacaattccaaaaggaagtctctttacccttcttggagcttcaggatgtgggaaaacgacccttcttcgtatgattgcaggtttcaacagtatcgaaggtggagaattttacttcgatgatacaaaaatcaataatatggaacccagcaaacgcaatatcgggatggttttccaaaactacgctattttcccacatttgactgtccgagacaacgttgcttttggtcttatgcaaaagaaggttccaaaagaagaattgattcaacagaccaacaagtatcttgaactcatgcaaattgctcaatatgcggatcgaaagcccgataaactcagtggtggacaacaacaacgtgtcaccttggcatgcgccttagcggttaatccaagtgttctcctcatggacgagccacttagtaatctggaggccaaacttcgcttggatatgcgtcaagccatccgagaaatccaacacgaagtgggaattacaactgtttatgtaacccacgaccaagaagaagccatggctatttcagaccaaattgctgttatgaaagatggggtgatccaacaaatcggccgaccaaaagaactctatcataaaccagctaatgagtttgtggcaacctttatcggacgcacaaatattatccctgccaatcttgaaaaacggagcgacggcgcttatatcgtcttttcagatggctatgcccttcgaatgccagctcttgatcaggttgaggagcaagctattcatgtaagcattcgtcccgaagagtttatcaaagatgaatctggagatattgaaggaactattagagatagcgtctatcttggactaaatacggattatttcattgagacaggttttgcctcaaaaattcaagttagtgaagaatcaacttttgaagaagatctacaaaaaggcaatcgtattcgtctacgaatcaatacgcaaaaattaaacatcttttctgcagatggttcccaaaacctgataaaaggagtcaaccatggaacgtaa

SEQ ID NO: 65763 - protein, 363 aa, Streptococcus pneumoniae TIGR4
MSEIKIINAKKIYHDVPVIENLNITIPKGSLFTLLGASGCGKTTLLRMIAGFNSIEGGEFYFDDTKINNMEPSKRNIGMVFQNYAIFPHLTVRDNVAFGLMQKKVPKEELIQQTNKYLELMQIAQYADRKPDKLSGGQQQRVTLACALAVNPSVLLMDEPLSNLEAKLRLDMRQAIREIQHEVGITTVYVTHDQEEAMAISDQIAVMKDGVIQQIGRPKELYHKPANEFVATFIGRTNIIPANLEKRSDGAYIVFSDGYALRMPALDQVEEQAIHVSIRPEEFIKDESGDIEGTIRDSVYLGLNTDYFIETGFASKIQVSEESTFEEDLQKGNRIRLRINTQKLNIFSADGSQNLIKGVNHGT

SEQ ID NO: 65764 - DNA, 1059 bp, Clostridium acetobutylicum ATCC 824
  CDS (1)..(1059): transl_table=11
atggaaaaagacatacttattgaacttaagaacgtttcaaagaaatatggcgaaaattatgtaattaaaaatttgaacttatttgtcagacgaaatgaatttcttacatttttaggtccaagcggatgcggtaaaacaacaaccttaaacatgattgctggttttgaaactcctgatgaaggaaacataatatttgaagacagtagtataaatattgttccccctcacaagaggcaaataaatactgtgtttcaaaaatatgctcttttttcacacatgaatgtatatgaaaatgtagcctttggtcttaggataaagaagcttccagaaaaacaaataagggaagaagttgaaaaaatgctttctctggtagacttaaaaggctttgaaaaaagatcaactgattctttaagcggtggtcaacagcagagggtagctattgcacgggcgcttgtaaataaaccaaagcttcttcttctagatgaacctcttggtgctcttgatttaaaacttagaaaagaaatgcagcttgaactgaaaaacatacaacaaaaacttggaataacctttatctttgtgactcatgatcaagaagaggcacttaccatgtctgatactattgtagtattaaacaaaggtacggttcaacaaataggtacccctgaagatatatacaacgaacctaaaaataaattcgttgcaaattttataggtgtaagtaatattttaaatggagttatgctacacgattacaaggtaaaatttgatgatgaaacttttgattgcgtagatactggatttaatgaaaatgaagatgttgatgttgttgtaagacctgaagatataaaaattgtgtccaaagaaaatggaaaactctttggaaaagttatttctgctgtttttagaggtgttcattatgaaatcaaggttgaagtaaaaaatactacgtggataatccataatacaaagcatgtaagagttggagatagtattggcttagatattcttcctgatgatatacatattatgagaaaggaaaaaatagatgaagaagcatag

SEQ ID NO: 65765 - protein, 352 aa, Clostridium acetobutylicum ATCC 824
MEKDILIELKNVSKKYGENYVIKNLNLFVRRNEFLTFLGPSGCGKTTTLNMIAGFETPDEGNIIFEDSSINIVPPHKRQINTVFQKYALFSHMNVYENVAFGLRIKKLPEKQIREEVEKMLSLVDLKGFEKRSTDSLSGGQQQRVAIARALVNKPKLLLLDEPLGALDLKLRKEMQLELKNIQQKLGITFIFVTHDQEEALTMSDTIVVLNKGTVQQIGTPEDIYNEPKNKFVANFIGVSNILNGVMLHDYKVKFDDETFDCVDTGFNENEDVDVVVRPEDIKIVSKENGKLFGKVISAVFRGVHYEIKVEVKNTTWIIHNTKHVRVGDSIGLDILPDDIHIMRKEKIDEEA

SEQ ID NO: 65766 - DNA, 1041 bp, Agrobacterium tumefaciens str. C58
  CDS (1)..(1041): transl_table=11
atgagtgaactcgagatcagcaatatcagcaaggattacggggcgagccgggcgcttcatccggtatcgatcaccgtggagcggggcgagttcgtcaccattcttggtccctccggttgcggcaagtcgacgcttttgcgcatcctcaccggcatcagccagccttcgggcggcgaaatccggctgggcggcaagcgtattgatcaggcgcagccggaagcgcgcgatatcgccatggtattccagtcctatgcgcttttcccgcatatgtcggtcgcgaaaaaccttggcttcggtctgaagatgaagaaggtcgcgaaggacgagcgtgcccgccgcatcgcccatgcgctggaaatttgcaatctcaccgggctagtggatcgcatgcctcggcaattgtccggtgggcagcagcagcgtgtggcgctggcgcgcgccatcgtcatgcagccgagcctgcttctcttcgacgagccgctctccaacctcgacgccaagctccgcgacacactgcgccatgagttgaccgaactgcaccgccgtatcggcgccaccagcctttatgtgacgcatgatcaggccgaggcgatggcgatgtcggaccggatcgtcgtcatgaatgccggccgggtggtcgagatcggcacgccgcttgagctttaccgcgcaccgaaacacgcctttaccgccggctttctcggccagaccaatcttctgccggtctccgctgagggccagcaggcgcaattgccctggggccagtccgtgacattggatcaggctgctgccggcaatgtgcagatttccgctcgcccggaaaacatccacatctgcgccgatcaggccggtgacggcacggtttccgccgtttccttcatgggtgcgaatgcgctttacaccgtcgagatcggcggtcgccagatccgggtcagccagtccggcgcggaaacgctgatcgatgccggacagagggtcgcgctgcagtttcccggctcagtccatcttcttgatgacagtgtggcgggggaggcggcatga

SEQ ID NO: 65767 - protein, 346 aa, Agrobacterium tumefaciens str. C58
MSELEISNISKDYGASRALHPVSITVERGEFVTILGPSGCGKSTLLRILTGISQPSGGEIRLGGKRIDQAQPEARDIAMVFQSYALFPHMSVAKNLGFGLKMKKVAKDERARRIAHALEICNLTGLVDRMPRQLSGGQQQRVALARAIVMQPSLLLFDEPLSNLDAKLRDTLRHELTELHRRIGATSLYVTHDQAEAMAMSDRIVVMNAGRVVEIGTPLELYRAPKHAFTAGFLGQTNLLPVSAEGQQAQLPWGQSVTLDQAAAGNVQISARPENIHICADQAGDGTVSAVSFMGANALYTVEIGGRQIRVSQSGAETLIDAGQRVALQFPGSVHLLDDSVAGEAA

SEQ ID NO: 65768 - DNA, 1083 bp, Agrobacterium tumefaciens str. C58
  CDS (1)..(1083): transl_table=11
atgaccaaaccgctcctgcaaattcgcggaatccgcaagcaatacggaccgttggtcgccgttcaggatgtcaatctcgacgttcagccgggcgagttcatgaccttcctcggtccttccggttccggcaagagcaccactctttatatccttgccggtttcgaacagccgacctcgggggatatcctgctgaacggcgagagcctgctgtcgactccatcgcacaagcgcaatatcggcatggtcttccagcgttacaccctgtttccgcatctgtcggtcggcgaaaacatcgcctttccgctgaaagttcgccgcaggagcaaggcggacatcgatgccaaggtgaaggagatgctgcggctcgtccgcctcgaaggtttcgaggacaggaagcccgcgcagatgtccggcggtcagcagcagcgcgtggcgctggcgcgtgcgcttgcttatgatccgccggtacttttgatggatgagccgctgtcggcgctcgacaagaagctgcgcgaggaaatccaattcgaaatccgtcgcatccaccagcagacggaagtgacgatcctttacgtcacccatgatcaggaagaagccttgcgtctttctgaccggatcgccgtgttttccaagggggtgatcgatcagatcggcacggggcccgagctttatgctcatcctactacccgtttcgtggctgaattcattggtgacagcgatttcatcgcctgcgatctgatcgcggcatcgggcggcaaggcgacggtgtcgcttggccgggatatcatcttcgatcatattcccatgcatggcgaggccgcgccgggcaagaaagcggcactgatgctgcgtccggaacgcctgcagctcagccgcaacagaccggttgcttccgccggttttcaggccacggtcagcgacatcaccttccttggcaacaatgtccatgtggttgctcataccggttcgggcgaaccgcttgccgtgcggctgccctttggccacgaggcgatttccggtctcaaccggggcgacctcgtgcacttggccttcgacccggcgtcagcccaggttttctgttga

SEQ ID NO: 65769 - protein, 360 aa, Agrobacterium tumefaciens str. C58
MTKPLLQIRGIRKQYGPLVAVQDVNLDVQPGEFMTFLGPSGSGKSTTLYILAGFEQPTSGDILLNGESLLSTPSHKRNIGMVFQRYTLFPHLSVGENIAFPLKVRRRSKADIDAKVKEMLRLVRLEGFEDRKPAQMSGGQQQRVALARALAYDPPVLLMDEPLSALDKKLREEIQFEIRRIHQQTEVTILYVTHDQEEALRLSDRIAVFSKGVIDQIGTGPELYAHPTTRFVAEFIGDSDFIACDLIAASGGKATVSLGRDIIFDHIPMHGEAAPGKKAALMLRPERLQLSRNRPVASAGFQATVSDITFLGNNVHVVAHTGSGEPLAVRLPFGHEAISGLNRGDLVHLAFDPASAQVFC

SEQ ID NO: 65770 - DNA, 1092 bp, Streptococcus pneumoniae R6
  CDS (1)..(1092): transl_table=11
atgagtgagatcgaaattattaacgccaaaaaaatctaccacgatgtccctgttattgagaatttgaacattacaattccaaaaggaagtctctttacccttcttggagcttcaggatgtgggaaaacgacccttcttcgtatgattgcaggtttcaacagtatcaaagatggagaattttacttcgatgatacaaaaatcaataatatggaacccagcaaacgcaatatcgggctggttttccaaaactacgctattttcccacatttgactgtccgagacaacgttgcttttggtcttatgcaaaagaaggttccaaaagaagaattgattcaacagaccaacaagtatcttgaactcatgcaaattgctcaatatgcggatcgaaagcccgataaactcagtggtggacaacaacaacgtgtcaccttggcatgcgccttagcggttaatccaagtgttctcctcatggacgagccacttagtaatctggaggccaaacttcgcttggatatgcgtcaaaccatccgagaaatccaacacgaagtgggaattacaactgtttatgtaacccacgaccaagaagaagccatggctatttcagaccaaattgctgttatgaaagatggggtgatccaacaaatcggccgaccaaaagaactctatcataaaccagctaatgagtttgtggcaacctttatcggacgcacaaatattatccctgccaatcttgaaaaacggagcgacggcgcttatatcgtcttttcagatggctatgcccttcgaatgccagctcttgatcaggttgaggagcaagctattcatgtaagcattcgtcccgaagagtttatcaaagatgaatctggagatatcgaaggaactattagagatagcgtctatcttggactaaatacggattatttcattgagacaggttttgcctcaaaaattcaagttagtgaagaatcaacttttgaagaagaactacaaaaaggcaatcgtattcgtctacgaatcaatacgcaaaaattaaacatcttttctgcagatggttcccaaaacctgataaaaggagtcaaccatggaacgtaa

SEQ ID NO: 65771 - protein, 363 aa, Streptococcus pneumoniae R6
MSEIEIINAKKIYHDVPVIENLNITIPKGSLFTLLGASGCGKTTLLRMIAGFNSIKDGEFYFDDTKINNMEPSKRNIGLVFQNYAIFPHLTVRDNVAFGLMQKKVPKEELIQQTNKYLELMQIAQYADRKPDKLSGGQQQRVTLACALAVNPSVLLMDEPLSNLEAKLRLDMRQTIREIQHEVGITTVYVTHDQEEAMAISDQIAVMKDGVIQQIGRPKELYHKPANEFVATFIGRTNIIPANLEKRSDGAYIVFSDGYALRMPALDQVEEQAIHVSIRPEEFIKDESGDIEGTIRDSVYLGLNTDYFIETGFASKIQVSEESTFEEELQKGNRIRLRINTQKLNIFSADGSQNLIKGVNHGT

SEQ ID NO: 65772 - DNA, 1146 bp, Sinorhizobium meliloti 1021
  CDS (1)..(1146): transl_table=11
atgatgaagtctctcggaagtatccggcgttctttcgcgccatgggcggaccccgcctccaagcctttcatttccgtcaagaacgtcaccaaaaagttcggtgacttcaccgccgtggacgatctttcgctgaacatctacacgcgcgaattcttcgcgctcctcggcgcttcgggctgcggcaaatccaccctcctgcggatgctggccggtttcgagcagccgacatcaggcgaaatcatcctcgacggccagagcctggcgggcatcccgccctaccgccgcccggtcaatatgatgttccagtcctatgcgctgtttccgcacatgacggtcgaaaacaacgtcgccttcggcctgaagcaggacggaatgccgaaagcggacatcgccgaacgcgtcgcgcagatgctgaagctcgtcaagctggagaagttcgccaagcgcaagccgcatcagctttccggcggccagcgccagcgcgtcgcccttgcccgttcgctggcaaagcggccgaaggtgctgctgctcgacgagccgctcggcgcgctcgacaagaagctgcgcgaggaaacgcaattcgagctcatggacctgcagcaggaactcggcctcaccttcgtcgtcgtcacccacgaccaggaagaggcgatgaccatggcggaccgcatcgccgtcatgagccacggcaaggtcgtccaggtggcgacgccggcggagatctacgaagcgccgaattcgcgcttcgtcgctgacttcatcggcgacgtgaacatattcgacggtaaggtgacctcggctgaagacggctatatccgtgtcgagacgacgggcggcatcccggtccggatggcgtcgccggaaaaaccggggaacggcgcaaaggcggctgtcgccatccggcccgagaagatcagaatcggccgacagccgccggcgcatgcgccggtgaacgccgccgaaggcgagatatgggacatcggctacctcggcgacatgacggtttttcacatccggctgaaggacggcaaggtcgtcaaggcgtcatcgctgaatgcggtgcgggcggtcgaggacccgctcggctacgaccagcaggtctggatctccttcggcgacgacgcgggcgtcgtattgaaggattga

SEQ ID NO: 65773 - protein, 381 aa, Sinorhizobium meliloti 1021
MMKSLGSIRRSFAPWADPASKPFISVKNVTKKFGDFTAVDDLSLNIYTREFFALLGASGCGKSTLLRMLAGFEQPTSGEIILDGQSLAGIPPYRRPVNMMFQSYALFPHMTVENNVAFGLKQDGMPKADIAERVAQMLKLVKLEKFAKRKPHQLSGGQRQRVALARSLAKRPKVLLLDEPLGALDKKLREETQFELMDLQQELGLTFVVVTHDQEEAMTMADRIAVMSHGKVVQVATPAEIYEAPNSRFVADFIGDVNIFDGKVTSAEDGYIRVETTGGIPVRMASPEKPGNGAKAAVAIRPEKIRIGRQPPAHAPVNAAEGEIWDIGYLGDMTVFHIRLKDGKVVKASSLNAVRAVEDPLGYDQQVWISFGDDAGVVLKD

SEQ ID NO: 65774 - DNA, 1062 bp, Sinorhizobium meliloti 1021
  CDS (1)..(1062): transl_table=11
atggcattcctgcaattgaccaatattcagaaatccttcggcccggttcaggtcgtgcataatttcgacatggggatcgacaagggcgagttcgtctcctttctcggcccctccggctgcggcaagacgaccatcctgcgcatgattgccggcttcgagaccccgtccggcggctcgatcttcatcgacggcaaggaccagggtgcgctgaagccgaaccagcgcaatatcggcatggtgttccaggcctatgcgctctttcccaacatgaatgtccacgacaatgtcgccttcggcctcaaggtcgccggcgcctccagaacggagatcgaggcacgggttaagcagatgctcggactgatcaagctagagcatctggcggaccgcttcccctatcaattgtccggcggacagcagcagcgcgtggcgcttgcccgcgccctcgccgtcaagccgcaggtgctgctcctcgacgagccgctctccgcgctcgatgcaaagatccgcatctcgctgcgggaggagatccgccagatccagcagcagctcggcatcaccacggtattcgtgacgcacgaccaggaggaggcactgtcgatctccgaccggatcgtcgtcatgaattccggccgcgccgatcagatcggcacccctttcgagatctacaacaccccggcgacacgcttcgtcgcctccttcgtcggcacgctcaacatcatcgagggcaaggtggccgatcccgcaagcggcgcagtcaccatcggcgggcagcgcatctcactgaaagagccgattgccggggcaaaaggcggcgacagcatctcgctggcgctcaggccggaagcaggctcgatcgccgagggcgccaggggcgataccgcacttccgggcgaagtggtatcgaggagctttctcggctccgtcatccgcaccaagctgcgggtcggcaaagacatcatctccttcgatatgttcaacgatccgggcatgaccccaccggtcgccggcgagagcgtcacgctgcgtttcgcggcaaaggacctgctcgtcatccgcgaatag

SEQ ID NO: 65775 - protein, 353 aa, Sinorhizobium meliloti 1021
MAFLQLTNIQKSFGPVQVVHNFDMGIDKGEFVSFLGPSGCGKTTILRMIAGFETPSGGSIFIDGKDQGALKPNQRNIGMVFQAYALFPNMNVHDNVAFGLKVAGASRTEIEARVKQMLGLIKLEHLADRFPYQLSGGQQQRVALARALAVKPQVLLLDEPLSALDAKIRISLREEIRQIQQQLGITTVFVTHDQEEALSISDRIVVMNSGRADQIGTPFEIYNTPATRFVASFVGTLNIIEGKVADPASGAVTIGGQRISLKEPIAGAKGGDSISLALRPEAGSIAEGARGDTALPGEVVSRSFLGSVIRTKLRVGKDIISFDMFNDPGMTPPVAGESVTLRFAAKDLLVIRE

SEQ ID NO: 65776 - DNA, 1080 bp, Sinorhizobium meliloti 1021
  CDS (1)..(1080): transl_table=11
gtgacatccgcttcgacgaacgacatcgaattccgttcggtcgccaaacgctatggcagcgtgacggcggtatcggacatcaacctgacggtgccgaagggcgccttcgttgcgctgctcggcccatccggctgcggcaagaccacatgcctgcgcatgatcggcggcttcgagcagccgagcgaaggcatggtctatatcggcggccagccgatgaacggcgtgcctgcctatcgccggccggtcaacatggtgttccagcaatatgcgcttttcccgcatctcgatgtcgagcagaacgtcgcctacggcttgaagcagacgcgtccccgtatcccggcggccgagatcacccggcgcgcccaggaggcgctggagatggtccgactcggcggcttcggcaagcgccgcatccacgaaatgtccggcggacaacagcagcgcgtggcgctcgcccgtgccatcgtcaacaagccgaaggtgctgctcctcgacgagccgctcgcagcgctcgacaagaagctgcgcaccgccatgcagatcgagctgcagagcctgcagcgcgagctcggcatcaccttcgtgctcgtcacgcacgatcaggaagaggcgctctctatgagcgacttcgtctgcgtcatgagcactggccgcatcgtgcagatcgggccgccgcaggagatctacgaccgcccggcaagcctcttcgtcgccgacttcgtcggcaagaccaaccgcatcgccgggacgatcgaacccggcgccggcgcggtcctcctcgccaatggcgtcggacttgccaagcccgcccgcgccaacggcacggcaggcccggtcatggtggcgctgcgcccggaggcgataagcctggtgcgcgacggcagcgctgcgctgcggggcacggtgacccaccgcatcttcctgggctcgtccgtcgaatattcggtcgaggtcgagggcctcggcgattttctcgttaccgccgaccgccgcagcctgaacgacagcgatctcgccgaacccggtgaaaggatcgggctcagcttcgacccgaatgcaatgcatgtctttccggcctga

SEQ ID NO: 65777 - protein, 359 aa, Sinorhizobium meliloti 1021
MTSASTNDIEFRSVAKRYGSVTAVSDINLTVPKGAFVALLGPSGCGKTTCLRMIGGFEQPSEGMVYIGGQPMNGVPAYRRPVNMVFQQYALFPHLDVEQNVAYGLKQTRPRIPAAEITRRAQEALEMVRLGGFGKRRIHEMSGGQQQRVALARAIVNKPKVLLLDEPLAALDKKLRTAMQIELQSLQRELGITFVLVTHDQEEALSMSDFVCVMSTGRIVQIGPPQEIYDRPASLFVADFVGKTNRIAGTIEPGAGAVLLANGVGLAKPARANGTAGPVMVALRPEAISLVRDGSAALRGTVTHRIFLGSSVEYSVEVEGLGDFLVTADRRSLNDSDLAEPGERIGLSFDPNAMHVFPA

SEQ ID NO: 65778 - DNA, 1041 bp, Sinorhizobium meliloti 1021
  CDS (1)..(1041): transl_table=11
atgaggggccgaaatctcgccgaaatctcctggagtatcgcaatgaacgccgccgtcctcttcgacaatgtttcccgctatttcggcgccgtgcgtgccgtcgatcgcgtgaacctcgagatcgccgagggcgagttcttcgcgatgctcggtccatcgggctcgggcaagaccacctgcctgaggctgatggcaggcttcgagcagccgaccggaggccacatcgagatcttcggcgagaccgccgaaggcgtgccgccctaccggcgcagcgtcaacaccgtctttcaggactacgccctcttcccgcatctctccattctcgacaacgtcgcctatggcctgatggtcaagggcgtcggacgcgaggagcgccgcagggcggccgaggatgcgctcgccatggtgaagcttccgggctacggcacgcgccggcccggacagctttccggcggccagcgccagcgcgtggcgctcgcccgcgcgctcgtcaacaagccgaaggttctgcttctcgacgagccgttgggcgcgctcgatctgaagctgcgcgaacagatgcaggaggaattgaaaacgctgcagaagtcgttgggcatcaccttcgtcttcgtcacccatgatcagggcgaagcgctctcgatggccgacaggatcgccgttttcaacgagggccgtatccagcaactgggaagcccggaggaggtctacaaccgtccgcagacccgtttcgtcgccgatttcgtcggctcctccaacgtgctttccgaggacctctgccgccgactggggctgaaggcttccttcgcgagcctgcgcccggaggctgtggccattgcgccgccgagcgacggagcgctgagcctttccggcactgtcgcttcgcagagcttcctcggcgccaccaaccgaatcctgatcgacgtcgagggtgcccgcatcgccgtggcgagcccggcggcgcgtggcgttccagcggtcggcagtccggtcacgatcagcttcgccgcgcacgacctccacccgatggaggacgcatga

SEQ ID NO: 65779 - protein, 346 aa, Sinorhizobium meliloti 1021
MRGRNLAEISWSIAMNAAVLFDNVSRYFGAVRAVDRVNLEIAEGEFFAMLGPSGSGKTTCLRLMAGFEQPTGGHIEIFGETAEGVPPYRRSVNTVFQDYALFPHLSILDNVAYGLMVKGVGREERRRAAEDALAMVKLPGYGTRRPGQLSGGQRQRVALARALVNKPKVLLLDEPLGALDLKLREQMQEELKTLQKSLGITFVFVTHDQGEALSMADRIAVFNEGRIQQLGSPEEVYNRPQTRFVADFVGSSNVLSEDLCRRLGLKASFASLRPEAVAIAPPSDGALSLSGTVASQSFLGATNRILIDVEGARIAVASPAARGVPAVGSPVTISFAAHDLHPMEDA

SEQ ID NO: 65780 - DNA, 1038 bp, Sinorhizobium meliloti 1021
  CDS (1)..(1038): transl_table=11
atgtcgggacttgcccttcaaaacgtcgtcaaggaattcgggtcgttcagggccgtcaacgatgtcgacctgacggtgccgcacggcaccttcgtctgcatgctcgggccgtcgggctgcggcaagaccacgctcctgcgcatgatcgcgggtctggacctgccgacctcgggttccatagggctcgacggcgaggacatcacccgggttccgacgcataagcgcaatctcggcatggtgttccagtcgctggcgctgttcccccacctgaccgtcggcgagaatatcgcctatccgctgcgcatccgcggcgcgccgaaggaagaccagaagaaacgggtcgacgagctgctttcgatgatccacctgtcgggctatgccgaccggccggtctcgaagctctccggcggccagcgccagcgcgtggcgatagcccgggcgctggcgatctcgccgaagctcttcctgctcgacgaacccctgtcggcgctcgatgccaagctgcgcgaggcgatgcaggtcgagctcaggcagttgcagcagaagctcggcatcaccaccatcgtcgtcacccacgaccagcgcgaggcgatgaccatggccgatacggtcgtggtcatgaacggcggcgagatccggcaggctgcctcgccgatcgagatctaccgccggccggccgacagcttcgtcgccgacttcatcggacagacgaatctgatcgaagcggaggcggacacttcgggtcgcgtgacggtgctcggtcagccggtgccgggcctgcagttgccgccgggtgcggcgaaggcgatgctttcgatccgcccggaagacgtgcacctgaccgcgccgggtgccggagcgctttccggcacggtgaccttcgtgcgcgatctcgggggcacgatcgagacattcgtcgatgtcgccggccggcagatcgtagcggtctcgacgccgcgcgcccggccgcaggtgacggtcggccaacaggtcggcgtcgctctcacacccgatgtctgtgtggtgctcgccagatga

SEQ ID NO: 65781 - protein, 345 aa, Sinorhizobium meliloti 1021
MSGLALQNVVKEFGSFRAVNDVDLTVPHGTFVCMLGPSGCGKTTLLRMIAGLDLPTSGSIGLDGEDITRVPTHKRNLGMVFQSLALFPHLTVGENIAYPLRIRGAPKEDQKKRVDELLSMIHLSGYADRPVSKLSGGQRQRVAIARALAISPKLFLLDEPLSALDAKLREAMQVELRQLQQKLGITTIVVTHDQREAMTMADTVVVMNGGEIRQAASPIEIYRRPADSFVADFIGQTNLIEAEADTSGRVTVLGQPVPGLQLPPGAAKAMLSIRPEDVHLTAPGAGALSGTVTFVRDLGGTIETFVDVAGRQIVAVSTPRARPQVTVGQQVGVALTPDVCVVLAR

SEQ ID NO: 65782 - DNA, 1179 bp, Agrobacterium tumefaciens str. C58
  CDS (1)..(1179): transl_table=11
ttgaaagccgctccgagcactcgttttcacgttcgtcgcggcaataaaaaacggaggggtgaggtattgataggtgagactctaaatcttgacgggctcgcgaagagctatggcaacgtcgttgcagtcgctggtgttgacgtccgcgtggagccaggcgagttcgtgtcagtgctgggcccatctgggtcaggcaagaccagcgtcctgacgatgattgccggttttgagcgtcccacggcaggcaggatcgtgatcggcgaccgagacgtgaccgaccttgcgccgaataagcgaaatatcgggatggtctttcagaaatacgcgcttttcccccatctcactgtccgtcagaacattgctttcccgctaaagctcagatcgcggtggcgctccggatggaggcagcgggcagacgacatgcttgacctcgttcacctagccggttttgctgacaggtttccttctgaactttcgggtggccagcagcagcgtgtggcggtcgcacgagcgcttgcgtttgagccgcccgttatgctgatggacgagcccctcggcgcgcttgacaagaaattgcgtgaagccatgcagttcgaaatcaagcgcatccagagacaggtgggagcaaccgtcctttacgtaacgcatgatcaggaagaagcgctgacgatgtccgatcgcgttgcgataatgcagggcggaaacatcgtccagataggggctccttctagtctttaccacgcgcccgcaacccgttttgttgctgatttcgtcggaaaaatgagcttcgtcggaggagagattgtttcttttgaagacgacgggatgctcgtgcgattggcggacgacgtatttgtccggaccgcttctgtcgatgcggcacgggcggcactccggcttggtgacgaggtaatcctggccatgcgtcccgagaggatcgccttgaaaaaacgaggtcctcgaggttttggggcaataccagctcagatcgagagccttgcattcgttggatcattccatgcgtacatggtccgtctggacctgcctggatcaccgctggtggaggttcaggtcgtgaccggaagtgaggtaaatttccgcgccggtgatacggtcgatctcgtacccgacccgcaggctgtcagctttttttcaaaagaggagacgtctgcggcatga

SEQ ID NO: 65783 - protein, 392 aa, Agrobacterium tumefaciens str. C58
MKAAPSTRFHVRRGNKKRRGEVLIGETLNLDGLAKSYGNVVAVAGVDVRVEPGEFVSVLGPSGSGKTSVLTMIAGFERPTAGRIVIGDRDVTDLAPNKRNIGMVFQKYALFPHLTVRQNIAFPLKLRSRWRSGWRQRADDMLDLVHLAGFADRFPSELSGGQQQRVAVARALAFEPPVMLMDEPLGALDKKLREAMQFEIKRIQRQVGATVLYVTHDQEEALTMSDRVAIMQGGNIVQIGAPSSLYHAPATRFVADFVGKMSFVGGEIVSFEDDGMLVRLADDVFVRTASVDAARAALRLGDEVILAMRPERIALKKRGPRGFGAIPAQIESLAFVGSFHAYMVRLDLPGSPLVEVQVVTGSEVNFRAGDTVDLVPDPQAVSFFSKEETSAA

SEQ ID NO: 65784 - DNA, 1272 bp, Agrobacterium tumefaciens str. C58
  CDS (1)..(1272): transl_table=11
ttgcaacatagcactgaaagcgtggttggcacgcggcttgcctctgctgtttccatgacccaaagcgaacccaaaattgttgatcgaaaacatttccccctgataccgacgagcaccgtgccctcggctgttcaggcgcaaccgaaggggacattcatgtcgcagacctcgaatgcagcagaaggcaagcagcttagcgttcgtggcctgacccatagctatggcggactgaatgcgatcagcgacatttctttcgagatagccgccggtgagatcgtcgcgctcctcggaccgagcggctgcggaaaatccaccgtgttgcgcgccatcgcaggcctgatccaaccgaaaagcggtgtgatccagctcggaggcgaagacatcgccaatgtttcggcgcgtgcgcgcggtatcggcatggttttccagaactatgcgctgtttccacacctgacggtcgccgagaacatcgcctatccgctggcatgccagaaagtgggacgcaccgagcgccgcgagcggattgaggaaatgctctcgctcgtgcagttgaagggatttggccatcggctgccgcgtgagctttccggtggccagcagcaacgcgtggcagtggcccgcgcgattgccggaaggccttcacttctgcttctcgacgaaccgttcggtgccttggaccgggcgctccgtttcgacctgcaggtcgagcttctccatctgcagaagacgcttggcatcacgacgttgatcgtgacgcatgaccaggaggaggcgcagagcctagctggccgtctggtgctcatgaacaagggcaatgtcgagcaaattgatacaccgatggccgtttatgaccgaccgaggtctctcttcgtcaataccttcatcggtcaggccaatgtgttgcatggaacggtggaccgggtggaggcggaggcaaccaccatctccctcgcgaatggcagggtcctcgttctgccgcgccgcctgaatttcacgacgggctccaagatcacgatcacctgccgccccgaagatgtgcgtctgtctgcggcaccgggcgcaccggccctgccggcacggctgaccgtgtcagtgccgcttggtcccacccttgtccatgatctccttctcgaagacgggacaaaccttcgctcctcggaggtccgcggaccttcgaccttcattcccgagccgggagcagagctctttgccgagatagacaccatcaggtgtcacgcctttccgagcgaaccggaagcatcccgtgaataa

SEQ ID NO: 65785 - protein, 423 aa, Agrobacterium tumefaciens str. C58
MQHSTESVVGTRLASAVSMTQSEPKIVDRKHFPLIPTSTVPSAVQAQPKGTFMSQTSNAAEGKQLSVRGLTHSYGGLNAISDISFEIAAGEIVALLGPSGCGKSTVLRAIAGLIQPKSGVIQLGGEDIANVSARARGIGMVFQNYALFPHLTVAENIAYPLACQKVGRTERRERIEEMLSLVQLKGFGHRLPRELSGGQQQRVAVARAIAGRPSLLLLDEPFGALDRALRFDLQVELLHLQKTLGITTLIVTHDQEEAQSLAGRLVLMNKGNVEQIDTPMAVYDRPRSLFVNTFIGQANVLHGTVDRVEAEATTISLANGRVLVLPRRLNFTTGSKITITCRPEDVRLSAAPGAPALPARLTVSVPLGPTLVHDLLLEDGTNLRSSEVRGPSTFIPEPGAELFAEIDTIRCHAFPSEPEASRE

SEQ ID NO: 65786 - DNA, 1071 bp, Agrobacterium tumefaciens str. C58
  CDS (1)..(1071): transl_table=11
atgcagccggttgttcattttaaaaacgtcaacaagtcttacggcgcttcccttgctgtcgacgatctagacctggaggtcgcgccgggccaattcgttaccctgcttggcccctccggttgcggcaaatccacgacactgagaatgttgggcgggttcgaaacgccgtcctccggcgagatttaccttgacgggcagccgatctcgcatctgccgcccaacaggcgaaacgtcaatatcgtctttcaggactatgccctgtttccgcacctgtcagtccagcgcaacattgctttcggacttgaactgaaggggctggattcggcgtccatccaccgccgggtcatggaactcctcggtctcgtcaagctgcaggattttgccggacgcatgcctgaacaattgtcgggtggtcagcgccagcgcgtcgccctcatgcgggcactggcgccggacccgaatgtcttgttgctcgacgagccgctatcggcactcgacgccaagctgcgtcatgagatgcagatcgagttgaagtcgatccagcagacgaccggcaaaaccttcatcttcgtcacccatgaccaggaagaggcgctgaccatgtctgacgtcgtggtggtgatgaacaaggggcggatcgagcagatgggagcgcctgatgatctctatgcacgcccccgcagccgcttcgtcgccgactttattggtcagagcaactttctcgatggccgtttggtgtctgccgagagcggggtcgctacggtcgactggcagggtagtttgatccgggcggatcttaacggccaccatcacgccattggcagccacgtcacgattgcgctgcgtccggaggctctgttctgtctgcccgagcagccgagtgatcgttttgccctcaagggccagatcgagcggcgcgtgttcaagggcgcacataccacgttgacgatccgcctcgataacggcgcactcctgtcggcccagctcgatccggtggcgctctcgcatcttgatggcgagacggtctggatgggttggcgcgatcgcgacgccgttgtcctggccgattaa

SEQ ID NO: 65787 - protein, 356 aa, Agrobacterium tumefaciens str. C58
MQPVVHFKNVNKSYGASLAVDDLDLEVAPGQFVTLLGPSGCGKSTTLRMLGGFETPSSGEIYLDGQPISHLPPNRRNVNIVFQDYALFPHLSVQRNIAFGLELKGLDSASIHRRVMELLGLVKLQDFAGRMPEQLSGGQRQRVALMRALAPDPNVLLLDEPLSALDAKLRHEMQIELKSIQQTTGKTFIFVTHDQEEALTMSDVVVVMNKGRIEQMGAPDDLYARPRSRFVADFIGQSNFLDGRLVSAESGVATVDWQGSLIRADLNGHHHAIGSHVTIALRPEALFCLPEQPSDRFALKGQIERRVFKGAHTTLTIRLDNGALLSAQLDPVALSHLDGETVWMGWRDRDAVVLAD

SEQ ID NO: 65788 - DNA, 1086 bp, Yersinia pestis CO92
  CDS (1)..(1086): transl_table=11
atgagaacctatgtcagcttcaaaaatatcaagaagagctacgatggcgacaagttggtcgttaaaaacctgaatctggacattcatgagggggattttttaaccctgctcggtccttctggttcaggtaaaaccaccagcctaatgatgctagccgggtttgaaacccccactcaaggcgagattacgctgcgtgataaacccctgcataacctgccccctcaccaacgggggatcggtatggttttccaaaattatgccctcttcccacatatgaccgtaactgaaaatctggcctttccactcacgatccgccgattgaataaggctgatatcaaagagaaaattgaccgtatattggatatggtgaagttgaagaatttggctgaccgctatcccgcgcagatgtctggtgggcagcagcaacgggttgcattggcacgtgccttggtatttgagcccaaactggtgctgatggatgaaccactcggggcgctggataagcagttacgtgagcatatgcaattggaaatcaaacagttacataaaatgcttgaattgaccattgtctacgtcacccatgaccaaagcgaagcaatgactctgtcaaatcgggtggtggtatttaacgatggtattattcagcaaatggatagcccaagcgtgatttatgaacagccaagcaatacttttgtggcgcaatttattggtgaaaacaactgcttactggccgttaatcagggcagtgacggggaatattaccgtgccatgttggacgatggcacccgcctgcaagcattaaaagtgtgccccagctcaccgggtaaaaaaattatgttatgtattcggccggagcgcgtcagtgtgaatcatcctgcggcgggcagccagcagatcaaggcccgcattcagcaatttatttatctgggggatcatgtgcggatgatgacggaagttgcaggccaagggaatttcatggtgaaactctctgccgcgcatatcgaaccacactggcagccgggaagtgaggtgttgctgtcgtggatgcctgcgcatttaagggcactggagggggtgacacactga

SEQ ID NO: 65789 - protein, 361 aa, Yersinia pestis CO92
MRTYVSFKNIKKSYDGDKLVVKNLNLDIHEGDFLTLLGPSGSGKTTSLMMLAGFETPTQGEITLRDKPLHNLPPHQRGIGMVFQNYALFPHMTVTENLAFPLTIRRLNKADIKEKIDRILDMVKLKNLADRYPAQMSGGQQQRVALARALVFEPKLVLMDEPLGALDKQLREHMQLEIKQLHKMLELTIVYVTHDQSEAMTLSNRVVVFNDGIIQQMDSPSVIYEQPSNTFVAQFIGENNCLLAVNQGSDGEYYRAMLDDGTRLQALKVCPSSPGKKIMLCIRPERVSVNHPAAGSQQIKARIQQFIYLGDHVRMMTEVAGQGNFMVKLSAAHIEPHWQPGSEVLLSWMPAHLRALEGVTH

SEQ ID NO: 65790 - DNA, 1146 bp, Caulobacter crescentus CB15
  CDS (1)..(1146): transl_table=11
gtgtgtcgggggatatccgcaatgaccacgccgaaacccatcatcaccttcgagaacgtcaccaagcgcttcggcaagctggcggccgtcgacaacgtgtcgctgacggtcaacgagggcgagttctttgcgctcttgggaccgtcgggctgcggcaagaccaccctgctgcggatgctggccggcttcgagacgcccaccgaagggcgcatcctgatcgacggccaggacatctccaacgtgccgcccaacaagcggccggtgaacatggtgttccagtcctatgcggtgttcccgcacatgactgtcgccgacaacgtcgcctacggcctgaaggtcgacaacgtgcccaaggccgagcgcgaggcgcgtgtcgccgaggcgctggagttggtgcaactgggcggcctgggcgggcgcaagcctgaccagctgtcgggcggtcaaaggcaacgggtcgcgcttgcccgagccctggtcaagcgcccccgcgtactgctgctggacgagccgctgtcggccctggacgccaagctgcgcgagcagatgcgcaccgagctgtgcaccctgcaggaaaaggtcgggatcaccttcatcatggtcacccacgaccaggacgaggccctggccctggcctcgcgctgcgcggtgatgagcaaggggctcctgcagcaggtggctacgcccagcgacctctatgagttccccaacagccgcttcgtcgccgacttcatcggccaggtgaacctgttcgagggcgtgctggcggtcgacgagcccagccacgcggtgatcaagtcgcccgacctcccggtcgacatcttcctggatcacggggtcaccgggccgcgtggcggcacggtgtgggcggcgatccgtcccgagaagatcgagctgcacaagaaggccgacgacaccccgcccaacctcggcgacgcgcccaaggggaccaacgccgtagagggcgtgatcaagcacgaggcctatctgggcggctcatccacctatgaggtcgagatcgccggcggtcgccgcgtcaaggtccagcgttcgaacctgacgcgctgggaccaggaagacttcaagctgggcgagaccgtctggctgtgctggcacgcctgttcacccgctgtgttgttgagctga

SEQ ID NO: 65791 - protein, 381 aa, Caulobacter crescentus CB15
MCRGISAMTTPKPIITFENVTKRFGKLAAVDNVSLTVNEGEFFALLGPSGCGKTTLLRMLAGFETPTEGRILIDGQDISNVPPNKRPVNMVFQSYAVFPHMTVADNVAYGLKVDNVPKAEREARVAEALELVQLGGLGGRKPDQLSGGQRQRVALARALVKRPRVLLLDEPLSALDAKLREQMRTELCTLQEKVGITFIMVTHDQDEALALASRCAVMSKGLLQQVATPSDLYEFPNSRFVADFIGQVNLFEGVLAVDEPSHAVIKSPDLPVDIFLDHGVTGPRGGTVWAAIRPEKIELHKKADDTPPNLGDAPKGTNAVEGVIKHEAYLGGSSTYEVEIAGGRRVKVQRSNLTRWDQEDFKLGETVWLCWHACSPAVLLS

SEQ ID NO: 65792 - DNA, 1080 bp, Sinorhizobium meliloti 1021
  CDS (1)..(1080): transl_table=11
atgaatagacccttcctgcagatccgcggcatccgcaaggagtatggcccggtgacggccgtgcaagatgttactctcgatgttgcacagggggaattcctgacctttcttggcccttcgggatccggaaaaagcacgacgctttacatcctggccggctttgagaacccgacgcgcggcgacatcttgctaaatggcgaaacgctgctggcgacgccttcgcacaaacgcaatatcggcatggtgttccagcgctacacgctgtttccgcatctttccgtcggcgagaatatcgcctttccgctaaaggtcaggcgtcttccgaaggcggagatcgacgccaaggtgcgcgcgatgctgaagctcgtccggttggaaggctttgaggaccgtaagcccgctcagatgtccggcggccagcagcagcgtgtggccttggcccgcgcactcgcctatgacccgccagtgctgctgatggatgagccgctttctgccctcgacaaaaagctgcgcgaggagatccagcacgaaatccgccggatccaccagcagacggaagtcacaatcctgtatgtcacgcatgaccaggaggaggcacttcgtctttccgatcgcatcgccgttttctcaaagggcgtgatcgatcagataggcacagggccggaactatacgccaacccggccactcggttcgtggccgagtttatcggcgacagcgattttcttccttgcgacgtggtctctacggtcaatggccgagccgagattgctgtgtgcggttccatgaccttttcgaacattccgcttcatgggactgcttctttggggagcaaagcggcgcttatgcttaggccggagcggctactgttgtcaaagacgaagtcagacatcgggttgccggtcacggtcagcgatatcaccttcctcggcaacaacgtccatgtggccacgaaaacccgcaaaggcaacgacctgtccgtccgccttcccttcggtcatgaagcgatctcgggactcaatcggggagatgccgtttggctcagattcgatgccgggtcggcgcacgttttcggtcagtga

SEQ ID NO: 65793 - protein, 359 aa, Sinorhizobium meliloti 1021
MNRPFLQIRGIRKEYGPVTAVQDVTLDVAQGEFLTFLGPSGSGKSTTLYILAGFENPTRGDILLNGETLLATPSHKRNIGMVFQRYTLFPHLSVGENIAFPLKVRRLPKAEIDAKVRAMLKLVRLEGFEDRKPAQMSGGQQQRVALARALAYDPPVLLMDEPLSALDKKLREEIQHEIRRIHQQTEVTILYVTHDQEEALRLSDRIAVFSKGVIDQIGTGPELYANPATRFVAEFIGDSDFLPCDVVSTVNGRAEIAVCGSMTFSNIPLHGTASLGSKAALMLRPERLLLSKTKSDIGLPVTVSDITFLGNNVHVATKTRKGNDLSVRLPFGHEAISGLNRGDAVWLRFDAGSAHVFGQ

SEQ ID NO: 65794 - DNA, 1119 bp, Sinorhizobium meliloti 1021
  CDS (1)..(1119): transl_table=11
ttgatcggtcaatctctgtcccttgcgggacttcaaaaacgatacggtgaggccctcgcggttcgcgagctgtcgctcgagatcgcagccggggaatttgtctcccttctggggccctccggctccggcaagacgacagccttgacgatgattgccggcttcgaaagcccaaatgccggcaagattgccatcggcggccgggacgtaacctttcttgcgcccaatcaccggaacatcggaatggtgttccagaagtacgcactctttccgcacctgacgatccgccagaacgtcgcattcccgctcaggatgcgcgggcgcatgcagaagaccgcgatcgcgcaacgcgtcgaggagatgctggatctggtgcaactctccagttacgcagagcgctatcccaaccagctctcgggcggtcaacagcaacgcgtcgccctcgcgcgggctctggcttttgaaccgcccgttctcctgatggacgaaccgcttggagcgctcgacaacaaattgcgagaggcgatgcagttcgagataaagcggctgcaggagcgacttggcgccacggtcgtctacgtgacccacgatcaggacgaagcgatgacgatgtcggatcgggtcgccatcatgtccaacggcggcctgatacaggtgggcacgccgacggagctctaccggcagccgaagaccgagttcgtcgcggacttcatcggccgaatgaattttctcgatggcgattgccttgactgtacggctgagcaaacggttgtccgtttctcggagagaaccgtgcttaggctccgtgctgcagcaaacgagcgagcgcgcaaatatgatgtcggaacggcgctgcgtgtggcaatccgtccggagcggatgcgccttgcgaagcgaggcgacggcggggcggacgcgctgccgggcgtcgtcgatgccgcggtgttcatcggttcgacatacatctttctcgtccgcctggccgatcgcccggaagtaagcctgcaggtgcaggtcgccgctgacggactgttgccattccaaagggacgacgaggtggacatcgtcctcgacggtgcagcaatgcacgtctttccagtggcagagaggtgcgccgcatga

SEQ ID NO: 65795 - protein, 372 aa, Sinorhizobium meliloti 1021
MIGQSLSLAGLQKRYGEALAVRELSLEIAAGEFVSLLGPSGSGKTTALTMIAGFESPNAGKIAIGGRDVTFLAPNHRNIGMVFQKYALFPHLTIRQNVAFPLRMRGRMQKTAIAQRVEEMLDLVQLSSYAERYPNQLSGGQQQRVALARALAFEPPVLLMDEPLGALDNKLREAMQFEIKRLQERLGATVVYVTHDQDEAMTMSDRVAIMSNGGLIQVGTPTELYRQPKTEFVADFIGRMNFLDGDCLDCTAEQTVVRFSERTVLRLRAAANERARKYDVGTALRVAIRPERMRLAKRGDGGADALPGVVDAAVFIGSTYIFLVRLADRPEVSLQVQVAADGLLPFQRDDEVDIVLDGAAMHVFPVAERCAA

SEQ ID NO: 65796 - DNA, 1080 bp, Sinorhizobium meliloti 1021
  CDS (1)..(1080): transl_table=11
atggagtcttccgtggccgaattcattcaatttgaccgcatcactaagttttacggccccctatgtgtggttgaaaacctcgttctcggtatcgggcagggcgagttcgtcagcctgctcggcccctccggctctggcaagacgacgctcctgatgatgctggcgggtttcgagcagccgacctccggcaatatcctgctggacgggacggcgatcaacgacgttccgacccacaagcgggacatgggcgtcgtctttcagagttatgccctgttcccgcatatgtcggtcggcgagaacgtcgccttcccgttgcagatgcgcggtttgggcaaagcggagattgccgagtgcgtggcgcgggcgctggacatggtgcaactgtcggccttcgcggaccgccggccctcacaactctccggtgggcagcaacagcgggtggcgctttcccgcgccctggtgttcgagccgcgcgtcgtgctgatggacgagccgctcggcgcgctcgacaagcagttgcgcgagcagatgcagttcgacatccgcgacctgcaccgccgccttggcctgacaatcgtcttcgtcacacatgaccagtcggaggcgctgaccatgtcggaccgcgtcgccgtcttcaacaggggcaaaatcgagcagatcggtacgccgcggcaggtctatgacgaaccggcgacgcgcttcgtcgcggaattcatcggcgagaccaatctggtcgaaggtgtcgtcgagaccgtgcaggggcaggaggcgatcgtgcgcctcccgtccggtgcgcacatcgtttcagccggttccggcagcttggtctctggccagtccgtttttctctccatccggccggagcgggtcgacctcagcgagacgcgcggcgacgctcgcaattgcctggaaacggaagtgaccgattccgtttaccaaggtgaccacctgcgcgtgcagttgcaaagcgccgcccatccgctgatcgccaagctcggtcgccggtcgcgcgaatttccgcctggcaccaaggtctatgcggccttttctgccaacgattgccgggtcatcgcaccatga

SEQ ID NO: 65797 - protein, 359 aa, Sinorhizobium meliloti 1021
MESSVAEFIQFDRITKFYGPLCVVENLVLGIGQGEFVSLLGPSGSGKTTLLMMLAGFEQPTSGNILLDGTAINDVPTHKRDMGVVFQSYALFPHMSVGENVAFPLQMRGLGKAEIAECVARALDMVQLSAFADRRPSQLSGGQQQRVALSRALVFEPRVVLMDEPLGALDKQLREQMQFDIRDLHRRLGLTIVFVTHDQSEALTMSDRVAVFNRGKIEQIGTPRQVYDEPATRFVAEFIGETNLVEGVVETVQGQEAIVRLPSGAHIVSAGSGSLVSGQSVFLSIRPERVDLSETRGDARNCLETEVTDSVYQGDHLRVQLQSAAHPLIAKLGRRSREFPPGTKVYAAFSANDCRVIAP

SEQ ID NO: 65798 - DNA, 1086 bp, Sinorhizobium meliloti 1021
  CDS (1)..(1086)
atgtccaatgattcaattcaggtcgagggaatcacaaagcgctatggcgcgatgacggccgtcgacaatgtatccttcgatgttggccagggggagttcgtgtcgctgctcggcccgagcggttgtggaaagaccacgacgctcaggatgatcgcgggcttcgtcgatccctccggcggcttactccgggtccgtggccgcgacgttacccacctaccgccggaaaagcgcgatctgggcttcgtcttccaaaattatgcactctggccccatatgacggtcgctgagaatgtcgctttcggcctgaaactgcgaaagaaaaatcggaacttcatccgcgacaaagtcgcggaagcgcttacgacaaccggcctctcggggtatgagaaccggctgccgcgccagctttcgggcgggcaacagcagcgcgtggcgctcgcccgcgcgctggcactggaaccgcaggttctactcatggacgagccgctctcgaatctcgaccgcgcgctccgcgtcaccatgcgccgggaactcaaggaactccaggcgcggatgaaaatgaccacactctacgtgacccacgaccaggaagaggcgctttcaatgtcgaaccgcgtggtgatcatgaacaaggggcaagtggaacaggttgcagcgccattcgagctttatgaaaatcctgcgaccggcttcgtggcagattttgtcggcattaccaatttcctcggaggcatcgtaacaagcgcggaaggcggaggagtcgaggtgaaactcggctcaggtcagatgttgcgcgcagttacgaaacaacccgtagctctggggaccaaggtgcgtgcactcattcgccccgaacgggtgacgctcaaaacgaccgccgctgacggcgacaacattttgacagggcaagtggtcctggccgaatatttcggcgcgctgctgcgctattcggtgcgcctcgacagcggtgatatcctgcgcgccgaagttcacaatttcgacagtttcatcgagagtggaagccgcgtctgggtttgcgtttcaccggaacatctgcgcctcattcccgacgagaggaatgcctga

SEQ ID NO: 65799 - protein, 361 aa, Sinorhizobium meliloti 1021
MSNDSIQVEGITKRYGAMTAVDNVSFDVGQGEFVSLLGPSGCGKTTTLRMIAGFVDPSGGLLRVRGRDVTHLPPEKRDLGFVFQNYALWPHMTVAENVAFGLKLRKKNRNFIRDKVAEALTTTGLSGYENRLPRQLSGGQQQRVALARALALEPQVLLMDEPLSNLDRALRVTMRRELKELQARMKMTTLYVTHDQEEALSMSNRVVIMNKGQVEQVAAPFELYENPATGFVADFVGITNFLGGIVTSAEGGGVEVKLGSGQMLRAVTKQPVALGTKVRALIRPERVTLKTTAADGDNILTGQVVLAEYFGALLRYSVRLDSGDILRAEVHNFDSFIESGSRVWVCVSPEHLRLIPDERNA

SEQ ID NO: 65800 - DNA, 1071 bp, Sinorhizobium meliloti 1021
  CDS (1)..(1071): transl_table=11
atgcagcctgtggtccacttcaaaaacgtcaacaaatattacggcggattgcctgcggtcgatgacctggacctcgccgtagaatccggacaattcgtgacgctgctcggcccctccggctgcggcaagtctacgacgctcaggatgctcggcggcttcgaacagccctcgtcgggggagatctatctggaaggcaagccgatcacccatctgccgccgaacagacgcaacgtcaacatcgtcttccaggactatgcgctctttccgcacctcaacgtcggccgcaacatcgccttcggactggagttgaaagggctgtcttcggacgcgatccacaagcggaccatggaactgctggctctcgtcaagctccaggatttcgccgaccgcatgcccgaccagctttcgggcggccagcgtcagcgcgtcgcgctgatgcgcgcgctcgcccccgacccgaacgtgcttctgctcgacgagcccctttcggcgctcgacgccaagctgcgccagcagatgcagatcgaactgaaaaccatccagcggaccaccggcaagaccttcatcttcgtcacccacgatcaggaggaggcgctgaccatgtccgacgtcatcgtggtgatgaacaaaggcaggatcgagcagatgggcggcccgaacgagctctattcccgcccgcgcagccgcttcgtcgccaacttcatcggccagagcaacttcctcgaaggcaagctgctttcccacgatggaacgaccgcggccatcgactggaacggaagcatcatccacgccgacctcaacgggacgaagctgccagccggcagcggcgcgaccgtcgcgcttcgtcccgaggcgctctactgcatggcggaacagccgaaggaccggttcgcactgagggggcgcatcgtccagcgcgtcttcaagggtgcgcacacctccctcacgatcgaactcgaaaatggcgcggagctggctttgcagctcgacccggtagcgctttcgcacctggagagggacgaggtgtgggtgggctggcgcgagcgcgacgcggtcgttctggccgactga

SEQ ID NO: 65801 - protein, 356 aa, Sinorhizobium meliloti 1021
MQPVVHFKNVNKYYGGLPAVDDLDLAVESGQFVTLLGPSGCGKSTTLRMLGGFEQPSSGEIYLEGKPITHLPPNRRNVNIVFQDYALFPHLNVGRNIAFGLELKGLSSDAIHKRTMELLALVKLQDFADRMPDQLSGGQRQRVALMRALAPDPNVLLLDEPLSALDAKLRQQMQIELKTIQRTTGKTFIFVTHDQEEALTMSDVIVVMNKGRIEQMGGPNELYSRPRSRFVANFIGQSNFLEGKLLSHDGTTAAIDWNGSIIHADLNGTKLPAGSGATVALRPEALYCMAEQPKDRFALRGRIVQRVFKGAHTSLTIELENGAELALQLDPVALSHLERDEVWVGWRERDAVVLAD

SEQ ID NO: 65802 - DNA, 1050 bp, Sinorhizobium meliloti 1021
  CDS (1)..(1050): transl_table=11
atgattgcccgttccctcacccttcgcaacatcaccaagacctatgacggcaggcatatggctgccgacgacgtttcgctcgacatcaaggccggcgagttcgtctccttcctcggcccctccggctccggcaagacgacgacgctgatgatgatcgccgggttccagcacccgacaagcggcgagatccgcctcggcgaacgcgcgatcgacaacctgccgccgcacaagcgcaatatcggcatggtctttcagaactatgcgctcttcccgcacatgacggtcgccgacaatgtgggatttccgctgcgcatgcgcggcgtcgccaagcaagacaaggagcgccgttgccgcgaggcactggccaaggtcgggcttcagggtttcgaagggcgcgtgcccgccgaactctccggcgggcagcagcagcgcgtggcgcttgcccgtgctctcgtcttcgaaccggacatcattctgctcgacgagccgctcggcgccctcgacaaggcgctgcgcgagcacatgcaggtggaactgaagcgcatccacaaggacctcggcgtcaccatggtctatgtcacccacgaccagtcggaggccatgaccatgtcagaccggatcgccgtcttcaatcagggccggatcgaacaggtcggcacgccgaacgagatctaccgcgcgccgaagacccgcttcgtcgcatccttcatcggcgacagcaacctcatcgagggctcctcgctgggcaacggaaggttcgacacgccggtcgggatcgtcgaggcgcggagccgccaagcggaccgcaaccgccgggccgatctgctgctgagaccagaaatgatccgcatcgccgaaacctcacaggacggacgccaaacgctgaagatcgacagcacgatcaactatggcgacaacctgctcgtcatcggaaagctcggcacgcagccaatccgcatgcgggtccccggcgccgatgcgcgcaggctcgaaggcatttccgaatgccacgtgacctggcgcgccgaggatgtccacgtgatcgcctga

SEQ ID NO: 65803 - protein, 349 aa, Sinorhizobium meliloti 1021
MIARSLTLRNITKTYDGRHMAADDVSLDIKAGEFVSFLGPSGSGKTTTLMMIAGFQHPTSGEIRLGERAIDNLPPHKRNIGMVFQNYALFPHMTVADNVGFPLRMRGVAKQDKERRCREALAKVGLQGFEGRVPAELSGGQQQRVALARALVFEPDIILLDEPLGALDKALREHMQVELKRIHKDLGVTMVYVTHDQSEAMTMSDRIAVFNQGRIEQVGTPNEIYRAPKTRFVASFIGDSNLIEGSSLGNGRFDTPVGIVEARSRQADRNRRADLLLRPEMIRIAETSQDGRQTLKIDSTINYGDNLLVIGKLGTQPIRMRVPGADARRLEGISECHVTWRAEDVHVIA

SEQ ID NO: 65804 - DNA, 1149 bp, Haemophilus influenzae Rd KW20
  CDS (1)..(1149): transl_table=11
ttggtgaaattagggagaaaaccaaagctagtggaaaatcagcttcaaaacaagcctattattgagcttcgttcaatcaaaaaatcctatggttctaacaccattattaatgatttcaatcttacaattaataacggtgagtttgtcactattcttggcccctcaggctgtggtaagaccacagttttacgcttacttgcaggcttagaagaattggattcaggtagcattattttagatggtgaagatatcaccaatgtgccagcggaaaaacgtcatattaatacggtattccaaagctatgcgctatttccacatatgacaatttttgagaacgtggctttcggtttgcgtatgcaaaaagtaccaaacgaggaaattaaaccgcgtgttttagaagccttgcgtatggtacagctagaagaaatggcggatcgtaagccaactcaactttctggcggacaacaacaacgtattgccatcgctcgtgccgtagtaaataaaccaaaagtgttgttacttgatgagtctttatctgcattggattacaaattgcgtaaacaaatgcagcaagaactcaaaatgttacaacgtcagcttggcattacctttattttcgtcacccacgatcaagaagaagcgattacaatgtctgatcgtattgtattattgcgtaaaggtaaaatcgcacaggatggttctccacgtgaaatctatgaagatccagctaacttattcgttgctcgtttcattggcgaaattaacgtatttgaagccactgtgattgaacgaaaatcagaacaagttgtactggcaaatgttgaaggtcgtatttgtgatatttatacggatatgcctgtggaaaaagatcaaaaacttcaagtactccttcgccctgaagatattgtgattgaagaattagatgaaaatgaacattctaaagcaattatcggtcatattattgaccgcacttataaaggaatgacattagaatcaacggtagagtttgatcataacggaatgcgtgtccttgtaagtgaattctttaatgaagatgatccacatatggatcatagcataggacaacgcgtaggtatcacatggcacgaaggctgggaggttgtactcaacgatgaagataatcaataa

SEQ ID NO: 65805 - protein, 382 aa, Haemophilus influenzae Rd KW20
MVKLGRKPKLVENQLQNKPIIELRSIKKSYGSNTIINDFNLTINNGEFVTILGPSGCGKTTVLRLLAGLEELDSGSIILDGEDITNVPAEKRHINTVFQSYALFPHMTIFENVAFGLRMQKVPNEEIKPRVLEALRMVQLEEMADRKPTQLSGGQQQRIAIARAVVNKPKVLLLDESLSALDYKLRKQMQQELKMLQRQLGITFIFVTHDQEEAITMSDRIVLLRKGKIAQDGSPREIYEDPANLFVARFIGEINVFEATVIERKSEQVVLANVEGRICDIYTDMPVEKDQKLQVLLRPEDIVIEELDENEHSKAIIGHIIDRTYKGMTLESTVEFDHNGMRVLVSEFFNEDDPHMDHSIGQRVGITWHEGWEVVLNDEDNQ

SEQ ID NO: 65806 - DNA, 1134 bp, Salmonella typhimurium LT2
  CDS (1)..(1134): transl_table=11
gtgaatgatgtcccccaccgcccgcaggtgaaaacccgtaaagcgctgacgccgcttctggaaattcgcaacctgacgaagtcattcgacgggcaacatgctgtcgatgatgtcagtctgactatctataaaggcgagatttttgccctgctgggcgcgtcaggttgtggaaaatcgactctgctacggatgctggcaggttttgaaccgccgagcagcgggcaaattatgctcgacggcgtcgatctggcgcatgttccgccgtatcagcgtccgattaatatgatgtttcagtcctatgcgttgtttccgcatatgacggtagagcagaacatcgcttttggtctgaagcaggacaaactgccgaaggcggagattaccagccgcgtcaatgagatgctgggtctggtgcacatgcaggagtttgcgaaacgtaagccgcatcagctttccggcggtcagcgtcagcgcgtggccctggcgcgcagcctggcgaaacgtcctaagctgctcttgttggatgaaccgatgggcgcgctggataaaaaattacgcgaccggatgcagctggaagtggtggatatccttgagcgcgtcggcgtgacctgcgtcatggtgacgcacgatcaggaagaagccatgacgatggcggggcgcattgccatcatgaaccgtggaaaatttgtgcaaattggcgaaccggaggagatttacgagcatccgacgacccgctacagcgccgaatttatcggatcggtaaatgtttttgagggcttactgaaagcgcgtgaggaggacggtctggtcattgacgcgcccggtttggttcatccgttaaaagtcgatgcagatgcctctgtcgttgataatgtgccggtatatgtggcgctacgtccggaaaaaatcatgctgtgtgagtcgccgcctgccgatggctataatttcgccgtcggcgaagtggcgcatattgcgtatctcggcgatctgtctatttatcatgtgcggctaaaaagcgggcagatgatcagcgctcaactgcagaatgcgcaccgttaccggaaagggttaccgacctggggcgatgaagtgcgtttgtgctgggaagcggatagctgcgtggtcctgacggtataa

SEQ ID NO: 65807 - protein, 377 aa, Salmonella typhimurium LT2
MNDVPHRPQVKTRKALTPLLEIRNLTKSFDGQHAVDDVSLTIYKGEIFALLGASGCGKSTLLRMLAGFEPPSSGQIMLDGVDLAHVPPYQRPINMMFQSYALFPHMTVEQNIAFGLKQDKLPKAEITSRVNEMLGLVHMQEFAKRKPHQLSGGQRQRVALARSLAKRPKLLLLDEPMGALDKKLRDRMQLEVVDILERVGVTCVMVTHDQEEAMTMAGRIAIMNRGKFVQIGEPEEIYEHPTTRYSAEFIGSVNVFEGLLKAREEDGLVIDAPGLVHPLKVDADASVVDNVPVYVALRPEKIMLCESPPADGYNFAVGEVAHIAYLGDLSIYHVRLKSGQMISAQLQNAHRYRKGLPTWGDEVRLCWEADSCVVLTV

SEQ ID NO: 65808 - DNA, 1146 bp, Nostoc sp. PCC 7120
  CDS (1)..(1146): transl_table=11
atgaatatggctcaaactgtaacgcagaatcccaggggcgtaaaaacactcctcccccttgatgttgaactacgtaacgtgttcaagtttttcaaccaagaaccggcggtacatggagtggacttagatgtaagacaaggggagttctttagtattcttggcccttctggctgtggtaagacaacgacactacgtttaatagccggatttgaacaagttgatgctggtaaattattgattcagggtcagccgatgaccaatattcccccttaccgccgaccagttaatacagtatttcaaagttacgctctatttaatcaccttaacgtctgggataatgttgctttcgggttgcggctaaagaaatcccggaaatcagaagtagaaagcagagttaaagaggctttaaagctggtaaaaatggaaagtttgcgatcgcgctttcctagccaactctccggtggtcaacagcagcgcgttgctttggctagggctttggtgaatcgtccggctgtggtgttgctggatgaacctttgggggcgttggatttaaagttacgtaaggaaatgcaggttgagttatcaaatttacataaaaacctgggtttaaccttcgttatggtaactcatgaccaagaagaggcgttatctttaagcgatcgcattgcggtgatgaatcaggggaaaattgaacaaattggtactccccaagagatttacgaacgtcctaaaacctcctttgtcgccgatttcatcggtgatactaatttgtttagtggtgaaatcaccgtattagaagctgaatatattcaaattgttaccaaaactggactcacaattgtagtcgcccgaaatgaagatacacccgcagaattattaaaacctgtagttgtgagtgtgcgaccagaaaaaattcaactttccctttatccgcctagttccctcaataactgttttgaaggaaggctgataaatgttatgtatttaggaactcacgttaattatgttgtccaattaattaacggtatgaatattaatgttttacaacctaatacttttggcaatttaccagaccgtgaaacacctatttatgcttggtgggcggaaagtgattgtttggctattaatcaaatgactaatgactaa

SEQ ID NO: 65809 - protein, 381 aa, Nostoc sp. PCC 7120
MNMAQTVTQNPRGVKTLLPLDVELRNVFKFFNQEPAVHGVDLDVRQGEFFSILGPSGCGKTTTLRLIAGFEQVDAGKLLIQGQPMTNIPPYRRPVNTVFQSYALFNHLNVWDNVAFGLRLKKSRKSEVESRVKEALKLVKMESLRSRFPSQLSGGQQQRVALARALVNRPAVVLLDEPLGALDLKLRKEMQVELSNLHKNLGLTFVMVTHDQEEALSLSDRIAVMNQGKIEQIGTPQEIYERPKTSFVADFIGDTNLFSGEITVLEAEYIQIVTKTGLTIVVARNEDTPAELLKPVVVSVRPEKIQLSLYPPSSLNNCFEGRLINVMYLGTHVNYVVQLINGMNINVLQPNTFGNLPDRETPIYAWWAESDCLAINQMTND

SEQ ID NO: 65810 - DNA, 1092 bp, Ralstonia solanacearum GMI1000
  CDS (1)..(1092): transl_table=11
atgaagaccgacgacgtgatcgtcagctttcgcggtgtgcgcaagacctacgacggcgagaccctggtggtcaagcacctggacctggacatctatcagggcgagttcctgacgctgctcggcccgtccggctccggcaagacgacctgcctgatgatgctggccggcttcgagtttccgaccggcggcgagatccgcctcgaaggcaccctgctcaacaccgtgccgccgcacaagcgcaacatcggcatggtgttccagaactacgcgctgttcccgcacctcacggtcgcgcagaacgtcgagtacccgctcaccgtgcgcaagcttgccgccgccgagcgcgccgagcgtgtccaccatgccctgaagatggtgcgcatggagggcttcgccaagcgctatcccgcgcagctctccggcggccagcagcagcgcatcgccctggcgcgcgcgctggtgttcgagcccaagctggtgctgatggacgaaccgctcggcgcgctcgacaagcagctgcgcgagcatatgcagtacgagctgaagtcgctgcacgagaagctgggcgtgaccttcgtctacgtcacgcacgaccagggcgaggcgctgaccatgtccgaccgcgtggccgtgttcgacaagggcgtggtgcagcagctcgacacggtcgaccgcctctacgaatccccctgcaacgcattcgtcgccaacttcatcggcgacagcaacacgctgcgcggcactgtcgtcggcctcgacggcgactactgccaactgcaattgaacgacggcgcgcgcgtgatcggccgcaacgtcgccggcgcgccggtcggggccgccgccgtcggctgcatccggcccgagcgcatgcgcctggccgagcccgccgatgccggcgccggcaacgcgctcgccggccagacgcgcggcctggtgtatttcggcgaccacgtccgcatgcgctgcgccctgcccgagcaggcggagtgcttcgtcaaggtgccgctcggcacgcgcgcgctcgaatcgttcgcgccgggcgcgccgatccggctggaattcgcgcccgagcacctgcgcgtcttcacctga

SEQ ID NO: 65811 - protein, 363 aa, Ralstonia solanacearum GMI1000
MKTDDVIVSFRGVRKTYDGETLVVKHLDLDIYQGEFLTLLGPSGSGKTTCLMMLAGFEFPTGGEIRLEGTLLNTVPPHKRNIGMVFQNYALFPHLTVAQNVEYPLTVRKLAAAERAERVHHALKMVRMEGFAKRYPAQLSGGQQQRIALARALVFEPKLVLMDEPLGALDKQLREHMQYELKSLHEKLGVTFVYVTHDQGEALTMSDRVAVFDKGVVQQLDTVDRLYESPCNAFVANFIGDSNTLRGTVVGLDGDYCQLQLNDGARVIGRNVAGAPVGAAAVGCIRPERMRLAEPADAGAGNALAGQTRGLVYFGDHVRMRCALPEQAECFVKVPLGTRALESFAPGAPIRLEFAPEHLRVFT

SEQ ID NO: 65812 - DNA, 1158 bp, Agrobacterium tumefaciens str. C58
  CDS (1)..(1158): transl_table=11
atggcaaagacactcggaccggtcaaacgcaaattcagcccttgggacaatcccgatgcggtgcctttcatccgatttgaaaacgtcaccaagcgctttggcgattttgtcgccgtcaacaatctgacgctcgatatttacgagcgcgaattcttctcgctgcttggtccttccggttgcggcaagaccacgctgatgcgcatgctggccggtttcgaggaaccgaccgagggtcgtatcctgctgcaaggcaaggatatttccggcgtgccgccctataagcgccccaccaacatgatgttccagtcctatgcgcttttcccgcatatgtcggtggaaaagaacgtcgccttcggcctcgagcaggatggccttcccaaggcggatatcgctgcccgcgtcgaggaaatgctgcggctcgtcaagctcacggagtttgccaagcgcaagccaagccagctttccggtggccagcgccagcgcgtggcgctcgcccgttcgcttgccaagcggccgaaggtgctgctgctggacgaaccgctcggcgcgctcgacaagaagctgcgcgaagaaacgcagttcgagctgatggatatccagaccaatctcggtctcaccttcctcatcgtcacccatgatcaggaagaggcgatgacggtgtcggaccgcatcgcggtcatggacaagggcaacgtcgtgcaggtggcgacgccggccgagatctatgaagcgccgaatacccgttatgtggccgacttcatcggcgacatcaatattttcgacgcccacgtcgtggccaacgcctccgatatcggcaagcccggtctggtgacgatggactgcgacggtctgaaagtttcagtggaacaggagtgtgccgccgccgccggcagccaggtggcttacgccattcgcccggaaaaggtccgcatctcgctcgaccagcccgccgacagcagcatcaattccgcctatggcgaagtctgggacatcggttatctcggtgatttttcggtattcatcgtcaagctggccgatggtcgcgtcatccgcgccgcgcaggcgaacgtctcgcgtctcgtcgatcgccccatcactttcggcgatatggtgtggctgaactggaaaccggattcagggcttgtcctgacacgctga

SEQ ID NO: 65813 - protein, 385 aa, Agrobacterium tumefaciens str. C58
MAKTLGPVKRKFSPWDNPDAVPFIRFENVTKRFGDFVAVNNLTLDIYEREFFSLLGPSGCGKTTLMRMLAGFEEPTEGRILLQGKDISGVPPYKRPTNMMFQSYALFPHMSVEKNVAFGLEQDGLPKADIAARVEEMLRLVKLTEFAKRKPSQLSGGQRQRVALARSLAKRPKVLLLDEPLGALDKKLREETQFELMDIQTNLGLTFLIVTHDQEEAMTVSDRIAVMDKGNVVQVATPAEIYEAPNTRYVADFIGDINIFDAHVVANASDIGKPGLVTMDCDGLKVSVEQECAAAAGSQVAYAIRPEKVRISLDQPADSSINSAYGEVWDIGYLGDFSVFIVKLADGRVIRAAQANVSRLVDRPITFGDMVWLNWKPDSGLVLTR

SEQ ID NO: 65814 - DNA, 1059 bp, Agrobacterium tumefaciens str. C58
  CDS (1)..(1059): transl_table=11
atgagctttttgacacttagcaacatcaagaaatccttcggctccgtgcaggtcgtgcatgatttcaacatggccatcgaaaagggcgaattcgtctcctttctcgggccatcgggctgtggcaagaccaccgtgctgcgcatgatcgccggtttcgaaatcccgaccggcggatcgatcgtcatcaacggcaaggaccagacgacgctcagaccgaaccagcgcaatatcggcatggtgttccaggcctatgccctgttcccgaacatgaatgtctatgaaaacgtcgccttcggtctgaaagtcgccggcaaaccaaaagccgagatcgacgcccgcgtgaaggaaatgctccagctcatccatctggaacatctggcggaccgctacccctatcagatgtcgggcggtcagcagcagcgcgtggcgctcgcccgggcgcttgcgccgaagccggaagtgcttctgctggacgaaccgctctccgccctcgacgccaagatccgcgtctcgctgcgtgaggaaatccgccagatccagcagaaactcggcatcaccaccattttcgtgacccacgatcaggaagaggccctgtcgatatccgaccgcatcgtcgtgatgaatggcggccgtgccgaccagatcggttcgcccttcgatatctacaacaaacccgccacccgcttcgtcgcctccttcgtcggtacgttgaacctcatcgacgccaccgtggtggattcctcatccaataccatccgtgtcggagagcagcagatcaccctgccgaagccggtcgatgcagcgaatggcgaaaaaatcacgctggcacttcgcccggaagcaggttccctcggcagcgatgcgaaaggcgatgttgccatttccggcctcgtcacctccagccagttcctcggctccgtcatccgcacccgccttgatctgggcggttcgacgctgtccttcgacatgttcaacgaccccggcacagcgccgcccgctgtcggtgagcgggtgacactgaaattcgctgccggcgacctgatgctcatcaaggactga

SEQ ID NO: 65815 - protein, 352 aa, Agrobacterium tumefaciens str. C58
MSFLTLSNIKKSFGSVQVVHDFNMAIEKGEFVSFLGPSGCGKTTVLRMIAGFEIPTGGSIVINGKDQTTLRPNQRNIGMVFQAYALFPNMNVYENVAFGLKVAGKPKAEIDARVKEMLQLIHLEHLADRYPYQMSGGQQQRVALARALAPKPEVLLLDEPLSALDAKIRVSLREEIRQIQQKLGITTIFVTHDQEEALSISDRIVVMNGGRADQIGSPFDIYNKPATRFVASFVGTLNLIDATVVDSSSNTIRVGEQQITLPKPVDAANGEKITLALRPEAGSLGSDAKGDVAISGLVTSSQFLGSVIRTRLDLGGSTLSFDMFNDPGTAPPAVGERVTLKFAAGDLMLIKD

SEQ ID NO: 65816 - DNA, 1113 bp, Agrobacterium tumefaciens str. C58
  CDS (1)..(1113): transl_table=11
ttgataggtgagactctaaatcttgacgggctcgcgaagagctatggcaacgtcgttgcagtcgctggtgttgacgtccgcgtggagccaggcgagttcgtgtcagtgctgggcccatctgggtcaggcaagaccagcgtcctgacgatgattgccggttttgagcgtcccacggcaggcaggatcgtgatcggcgaccgagacgtgaccgaccttgcgccgaataagcgaaatatcgggatggtctttcagaaatacgcgcttttcccccatctcactgtccgtcagaacattgctttcccgctaaagctcagatcgcggtggcgctccggatggaggcagcgggcagacgacatgcttgacctcgttcacctagccggttttgctgacaggtttccttctgaactttcgggtggccagcagcagcgtgtggcggtcgcacgagcgcttgcgtttgagccgcccgttatgctgatggacgagcccctcggcgcgcttgacaagaaattgcgtgaagccatgcagttcgaaatcaagcgcatccagagacaggtgggagcaaccgtcctttacgtaacgcatgatcaggaagaagcgctgacgatgtccgatcgcgttgcgataatgcagggcggaaacatcgtccagataggggctccttctagtctttaccacgcgcccgcaacccgttttgttgctgatttcgtcggaaaaatgagcttcgtcggaggagagattgtttcttttgaagacgacgggatgctcgtgcgattggcggacgacgtatttgtccggaccgcttctgtcgatgcggcacgggcggcactccggcttggtgacgaggtaatcctggccatgcgtcccgagaggatcgccttgaaaaaacgaggtcctcgaggttttggggcaataccagctcagatcgagagccttgcattcgttggatcattccatgcgtacatggtccgtctggacctgcctggatcaccgctggtggaggttcaggtcgtgaccggaagtgaggtaaatttccgcgccggtgatacggtcgatctcgtacccgacccgcaggctgtcagctttttttcaaaagaggagacgtctgcggcatga

SEQ ID NO: 65817 - protein, 370 aa, Agrobacterium tumefaciens str. C58
MIGETLNLDGLAKSYGNVVAVAGVDVRVEPGEFVSVLGPSGSGKTSVLTMIAGFERPTAGRIVIGDRDVTDLAPNKRNIGMVFQKYALFPHLTVRQNIAFPLKLRSRWRSGWRQRADDMLDLVHLAGFADRFPSELSGGQQQRVAVARALAFEPPVMLMDEPLGALDKKLREAMQFEIKRIQRQVGATVLYVTHDQEEALTMSDRVAIMQGGNIVQIGAPSSLYHAPATRFVADFVGKMSFVGGEIVSFEDDGMLVRLADDVFVRTASVDAARAALRLGDEVILAMRPERIALKKRGPRGFGAIPAQIESLAFVGSFHAYMVRLDLPGSPLVEVQVVTGSEVNFRAGDTVDLVPDPQAVSFFSKEETSAA

SEQ ID NO: 65818 - DNA, 1116 bp, Agrobacterium tumefaciens str. C58
  CDS (1)..(1116): transl_table=11
atgtcgcagacctcgaatgcagcagaaggcaagcagcttagcgttcgtggcctgacccatagctatggcggactgaatgcgatcagcgacatttctttcgagatagccgccggtgagatcgtcgcgctcctcggaccgagcggctgcggaaaatccaccgtgttgcgcgccatcgcaggcctgatccaaccgaaaagcggtgtgatccagctcggaggcgaagacatcgccaatgtttcggcgcgtgcgcgcggtatcggcatggttttccagaactatgcgctgtttccacacctgacggtcgccgagaacatcgcctatccgctggcatgccagaaagtgggacgcaccgagcgccgcgagcggattgaggaaatgctctcgctcgtgcagttgaagggatttggccatcggctgccgcgtgagctttccggtggccagcagcaacgcgtggcagtggcccgcgcgattgccggaaggccttcacttctgcttctcgacgaaccgttcggtgccttggaccgggcgctccgtttcgacctgcaggtcgagcttctccatctgcagaagacgcttggcatcacgacgttgatcgtgacgcatgaccaggaggaggcgcagagcctagctggccgtctggtgctcatgaacaagggcaatgtcgagcaaattgatacaccgatggccgtttatgaccgaccgaggtctctcttcgtcaataccttcatcggtcaggccaatgtgttgcatggaacggtggaccgggtggaggcggaggcaaccaccatctccctcgcgaatggcagggtcctcgttctgccgcgccgcctgaatttcacgacgggctccaagatcacgatcacctgccgccccgaagatgtgcgtctgtctgcggcaccgggcgcaccggccctgccggcacggctgaccgtgtcagtgccgcttggtcccacccttgtccatgatctccttctcgaagacgggacaaaccttcgctcctcggaggtccgcggaccttcgaccttcattcccgagccgggagcagagctctttgccgagatagacaccatcaggtgtcacgcctttccgagcgaaccggaagcatcccgtgaataa

SEQ ID NO: 65819 - protein, 371 aa, Agrobacterium tumefaciens str. C58
MSQTSNAAEGKQLSVRGLTHSYGGLNAISDISFEIAAGEIVALLGPSGCGKSTVLRAIAGLIQPKSGVIQLGGEDIANVSARARGIGMVFQNYALFPHLTVAENIAYPLACQKVGRTERRERIEEMLSLVQLKGFGHRLPRELSGGQQQRVAVARAIAGRPSLLLLDEPFGALDRALRFDLQVELLHLQKTLGITTLIVTHDQEEAQSLAGRLVLMNKGNVEQIDTPMAVYDRPRSLFVNTFIGQANVLHGTVDRVEAEATTISLANGRVLVLPRRLNFTTGSKITITCRPEDVRLSAAPGAPALPARLTVSVPLGPTLVHDLLLEDGTNLRSSEVRGPSTFIPEPGAELFAEIDTIRCHAFPSEPEASRE

SEQ ID NO: 65820 - DNA, 1068 bp, Brucella melitensis 16M
  CDS (1)..(1068): transl_table=11
ttgacggactatcgcacccgctttgaaaatatcagtaaatcctatggcgatttcaaagttatagacggcctgaacctcgatatcgaacggggcgaattcgtaagcctgctggggccctcggggtcgggcaagaccacccttttgatgatgctcgccggttttgaaaatccaagtagcggcacgatccatgtggacggaaagtccatcaactccgtcccttcctataagcgcaatatgggcgtcgttttccagaattatgcgctgtttccacatatgacggtggcggaaaacattgcctttcccttgcagatgcggggggtgggcaaggcgcaagcagctgagaaggtcgcgcgcgtgctggatatggtgcagctttcggccatgagcgagcgtaaaccatcgcaactttcgggtggtcagcaacagcgtgtcgctttggcgcgtgcgctggtgttcgagccgcatgtggtgctgatggatgagccgctcggcgcgctcgacaagcagttgcgcgagcagatgcagcttgatatccgcgccctgcacaaccggcttggcctcaccatcgttttcgtcacacatgaccagagcgaggcactcaccatgtcggaccgcatcgcggtcttcaacaagggcaagatcgagcagatcggctcgccacgcgctatttatgacgagccgcagacacgtttcgtcgccgaattcatcggcgagacgaacctggccgaaggcacggtggaaagcgttgaaggttcaagaattcttatccgtttgaaggacgccaccgccattgccgcttcatccgcttccaggcccatcagcggccagaatgtgcttctttccattcgcccggagcgcatcgagcttggagaggcggatggcgcggaaaaccggctggcggcgcgcgtgatggacagtgtttatcagggcgaccatctgcgtatccagcttgaggccaaggcgcataattttgtggttcgccttgatcgcaaggcgcgcgaatggcagccgggtgcggacgtggccgcaagcttcaaggccgccgattgctggaccatcctcgtatga

SEQ ID NO: 65821 - protein, 355 aa, Brucella melitensis 16M
MTDYRTRFENISKSYGDFKVIDGLNLDIERGEFVSLLGPSGSGKTTLLMMLAGFENPSSGTIHVDGKSINSVPSYKRNMGVVFQNYALFPHMTVAENIAFPLQMRGVGKAQAAEKVARVLDMVQLSAMSERKPSQLSGGQQQRVALARALVFEPHVVLMDEPLGALDKQLREQMQLDIRALHNRLGLTIVFVTHDQSEALTMSDRIAVFNKGKIEQIGSPRAIYDEPQTRFVAEFIGETNLAEGTVESVEGSRILIRLKDATAIAASSASRPISGQNVLLSIRPERIELGEADGAENRLAARVMDSVYQGDHLRIQLEAKAHNFVVRLDRKAREWQPGADVAASFKAADCWTILV

SEQ ID NO: 65822 - DNA, 1062 bp, Brucella melitensis 16M
  CDS (1)..(1062): transl_table=11
atggcttttctgaatatcaaaaacctgaaaaagagcttcggcaccaatacggtcgtccatgatttcaacctcgccgtggaaaagggtgaattcgtctcctttctcggcccatcgggctgcggcaagaccacagttctgcgcatgattgccggctttgaaaccccggacaacggctcgattgaaatcgacggcaaggacgtggtgaacctgaggcccaaccagcgcaatatcggcatggtgtttcaggcttatgcgctctttcccaatatgaccgttgcacagaacgtttcgttcggcctgcgcgtttcgggcaagtcccgctcggaaatcgatgccaccgtgaaggaaatgctgagcctcatccggctcgaccatctggccgaccgctacccctaccagatgtccggtggccagcagcagcgcgtggcgcttgcccgtgcactcgccaccaagccgcaggttctcctgctcgacgagccactttcggcgctcgatgcgaaaatccgcatatccttgcgggaagaaatccgcgccatccagcaaaagctcggcatcaccacggttttcgtcacgcatgaccaggaagaggcgctgtcgatctccgaccgcatcgtggtgatgcatgaaggccgcgccgaccagatcggctcacccttcgatatttataaccgcccggcctcgcgcttcgtcgcatccttcgtcggcacgctcaacatgctggaagcttctgtcagcgaaccggcacagaacagcatcgatctcgacgggcgccagatcaccgtgcaggaaacgctcgctcatcaccccaagggcaagccattgacgctggcgctccgcccggaggcggtgagccttgaagcccgcaagagccacgacacttcgctggaagccactattgatgacgtgcacttcctcggctccgtcatccgtacgcgcgtgatactcggcaagaaccggctgtccttcgacacgtttaacgacccgacccacccgccgccacaacgcggcgacaaggtgaaagtgcatttcgcctcacacgatcttctcgtgctggcagattag

SEQ ID NO: 65823 - protein, 353 aa, Brucella melitensis 16M
MAFLNIKNLKKSFGTNTVVHDFNLAVEKGEFVSFLGPSGCGKTTVLRMIAGFETPDNGSIEIDGKDVVNLRPNQRNIGMVFQAYALFPNMTVAQNVSFGLRVSGKSRSEIDATVKEMLSLIRLDHLADRYPYQMSGGQQQRVALARALATKPQVLLLDEPLSALDAKIRISLREEIRAIQQKLGITTVFVTHDQEEALSISDRIVVMHEGRADQIGSPFDIYNRPASRFVASFVGTLNMLEASVSEPAQNSIDLDGRQITVQETLAHHPKGKPLTLALRPEAVSLEARKSHDTSLEATIDDVHFLGSVIRTRVILGKNRLSFDTFNDPTHPPPQRGDKVKVHFASHDLLVLAD

SEQ ID NO: 65824 - DNA, 1032 bp, Clostridium perfringens str. 13
  CDS (1)..(1032): transl_table=11
atggatttaataaacctacagaatataaatgtttcttatgataagaaaaataatatattggaaaatctaaatttaaaagttaaaaaaggagaattagtttctcttttaggaccaagtgggtgtggaaagacaacaacattaagggttgtagctggatttatagaaccaacagcaggaaagtttttattaggagatgaagattatacaaatatacctgttcataatagaaactttggattagtctttcaaagctatgcattatttcctcacttaacagtagaagaaaatgtagcttttggattaaaaatgaaaaagatgagcaaagaagaaataagaaaaaaggttgatgatatattaaaagttgttgatatgagccatttagcaaagaggtatccaaaggaattatctggaggacaaagacaaagggttgccatagcaagagccttagtaatagagccaagtcttttattactagatgaacctttaagcaacttagatgctaaattaagattaaaaatgagagttgaaataagaaaacttcaacaaaagcttggaataacaacattattcgtaactcatgaccaagaagaatgtttttcaatttcagataaagtagcagttttaaataaaggggtaatagaacaatttgatactccagaaaatatttattcaaatccagcaacagagtttgttgcaagatttgtaggttttgaaaactttatagatttaataaaggtatcagatggtatatacaaaaatgagagtggaattaacttaaaagttaacaaggttaaggataagaatgaagtaaaagcaactataagaccagatgatataaagattgtaaaagaggatttagaaaacacagtaaatggagttatagaggttagaactttcttaggaaaggcataccaatatgatattaaaacaaaacttgggaatctaattgtaaatagtgaaaatgacagcatatatgaaaagggacaaaatataaaacttcaattaccagtggataaaatagtaattttataa

SEQ ID NO: 65825 - protein, 343 aa, Clostridium perfringens str. 13
MDLINLQNINVSYDKKNNILENLNLKVKKGELVSLLGPSGCGKTTTLRVVAGFIEPTAGKFLLGDEDYTNIPVHNRNFGLVFQSYALFPHLTVEENVAFGLKMKKMSKEEIRKKVDDILKVVDMSHLAKRYPKELSGGQRQRVAIARALVIEPSLLLLDEPLSNLDAKLRLKMRVEIRKLQQKLGITTLFVTHDQEECFSISDKVAVLNKGVIEQFDTPENIYSNPATEFVARFVGFENFIDLIKVSDGIYKNESGINLKVNKVKDKNEVKATIRPDDIKIVKEDLENTVNGVIEVRTFLGKAYQYDIKTKLGNLIVNSENDSIYEKGQNIKLQLPVDKIVIL

SEQ ID NO: 65826 - DNA, 1050 bp, Clostridium perfringens str. 13
  CDS (1)..(1050): transl_table=11
ttgaaagataataatattattgaattaaaaggaataactaaatcatatggaaaagatacaattttagataatctttccctaaatataaaaaagaatgaattcctaactcttttaggacctagtggatgtggtaaaacaaccactttaaaaattatagctggctttgaaacggcagatagtggccaggtggtctttgaaaataatattattaacgatataccaccttacgaaagacaattaaatactgtattccaaaaatatgctctattccctcatatgaatgtatatgaaaatatagcttttggattaaaactaaaaaaaatgcctaaagatgttatagatcaaaaagttaaggaaatgcttaagttagttgcccttgaaggatatgaaaacagagatattgaagcccttagtggtggtcaacaacaaagggttgccatagctagagctttagtaaatgaaccaaaggtacttttattagatgagccacttggtgcattagatatgaaacttagaaaaggaatgcaaatagagcttaagagaattcaacaaaaattaggaattacatttatatttgtaactcatgatcaagaagaagctttaacaatgtcagatacaatagttgttatgaataaaggtgaaattcaacaaatgggaagcccagaagatatatataatgaacctgctaactcatttgtagcaaaattcatcggtgaaagtaatatagttgatggaactatgttagatgactttaaggttgaatttgctggaagaatatttaactgtgttgataaaggttttgaaaagaacgaagctattgaagttgtaataagaccagaggattttgaaatggttaaatatgaagaaggtatgttaaaaggaactgttacttcagttatatttaaaggtgttcactatgaaatagaagtaaaggatgaaaaccacacttggatattacacaatacaaaacatgctgaaataggatctaaaataggattatctcttgatccagaaagcatacacataatgaaaaaagagagtgatgtttaa

SEQ ID NO: 65827 - protein, 349 aa, Clostridium perfringens str. 13
MKDNNIIELKGITKSYGKDTILDNLSLNIKKNEFLTLLGPSGCGKTTTLKIIAGFETADSGQVVFENNIINDIPPYERQLNTVFQKYALFPHMNVYENIAFGLKLKKMPKDVIDQKVKEMLKLVALEGYENRDIEALSGGQQQRVAIARALVNEPKVLLLDEPLGALDMKLRKGMQIELKRIQQKLGITFIFVTHDQEEALTMSDTIVVMNKGEIQQMGSPEDIYNEPANSFVAKFIGESNIVDGTMLDDFKVEFAGRIFNCVDKGFEKNEAIEVVIRPEDFEMVKYEEGMLKGTVTSVIFKGVHYEIEVKDENHTWILHNTKHAEIGSKIGLSLDPESIHIMKKESDV

SEQ ID NO: 65828 - DNA, 1131 bp, Fusobacterium nucleatum subsp. nucleatum ATCC 25586
  CDS (1)..(1131): transl_table=11
ttggaaaaaaaagatataaatatagttaatgtaaataaaagttttgatggagttcaaattttgaaagacattaatttaaagatagaacagggagaatttttttctataataggtccatcaggttgtggtaaaaccacacttttaagaatgatagctggatttatttctccagatagtggggctatatatcttggtgatgaaaatatagttaacttaccaccaaatcttagaaatgtaaatactatatttcaaaaatatgctcttttcccacatttgaatgtttttgaaaatgtagcatttcctttaagacttaaaaaagttgatgaaaaaacaataaatgaagaagttaataaatatttaaaacttgtgggcttggaagaacacagcacaaaaaaagttagccaattatcaggaggacaacaacaaagaatttcaatagcaagagctttaatcaataaaccaggagttctattgctggatgaacctttatcagctcttgatgcaaaattaaggcaaaatcttttaatagaacttgacttaattcatgatgaagttggaataacttttatctttattacccatgatcaacaagaagccctttctatctcagatagaatagcagttatgaatgcaggaaaagttttacaagttggtactcctgctgaagtctatgaagctcctgctgatacttttgttgcagatttcttaggagaaaataattttttcagtggaaaggttactgagattataaatgaagaattagctaaaataaatttagaaggtattggagaaataattattgaactggataaaaaggttaaaattggggataaggttactatctctttaagacctgaaaaaataaaactttctaaaaacgaaataaaaaagactaaaaattacatgaatagcgcagctgtttatgttgatgaatatatttattctggtttccaaagtaaatattatgtacatttaaaaaataatgaaaagttaaaatttaaaatctttatgcaacatgcagctttctttgatgataatgatgaaaaagctatatggtgggatgaagatgcttacatcacttgggatgcctatgatggttatctagtggaggtggaaagtgaaaaaaaatag

SEQ ID NO: 65829 - protein, 376 aa, Fusobacterium nucleatum subsp. nucleatum ATCC 25586
MEKKDINIVNVNKSFDGVQILKDINLKIEQGEFFSIIGPSGCGKTTLLRMIAGFISPDSGAIYLGDENIVNLPPNLRNVNTIFQKYALFPHLNVFENVAFPLRLKKVDEKTINEEVNKYLKLVGLEEHSTKKVSQLSGGQQQRISIARALINKPGVLLLDEPLSALDAKLRQNLLIELDLIHDEVGITFIFITHDQQEALSISDRIAVMNAGKVLQVGTPAEVYEAPADTFVADFLGENNFFSGKVTEIINEELAKINLEGIGEIIIELDKKVKIGDKVTISLRPEKIKLSKNEIKKTKNYMNSAAVYVDEYIYSGFQSKYYVHLKNNEKLKFKIFMQHAAFFDDNDEKAIWWDEDAYITWDAYDGYLVEVESEKK

SEQ ID NO: 65830 - DNA, 1194 bp, Streptomyces coelicolor A3(2)
  CDS (1)..(1194): transl_table=11
atgacgacgaatccgacgaagaaccagacggccgcgaaggacggcggcggcgacgtccgcctcgccggcatcagcaagacctacggctccttcaccgccgtgcacccgctcgacctgaccgtgccccagggctccttcttcgccctgctcggcgcctccggctgcggcaagaccaccaccctgcgcatgatcgccggactggaggagccgagcggcggcaccgtccacctcggcgaccaggacgtgaccgcgctgccgccctacaaacggccggtcaacacggtcttccagtcctacgccctcttcccgcacctggacatctacgagaacgtcgccttcggcctgcgccggcgcggcatcaagagcgtgaagaagcaggtcggcgagatgctcgacctggtgcagctcggtgagcaggcgcgcaagaagccgcaccagctctccggcggccagcagcagcgcgtagcagtcgcccgcgccctgatcaaccaccccaaggtgctgctcctcgacgaacccctcggcgccctcgacctcaagctgcgccgccagatgcaactggagctcaagcgcatccagaccgaggtcggcatcaccttcgtgcacgtcacccacgaccaggaggaggccatgacgatggccgaccaggtcgccgtgatgaacgcgggccgcgtcgagcaactgggcgcccccgccgacctgtacgagaacccgaggaccacgttcgtcgccaacttcctcggcacctccaacctcatcgaggccgaggtcgacacccgcagcggcgacgacgtcgtcgtgaaggcggccggtgacaagctcgtcctgcccggcgccaggtgctccgccccggcgaaaacgggcggcaaggtcctggtcggggtccgccccgagaagatcagcctcacccacgcggacgacgcgggctccatccccgagggccgcaaccggatcaccggcaggatcggcagcaccagtttcatcggcgtctccacccagtacgtggtcgactgcgccgcctgccccgagttcgaggtctacgcccagaacatcgaccgcgacccccgcctcacgcccggcgccgaggtcgtcctgcactggaacccggcgcacaccttcgggctcgacgccgaccagtccgtgcttgcagggacgatgggcgacgcgggtgtcgccgagggcgaggccgcctga

SEQ ID NO: 65831 - protein, 397 aa, Streptomyces coelicolor A3(2)
MTTNPTKNQTAAKDGGGDVRLAGISKTYGSFTAVHPLDLTVPQGSFFALLGASGCGKTTTLRMIAGLEEPSGGTVHLGDQDVTALPPYKRPVNTVFQSYALFPHLDIYENVAFGLRRRGIKSVKKQVGEMLDLVQLGEQARKKPHQLSGGQQQRVAVARALINHPKVLLLDEPLGALDLKLRRQMQLELKRIQTEVGITFVHVTHDQEEAMTMADQVAVMNAGRVEQLGAPADLYENPRTTFVANFLGTSNLIEAEVDTRSGDDVVVKAAGDKLVLPGARCSAPAKTGGKVLVGVRPEKISLTHADDAGSIPEGRNRITGRIGSTSFIGVSTQYVVDCAACPEFEVYAQNIDRDPRLTPGAEVVLHWNPAHTFGLDADQSVLAGTMGDAGVAEGEAA

SEQ ID NO: 65832 - DNA, 1134 bp, Xanthomonas axonopodis pv. citri str. 306
  CDS (1)..(1134): transl_table=11
atggcatcccccgaggccaccccgcagccccacctcaccgctggcgacggcggctacctgagcatcgacgcggtccgcaaggagttcgacggcttcgtcgcggtcgacgacgtcagcctgcagattcgcaagggcgagatcttcgcgttgctcggtggttcgggcagcggcaaatccacgctgctgcgctgccttgccggcttcgagcggccgaccaaggggcgcatcgtcctggatggtcaacccatcgacgcgctgccgccgtacgagcgcccgatcaacatgatgttccagtcgtacgcgctgtttccgcatatgagcgtggagcagaacatcgccttcgggctgaagcaggaaggcttgtccaaggctgcgatcgccacccgcgtcggcgagatgctcgcgctggtgcagcttggcgcgctggccaggcgcaagccgcaccagctctccggcgggcagcagcagcgcgtggccctggcgcgctcgctggccaagcggcccaagctgctgttgctggacgaaccgatgggtgcgctggataaaaaactgcgctcgcagatgcagctggaactggtcaacatcatcgaaacctccggcgtgacctgcgttatggtcacccacgatcaggaagaggccatgaccatggccacgcggatcgcgttgatggaccagggctggatccagcaggtcggcacgcccgatgaaatctacgagcagccggccaaccggtttgcggccgagttcatcggctcggtcaatctgatcgacgcgctcatcgccgacgacgcgcccgaatacgtcaccttgaaaacgcctgcgttcgatgcctgcatccgcatcggccacggcatcaccggcttcgaagggcaggcggtggcgttcgcgctgcgcccggaaaagctcgcgatcggcaaggacgagccggcgcaggcctgcaacaaggcgcagggcgtgatcgaagacatcgcctatttcggcagccattcggtgtaccacgtgcgcttgcccagcggggtcaagctgatggccaatttcgccaatcgccagcgttgggccagcgaagcgttgacctggggcgacaccgtgtgggtagggtggggcgaagacgacggcgtggtgttcaccgcatga

SEQ ID NO: 65833 - protein, 377 aa, Xanthomonas axonopodis pv. citri str. 306
MASPEATPQPHLTAGDGGYLSIDAVRKEFDGFVAVDDVSLQIRKGEIFALLGGSGSGKSTLLRCLAGFERPTKGRIVLDGQPIDALPPYERPINMMFQSYALFPHMSVEQNIAFGLKQEGLSKAAIATRVGEMLALVQLGALARRKPHQLSGGQQQRVALARSLAKRPKLLLLDEPMGALDKKLRSQMQLELVNIIETSGVTCVMVTHDQEEAMTMATRIALMDQGWIQQVGTPDEIYEQPANRFAAEFIGSVNLIDALIADDAPEYVTLKTPAFDACIRIGHGITGFEGQAVAFALRPEKLAIGKDEPAQACNKAQGVIEDIAYFGSHSVYHVRLPSGVKLMANFANRQRWASEALTWGDTVWVGWGEDDGVVFTA

SEQ ID NO: 65834 - DNA, 1116 bp, Yersinia pestis KIM
  CDS (1)..(1116): transl_table=11
ttgttcaacaataaattgagagtgtgcgcaatgagaacctatgtcagcttcaaaaatatcaagaagagctacgatggcgacaagttggtcgttaaaaacctgaatctggacattcatgagggggattttttaaccctgctcggtccttctggttcaggtaaaaccaccagcctaatgatgctagccgggtttgaaacccccactcaaggcgagattacgctgcgtgataaacccctgcataacctgccccctcaccaacgggggatcggtatggttttccaaaattatgccctcttcccacatatgaccgtaactgaaaatctggcctttccactcacgatccgccgattgaataaggctgatatcaaagagaaaattgaccgtatattggatatggtgaagttgaagaatttggctgaccgctatcccgcgcagatgtctggtgggcagcagcaacgggttgcattggcacgtgccttggtatttgagcccaaactggtgctgatggatgaaccactcggggcgctggataagcagttacgtgagcatatgcaattggaaatcaaacagttacataaaatgcttgaattgaccattgtctacgtcacccatgaccaaagcgaagcaatgactctgtcaaatcgggtggtggtatttaacgatggtattattcagcaaatggatagcccaagcgtgatttatgaacagccaagcaatacttttgtggcgcaatttattggtgaaaacaactgcttactggccgttaatcagggcagtgacggggaatattaccgtgccatgttggacgatggcacccgcctgcaagcattaaaagtgtgccccagctcaccgggtaaaaaaattatgttatgtattcggccggagcgcgtcagtgtgaatcatcctgcggcgggcagccagcagatcaaggcccgcattcagcaatttatttatctgggggatcatgtgcggatgatgacggaagttgcaggccaagggaatttcatggtgaaactctctgccgcgcatatcgaaccacactggcagccgggaagtgaggtgttgctgtcgtggatgcctgcgcatttaagggcactggagggggtgacacactga

SEQ ID NO: 65835 - protein, 371 aa, Yersinia pestis KIM
MFNNKLRVCAMRTYVSFKNIKKSYDGDKLVVKNLNLDIHEGDFLTLLGPSGSGKTTSLMMLAGFETPTQGEITLRDKPLHNLPPHQRGIGMVFQNYALFPHMTVTENLAFPLTIRRLNKADIKEKIDRILDMVKLKNLADRYPAQMSGGQQQRVALARALVFEPKLVLMDEPLGALDKQLREHMQLEIKQLHKMLELTIVYVTHDQSEAMTLSNRVVVFNDGIIQQMDSPSVIYEQPSNTFVAQFIGENNCLLAVNQGSDGEYYRAMLDDGTRLQALKVCPSSPGKKIMLCIRPERVSVNHPAAGSQQIKARIQQFIYLGDHVRMMTEVAGQGNFMVKLSAAHIEPHWQPGSEVLLSWMPAHLRALEGVTH

SEQ ID NO: 65836 - DNA, 1113 bp, Oceanobacillus iheyensis HTE831
  CDS (1)..(1113): transl_table=11
atgaaaaataatcaaccaattattcaattcaagaatgtctccaaacagtttgataacgatcctcttgtcttggatcatgtcagctttacaatagaaaaaggaaagttttacacattacttggtccttcaggttgtggaaaaacgactattttacgtctaatcgctgggtttacagaagcatcatcaggtgacatcatttttgaaggaaaaagaataaaccatatacctgccaataaacgtccaattaatacagtcttccaggactatgccttatttcctcaccttaacgtctatgaaaatgttgcttttgggttacgaattaagaaattgaaaaaatccatgatcgatgaaaaagtcaaggaagcactttcttttgtcaatttagttggatatgaaaatcgtgaaattaaggacatgtcagggggacaacgacaacgtgtagcaattgcacgtgcaatcgttaatgagcctgcagtaattttactagatgaaccattatccgcattagatcttaaattaaggtatcaaatgcagtatgagctccgtgaacttcaacaaagacttggcattacctttatttttgttacgcatgatcaagaagaagcgctcgcaatgtccgatgagatatttgttttaaataaaggaaaaatccaacaaagcggaacaccaaatgatatctatgatgagccgattaaccgttttgtcgctgactttattggtgaatcaaatattactaaagcaacaatgattgaagactaccttgtagaatttgcaggaaaacaattcacatgtgtagatatgggaatgaatgcaaatgaacctgtcgaagtcgttattcgtccagaagacatggagatcacttctgtagaacaagggatgatttccgttaccgtacacactcaattattccgtggtgtgcattatgaaattacttgtttggatagcgaaggaaacgaatggctcgttcaatcgacgaaaaaagccattgtcggtgaacaaattggattgagatttcatccagaagatatacatgttatgcgatttaatgagtccgaagcagactttgaccgccgtttagattcttattcggagggagaaacagatggagaataa

SEQ ID NO: 65837 - protein, 370 aa, Oceanobacillus iheyensis HTE831
MKNNQPIIQFKNVSKQFDNDPLVLDHVSFTIEKGKFYTLLGPSGCGKTTILRLIAGFTEASSGDIIFEGKRINHIPANKRPINTVFQDYALFPHLNVYENVAFGLRIKKLKKSMIDEKVKEALSFVNLVGYENREIKDMSGGQRQRVAIARAIVNEPAVILLDEPLSALDLKLRYQMQYELRELQQRLGITFIFVTHDQEEALAMSDEIFVLNKGKIQQSGTPNDIYDEPINRFVADFIGESNITKATMIEDYLVEFAGKQFTCVDMGMNANEPVEVVIRPEDMEITSVEQGMISVTVHTQLFRGVHYEITCLDSEGNEWLVQSTKKAIVGEQIGLRFHPEDIHVMRFNESEADFDRRLDSYSEGETDGE

SEQ ID NO: 65838 - DNA, 1146 bp, Brucella suis 1330
  CDS (1)..(1146): transl_table=11
atggaatcttttggcagctttcgccgcaaattcgcgccgtggaacgacccggcggccaagccttttatttctttcgagaatgtgacgaaaattttcggtgatttcactgccgtcgataatctgtcgctcaatgttttcaatcgggaattctttgcgctgcttggtgcgtcgggttgcggcaagaccacgctgatgcgtatgctggcgggcttcgaggagccgacatcgggccgcattacgctcgatggtcaggatatgcgcggcatcccgccctataagcgccccgtcaacatgatgttccagtcctatgcactgttcccgcatatgacggtggagaagaatatcgccttcggtctcaaacaggatggcatggcgaaatcggagatcgatgcccgtgtcgctgaaatgctcaagctcgtgaagctggagcaatatggcaagcgcaagccacatcagttatccggcggccagcgccagcgcgtggcgctggcccgttccgtcgccaagcgcccgaaggtgttgctgctcgacgagccgcttggtgcgctcgacaagaagctgcgcgaggaaacccagtttgaattgatggatttgcaggtcaagcttggcatgaccttcatggttgtcacccacgatcaggaagaagccatgaccatggccgaccgtatcgcggtcatggacaagggtcgcatcatgcaggtggcaacgcctgccgaagtctatgaagcgccgcgctccaaattcgtggccgatttcatcggcaatgtgaatatcatcgaaggcgaggtggtgaaggcggcaaacggcgaggcggaaatcgccaccgagaaattcggcttccacattcacaccgaaacgcgcgaacagctcaatcccggccagaaggtctggtatgcggtgcgcccggaaaagacccgcatctcgcgcgagaaacccgacgaggccgccgtcaatgcggtggagggcgagctttgggatattgcctatttcggcgacatgacggtctttcacgtgcgtctcgacaatggccgcactgtcaaggcagcgagcctcaatgccgtgcgcaagactgaaaacccgctcacctatgacgagcgcgtctgggtttcattcgatatcgatgccggtctggtgctgacggcctga

SEQ ID NO: 65839 - protein, 381 aa, Brucella suis 1330
MESFGSFRRKFAPWNDPAAKPFISFENVTKIFGDFTAVDNLSLNVFNREFFALLGASGCGKTTLMRMLAGFEEPTSGRITLDGQDMRGIPPYKRPVNMMFQSYALFPHMTVEKNIAFGLKQDGMAKSEIDARVAEMLKLVKLEQYGKRKPHQLSGGQRQRVALARSVAKRPKVLLLDEPLGALDKKLREETQFELMDLQVKLGMTFMVVTHDQEEAMTMADRIAVMDKGRIMQVATPAEVYEAPRSKFVADFIGNVNIIEGEVVKAANGEAEIATEKFGFHIHTETREQLNPGQKVWYAVRPEKTRISREKPDEAAVNAVEGELWDIAYFGDMTVFHVRLDNGRTVKAASLNAVRKTENPLTYDERVWVSFDIDAGLVLTA

SEQ ID NO: 65840 - DNA, 1062 bp, Brucella suis 1330
  CDS (1)..(1062): transl_table=11
atggcttttctgaatatcaaaaacctgaaaaagagcttcggcaccaatacggtcgtccatgatttcaacctcgccgtggaaaagggtgaattcgtctcctttctcggcccatcgggctgcggcaagaccacagttctgcgcatgattgccggctttgaaaccccggacaacggctcgattgaaatcgacggcaaggacgtggtgaacctgaggcccaaccagcgcaatatcggcatggtgtttcaggcttatgcgctctttcccaatatgaccgttgcacagaacgtttcgttcggcctgcgcgtttcgggcaagtcccgctcggaaatcgatgccaccgtgaaggaaatgctgagcctcatccggctcgaccatctggccgaccgctacccctaccagatgtccggtggccagcagcagcgcgtggcgcttgcccgtgcactcgccaccaagccgcaggttctcctgctcgacgagccactttcggcgctcgatgcgaaaatccgcatatccttgcgggaagaaatccgcgccatccagcaaaagctcggcatcaccacggttttcgtcacgcatgaccaggaagaggcgctgtcgatctccgaccgcatcgtggtgatgcatgaaggccgcgccgaccagatcggctcacccttcgatatttataaccgcccggcctcgcgcttcgtcgcatccttcgtcggcacgctcaacatgctggaagcttctgtcagcgaaccggcacagaacagcatcgatctcgacgggcgccagatcaccgtgcaggaaacgctcgctcatcaccccaagggcaagccattgacgctggcgctccgcccggaggcggtgagccttgaagcccgcaagagccacgacacttcgctggaagccactattgatgacgtgcacttcctcggctccgtcatccgtacgcgcgtgatactcggcaagaaccggctgtccttcgacacgtttaacgacccgacccacccgccgccacaacgcggctacaaggtgacagtgcatttcgcctcacacgatcttctcgtgctggcagattag

SEQ ID NO: 65841 - protein, 353 aa, Brucella suis 1330
MAFLNIKNLKKSFGTNTVVHDFNLAVEKGEFVSFLGPSGCGKTTVLRMIAGFETPDNGSIEIDGKDVVNLRPNQRNIGMVFQAYALFPNMTVAQNVSFGLRVSGKSRSEIDATVKEMLSLIRLDHLADRYPYQMSGGQQQRVALARALATKPQVLLLDEPLSALDAKIRISLREEIRAIQQKLGITTVFVTHDQEEALSISDRIVVMHEGRADQIGSPFDIYNRPASRFVASFVGTLNMLEASVSEPAQNSIDLDGRQITVQETLAHHPKGKPLTLALRPEAVSLEARKSHDTSLEATIDDVHFLGSVIRTRVILGKNRLSFDTFNDPTHPPPQRGYKVTVHFASHDLLVLAD

SEQ ID NO: 65842 - DNA, 1068 bp, Brucella suis 1330
  CDS (1)..(1068): transl_table=11
ttgacggactatcgcatccgctttgaaaatatcagtaaatcctatggcgatttcaaagttatagacggcctgaacctcgatatcgaacggggcgaattcgtaagcctgctggggccctcggggtcgggcaagaccacccttttgatgatgctcgccggttttgaaaatccaagtagcggcacgatccatgtggacggaaagtccatcaactccgtcccttcctataagcgcaatatgggcgtcgttttccagaattatgcgctgtttccacatatgacggtggcggaaaacattgcctttcccttgcagatgcggggggtgggcaaggcgcaagcagctgagaaggtcgcgcgcgtgctggatatggtgcagctttcggccatgagcgagcgtaaaccatcgcaactttcgggtggtcagcaacagcgtgtcgctttggcgcgtgcgctggtgttcgagccgcatgtggtgctgatggatgagccgctcggcgcgctcgacaagcagttgcgcgagcagatgcagcttgatatccgcgccctgcacaaccggcttggcctcaccatcgttttcgtcacacatgaccagagcgaggcactcaccatgtcggaccgcatcgcggtcttcaacaagggcaagatcgagcagatcggctcgccacgcgctatttatgacgagccgcagacacgtttcgtcgccgaattcatcggcgagacgaacctggccgaaggcacggtggaaagcgttgaaggttcaagaattcttatccgtttgaaggacggcgccgccattgccgcttcatccgcttccaggcccatcagcggccagaatgtgcttctttccatccgcccggagcgcatcgagcttggagaggcggatggcgcggaaaaccggctggcggcgcgcgtgatggacagtgtttatcagggcgaccatctgcgtatccagcttgaggccaaggcgcataattttgtggttcgccttgatcgcaaggcgcgcgaatggcagccgggtgcggacgtggccgcaagcttcaaggccgccgattgctggaccatcctcgtatga

SEQ ID NO: 65843 - protein, 355 aa, Brucella suis 1330
MTDYRIRFENISKSYGDFKVIDGLNLDIERGEFVSLLGPSGSGKTTLLMMLAGFENPSSGTIHVDGKSINSVPSYKRNMGVVFQNYALFPHMTVAENIAFPLQMRGVGKAQAAEKVARVLDMVQLSAMSERKPSQLSGGQQQRVALARALVFEPHVVLMDEPLGALDKQLREQMQLDIRALHNRLGLTIVFVTHDQSEALTMSDRIAVFNKGKIEQIGSPRAIYDEPQTRFVAEFIGETNLAEGTVESVEGSRILIRLKDGAAIAASSASRPISGQNVLLSIRPERIELGEADGAENRLAARVMDSVYQGDHLRIQLEAKAHNFVVRLDRKAREWQPGADVAASFKAADCWTILV

SEQ ID NO: 65844 - DNA, 1137 bp, Shewanella oneidensis MR-1
  CDS (1)..(1137): transl_table=11
atggcaagcacctcgggcgtcaccaataaacccacaacaaagacgcaagaaaaagtcctgcttaagattgagcgggtgagtaagttatttgacgatgtacgcgcggttgatgacgtatcattgacgatcaataaaggtgagatttttgccttacttgggggctcaggctctggtaagtcgaccttattacgcatgctcgctggatttgaaagaccaacaagtggccggatttatcttgatggcgaagatattaccgatctgccgccttacgagcgccctatcaacatgatgttccaatcctatgcactgtttccccatatgacagtggcacaaaatattgccttcggattaaagcaagataagttgcctaaagctgaaattgagcagcgcgtacaggaaatgctcaagttggtgcatatggagcaatacggaaaacgaaaaccccatcaactttctggcggtcagcgccaacgggtcgccttggcacgctctttggcaaaacgccccaaattattattgctcgacgagccaatgggcgcgctcgataaaaaactgcgtacccagatgcagctagaagtggttgaaatccttgagcgcgttggtgtgacatgtgtgatggtgacccacgatcaagaagaagccatgaccatggcggggcggatttcaattatgagtgatggctggatagcccaaactggctctcctatggatatctacgagagtccaaatagccgcatgattgctgaatttattggctctgtgaacctgtttagtggtgagattgaagtggacgaagtcgaccatctcatcattaagcctaatgatttagcgcgatctttctatgtaggttacggtgtgaccaccagccttgaagataaacgtgtatggctagcagtgcgccctgaaaaaaccattattagtcgtgagcaacctgaaggtgaatacaactgggccaaaggtatagtgcatgatattgcttatttaggcgggatttcggtttactacattcgccttgaaaatgggcagattgtgcagtgcagtatgacaaaccgtgaacgccgcgctgaccatgcaacctgggatgatgaagtgttcatcagttgggaggacaccagtggcgtggtgttaagatcatga

SEQ ID NO: 65845 - protein, 378 aa, Shewanella oneidensis MR-1
MASTSGVTNKPTTKTQEKVLLKIERVSKLFDDVRAVDDVSLTINKGEIFALLGGSGSGKSTLLRMLAGFERPTSGRIYLDGEDITDLPPYERPINMMFQSYALFPHMTVAQNIAFGLKQDKLPKAEIEQRVQEMLKLVHMEQYGKRKPHQLSGGQRQRVALARSLAKRPKLLLLDEPMGALDKKLRTQMQLEVVEILERVGVTCVMVTHDQEEAMTMAGRISIMSDGWIAQTGSPMDIYESPNSRMIAEFIGSVNLFSGEIEVDEVDHLIIKPNDLARSFYVGYGVTTSLEDKRVWLAVRPEKTIISREQPEGEYNWAKGIVHDIAYLGGISVYYIRLENGQIVQCSMTNRERRADHATWDDEVFISWEDTSGVVLRS

SEQ ID NO: 65846 - DNA, 1125 bp, Pseudomonas putida KT2440
  CDS (1)..(1125): transl_table=11
atgagcgaggcgaagtcgaacgctgcaaccggcgaaacgctggtcagcttccgtggtgtgcagaagagctacgacggcgagtcgctgatcgtcaaagacctcaacctggatatccgcaagggcgagtttctcaccctgcttggcccgtccggctcgggcaagactaccagcctgatgatgctggcgggcttcgagacccccaccgccggtgaaatccagcttggcgggcgctcgatcaacaacgtgccgccgcacaaacgtgatatcggcatggtgttccagaactacgcgctctttccgcacatgaccgtggccgagaacctggcctttccgctgaccgtgcgcaacctgagcaagaccgacatcagcgagcgggtcaaacgcgtgctgaacatggtgcagctcgacgctttcgccaaacgctaccccggccagctgtctggcggccagcagcagcgtgtggcgctggcccgggcattggtgttcgagccacaactggtactgatggacgagccacttggcgcgctggacaagcagctgcgcgaacacatgcagatggagatcaagcacattcaccagcgcctgggtgtgaccgtggtgtacgtgacccacgaccagggcgaagcgctgaccatgtccgaccgcgtggcggtgttccaccagggcgaaatccagcagatcgccgacccgcgcacgctgtacgaagagccctgcaacaccttcgtcgccaacttcatcggcgagaacaaccgcatcagcggcaccctgctggccagcgatggcaaacgttgccaggtgcagttgcctcgcggcgagcgggtcgaggcgctggcggtgaatgtcggccaggccggcgagccggtgaccctgtcgatacgcccggagcgcgtgcgcctgaacggccacagtgaaagctgcgtcaaccggttctctggccgggtggccgaattcatttacctgggcgaccacgtgcgggtgcgtctggaggtttgcggcaaaggcgacttcttcgtgaagcagccgattgccgagctcgacccggcgttggccgtgggcgatgtagtaccgctgggctgggaggtggagcacgcccgcgcgctcgatccgattgccgaagcccattga

SEQ ID NO: 65847 - protein, 374 aa, Pseudomonas putida KT2440
MSEAKSNAATGETLVSFRGVQKSYDGESLIVKDLNLDIRKGEFLTLLGPSGSGKTTSLMMLAGFETPTAGEIQLGGRSINNVPPHKRDIGMVFQNYALFPHMTVAENLAFPLTVRNLSKTDISERVKRVLNMVQLDAFAKRYPGQLSGGQQQRVALARALVFEPQLVLMDEPLGALDKQLREHMQMEIKHIHQRLGVTVVYVTHDQGEALTMSDRVAVFHQGEIQQIADPRTLYEEPCNTFVANFIGENNRISGTLLASDGKRCQVQLPRGERVEALAVNVGQAGEPVTLSIRPERVRLNGHSESCVNRFSGRVAEFIYLGDHVRVRLEVCGKGDFFVKQPIAELDPALAVGDVVPLGWEVEHARALDPIAEAH

SEQ ID NO: 65848 - DNA, 1032 bp, Pseudomonas putida KT2440
  CDS (1)..(1032): transl_table=11
atgcccctagccgtccagttcacccaggtttcccgcaccttcggcgaggtcaaggccgtcgaccaggtcagcatcgacatcatcgatggcgagttcttttccatgctcggcccttccggctcgggcaagaccacctgcctgcgcctgatcgcaggcttcgagcaaccctccagcggttcgatccgcatccaaggggtcgaggccgctggcctgccgccctaccaacgtgacgtcaacactgtgttccaggactatgcgctgttcccgcacatgaacgtgctggagaacatcgcctatggcctgaaggtaaaaggcgtgggcaaggccgaacgccacagccgcgccgaagaagccctggccatggtggccctggccggctatggcgcgcgcaagccggcacagctgtctggcggccagcgtcagcgcgtggccctggcccgggcgttggtcaaccggccgcgggtgctgctgctggatgagccactgggcgcgctggacctgaaattgcgcgaacagatgcaaggcgagctgaaaaagctgcaacgccaactgggcatcaccttcatcttcgtcacccacgaccagaccgaggcgctgtcgatgtccgaccgggtcgcggtgttcaaccgcggccgtatcgaacaggtcgacaccccgcgcaacctgtacatgaagcccagcacaaccttcgtcgctgaatttgtcggcacgtccaacgtggtgcggggcgagctggccatgcagatcaacggcagcccggcgcccttttccatccgtcccgagctcattcgcctgggcgacccggtagtgaccagccatgaggtacaggtcagcggcgtgctgcacgatgtccagtaccaaggcagcgccacccgctacgaactgcagctggacaacggtcaactgctggcagtaagccaggccaatgaccgctggcagaagcagatgcaggcctggcagctcgggcaacgcctgcaggcgcactggccccgcgaggccatgacggtgctgcaggaaaccgagggccgctga

SEQ ID NO: 65849 - protein, 343 aa, Pseudomonas putida KT2440
MPLAVQFTQVSRTFGEVKAVDQVSIDIIDGEFFSMLGPSGSGKTTCLRLIAGFEQPSSGSIRIQGVEAAGLPPYQRDVNTVFQDYALFPHMNVLENIAYGLKVKGVGKAERHSRAEEALAMVALAGYGARKPAQLSGGQRQRVALARALVNRPRVLLLDEPLGALDLKLREQMQGELKKLQRQLGITFIFVTHDQTEALSMSDRVAVFNRGRIEQVDTPRNLYMKPSTTFVAEFVGTSNVVRGELAMQINGSPAPFSIRPELIRLGDPVVTSHEVQVSGVLHDVQYQGSATRYELQLDNGQLLAVSQANDRWQKQMQAWQLGQRLQAHWPREAMTVLQETEGR

SEQ ID NO: 65850 - DNA, 990 bp, Pseudomonas putida KT2440
  CDS (1)..(990): transl_table=11
atgagcttcgtcagcgtacagaaactgcagaaaagctacgccggcagcccggtgttcgagcgcatcgactgccacatcgaacgcggcgaattcgtcaccctgctcggcccgtccggctgcggcaagtccaccctgctgcgctgcattgccgggctgacctcggtggacagcgggcagatactgctcgacggccacgacatcgtgccgctaagcccgcaaaagcgtggcatcggcatggtgttccagagctacgcgctgttccctaacatgaccgtggagcagaatgtcgccttcggcctgcgcatgcagaaggtcaaggccgacgaaagccagctgcgggtacgcgaggtactggagctggtggagctgggcaagttcgccgggcgctacccgcaccagctttccggcggccagtgccagcgcgtggccctggcacgctcactggtcacccgcccgcgcctgctgctgctcgacgaaccgttgtcggcgctggatgcgcgtatccgcaagcacctgcgcgagcagattcgtgccatccagcgcgaactggggctgaccaccatcttcgtcactcacgatcaggaggaagcgctgaccatgtccgaccgcatcttcctgatgaaccaggggcgcatcgtccagagcggcgatgccgaaaccctctacaccgcccccgtggacctgtttgccgccggtttcatcggcaactacaacctgctcgacgccgacagcgccagccgcctgctgcagcgcccggtggccagccgcctggcgatccgcccggagtcgatcacccttggcgagcacggcgagctggacgccgaggtgcgcagccacagcctgctgggcaacgtgatccgctaccgggtacgggtacgcgaagtggagctggtggtcgatgtgctcaaccgctcgccggccgacttgcacgcggacggaaaacgggtaagcgtgtcgatcgaccccactgcgctgcgggaagtggcttaa

SEQ ID NO: 65851 - protein, 329 aa, Pseudomonas putida KT2440
MSFVSVQKLQKSYAGSPVFERIDCHIERGEFVTLLGPSGCGKSTLLRCIAGLTSVDSGQILLDGHDIVPLSPQKRGIGMVFQSYALFPNMTVEQNVAFGLRMQKVKADESQLRVREVLELVELGKFAGRYPHQLSGGQCQRVALARSLVTRPRLLLLDEPLSALDARIRKHLREQIRAIQRELGLTTIFVTHDQEEALTMSDRIFLMNQGRIVQSGDAETLYTAPVDLFAAGFIGNYNLLDADSASRLLQRPVASRLAIRPESITLGEHGELDAEVRSHSLLGNVIRYRVRVREVELVVDVLNRSPADLHADGKRVSVSIDPTALREVA

SEQ ID NO: 65852 - DNA, 1149 bp, Pseudomonas putida KT2440
  CDS (1)..(1149): transl_table=11
atgagtgcagtgatcaaagacaacgcgcacggcaaaaccctggtcagcctgcgcggcctgaacaagcactacggcgacttcaccgccgtggacaacctcgacctggagatccaggacggcgagttcctgaccttcctcggttccagcgggtcgggcaagtccaccaccctgtcgatgctggccggcttcgaaacaccgagcagcggcgagatcctggtcgacggccagtcgctggtcaacgtgccgccgcacaagcgtgacatcggcatggtgttccagcggtattcgctgttcccgcacctgaatgtgcgtgacaacatcgccttcccactggccattcgcaaactcggcgctgccgaaaccgccaagcgcgtcgacgccatgctcaagctggtgcaactggaacagttcgcgcaccgcaaaccctcgcaaatgtcgggcggccagcagcagcgcgtggcgatcgcccgggcgctggtgtacgagccgcgtatcctgctgatggacgagccgctcggcgcgctggacaagaagctgcgtgaagacctgcaggacgaactgcgccagttgcaccgccgcctgggcatcaccatcgtctacgtcacccacgaccaggaagaagccatgcgcctgtcccagcgcatcgccattttcagccacggcaagatcgtcggcctgggcaccggttacgacctgtaccagaacccaccgaatgcctttgtcgcatcgttcctgggcaactccaacttcctgcggatcaaggccagcagcaacggcgcgggcagcttcgagggccagccagtggccattcgcttgaccccggggctggccgcctcgcaggatgcactgatcatggtgcgcccggaaaaggccgtggccatgagcgccgaacaggccatgcgtgaaccgctgccggcgggttggaacgaggtcactgccaaggttggcgaagtgctgttcctgggtgaaagccagacctgccatgtggtgactgcagggggtaccgagctgaccgtgaaggcactgtcggcggcgggcatgccgatgcagccgggcgacagcgtgaaggtgcgttgggcagtggcagacgcttgcatttataccgaatgggccgagagcgacctgagcaagtcggccggggcgcattaa

SEQ ID NO: 65853 - protein, 382 aa, Pseudomonas putida KT2440
MSAVIKDNAHGKTLVSLRGLNKHYGDFTAVDNLDLEIQDGEFLTFLGSSGSGKSTTLSMLAGFETPSSGEILVDGQSLVNVPPHKRDIGMVFQRYSLFPHLNVRDNIAFPLAIRKLGAAETAKRVDAMLKLVQLEQFAHRKPSQMSGGQQQRVAIARALVYEPRILLMDEPLGALDKKLREDLQDELRQLHRRLGITIVYVTHDQEEAMRLSQRIAIFSHGKIVGLGTGYDLYQNPPNAFVASFLGNSNFLRIKASSNGAGSFEGQPVAIRLTPGLAASQDALIMVRPEKAVAMSAEQAMREPLPAGWNEVTAKVGEVLFLGESQTCHVVTAGGTELTVKALSAAGMPMQPGDSVKVRWAVADACIYTEWAESDLSKSAGAH

SEQ ID NO: 65854 - DNA, 1143 bp, Pseudomonas putida KT2440
  CDS (1)..(1143): transl_table=11
atggcagttgcctccggtgcctataaaaaagccctcgagggtggccagcaacccaagcaggtgctggtcaagatcgaccgggtcacgaaaaagttcgacgaaacggtagccgtggacgatgtgtccctggaaatccgcaagggtgagatcttcgccctgctgggcggctccggttccggcaagtccaccttgctgcgcatgctggccggcttcgagcgcccgtccgaagggcggatcttcctcgatggcgtcgacatcaccgacatgccgccctacgagcggccaatcaacatgatgttccagtcctacgcactgttcccgcacatgaccgtggcgcagaacatcgccttcggcctgcagcaggacaagatgcccaaggccgagatcgatgcccgcgtggccgagatgctcaagctggtgcacatgacccagtacgccaagcgcaagccgcaccagttgtcgggcggccagcgtcagcgtgtggcgttggcccgctcgctggccaagcgccctaaactgctgctgctcgacgagccaatgggtgcactggacaagaaactgcgttcgcagatgcagctggagctggtcgagatcatcgagcgcgtgggtgtaacctgcgtgatggtgacccacgaccaggaagaggccatgaccatggcccagcgcatcgccatcatgcacctgggctggatcgcccagatcggctcgccagtggacatctacgagacgcctaccagccgcctggtgtgcgagttcatcggtaacgtcaacctgttcgaaggtgacgtggtcgacgacgccgaaggctacgcgatcattgccagcccggagctggagcgcaagatctacgtgggccacggcatcaccacctcggtggaagacaagcacatcacctacgccctgcgcccggaaaagatgctggtcaccacccagcagccaacctgcgagcacaactggtcgcgcggcaagatccacgacatcgcctacctgggcggccactcggtgttctatgtcgagctgccgagcggcaaggtcgtccagtcgttcgttgccaacgccgagcgccaaggtacccgtcctacctggggcgatgaagtgtacgtatggtgggaagacgacagcggcgtggtactgcggtcatga

SEQ ID NO: 65855 - protein, 380 aa, Pseudomonas putida KT2440
MAVASGAYKKALEGGQQPKQVLVKIDRVTKKFDETVAVDDVSLEIRKGEIFALLGGSGSGKSTLLRMLAGFERPSEGRIFLDGVDITDMPPYERPINMMFQSYALFPHMTVAQNIAFGLQQDKMPKAEIDARVAEMLKLVHMTQYAKRKPHQLSGGQRQRVALARSLAKRPKLLLLDEPMGALDKKLRSQMQLELVEIIERVGVTCVMVTHDQEEAMTMAQRIAIMHLGWIAQIGSPVDIYETPTSRLVCEFIGNVNLFEGDVVDDAEGYAIIASPELERKIYVGHGITTSVEDKHITYALRPEKMLVTTQQPTCEHNWSRGKIHDIAYLGGHSVFYVELPSGKVVQSFVANAERQGTRPTWGDEVYVWWEDDSGVVLRS

SEQ ID NO: 65856 - DNA, 1134 bp, Vibrio vulnificus CMCP6
  CDS (1)..(1134): transl_table=11
gtgggagaaatacagacgttgaacgctaaacaaaatgcaggacaaccagtaatccgtttatctggtatcagtaagagtttcgatggtaaggaaatcatcggtaatttaaacctggacgttaatcacggtgaatttttaacgattctaggtccttctggctgtggtaaaacaaccgttttacgcatgatcgcaggttttgaaactgcagataatggccaaattacgatcgacaatcaggatgtcactaacgttcctgcagaacaaaggcatgtcaacacggtattccaaagttacgcattgttcccacatatgactgtgtttgataatgttgcgtttggcttacgcatgcagaaggtccctgctgctgaaatcgaacctcgcgtaatggacgcgcttaaaatggttcgtctagagagcatggctcagcgtaaacctcatcagctttctggtggtcaacagcagcgtattgcaattgcgcgtgctgtggtgaacaaaccaaaagtactattacttgatgaatccctatcagcgcttgattacaaattacgtaagcaaatgcagattgagcttaagcagctacagcgacagcttggcatcacctttattttcgtgacgcacgatcaggaagaagcactatcgatgtcagaccgcattatcgtcatgcgctcaggcgttatcgagcaagatggctctcctcgtgaaatctacgaagatccgaaaaacttatttgttgcgcgctttatcggcgaaatcaacgtgtttgaagcaacggccaaagaacgccttgatgaaaaccgtattcgtgctgagattgaaggcgtcgactcagtggtttacttcgatcaaccggtaacggaaggtcagaaactgcaagtgctacttcgtccagaagacttacgtattgaagagatcaaagaatccgaagagaaaggtattgtcggtcatgttaccgagcgtacttacaaagggatgactcttgattctgttattgaaacggaatctggcatgcgtgtaatggtaagcgagttctttaacgaagatgatcctgatgtggaccactctttaggacaaaaagtcgccattacttgggttgaaagctgggaagtggtgctaagcgatgagcaagaaatttag

SEQ ID NO: 65857 - protein, 377 aa, Vibrio vulnificus CMCP6
MGEIQTLNAKQNAGQPVIRLSGISKSFDGKEIIGNLNLDVNHGEFLTILGPSGCGKTTVLRMIAGFETADNGQITIDNQDVTNVPAEQRHVNTVFQSYALFPHMTVFDNVAFGLRMQKVPAAEIEPRVMDALKMVRLESMAQRKPHQLSGGQQQRIAIARAVVNKPKVLLLDESLSALDYKLRKQMQIELKQLQRQLGITFIFVTHDQEEALSMSDRIIVMRSGVIEQDGSPREIYEDPKNLFVARFIGEINVFEATAKERLDENRIRAEIEGVDSVVYFDQPVTEGQKLQVLLRPEDLRIEEIKESEEKGIVGHVTERTYKGMTLDSVIETESGMRVMVSEFFNEDDPDVDHSLGQKVAITWVESWEVVLSDEQEI

SEQ ID NO: 65858 - DNA, 1140 bp, Bradyrhizobium japonicum USDA 110
  CDS (1)..(1140): transl_table=11
gtggtacaacgagcgcaaggacgagatcgaccagcgcgtcaaccggatcttccgcgcatgagcgcgtcgatcgagatcgccagcgtcagcaaggtctatgaaggcggcgtgcgcgcggtggacgcggtcgcgatggacatcaggcagggcgagttcttctccctgctcggcccgtccggctgcggcaagaccacgacgctgcgcatgatcgccggcttcgaaaccccgagcgcgggcgcgattcgcgtcgacggcgccgacatcacccatgtgcccgcgcacaagcgcgacatgggcatggtgttccagaactacgcgctgttcccgcatcggaccgtcgccgagaacgtcgccttcggcctgcgcatgcgcgggctcgacaaggcgagcatcgcagccaaggtgaaggcggcgctggccatggtcgagctgtccggcctcgaggaccgccgccctgcccagctctccggcggccagcagcagcgcgtggcgcttgcccgcgccatcgtgatcgcgccgcgcgtcctgctctgcgacgagccgctcggcgcgctggacaagaagctgcgtcagcagatgcagttcgagctcaagcagctccagaagaagctcggcctgaccctggtcttcgtcacccacgaccaggaggaggcgctggcgatgtccgaccgcatcgccgtgatgaacagcggccgtgtcgagcaggtcggcaccccgaccgagatctacaaccagccgacgacgcgcttcgtcgccgacttcatcggcgacaccaacatctttcgtggcgagcgcaccacgacgagcgcgggcggcccggcgctcgacgtcggcaagggtctgatcctggcgctgccgtcctccgaggcgcaaggcaccggcgttctctcggtcgctctgcgccccgaaaagattcgcttcatgccgcgcgctgacgccaccgcagccggcagctccgcccatggcatcgtcgagaataccaacttcctcggcggcgcggtgctctaccggatcacgctcgagggcggccatcgtgtcctcgtgcaacagcccaatgcaggcacgagccgcctgttcgtccccggcaacggtgtcacgctcgactggacgccggccgatctcgtcgtcttgaaggactag

SEQ ID NO: 65859 - protein, 379 aa, Bradyrhizobium japonicum USDA 110
MVQRAQGRDRPARQPDLPRMSASIEIASVSKVYEGGVRAVDAVAMDIRQGEFFSLLGPSGCGKTTTLRMIAGFETPSAGAIRVDGADITHVPAHKRDMGMVFQNYALFPHRTVAENVAFGLRMRGLDKASIAAKVKAALAMVELSGLEDRRPAQLSGGQQQRVALARAIVIAPRVLLCDEPLGALDKKLRQQMQFELKQLQKKLGLTLVFVTHDQEEALAMSDRIAVMNSGRVEQVGTPTEIYNQPTTRFVADFIGDTNIFRGERTTTSAGGPALDVGKGLILALPSSEAQGTGVLSVALRPEKIRFMPRADATAAGSSAHGIVENTNFLGGAVLYRITLEGGHRVLVQQPNAGTSRLFVPGNGVTLDWTPADLVVLKD

SEQ ID NO: 65860 - DNA, 1095 bp, Bradyrhizobium japonicum USDA 110
  CDS (1)..(1095): transl_table=11
atgaggtcttccgaagtcaggcttgaccgcctcagcaaggaatacaaccgcaccgtcgcggtcgacgatgtctcgctcacgatcgagccgggccacatggttgcgctgctcggtccgagcggatgcggcaagacgacctgcctgcgcatgatcgcggggctgatccgtccgacatccggcgacgtcttcgtgaacgacaagaagatgacggacgttccggtgcaccgccgcaacgtcgggatgttgttccagaactacgcgctgtttcctcacctgaccgtcgaggagaacatcgcattcggtctcgagatgcgcgggatatccaaggccgctgccgcaaggaaggtgggcgaagccctcaatctggtccagctgtcgagcttcgggaagcgctatccggcgcagctctccggtggtcagcagcagcgcgtcgcactggggcgcgccctggtgatcgagccggcgatgctgctgctggacgagccgctcggggcgctcgacaagggacttcgcgaaagcatgcaggtcgagctgcgggcccttcagcgcaggctcgggttgaccaccatcatggtgacccacgaccaggacgaagccctgacgatggccgacaagatcgtggtgatgcgcgatggcaagctcgagcaggtcggctcggcgaccgaaatctaccagcgtccggcctcgaaattcgtcgcacagttcatcggtgcgtcaaatctgtttgagggtctcatcgagcagcgaaacggaagcggagcggtcattcgtgtctcgcccgaattgagcctccaggtcgaccagattacgcaatcggcaagcgatgtgatggtctcgatcaggcccgaagcgatcttcgtcgagcgcgttggccagagtccgacggcgcaacgcgccaatagcgtgacggcgcgtgtcgaccaggccatttatcgcgggtttgtcagtcactactacctcaagacgccgagcggcggccagatcatcgtgttcgagcagaatcaatcgcagcaagcgggacttcgatacgccgtgggcgaggaggttgtcgcgcgatgggagtccccgagcaatcacgtcattgcccgtcactga

SEQ ID NO: 65861 - protein, 364 aa, Bradyrhizobium japonicum USDA 110
MRSSEVRLDRLSKEYNRTVAVDDVSLTIEPGHMVALLGPSGCGKTTCLRMIAGLIRPTSGDVFVNDKKMTDVPVHRRNVGMLFQNYALFPHLTVEENIAFGLEMRGISKAAAARKVGEALNLVQLSSFGKRYPAQLSGGQQQRVALGRALVIEPAMLLLDEPLGALDKGLRESMQVELRALQRRLGLTTIMVTHDQDEALTMADKIVVMRDGKLEQVGSATEIYQRPASKFVAQFIGASNLFEGLIEQRNGSGAVIRVSPELSLQVDQITQSASDVMVSIRPEAIFVERVGQSPTAQRANSVTARVDQAIYRGFVSHYYLKTPSGGQIIVFEQNQSQQAGLRYAVGEEVVARWESPSNHVIARH

SEQ ID NO: 65862 - DNA, 1110 bp, Bradyrhizobium japonicum USDA 110
  CDS (1)..(1110): transl_table=11
atggaagccggcatggtcacgcttgcgccggcactggtgcgattttccggcatacagaagacctatgatggcgagcacctcgtggtgaagaacctcgacctcgacatcaggaagggcgagttcatcaccctgctcggcccgtcgggctcgggcaagacgaccacgctgatgatgctggctggcttcgaggttccgacccatggcgagatctatctcgcagaccggccgatcaagaacatgccgccgcacaagcgcgacatcggcatggtgttccagaactatgccttgtttccgcacctgacgatcgcggagaatatcgccttcccgctctccgtccgcaaaatcaacaaggcggaagcgcaggagcgcgtcagggcggcgctccgcatgatcaagatggaaaccctggcgcaccggcggcccgggcagctgtccggcggtcagcagcagcgcgtggcgctcgcccgcgcgctggttttcaatccgcaactcgtgttgatggacgagccccttggcgccctcgacaagcgcctgcgggagcagatgcaactcgaaatcaagcaactgcacgagacgatgggcatcaccgtcgtctacgtcacccacgatcagagtgaagcgctcaccatgtcggaccgcattgccgtgttcaacgacggcatcgtgcagcagatcgacaggcccgacgcgctgtatgagcatccggtgaacagcttcgtcgctcacttcatcggcgagaacaatgtgctggccggcaccgtcgagacggtcgacaaggactattgccgcgtcgcgctggcgggcggcggcgccgtcaccgcacgggcggtcaatgtatcaggcgcgggcgcatcgacctccctgtcggtgcggccggagcgcgtcgccattgtcccggacggcacctccagcgaaggaccgaaccggctgccggccagggtgcagaacaccatctatctcggcgaccacgcgctggccgtgctcgatgtcgccggcaacggggagttcatggtcaagcttcagccgggggcgcatcacagtctcattcctggcgaaagcgtgttcatcaccttccggcccgaagattgcctcgccctcgatcctgtttga

SEQ ID NO: 65863 - protein, 369 aa, Bradyrhizobium japonicum USDA 110
MEAGMVTLAPALVRFSGIQKTYDGEHLVVKNLDLDIRKGEFITLLGPSGSGKTTTLMMLAGFEVPTHGEIYLADRPIKNMPPHKRDIGMVFQNYALFPHLTIAENIAFPLSVRKINKAEAQERVRAALRMIKMETLAHRRPGQLSGGQQQRVALARALVFNPQLVLMDEPLGALDKRLREQMQLEIKQLHETMGITVVYVTHDQSEALTMSDRIAVFNDGIVQQIDRPDALYEHPVNSFVAHFIGENNVLAGTVETVDKDYCRVALAGGGAVTARAVNVSGAGASTSLSVRPERVAIVPDGTSSEGPNRLPARVQNTIYLGDHALAVLDVAGNGEFMVKLQPGAHHSLIPGESVFITFRPEDCLALDPV

SEQ ID NO: 65864 - DNA, 1131 bp, Bradyrhizobium japonicum USDA 110
  CDS (1)..(1131): transl_table=11
atggcgcgcagtgaggcacgccggctcaggacatggcgaggtcgatcgttggacaaacgagcggaaagcgtcgagatcaggtccgcaagcaaggcttacggcgcggttcgcgccctcgacgacgtgtccctcaatgtcggcgccggtgagttcgtctccctgctcggcccgtccggttccggcaagaccacgctgctcggcatcctgggcggcttcatcctgccatccagcggcaccatcctgtttggcggccgcgacgtcacttacatgccgccgcacaagcgcgacatcggcgtcgtattccagaactacgcgctgttcccgcatatgagcgtcggcgagaacgtcgccttccccttgcgcgcgcgccacctgccgaaagcgagctggccgaacaaggtgcgcgcggcgctcgcgatggtcggccttgccggctacgaggaacgcggcatcgcgcagctctccggcggccagcgccagcgcgtggcgctggcacgcgccatgatcttcgagccgcgtctgatcctgatggacgagccgctatccgcgctcgacaagcagctgcgcgaatccatgcagatcgagctgcgcgcgctgcaccggcgcatcggcgccaccatcatctacgtcacccatgatcagcgcgaggcgctgaccatgagcgaccgcgtcgccgtgatgaaggacggccggctgatccagatcgacgagccggcacgtctgcacgaccatcccgccgattccttcgtcgcaagcttcatcggcgaggcgacgatgttgcccgtccgccgcgtcgatgcctccagcgtggcgctcggcagcgccctgttgcgcagtgcccgcgccattcccgacggcgacgccctgatgctggccgtgcacagcgagaagctgctgatcgacgacggcgcgcaggatgccgcctgcaaccggctcagcggcaccgtcaccgacatcgtctaccagggcgagagcctgcgcatcttcctggcgctcgaaggcggcgtcgcgctcagcctgcgccagccgagctaccaccaggcctacagccgcatcccgccgctcggcggcagcctcaccgtcaccctccaccccgaggacaccatcgtcgtgcccagggtgggggactga

SEQ ID NO: 65865 - protein, 376 aa, Bradyrhizobium japonicum USDA 110
MARSEARRLRTWRGRSLDKRAESVEIRSASKAYGAVRALDDVSLNVGAGEFVSLLGPSGSGKTTLLGILGGFILPSSGTILFGGRDVTYMPPHKRDIGVVFQNYALFPHMSVGENVAFPLRARHLPKASWPNKVRAALAMVGLAGYEERGIAQLSGGQRQRVALARAMIFEPRLILMDEPLSALDKQLRESMQIELRALHRRIGATIIYVTHDQREALTMSDRVAVMKDGRLIQIDEPARLHDHPADSFVASFIGEATMLPVRRVDASSVALGSALLRSARAIPDGDALMLAVHSEKLLIDDGAQDAACNRLSGTVTDIVYQGESLRIFLALEGGVALSLRQPSYHQAYSRIPPLGGSLTVTLHPEDTIVVPRVGD

SEQ ID NO: 65866 - DNA, 1173 bp, Bradyrhizobium japonicum USDA 110
  CDS (1)..(1173): transl_table=11
atggcggaagagttgcccggaacggacgtcgcggcggatacggccgctggagctgcatttcccgtagcgggtcagccgttgctgcgcatcgagggcgtcaccaagactttcgggacgttccgggccgtggacggtgtctcgctcgacatcaaggccggcgagtttttcgcgctgctcgggcctagcggctgcggcaagaccacgctgttgcgcatgctcgccggcttcgaggcgccggatgaggggcgtatcctgcttggcggcaaggacatcgcgcaggcgctgccgcatgagcgtccgatcaacatgatgttccagaactacgcgttgtttccgcacctctcggtgcgcgacaacatcgccttcggcctgaagcgcgccggcttggcgcgcgccgacatcgccacgcgcgttgcggagatgctcgcattggtgaagctcgagggcctcgagaagcgcaagcccgaccagctctccggcggccagcgccagcgcgtggcgctggcccgcgctttggcacgccggccgcaattgttgctgctcgacgagccgctcgccgcgctggacaagaagctgcgcgagagcacgcaaggcgagttgatggagctccagcgccggctcggcatgaccttcatcatcgtcacccacgatcaggaagaggcgatgacgatggcgagccagatcggggtgatgaaggccggcaagctcgcccaggtcgcgagcccccgcgagctctacgaggcgccgcgttcgcgctggatcgcggagttcgtcggcgacatcaatctgttcgacgccgagtccagattgcgcgacggccatcgtctggtcatcggcacgcgtgatgcggggacgctggtggtggccgagccgcgcgagccggtcggcgcgggaaaattgtcggtcgcgatccgtcccgagaaggtcaagctgtcgcgccgcggcccggtgagcgaggcaggttatgaaacggcgatcaaccggctggacggcgtgatcgccgacatctgctatctcggcggcaccaccacctacaaggtgaagctcgacaccggcgggatggtgcaggcgtccgtcgccaacagcgcgcgcctcgacgtcgacgcctacagcctgaaccagcacgtggtcgcctggttcacgcccgacgactgcgtggtgctgccgtcatga

SEQ ID NO: 65867 - protein, 390 aa, Bradyrhizobium japonicum USDA 110
MAEELPGTDVAADTAAGAAFPVAGQPLLRIEGVTKTFGTFRAVDGVSLDIKAGEFFALLGPSGCGKTTLLRMLAGFEAPDEGRILLGGKDIAQALPHERPINMMFQNYALFPHLSVRDNIAFGLKRAGLARADIATRVAEMLALVKLEGLEKRKPDQLSGGQRQRVALARALARRPQLLLLDEPLAALDKKLRESTQGELMELQRRLGMTFIIVTHDQEEAMTMASQIGVMKAGKLAQVASPRELYEAPRSRWIAEFVGDINLFDAESRLRDGHRLVIGTRDAGTLVVAEPREPVGAGKLSVAIRPEKVKLSRRGPVSEAGYETAINRLDGVIADICYLGGTTTYKVKLDTGGMVQASVANSARLDVDAYSLNQHVVAWFTPDDCVVLPS

SEQ ID NO: 65868 - DNA, 1098 bp, Bradyrhizobium japonicum USDA 110
  CDS (1)..(1098): transl_table=11
gtggaccaagcgctggaatcgcgaagtcgaacgctaatcgttcgcggcggagacagcgtcatggcctatctcgagctcgatcgggtcgccaagcagttcggagcacagactgtggtcgatgacgtcagtctgtcggtggggaagggggagttcatctccttcctcggcccgtccggctgcggcaagaccacgaccctgcagatgatcgcgggcttcctcgatcccacgcgcggcgcgattcgcctcgagggcaaggacctgaccgcgatccatccggccaggcgtggcctcggcatcgtgttccagagctacgcgctgtttccgcacatgaccgcggcggagaacgtcgccttcggcctcgagatgcgcaaggtgccgcgcgccgaaagggccgagcgcgttcgcgccgcgctcgcgatggtcggcctcgccggctacgaggatcgccatccgcgccgcatgtccggcggccagcagcagcgcgtggcgctggcgcgtgcgctggtgatcaagccgagcgtgctgctgctcgacgagccgctgtcgaacctcgatgccaagctgcgcgaggagatgcagatcgagctgcgccagatccagcgcaccatcggcaccaccacgatcctggtcacgcacgaccagaacgaggcgatgtcgctgtccgaccgcatcgtggtgatgagccagggcaagatcgagcagatcggcacgccgcaggagacctatgagaagcccgcctcggccttcgtctcgcagtttctcggcaagactaacgactttgccgcgacgatcgatcgggccacggcgcccgcgaagctggtggcgggctcctggagcgcgccggcaccagttggcctcagcggtcccgtcaccgtcagcattcgccctgaaagaattggttttggcgatacgggcctcagcgcaaagatcgtcacgcgcattttccagggcaatcactggctgttccagtgcgacagcgaatgtggtcctgcgatcgtgatccgccagaatgacggccagtcacagccggccgaaggcgagaccgttcgtcttgcatggcggcctgaggacatgagcgtgcgcggagctgccgcatga

SEQ ID NO: 65869 - protein, 365 aa, Bradyrhizobium japonicum USDA 110
MDQALESRSRTLIVRGGDSVMAYLELDRVAKQFGAQTVVDDVSLSVGKGEFISFLGPSGCGKTTTLQMIAGFLDPTRGAIRLEGKDLTAIHPARRGLGIVFQSYALFPHMTAAENVAFGLEMRKVPRAERAERVRAALAMVGLAGYEDRHPRRMSGGQQQRVALARALVIKPSVLLLDEPLSNLDAKLREEMQIELRQIQRTIGTTTILVTHDQNEAMSLSDRIVVMSQGKIEQIGTPQETYEKPASAFVSQFLGKTNDFAATIDRATAPAKLVAGSWSAPAPVGLSGPVTVSIRPERIGFGDTGLSAKIVTRIFQGNHWLFQCDSECGPAIVIRQNDGQSQPAEGETVRLAWRPEDMSVRGAAA

SEQ ID NO: 65870 - DNA, 1080 bp, Clostridium tetani E88
  CDS (1)..(1080): transl_table=11
atgtcttcaaaatacgtaaaattaaaagatataagtaaaatatataaaagtcctggtgggaagactttcacagcggtggataacgtatccttaaatatagaaccaggggaatttgtaactcttttaggtccttctggatgtggtaaaaccactacattgagaatgatagctggatttgaagtaccaacagaaggaggtattcatataggagaacaaagagtaaacaatcttactccagataaaagagatacagccatggtttttcaaacttatgcacttttcccccatttaaacatatttgaaaatatagcatatggattaaaaataaaaaaattatccaaaagtgaaatagcagataaggtaaaaaacatattagaactagtggggctttcaggtctagaaaatagagcaccaaatcagttatctggaggtcaacagcaaagagttgccttagcaagggcattggttatggaaccatctgttcttttgtttgatgaaccattatctaacttagatgctaagctaagagtttatatgagaacagagataagaagaattcaaaaaaatattggaataactagtgtatatgtaactcatgaccaagcagaagctatgagtatgtcagatagagtaattataatgaataagggaataatagagcaaataggaacacctcaagaaatatataatagtcctgctacagagtttgtagctgattttattggggtagctaatatttttgattcatctgtaaaagatatagaagatgattatgttagtatagaattatttgacaacatatataaggttaaggctaataaggcatttaaaaaaggagaaaaaataaaagcaattataagaccagaagcattatcttttggtgaagaaaatggaataaaagtgttagtggattattctgtatttatgggttcataccaagattataatttaaagtataaggattttgatattaaacttacagattataatccttcaagtaaaaaggtatatagtcaaggtgaatacgctttattgagtattaatgaagatagtatacatataatatctacagaaaaatag

SEQ ID NO: 65871 - protein, 359 aa, Clostridium tetani E88
MSSKYVKLKDISKIYKSPGGKTFTAVDNVSLNIEPGEFVTLLGPSGCGKTTTLRMIAGFEVPTEGGIHIGEQRVNNLTPDKRDTAMVFQTYALFPHLNIFENIAYGLKIKKLSKSEIADKVKNILELVGLSGLENRAPNQLSGGQQQRVALARALVMEPSVLLFDEPLSNLDAKLRVYMRTEIRRIQKNIGITSVYVTHDQAEAMSMSDRVIIMNKGIIEQIGTPQEIYNSPATEFVADFIGVANIFDSSVKDIEDDYVSIELFDNIYKVKANKAFKKGEKIKAIIRPEALSFGEENGIKVLVDYSVFMGSYQDYNLKYKDFDIKLTDYNPSSKKVYSQGEYALLSINEDSIHIISTEK

SEQ ID NO: 65872 - DNA, 1098 bp, Lactobacillus plantarum WCFS1
  CDS (1)..(1098): transl_table=11
ttggcggttaatacacaaccaatcattcgattgacaaatgtcactaaaagttacggggaacatcaagttttaaaaaacatcaacttagatcttgaagcgggcaaattctatacgttactcggtccgtctgggtgtggtaaaacaaccattctgcgtaccattgcggggtttacggatgccacttccggtcaagtttactttgacggtcaggtcatcaacaccctgccggccaatcagcggcaagtcaacacagtctttcaagattacgccctttttccacacatgaatgtcgcggaaaacgtggcatttggcttgaaattacacaaagttcccaaggatgaaatcgagacgcgggtccaaaaagcactcgcaatggtccaactagccgatcttggggaacgtgaaatcagtgagatctctggtggacaacaacaacgagttgccattgcccgggcacttgttatgcagcctaaggtcctcttactcgacgaaccgttatcggctctcgatgccaaactgcgtaaggatatgcaatatgagttgcgggaccttcaacaacgcctgggcatcacttttctctttgtcacccacgatcaggaagaagccttggccatgagtgatgaaatctttgtcatgaacgctggcgagattttacaaggtgggtccccagttgatatttacgatgaaccgatcaaccatttcgtggcgaacttcatcggtgaaagtaacattattccgggtaaaatgctcaaagattttgaagtagaatttgtcggcaaacaattcgaatgcgccgatgcgggaatgcagcctaatgaagctgtcgaagtcgttcttcggcctgaagatctcgacattgtggccgcgaatcaaggcaaattagtcgtcactgtcgactcccaactatttcgaggcaattatttcgaaatcgtcgcttacgataccgatcataacgaatggctcgttcattcaactaaccctgccgcagaaggcgaaccgatcggcctgacctttgacccacaagacattcacgtcatgcggttaaacgagagcgaagctgcttttgatgctcgtcttgaacaatacgaagatgattag

SEQ ID NO: 65873 - protein, 365 aa, Lactobacillus plantarum WCFS1
MAVNTQPIIRLTNVTKSYGEHQVLKNINLDLEAGKFYTLLGPSGCGKTTILRTIAGFTDATSGQVYFDGQVINTLPANQRQVNTVFQDYALFPHMNVAENVAFGLKLHKVPKDEIETRVQKALAMVQLADLGEREISEISGGQQQRVAIARALVMQPKVLLLDEPLSALDAKLRKDMQYELRDLQQRLGITFLFVTHDQEEALAMSDEIFVMNAGEILQGGSPVDIYDEPINHFVANFIGESNIIPGKMLKDFEVEFVGKQFECADAGMQPNEAVEVVLRPEDLDIVAANQGKLVVTVDSQLFRGNYFEIVAYDTDHNEWLVHSTNPAAEGEPIGLTFDPQDIHVMRLNESEAAFDARLEQYEDD

SEQ ID NO: 65874 - DNA, 1095 bp, Ruegeria sp. PR1b
  CDS (1)..(1095): transl_table=11
atgatcgacatttccgatgtcacccgaattttcgcaggcaccgtgcttgcgcttgactccgtctcgctgagcatcgaagcgggcgagttcgtcaccctgctcgggccgtccggctgtggcaagacgactttgctgcgcttgctggccgggttcgacacacccacaaaaggcaagatcctgctgaacgatgctgatgtaaccgacgtgccgccgtacgatcgcgatgtgaacatggtgtttcaggattatgccttgttcccccatctcagcgttggccgcaacgtcgcctttggactggaacggctgaaatggcccaaggccaaggtagccaccgctgtgcgcgacgcgctggatatggtcgaactcgcggacaagatcgaccgcatgccgcatgagctttccggagggcagcgtcagcgtgtagcactagcccgggcactggcgcgtggcccgaaggtgttactgttggatgaaccgctttcggcgctggacgccggtctgcgcgaggcgatgcaggtcgaactcaagcggctgcacaacaagctgggtatcaccttcgtcatggtcacccacgaccagaccgaagcactggccatgagcgaccgtattgtccttatgctggacgggcgagtggcacaggtcggcacgccggacgagttgtacaacgcccccgcctcgccctacgtggcgtccttcatcggcacgacgaacctgtttgatggccaagtaatcgactcttctgccgccgaattgctggtcgaaaccggggccggcagattgcactgcgcgccccgcaccgacattgcgcgcggcgcatcggtccgggtcggcatgcgccccgagcatctgcgccttgccgcagactccgaagcgagcgccgtcaacaccctgccctgccgaatcgaggacgccctgtttcacggcagtctcacccggttccgctgtgccactggcaccacgaccgaacagatctattgggactggcagaaatcggcccatcccgacgactccattcgcccgaccgaaggcagcaccgtgcatctttacgcgcctccggcggatatgtttgtctttccgcaggagggggcgcgatga

SEQ ID NO: 65875 - protein, 364 aa, Ruegeria sp. PR1b
MIDISDVTRIFAGTVLALDSVSLSIEAGEFVTLLGPSGCGKTTLLRLLAGFDTPTKGKILLNDADVTDVPPYDRDVNMVFQDYALFPHLSVGRNVAFGLERLKWPKAKVATAVRDALDMVELADKIDRMPHELSGGQRQRVALARALARGPKVLLLDEPLSALDAGLREAMQVELKRLHNKLGITFVMVTHDQTEALAMSDRIVLMLDGRVAQVGTPDELYNAPASPYVASFIGTTNLFDGQVIDSSAAELLVETGAGRLHCAPRTDIARGASVRVGMRPEHLRLAADSEASAVNTLPCRIEDALFHGSLTRFRCATGTTTEQIYWDWQKSAHPDDSIRPTEGSTVHLYAPPADMFVFPQEGAR

SEQ ID NO: 65876 - DNA, 1179 bp, Ruegeria sp. PR1b
  CDS (1)..(1179): transl_table=11
gtgctgcctcgttttcggaccctcagacggagtctctcgatgacacaggccgatacaccggcgcatacagagccctggaccgacgcaaacgcagcgccctttcttaaaatccagaacgtgaccaagaagttcggcgatttcgtcgcggtggaaaacgtctcgctcgacatttatcgcggcgagctgttctgcctgctgggcggatcaggctgtggcaaatccacactgctgcggatgatgtccggctttgaaaccacgaccagcggcaagatcatcatcgacggtcaggatcagaccggcgtgccgccgcacaagcgccagaccaacatgatgtttcagtcctacgcgctgtttccgcacatgagcgtggaaaagaacatcgcctacgggctgaagcgggacggcatcgcgcgggacgaggtgcacgcgcgggtcgcggacatgctgaaaatggtgcagatgtcgaaattcgcggcgcgcaagccgcaccagctttcgggtggacagcggcagcgcgtcgccctcgcccgcgcgctggtgaaaaagcccaagctgctgctgctggacgaaccgctgggcgcgctggacaagaagctgcgcgaggaaacccagttcgaactgatcaagatccaggaaagccttggcatcaccttcgtggtggtgacccacgatcaggaagaagcgatgaccctgtcgagccgcatcggcgtcatgacagacggcgagatcgtgcaggtcggcaccccgcgcgagatttacgaatacccgcagaaccgcttcgtcgcggacttcatcgggtcggtcaacaccttcgaaggccggatcgtcgaggacgaggtggatcacgtggtgattgcctcgccggacaccggaacaaatatcacggtcgatcacggggtcagctgtacgcttggtcagaaggtcgcgatcgcattgcgcccggaaaagatccagatgcgtcggcaaccgcttggggatctgcgcaacctgaccaccgggacggtgcgggaaatcggctatcttggcagccagtccatctatcatgtcgaattggacagcggaaagatcgtgcgcgtctctcggtccaacctgacgcgcagcgcagaggattccccgacatggggtgacaaggttttccttgggtggggcggcgcgtcgggcgttgtgatcacgtcatga

SEQ ID NO: 65877 - protein, 392 aa, Ruegeria sp. PR1b
MLPRFRTLRRSLSMTQADTPAHTEPWTDANAAPFLKIQNVTKKFGDFVAVENVSLDIYRGELFCLLGGSGCGKSTLLRMMSGFETTTSGKIIIDGQDQTGVPPHKRQTNMMFQSYALFPHMSVEKNIAYGLKRDGIARDEVHARVADMLKMVQMSKFAARKPHQLSGGQRQRVALARALVKKPKLLLLDEPLGALDKKLREETQFELIKIQESLGITFVVVTHDQEEAMTLSSRIGVMTDGEIVQVGTPREIYEYPQNRFVADFIGSVNTFEGRIVEDEVDHVVIASPDTGTNITVDHGVSCTLGQKVAIALRPEKIQMRRQPLGDLRNLTTGTVREIGYLGSQSIYHVELDSGKIVRVSRSNLTRSAEDSPTWGDKVFLGWGGASGVVITS

SEQ ID NO: 65878 - DNA, 1125 bp, Pseudomonas syringae pv. tomato str. DC3000
  CDS (1)..(1125): transl_table=11
atgagcgacgtcgatacaagcgctggagcgagtgatgttctggtcagctttcgtggtgtgcagaagagctacgacggcgaagcactgatcgtcaaagacctcaatctggacattcgcaaaggcgaattcctcaccctgctcgggccttccggctccggcaagaccaccagcctgatgatgctggccggcttcgaaacaccgaccgctggcgaaattctgctcggtggccgcgccatcaacaacgtgccgccgcacaagcgtgacatcggcatggtgttccagaactacgctttgtttccgcacatgacggttgccgagaacctcgcgttcccgctgtcggtgcgtggcatgagcaagaccgacgtcggcgaaaaagtcaaaaaggctctgggcatggtccagctcgacacgtttgcgcatcgctacccggcgcagctgtccggtggccagcagcaacgtgtagctctggcgcgcgcgttggtgttcgagccacaactggtgctgatggatgagccgctcggcgcgctcgacaaacaactgcgcgaacacatgcagatggagatcaagcatctgcaccagcgcctcggtgtgacagtggtctacgtgacccacgaccagggtgaagcactgaccatgtccgaccgggttgcggtcttccatcaaggtgagatccagcagatcgcgccgccacgcagcctgtacgaagagccgaaaaacaccttcgtagccaatttcatcggcgagaacaatcgactcaacgggcgtctggtcagccaggacggcgaccgctgcgtggtcgagctggagcgcggcgagaaagtgcacgcactggcgatcaacgtcggtcggccgggtggcccggtgacgctgtccattcgccccgaacgcatcaacctcaatggccgcagcgaaagctgtgtgaaccgtttctctggtcgagtggccgagtttatctacctcggcgaccacgtccgtgtgcgtctggaagttgccggcaagactgacttcttcgtcaagcagccgattgccgagctggacccgacgctgagtgtgggtgacgttgtgccgatcggttggcaagtcgagcacgtgcgtgcgctcgatcccctgcagcaagagcattga

SEQ ID NO: 65879 - protein, 374 aa, Pseudomonas syringae pv. tomato str. DC3000
MSDVDTSAGASDVLVSFRGVQKSYDGEALIVKDLNLDIRKGEFLTLLGPSGSGKTTSLMMLAGFETPTAGEILLGGRAINNVPPHKRDIGMVFQNYALFPHMTVAENLAFPLSVRGMSKTDVGEKVKKALGMVQLDTFAHRYPAQLSGGQQQRVALARALVFEPQLVLMDEPLGALDKQLREHMQMEIKHLHQRLGVTVVYVTHDQGEALTMSDRVAVFHQGEIQQIAPPRSLYEEPKNTFVANFIGENNRLNGRLVSQDGDRCVVELERGEKVHALAINVGRPGGPVTLSIRPERINLNGRSESCVNRFSGRVAEFIYLGDHVRVRLEVAGKTDFFVKQPIAELDPTLSVGDVVPIGWQVEHVRALDPLQQEH

SEQ ID NO: 65880 - DNA, 1029 bp, Pseudomonas syringae pv. tomato str. DC3000
  CDS (1)..(1029): transl_table=11
atggcatttctgcagctcgaaggtctctccaaacgctatggctctatagacgctgtggttgccacccacctgagtgtggacaagggcgaattcgtttcactgctcggcccttccggctgtggcaaaaccaccacgttgcaaatgatcgcaggcttcgttgaggtcagtgacgggcgcatcgtgctcgacggccgtgacatcactcatgccaaaccgagcagccgagggcttggcgtggtgtttcagagttatgcgctgttcccgcacatgaccgtggccgacaacgtggcgttcggcctgcgtatgcgcaaggtcgccaaagcagaattgcaacaacgggtcagcaaggtactcgcgctggtgcgtcttgatcagcacgccgagcgctacccccgcgagctgtcaggcggacaacggcagcgggtcgcgctggcccgggcgttggtgatcgagccgccggtgttgctgctggatgagccactgtcgaacctggatgccaacctgcgcgaagaaatgcagttcgagattcgccgtattcagaacgaagtgggcattaccacgctgatggtcacccacgatcaggccgaagccctgtcgatcagcgaccgggtggtagtcatgcaggccgggcgcatcactcagatcgacgcgccttacacgctttacgagcacccgcgcacgcgctttatctcgggctttgtcggcaaggccaacatggtgcaaggcgatctggacagcagcggcaccccgcagattcgccagttgcccggtgacggcgcgctgaccctgagcctgcgcccggagaaaatcgacctggtcgcacccggttgcgggcgtctgtcaggccgtatcaccacgcgctacttcctcggcagccaatggctgtatcgcattcagaccggcatcggtgaactgaccgtggtgcgtcgcaacgacgggcaagccccgctggagcaaggcgcagcagtcggcatggactggccggccgagttgctgcgtgtactggatgccgacgaggtgcgtgcatga

SEQ ID NO: 65881 - protein, 342 aa, Pseudomonas syringae pv. tomato str. DC3000
MAFLQLEGLSKRYGSIDAVVATHLSVDKGEFVSLLGPSGCGKTTTLQMIAGFVEVSDGRIVLDGRDITHAKPSSRGLGVVFQSYALFPHMTVADNVAFGLRMRKVAKAELQQRVSKVLALVRLDQHAERYPRELSGGQRQRVALARALVIEPPVLLLDEPLSNLDANLREEMQFEIRRIQNEVGITTLMVTHDQAEALSISDRVVVMQAGRITQIDAPYTLYEHPRTRFISGFVGKANMVQGDLDSSGTPQIRQLPGDGALTLSLRPEKIDLVAPGCGRLSGRITTRYFLGSQWLYRIQTGIGELTVVRRNDGQAPLEQGAAVGMDWPAELLRVLDADEVRA

SEQ ID NO: 65882 - DNA, 1155 bp, Pseudomonas syringae pv. tomato str. DC3000
  CDS (1)..(1155): transl_table=11
atgagtgccgtgatcaaagaccccgccccagcgcatcagaaaccgctggttgcgctgtgcaacctgaacaagcattacggtgacttcgcagccgtcgatgatatttctctggagattcaggacggtgaattcctgacgtttctgggctccagtggctcgggtaaaagcaccacgttgtcgatgctcgccggtttcgagacgcccagttcaggtgaaatcctggtcagcggcaaatcgctggtcaatgtgccgccgcacaagcgcgacatcggcatggtgttccagcgctactcgctgttcccgcacctgtcggttcgcgacaacattgccttcccgctggcgatccgcaagctgccagcagccgagcgcgaaaagaaggtcgatgccatgctcaagctggttcaactggaagccttcgctcatcgtcgcccttcgcaattgtccggtggccagcagcaacgggtcgccattgcccgggcgctggtttacgagccacgcatcctgctgatggacgaacccctcggtgcgctggacaagaagctgcgcgaagacctgcaggacgaattgcgccagttgcaccgcaggctaggcatcaccattgtctacgtgacccacgatcaggaagaagccatgcgcctgtcccagcgcatcgcgattttcagccacggcaagatcgtcggtctgggcaccggttacgacctgtatcagaacccgccgaatgcctttgtcgcctcgtttctgggcaactcgaacttccttaagctcaaggcacagggcaacgccgttgcgacgtttgaaggcagttcgctggcgattcggctgacctccaacctcaaaaccgatcaggacgtgctgctgatggtgcgcccggaaaaagcccaggcactgagtgtggcccaggccgccgccacgccgctggaagccggctggaacgaggtcagcgccactgtcaccgaggtgctgtttctcggcgaaagccagacgtgctcggtggtgaccactggcggcacagcgatgaccgtcaaagcgctgtccgccaccggcatgcccttaaaagccgcagatccggtgcgcgtgcgctgggccgccgccgatgcgtgtatctacaccgaatggaccgacagcgacctgaacaaggcggctggcgcgcactga

SEQ ID NO: 65883 - protein, 384 aa, Pseudomonas syringae pv. tomato str. DC3000
MSAVIKDPAPAHQKPLVALCNLNKHYGDFAAVDDISLEIQDGEFLTFLGSSGSGKSTTLSMLAGFETPSSGEILVSGKSLVNVPPHKRDIGMVFQRYSLFPHLSVRDNIAFPLAIRKLPAAEREKKVDAMLKLVQLEAFAHRRPSQLSGGQQQRVAIARALVYEPRILLMDEPLGALDKKLREDLQDELRQLHRRLGITIVYVTHDQEEAMRLSQRIAIFSHGKIVGLGTGYDLYQNPPNAFVASFLGNSNFLKLKAQGNAVATFEGSSLAIRLTSNLKTDQDVLLMVRPEKAQALSVAQAAATPLEAGWNEVSATVTEVLFLGESQTCSVVTTGGTAMTVKALSATGMPLKAADPVRVRWAAADACIYTEWTDSDLNKAAGAH

SEQ ID NO: 65884 - DNA, 990 bp, Pseudomonas syringae pv. tomato str. DC3000
  CDS (1)..(990): transl_table=11
atgagttttgtcagcattgaaaacctgcagaaaagctacgccagcacgtcagtgttcagcgacatcaactgccgcatcgctaaaggcgaatttgtcaccctgcttggcccgtcgggctgtggtaaatccaccttgctacgctgcattgccgggctgacgccggtcaatagcgggcgcattctgctcgatggcaatgacctggtgccgctcacgccgcaaaaacgcaatatcggcatggtgttccagagttacgcgctgttccccaacatgaccgtggagcagaacgtcgcgttcggcctgcgcatgcagaaagtcagcgcagacgacagtgaacggcgcgtcgccgagatcttgcggatggtcgagctgcatgatttcgccaagcgctacccgcatcaactgtccggcgggcaatgccaacgcgtggccctggcccgctcactggttacccgcccgcgcctgctgctgctcgatgaaccgctgtcggcgctggacgcgcggatccgcaagctgctgcgcgaacagatacgtgccattcagcgcgaattaggcctgacgaccattttcgtgacccacgatcaggaggaagcgctgaccatgtctgaccgcatctttctgatgaaccagggccggatcgtacagagcggcgatgcagaaaccctctacaccgcgccggtcgacgtgtttgccgccggtttcatcggcaactacaacctgctggaagccgaagacgccacgcgcctgatgcagcgcccgattgccagccgcatcgcgatccgccctgaatcgatccaattgagcctgaccggcgaactggaaggccaggttcgcagtcacagtctgctcggcaacgtcatccgctaccggatacaggcgcgtggcgtggacctggtggtcgacgtactcaaccgcagcgccgaagacctgcacccggacggccgacgcgttacgctgaacatcgagccctcggcgctgtgcgttctgaactga

SEQ ID NO: 65885 - protein, 329 aa, Pseudomonas syringae pv. tomato str. DC3000
MSFVSIENLQKSYASTSVFSDINCRIAKGEFVTLLGPSGCGKSTLLRCIAGLTPVNSGRILLDGNDLVPLTPQKRNIGMVFQSYALFPNMTVEQNVAFGLRMQKVSADDSERRVAEILRMVELHDFAKRYPHQLSGGQCQRVALARSLVTRPRLLLLDEPLSALDARIRKLLREQIRAIQRELGLTTIFVTHDQEEALTMSDRIFLMNQGRIVQSGDAETLYTAPVDVFAAGFIGNYNLLEAEDATRLMQRPIASRIAIRPESIQLSLTGELEGQVRSHSLLGNVIRYRIQARGVDLVVDVLNRSAEDLHPDGRRVTLNIEPSALCVLN

SEQ ID NO: 65886 - DNA, 1143 bp, Pseudomonas syringae pv. tomato str. DC3000
  CDS (1)..(1143): transl_table=11
atggcagttgcctccggcgcctacaagaaagccctcgaaggcggtcagcaacccaaagaggtgctggtcaggatcgatagggtcaccaagaagttcgacgagacgattgcggtggacgatgtgtccctgcagatcaacaagggcgaaatcttcgccctgcttggcggctctggctccggcaagtccacgctgctgcgcatgctggccggtttcgagcgcccgaccgaggggcgtatctacctcgacggcgtcgacatcaccgacatgccgccgtacgaacgtccgatcaacatgatgtttcagtcctatgcgctgttcccgcacatgaccgtggccgacaacatcgccttcggcctcaagcaggacaagctcgccaagtcggaaatcgaagcccgtgtggccgaaatgctcaagctggtgcagatgacccagtacgccaagcgcaagccgcatcagctttccggcggccagcgtcagcgtgttgcgctggcccgttcgctggccaaaaagcccaagctgctgctgctcgatgaaccgatgggcgcgctggacaagaaactgcgctcgcagatgcaactggagctggtggagatcatcgagcgcgttggcgtgacctgcgtgatggtgactcacgatcaggaagaggccatgaccatggccgagcgcatcgccatcatgcatctgggctggatcgcgcagatcggcagccctatcgacatctacgaaacccctaccagccgtctggtctgcgagttcatcggcagcgtcaacctgttcgagggtgaagtgatcgaggacatggaaggccatgcgctgatccgcagcccggagctggaacgcaacatttatgtcggccacggcgtcagtacgtcggtggaagacaagcacatcacctacgcattgcgcccggaaaaactgctgatcaccgctgaacaacccggtttcgaatacaactggtcgcgcggcaaggtccacgacattgcctacctgggcggccattcggtgttctacgtcgaactgccgggcggcaagctggtgcagtcgtttgtcgccaatgccgagcgtcagggcgcgcgacctacctggggcgatgaagtctacgtctggtgggaagacgacagcggcgtggtactgcgctcatga

SEQ ID NO: 65887 - protein, 380 aa, Pseudomonas syringae pv. tomato str. DC3000
MAVASGAYKKALEGGQQPKEVLVRIDRVTKKFDETIAVDDVSLQINKGEIFALLGGSGSGKSTLLRMLAGFERPTEGRIYLDGVDITDMPPYERPINMMFQSYALFPHMTVADNIAFGLKQDKLAKSEIEARVAEMLKLVQMTQYAKRKPHQLSGGQRQRVALARSLAKKPKLLLLDEPMGALDKKLRSQMQLELVEIIERVGVTCVMVTHDQEEAMTMAERIAIMHLGWIAQIGSPIDIYETPTSRLVCEFIGSVNLFEGEVIEDMEGHALIRSPELERNIYVGHGVSTSVEDKHITYALRPEKLLITAEQPGFEYNWSRGKVHDIAYLGGHSVFYVELPGGKLVQSFVANAERQGARPTWGDEVYVWWEDDSGVVLRS

SEQ ID NO: 65888 - DNA, 1122 bp, Vibrio parahaemolyticus RIMD 2210633
  CDS (1)..(1122): transl_table=11
atgagcacagcaaacaaggattatgtgagctttcaacatgttaagaaaacctacgacggtgcaaacttggtggttaaagacttcaacttagacatcgcacccggagagtttgtcaccatgttggggccttctggatcaggcaaaacaacgtgtctgatgatgctggcgggttttgaaacggcaacaggcggagggatttacattgatggcgttccggtaaacaatcttgcgccacataaacgcgacatcggaatggtatttcaaaactacgcgctgtttcctcacatgacgattgcggagaatctcgcttttcctctaaaagtgcgcaagctcgataatcaaaccattcaaaataaagtacagagcgcactggacatggtcgagttggggcacgttgccagccgttatccaaagcagttatctggcgggcagcaacaacgtgtcgcgttggcgagagcgcttgtgtttgaaccgaaactcgtcctgatggatgagcctttgggcgcgttggacaagcaacttcgtgagcaaatgcagatggagattaaacacctgcacgaaaagctcggtattacgattttatatgtcacgcatgaccaagatgaagcgctcactatgtctgaccgaatcgcagtttttaatcaaggcgaagtgcagcaacttgccccgccaacggaactgtatgaatctccgagtaacgcgttcgtcgctcagtttattggtgaaaataatcagctttctggtgtggtaaaagggtggcaatcagagcgatgccaagtccaggtcggccccgctcacttcgttgccaaaccggttcgagtgacccaaaacggcgagcgcaccaccttgtctattcgaccagagaaaatttccatccagcctgatgacgaatcgtgtgataaccaaattgaaggcgtactgcgtgagctaatttatcacggtgatcattatcggttagtggtcgacgttgaattggttggtcagtttgtcgtgaaagtgccgaacgacaaccgaacgcatctgaaccttattccgggaacggtttgtcgaattgggtggaaaagtacagattgccatgcgctagatgcgattcaaccagaaaccgaagaggtggcggcatga

SEQ ID NO: 65889 - protein, 373 aa, Vibrio parahaemolyticus RIMD 2210633
MSTANKDYVSFQHVKKTYDGANLVVKDFNLDIAPGEFVTMLGPSGSGKTTCLMMLAGFETATGGGIYIDGVPVNNLAPHKRDIGMVFQNYALFPHMTIAENLAFPLKVRKLDNQTIQNKVQSALDMVELGHVASRYPKQLSGGQQQRVALARALVFEPKLVLMDEPLGALDKQLREQMQMEIKHLHEKLGITILYVTHDQDEALTMSDRIAVFNQGEVQQLAPPTELYESPSNAFVAQFIGENNQLSGVVKGWQSERCQVQVGPAHFVAKPVRVTQNGERTTLSIRPEKISIQPDDESCDNQIEGVLRELIYHGDHYRLVVDVELVGQFVVKVPNDNRTHLNLIPGTVCRIGWKSTDCHALDAIQPETEEVAA

SEQ ID NO: 65890 - DNA, 1134 bp, Vibrio parahaemolyticus RIMD 2210633
  CDS (1)..(1134): transl_table=11
gtgggagaaatacagacgttgaacgctaaacagcaagcaggaaagccagttattcgtttatctggtatcagcaaaagtttcgatggaaaggaaatcatcggtaatttaaatcttgatgttaatcatggtgagtttctgacgattcttggtccatctggttgtggtaaaacgacggttttacgcatgatcgctggttttgaaacggcagataacggtcaaatcgtattagatgaccaagatgtaacgcaagttcctgcagagcataggcacgtcaacacggtatttcagagttacgcattattccctcacatgaccgtattcgataatgtggcatttggcctacgcatgcaaaaaacgcctgcggcagaaatcgaaccacgtgtaatggaagcgctacgtatggttcgcctagaaaaaatggcgcagcgtaagccgcaccaactttctggtggtcagcaacaacgtatcgcgatcgcgcgtgcggttgtaaataagccaaaagtactgctacttgatgaatcgctttctgctcttgattacaaacttcgtaaacaaatgcagattgagttgaaacaacttcagcgtcaacttggtattacctttatctttgttactcacgatcaggaagaagctctatcgatgtctgaccgcattatcgttatgcgcgatggtgttatcgaacaagatggctcaccacgtgaaatttacgaagaacctaaaaacttgtttgttgctcgctttatcggcgagattaatgtcttcaacgcaacaatgcttgaacgcattgatgaaaaacgcatccgtgcggaaatcgaaggtgttgagtctgtcgtttactacgacaaagaagcacaagcaggtgacaaactacaagtgctgcttcgccctgaagacttacgtatcgaagagatcaaagagtctgaagaaaaaggcattgttggtcacgtcactgaacgtacctataaaggtatgacgctagactctgttgtccaactggactcaggcatgcgcgtgatggttagcgagttctttaacgaagatgatccagatgtggaccactctctcggccaaaaagtcgctatcacttgggttgagagctgggaggtagtactcaatgataagcaagaagattaa

SEQ ID NO: 65891 - protein, 377 aa, Vibrio parahaemolyticus RIMD 2210633
MGEIQTLNAKQQAGKPVIRLSGISKSFDGKEIIGNLNLDVNHGEFLTILGPSGCGKTTVLRMIAGFETADNGQIVLDDQDVTQVPAEHRHVNTVFQSYALFPHMTVFDNVAFGLRMQKTPAAEIEPRVMEALRMVRLEKMAQRKPHQLSGGQQQRIAIARAVVNKPKVLLLDESLSALDYKLRKQMQIELKQLQRQLGITFIFVTHDQEEALSMSDRIIVMRDGVIEQDGSPREIYEEPKNLFVARFIGEINVFNATMLERIDEKRIRAEIEGVESVVYYDKEAQAGDKLQVLLRPEDLRIEEIKESEEKGIVGHVTERTYKGMTLDSVVQLDSGMRVMVSEFFNEDDPDVDHSLGQKVAITWVESWEVVLNDKQED

SEQ ID NO: 65892 - DNA, 1137 bp, Salmonella enterica subsp. enterica serovar Typhi Ty2
  CDS (1)..(1137): transl_table=11
atgggacagagtaagaaattgaataaacaaccgcgttcgctttcaccgctggtgcttttgtcgggaattagcaaaagtttcgatggcaaagaggtcatttcacagctggatttgaccattaacaatggcgaattcctcacgctgcttggcccttccggctgcggtaaaacaaccgttcttcgcctgattgccggcctggaaaccgttgatgccgggcatatcatgttggataaccaggatatcacccacgttcccgccgaaaatcgttatgtaaataccgtatttcaaagctacgctttatttccgcatatgacggtgtttgaaaatgtcgcgtttggcttacgaatgcaaaaaacaccagccgccgagatagcgcctcgcgtgaccgatgcgctgcgtatggtgcagcttgaagagtttgcacaacgtaaaccgcaccagctttccggcggacagcagcagcgtgtggctatcgctcgcgcggtggtgaataaacctcgcctgttattactggacgaatcgctctccgcgctggactataaattgcgcaaacaaatgcagaacgagcttaaagcattacagcgtaaactcggtatcacgtttgtttttgtcactcacgatcaggaagaagcgctcaccatgtccgatcgtatcgtggtaatgcgtaatggcgtgattgagcaagacggcacgccgcgtgaaatctatgaagagccaaaaaacctgtttgtcgccggttttatcggcgaaattaaccgctttgacgcaaccgtcattgaacggcttgatgaacagcgcgtccgcgccagcgtagaaggtcgggagtgcaatatatacgtcaatttcgctgtcgaactgggccaaaaactgaacgtcctgctgcgaccggaagatctacgcgtcgaagagatcaacgatgataaccacatcgaagggcttatcggctacgtgcgcgagcgcaattacaaaggtatgacgctggagtcggtggttgaactggaaaatggcaaaatggtgatggtcagcgaattcttcaacgaagacgatcctgacttcgaccattcacttgaccaaaaaatggccattagttgggtagaaagctgggaggtcgtactggctgatgaagaacacaagtaa

SEQ ID NO: 65893 - protein, 378 aa, Salmonella enterica subsp. enterica serovar Typhi Ty2
MGQSKKLNKQPRSLSPLVLLSGISKSFDGKEVISQLDLTINNGEFLTLLGPSGCGKTTVLRLIAGLETVDAGHIMLDNQDITHVPAENRYVNTVFQSYALFPHMTVFENVAFGLRMQKTPAAEIAPRVTDALRMVQLEEFAQRKPHQLSGGQQQRVAIARAVVNKPRLLLLDESLSALDYKLRKQMQNELKALQRKLGITFVFVTHDQEEALTMSDRIVVMRNGVIEQDGTPREIYEEPKNLFVAGFIGEINRFDATVIERLDEQRVRASVEGRECNIYVNFAVELGQKLNVLLRPEDLRVEEINDDNHIEGLIGYVRERNYKGMTLESVVELENGKMVMVSEFFNEDDPDFDHSLDQKMAISWVESWEVVLADEEHK

SEQ ID NO: 65894 - DNA, 1134 bp, Salmonella enterica subsp. enterica serovar Typhi Ty2
  CDS (1)..(1134): transl_table=11
gtgaatgatgccccccaccgcccgcaggtgaaaacccgtaaagcgctgacgccgcttctggaaattcgcaacctgacgaagtcattcgacgggcaacatgctgtcgatgatgtcagtctgactatctataaaggtgagatttttgccctgctgggcgcgtcaggttgtggaaaatcgactctgttacggatgctggcgggttttgaaccgccgagcagcgggcaaattatgctcgacggcgtcgatctggcgcatgttccgccgtatcagcgtccgattaatatgatgtttcagtcctatgcgttgtttccgcatatgacggtagagcagaacatcgcttttggtctgaagcaggacaaactgccgaaggcggagattaccagccgcgtcaatgagatgctgggtctggtgcacatgcaggagtttgcaaaacgtaagccgcatcagctttccggcggtcagcgtcagcgcgtggccctggcgcgcagcctggcgaaacgtcttaagctgctcttgttggatgaaccgatgggcgcgctggataaaaaattacgcgaccggatgcagctggaagtggtggatatccttgagcgcgtcggcgtgacttgcgtcatggtgacgcacgatcaggaagaagccatgacgatggcggggcgcattgccatcatgaaccgtggaaaatttgtgcaaattggcgaaccggaggagatttacgagcatccgacaacccgctatagcgccgaatttatcggatcggtaaatgtttttgagggcttactgaaagcgcgtgaagaggacggtctggtcattgacgcgcccggtttggttcatccgttaaaagtcgatgcagatgcctctgtcgttgataatgtgccggtatatgtggcgctacgtccggaaaaaatcatgctgtgtgagtcgccgcctgccgatggctataatttcgccgtcggcgaagtggcgcatattgcgtatctcggcgatctgtctatttatcatgtgcggctaaaaagcgggcagatgatcagcgctcaactgcagaatgcgcaccgttaccggaaagggttaccgacctggggcgatgaagtgcgtttgtgctgggaagcggatagctgcgtggtcctgacggtataa

SEQ ID NO: 65895 - protein, 377 aa, Salmonella enterica subsp. enterica serovar Typhi Ty2
MNDAPHRPQVKTRKALTPLLEIRNLTKSFDGQHAVDDVSLTIYKGEIFALLGASGCGKSTLLRMLAGFEPPSSGQIMLDGVDLAHVPPYQRPINMMFQSYALFPHMTVEQNIAFGLKQDKLPKAEITSRVNEMLGLVHMQEFAKRKPHQLSGGQRQRVALARSLAKRLKLLLLDEPMGALDKKLRDRMQLEVVDILERVGVTCVMVTHDQEEAMTMAGRIAIMNRGKFVQIGEPEEIYEHPTTRYSAEFIGSVNVFEGLLKAREEDGLVIDAPGLVHPLKVDADASVVDNVPVYVALRPEKIMLCESPPADGYNFAVGEVAHIAYLGDLSIYHVRLKSGQMISAQLQNAHRYRKGLPTWGDEVRLCWEADSCVVLTV

SEQ ID NO: 65896 - DNA, 1392 bp, Bacteroides thetaiotaomicron VPI-5482
  CDS (1)..(1392): transl_table=11
atgaatatgcaagaagacaaatccatcattgaggttagccatgtatcgaagttttttggcgacaaaacagctttggatgatgtaactctgaacgtgaaaaagggcgagtttgttacgattctcggaccttccggctgcggaaaaacgacattgttgcgtctcattgccggttttcagacagcttcggaaggcgaaatccgaatatcgggtaaggaaatcacacagactccaccccataaacgtccggtgaacacggtatttcagaaatatgccctgttcccgcatttgaatgtatacgacaatattgctttcggcctgaagctgaaaaagacgccgaaacagacaatcggcaagaaggtgaaagccgcattgaagatggttggtatgacggattacgagtatcgggatgtagattctctttccggtggccagcaacagcgtgtagctattgcccgtgccattgtcaatgagccggaagttttgctgctcgacgaaccgttggctgcgctcgacctcaaaatgcgcaaggatatgcagatggaactgaaagaaatgcataaatctctgggcattacatttgtatacgtaactcatgatcaggaagaagccttgacattgagtgatacgattgtcgtgatgagcgaaggaaaaatccagcagatcggtacgccgattgatatctataatgagccgatcaattcatttgttgcggattttatcggagaaagtaatattctcaacggaacgatgattcatgataaactggtacgcttttgtggtacggagtttgaatgcgtggacgaaggtttcggtgaaaatactccggtggacgtagtcattcgtccggaagacctttatattttcccggtttcggagatggcgcaactgaccggtgtggtacagacttcgatcttcaaaggggtacactatgaaatgactgtgctttgtggcggatatgagttccttgttcaggattatcatcattttgaagtcggtgcggaagtggggctgctggtgaagccgtttgatattcatattatgaagaaagaacgtgtatgcaatacatttgaaggaaagttgcaggatgctactcatgtagagttcctgggctgtacgttcgaatgtgcttctgtggaagggctggaatccggtacggatgtcaaggtcgaagtagactttgataaagtgatcttgcaggataacgaagaagacggtacgctgacgggagaagtgaagttcatcctttataaaggtgatcattaccatctgactgtatggtctgactgggacgagaatgtgtttgtggatacgaacgatgtctgggatgacggagaccgtgtgggtattactatccctccggatgcgattcgtgtaattaaaataaccgattaa

SEQ ID NO: 65897 - protein, 463 aa, Bacteroides thetaiotaomicron VPI-5482
MNMQEDKSIIEVSHVSKFFGDKTALDDVTLNVKKGEFVTILGPSGCGKTTLLRLIAGFQTASEGEIRISGKEITQTPPHKRPVNTVFQKYALFPHLNVYDNIAFGLKLKKTPKQTIGKKVKAALKMVGMTDYEYRDVDSLSGGQQQRVAIARAIVNEPEVLLLDEPLAALDLKMRKDMQMELKEMHKSLGITFVYVTHDQEEALTLSDTIVVMSEGKIQQIGTPIDIYNEPINSFVADFIGESNILNGTMIHDKLVRFCGTEFECVDEGFGENTPVDVVIRPEDLYIFPVSEMAQLTGVVQTSIFKGVHYEMTVLCGGYEFLVQDYHHFEVGAEVGLLVKPFDIHIMKKERVCNTFEGKLQDATHVEFLGCTFECASVEGLESGTDVKVEVDFDKVILQDNEEDGTLTGEVKFILYKGDHYHLTVWSDWDENVFVDTNDVWDDGDRVGITIPPDAIRVIKITD

SEQ ID NO: 65898 - DNA, 1086 bp, Enterococcus faecalis V583
  CDS (1)..(1086): transl_table=11
gtgagaaaccatgtgatttcatttgaaaatgttgtcaaacaatttgacgatgaaccagtattaaaaaatgtcagctttgaaattgaagaaggaaaattttatacgttattaggaccttcaggatgtggcaaaacaacgattttgcgtattattgcgggattcaatgacgtgacttctggcgatgtttattttgatggtaaaagaataaatgatgtacctgccaataaacgccaagtcaataccgtgtttcaggattatgctttgtttcctcacatgaatgtttttgataatgttgcgtttggtttaaaaatcaaaaaactatccaaagcagaaattgaaaaaaaagtgaaagaggcattacgtttggttcaattaccgggctacgaaacacgtgaaattagtgaaatgtctgggggccaacgtcagcgggtcgcaattgcacgagcgattgtcaatgagccaaaagtattgcttttagatgagccgttatccgctttagatttgaaattacgcacagcgatgcaatatgaactacgtgatttacaacaacgtttaggaattacttttatttttgtgacccatgatcaagaagaagcattagcgatgagtgatgaaatttttgtcatgaataaaggtcatatcgtgcaaagtggcacaccagtcgatatttatgatgaaccgattaatcactttgttgctgactttgtgggggaaagtaatattgtggatggcgtgatgctggaagataatttagtttcatttgtgggcaaaaagtttgaatgtgtcgatggcggcatgcggaaaaatgaacctgtagaagtcgttttacgtccagaagacttaacgattaccacgcttgaaaaaggcaagctaaccgtaacggtggacacgcagttattccgcggcgttcattatgaaattatttgttttgatgaacaaggaaacgaatggatggtgcattccactcgaaaagccaaagaaggcgctcaagtagggctctcttttgagccagaagatattcacgtgatgcgcttcaatgaatcagaagaagactttgatgcccgtttagaaagttacgacgagtaa

SEQ ID NO: 65899 - protein, 361 aa, Enterococcus faecalis V583
MRNHVISFENVVKQFDDEPVLKNVSFEIEEGKFYTLLGPSGCGKTTILRIIAGFNDVTSGDVYFDGKRINDVPANKRQVNTVFQDYALFPHMNVFDNVAFGLKIKKLSKAEIEKKVKEALRLVQLPGYETREISEMSGGQRQRVAIARAIVNEPKVLLLDEPLSALDLKLRTAMQYELRDLQQRLGITFIFVTHDQEEALAMSDEIFVMNKGHIVQSGTPVDIYDEPINHFVADFVGESNIVDGVMLEDNLVSFVGKKFECVDGGMRKNEPVEVVLRPEDLTITTLEKGKLTVTVDTQLFRGVHYEIICFDEQGNEWMVHSTRKAKEGAQVGLSFEPEDIHVMRFNESEEDFDARLESYDE

SEQ ID NO: 65900 - DNA, 1038 bp, Streptomyces avermitilis MA-4680
  CDS (1)..(1038): transl_table=11
atggaggcacgcgcgatccggctgcagggactgcggaaggtgttcggtgataccgccgccgtgaccggcgtcgacctggagatagccgacggagagttcttctcgatgctcggcccgtccggctccggcaagacgaccgtcctgcgtatgatcgcgggcttcgagagccccaccgccggccggatagagctggcgggccaggaggtcaccgggctcgcccccttcgaacgggacgtgcacaccgtcttccaggactacgccctgttcccgcacatgaccgtggaacagaacgtcgcctacggcctcaaggtccgcaaggtgcccagggtcgagcggctcgcccgggcccgcaaggcactcgccgacgtacgcctcgaagcgttcggcacccggcgcccatcccagctctccggcggtcagcgccagcgggtcgcgctcgcccgcgccctggtcggccgcccccgtgtgctgctgctcgacgaaccgctcggcgccctcgacctcaaactgcgcgagcagatgcaggtcgaactcaaggcgatccagcgcgaggtcggcatcaccttcgtgttcgtcacccacgaccaggaggaggccctgacgatgagcgaccgcatcgccgtcttcaaccggggccgcatcgaacaggtcggcaccccggccgagatctacgagcgcccctcgaccccgttcgtggcctcgttcgtcggcacctcgaacctcctgtcgggcgagtcggcacagcggatcgtcggcgcccccggcacgtacagcatcaggcccgagaagatccgggtccttggggagtccgcccacgcgggcgacccgcagtactccaccgccactggcaccgtcgtcgaggtggtctatctcggagacgtcacccgtttcctggtggacctggacgcgggcggccggctcaccgccctccagcagaacctggagacctcctccgcggacgtcgccgcgtatcgcggcacccgggtcaccctccagtggcaccgcggccacaccttcagggtccccgaagccggttga

SEQ ID NO: 65901 - protein, 345 aa, Streptomyces avermitilis MA-4680
MEARAIRLQGLRKVFGDTAAVTGVDLEIADGEFFSMLGPSGSGKTTVLRMIAGFESPTAGRIELAGQEVTGLAPFERDVHTVFQDYALFPHMTVEQNVAYGLKVRKVPRVERLARARKALADVRLEAFGTRRPSQLSGGQRQRVALARALVGRPRVLLLDEPLGALDLKLREQMQVELKAIQREVGITFVFVTHDQEEALTMSDRIAVFNRGRIEQVGTPAEIYERPSTPFVASFVGTSNLLSGESAQRIVGAPGTYSIRPEKIRVLGESAHAGDPQYSTATGTVVEVVYLGDVTRFLVDLDAGGRLTALQQNLETSSADVAAYRGTRVTLQWHRGHTFRVPEAG

SEQ ID NO: 65902 - DNA, 1164 bp, Streptomyces avermitilis MA-4680
  CDS (1)..(1164): transl_table=11
gtgacgacgatgaacaacacggacaacagcggcgacgtccgcctctccggaatcagcaagacctacggctccttcaccgccgtgcaaccgctcgacctgaccgtgccgcagggctcgttcttcgccctgctcggcgcttccggctgcggcaagaccaccacgctgcgcatgatcgcgggactggaggaaccttcctccggcaccgtgttcctcggcgaccaggaggtcacccacctgccgccctacaagcgaccggtgaacacggtcttccagtcgtacgccctcttcccgcacctcgacatcttcgagaacgtggccttcggcctgcgccggcgcggcatcaagtcggtgaagaagcaggtcgaggacatgctggacctcgtccagctcggcgagcaggcgcgcaagaaaccgcaccagctctccggcggccagcagcagcgcgtcgccgtcgcccgcgcgctgatcaaccaccccaaggtgctgctcctcgacgagcccctcggcgccctcgacctcaaactgcgccgtcagatgcagctggagctcaagcgcatccagaccgaggtcggcatcaccttcgtgcacgtcacccacgaccaggaggaggccatgaccatggccgacacggtcgccgtgatgaacgcgggccgcgtcgaacagctcggctcgcccgccgacctctacgagaacccgaacaccacgttcgtcgccaacttcctcggcacctccaacctcatcgaggcggaggtcgactccaagggcggcgacgagatcgtcctcagggcgggcggtggcaagctcacgctgcccacggcgcgatgttcggcggccacgacgaccggcggcaaggtccttgtgggcgtccgccccgagaagatctccctcacgcacgccgacgacgcgggcgagatcccggcgggccgcaaccggatcaccgggaagatcgccgactccagcttcatcggagtctccacccagtacgtcatcgacagcgcggtctgccccgagttcgaggtctacgcccagaacatcgaccgcgactcccggctcacccccggcgccgacgtcgtcctgcactggaacccggctcacaccttcggtctggacgccgcgcaggacatcgacgcgggcgtggagacggtcgaggaagaggccgcgtga

SEQ ID NO: 65903 - protein, 387 aa, Streptomyces avermitilis MA-4680
MTTMNNTDNSGDVRLSGISKTYGSFTAVQPLDLTVPQGSFFALLGASGCGKTTTLRMIAGLEEPSSGTVFLGDQEVTHLPPYKRPVNTVFQSYALFPHLDIFENVAFGLRRRGIKSVKKQVEDMLDLVQLGEQARKKPHQLSGGQQQRVAVARALINHPKVLLLDEPLGALDLKLRRQMQLELKRIQTEVGITFVHVTHDQEEAMTMADTVAVMNAGRVEQLGSPADLYENPNTTFVANFLGTSNLIEAEVDSKGGDEIVLRAGGGKLTLPTARCSAATTTGGKVLVGVRPEKISLTHADDAGEIPAGRNRITGKIADSSFIGVSTQYVIDSAVCPEFEVYAQNIDRDSRLTPGADVVLHWNPAHTFGLDAAQDIDAGVETVEEEAA

SEQ ID NO: 65904 - DNA, 984 bp, Bacillus cereus ATCC 14579
  CDS (1)..(984): transl_table=11
atgaaaaagattattaaagttgaagcagttgaaaaacattttggaaatcaagtgattatcccacctctttctttagatattaaagagggagagtttttaacaattttagggccgagtggctgcgggaaaacgactttacttcgtatgatcgcaggatttgaaactccaactaaagggaatcttttattagatgatgaaagaattaacgatttgccgccatataagcgtcatatgaacctagtgttccaacattacgcactattcccacatatgacagtagagaagaatatttgttttggtatgaaaatgcagaaagtatcagcagcagagcagaaagagcgtgctgaagaggcaatgcgtttaacgcagttacttgagttccgtaatcgtaaacctgcgaagctttctggtggacaacagcagcgtgttgcaattgcaagagcgattgtaaataatccgcgtgtattactattagatgagccacttggagcgcttgactttaagttacgaaaagacttgcaacgtgaattgaaaaacttacaacgtaatttaggaattacgttcatatacgtaacgcacgatcaagaagaagcaatgagcatgagcgatcgtattgtcgttatgaataaaggacatatcgaacaaatcggaacgccgaaagaaatttataataagccgaaaacattgttcgttgcgacattcatcggtgaaaataatattgtgaagaacggggaaggctatgtagcaattcgccctgaaaatgtaaaagtacgttcggttgaagaaccaattttaaaagaataccatcttggacatattgaagatattgagtttgtcggaaatatggagaagctttatgtacgtgatgagaaaacatcagaattactaatggcatatcaaactgctgaagaggcagcgcagtggagcattggagataatgtatatgtaggctgggagcaagaggacgaggtgaccttaaattga

SEQ ID NO: 65905 - protein, 327 aa, Bacillus cereus ATCC 14579
MKKIIKVEAVEKHFGNQVIIPPLSLDIKEGEFLTILGPSGCGKTTLLRMIAGFETPTKGNLLLDDERINDLPPYKRHMNLVFQHYALFPHMTVEKNICFGMKMQKVSAAEQKERAEEAMRLTQLLEFRNRKPAKLSGGQQQRVAIARAIVNNPRVLLLDEPLGALDFKLRKDLQRELKNLQRNLGITFIYVTHDQEEAMSMSDRIVVMNKGHIEQIGTPKEIYNKPKTLFVATFIGENNIVKNGEGYVAIRPENVKVRSVEEPILKEYHLGHIEDIEFVGNMEKLYVRDEKTSELLMAYQTAEEAAQWSIGDNVYVGWEQEDEVTLN

SEQ ID NO: 65906 - DNA, 1002 bp, Bacillus cereus ATCC 14579
  CDS (1)..(1002): transl_table=11
atgagcgaatatttatcaattcaacacattcaaaaacagtttgatgcatttacagcgttaaaagatatttcttttactgtgaaaaaaaatgagtttgtttgtttattaggcccaagtggctgtgggaaaacgacgttgcttcgcattttagcgggactagaggaaccaacgactggcagtatagctgtgaatggaaaagatattacagcattgcctcctggaaagagaaacttcggaatggttttccaatcgtatgctttatttccgaatttaacagcacttgaaaatattgaatacggcttaaagacaaaaaaatatgggaaagcagaagtgaaagagaaagcgctagatgcgttaaaacttgtagatttgctgaatgtaaaagataaatatcctgctcaaatgtctggtggacaacagcagcgagtagcacttgcacgtgcgctcgctctgtctccagatattttgttactcgatgagccgttatcagctttagatgcaaaagtgcgtgaaaaattacgtagggaaatgcgtgatttgcaagagaaaataggagtaacgacgattatggtaacgcatgatcaagaagaggcattaacgatggctgataaaattgttgtaatgaatcatgcggaaattatgcagattggaacaccagaggagatttatcaaagaccagccaatccgtttgtggcagattttattggttctattaatttcttttcgaaaaataacgaagaacatgcaattcgtcctgaacatgtaacaattgtacaaaaggacggtattaaatcagttgtggaaagtatggaatttcgcggatctgtatatcggacggaagtgcgagtcttagaagaaaacacacacctttataatgagaaaattgtagtggatatattagcatcagaagtagaagcaacggctattagaaaaggaaagccgattcaaatctctttctcagaaaatcatatgttgtcatatggaaagaaggtcattgtatag

SEQ ID NO: 65907 - protein, 333 aa, Bacillus cereus ATCC 14579
MSEYLSIQHIQKQFDAFTALKDISFTVKKNEFVCLLGPSGCGKTTLLRILAGLEEPTTGSIAVNGKDITALPPGKRNFGMVFQSYALFPNLTALENIEYGLKTKKYGKAEVKEKALDALKLVDLLNVKDKYPAQMSGGQQQRVALARALALSPDILLLDEPLSALDAKVREKLRREMRDLQEKIGVTTIMVTHDQEEALTMADKIVVMNHAEIMQIGTPEEIYQRPANPFVADFIGSINFFSKNNEEHAIRPEHVTIVQKDGIKSVVESMEFRGSVYRTEVRVLEENTHLYNEKIVVDILASEVEATAIRKGKPIQISFSENHMLSYGKKVIV

SEQ ID NO: 65908 - DNA, 1086 bp, Nitrosomonas europaea ATCC 19718
  CDS (1)..(1086): transl_table=11
atggcgttactcgagttgcgcgacgttacccggcgttttggcgacttcaccgcagtagactgcgtcaatctgtcgatcgaggcaggcgagctcttcaccttactgggtccgtccggctgcggaaaaacgacactcctgcgcatgattgccgggttcgatgtacctgattccggccaaatattgctggatggacaggatatcgccaacactccgcccgagaaacgtcctattcatacggtctttcagagctacgccctgtttccgcacatgacagtagcggacaatgttgctttcccattgaagatgtcgggaaagacacctgccgaaatcaaaaaacgagtagaaaaagcactggaagaagtacaactgtccagattcacacaccgttttccgcatgaactgtccggcggacaaaagcagcgggtggcatttgcccgcgggttgatcaaccggccacgcctgctgctgatggatgagccgctcggcgccttggacgcaaagctgcgggaagatatgcaacgggagctgatcagcctgcaaaaagaggtcggcatcactttcgtttttgtcactcactcgcaggatgaagcgctggcgctatcgcagcgaattgctgtcatgaatcaggggcaagtcgagcagatcggtgagccttccgtaatttacagccacccggccaatcgcttcattgccgacttcatcggtaagatcaatctgatggcagcacgggtaacacaggtttccgacaacgacatgacgctggaaatcgaccagctcggcaccaccacactcccactcaaacaaggtatcaaaaccggagatcagggcgtgatggcaatccgcccggaacaagtgagcgtacatgcactggccaggcatgcggaactgccccatgcccataccggcaaagtgctcgattttctctatgttggcgatgtcaccacctatatcgtcgaactggattgcggtatccgcgtggaagccctgctggcgaactcctcacccggacgcgcgcgtttctttgaagtgggtgatccggtcatcgtcagctggacacgggaagccgcccaatttctgatgaactga

SEQ ID NO: 65909 - protein, 361 aa, Nitrosomonas europaea ATCC 19718
MALLELRDVTRRFGDFTAVDCVNLSIEAGELFTLLGPSGCGKTTLLRMIAGFDVPDSGQILLDGQDIANTPPEKRPIHTVFQSYALFPHMTVADNVAFPLKMSGKTPAEIKKRVEKALEEVQLSRFTHRFPHELSGGQKQRVAFARGLINRPRLLLMDEPLGALDAKLREDMQRELISLQKEVGITFVFVTHSQDEALALSQRIAVMNQGQVEQIGEPSVIYSHPANRFIADFIGKINLMAARVTQVSDNDMTLEIDQLGTTTLPLKQGIKTGDQGVMAIRPEQVSVHALARHAELPHAHTGKVLDFLYVGDVTTYIVELDCGIRVEALLANSSPGRARFFEVGDPVIVSWTREAAQFLMN

SEQ ID NO: 65910 - DNA, 1131 bp, Bacillus anthracis str. Ames
  CDS (1)..(1131): transl_table=11
atggatacaagaagaaaaaaggagtgcaatcttgtgattgaattgaaaaatgtttcaaaggtatatcaaaatgcagaggagacagcggttaaaggtgtatcggttcatattaagaagggagaattttttgttttagttggcccttcaggatgtggaaaaagtacattattaagaatgattgctggtttagaagaaatttcttcgggggatttaattattaatgaacgtgttgcaaatgatttagagccgaaagatcgtaatctatcaatggtatttcaaaattatgcactatatccacacttatctgtagaagaaaatattttattcggacttaaggtaaggaaagtacaaaaagaagagcgacaaaagagattaatggaagctgtggaaatggtaggactgaaagagtatgtgaaaatgaaaccaggccaattatcaggtggacaaagacagcgtgttgcgcttgctagggcgattgtgagtcaagcgccgatttgtttaatggatgaaccactttcgaatttagatgcgaaattacgtgcgcaaatgaggattgaaattagagaaattcagcagcgtttaggaattacaatgatttacgttactcacgatcaaatagaagcgatgactatgggagatcgtattatggtcttaaataaaggaagcgtacagcaagttggaacaccgcttgatatatataacaaaccagcgaatgaatttgttgcaagttttatagggtctccttcgatgaatatgaatgatggagaagtagacgaagaaaaaggtgtattacatatagggcaattgcaaatcccattatctattggacaattaaagcaattaccagcaggaactgttcgagtaggcatgcgtccagaacatattgcattgtccgaggaaggacaagaagttacattgcaatctgtagaagtgttagggaatgaatctatattaaacttcgtgataaacggaacaacttggagtgcgaaagtcatcggacagttactcctgaataaaggtgacaaagtaaaattattattctcggaagaaaagttatgcttctttcatcaaaacacgaatgaacgcttaaaagtggtagctgaagaagagttgaaagtggtggcgaaataa

SEQ ID NO: 65911 - protein, 376 aa, Bacillus anthracis str. Ames
MDTRRKKECNLVIELKNVSKVYQNAEETAVKGVSVHIKKGEFFVLVGPSGCGKSTLLRMIAGLEEISSGDLIINERVANDLEPKDRNLSMVFQNYALYPHLSVEENILFGLKVRKVQKEERQKRLMEAVEMVGLKEYVKMKPGQLSGGQRQRVALARAIVSQAPICLMDEPLSNLDAKLRAQMRIEIREIQQRLGITMIYVTHDQIEAMTMGDRIMVLNKGSVQQVGTPLDIYNKPANEFVASFIGSPSMNMNDGEVDEEKGVLHIGQLQIPLSIGQLKQLPAGTVRVGMRPEHIALSEEGQEVTLQSVEVLGNESILNFVINGTTWSAKVIGQLLLNKGDKVKLLFSEEKLCFFHQNTNERLKVVAEEELKVVAK

SEQ ID NO: 65912 - DNA, 996 bp, Bacillus anthracis str. Ames
  CDS (1)..(996): transl_table=11
ttggacgggaaaatgaaaaagattattaaagttgaagcagtagaaaaacattttggaaatcaagtgattatcccaccgctttctttagatattaaagaaggggaatttttaacgattttagggccgagtggttgcgggaaaacgacgttacttcgtatgatcgcaggatttgaaacgccaactaaagggaatcttttattagatgatgaaaagattaacgatttgccaccatataagcgtcatatgaacctagtgttccaacattatgcgctattcccacacatgaatgtggagaaaaatatttgtttcggtatgaaaatgcagaaagtaccggtagcagagcagaaagagcgtgctgaagaggcaatgcgtttaacgcagttacttgagttccgtaatcgtaaacctgcgaagctttctggtggacagcagcagcgtgtagcaattgcgagagcaattgtaaataacccgcgtgtattattactagatgagccacttggggcgttagactttaagttaagaaaagacttgcaacgtgaattgaaaaacttacaacgtaatttaggaattacgttcatatacgtaacgcacgatcaagaagaagcgatgagcatgagtgatcgtatcgttgttatgaataaaggccatattgaacaaatcggaacaccgaaagaaatttataataagccgaaaacgttattcgttgcgacatttatcggtgaaaataatattgtgaaaaacggggaaggctatgtagcaattcgccctgaaaatgtaaaagtgcgttcggttgaagagccgattttaaaagaatatcaccttggacatattgaagacattgagtttgttggaaatatggaaaagctttatgtacgtgatgagaaaacatcagaattactaatggcatatcaaactgctgaagaagcagcgcagtggagcattggagataatgtatacgtaggctgggagcaagaggacgaggtgaccttaaattga

SEQ ID NO: 65913 - protein, 331 aa, Bacillus anthracis str. Ames
MDGKMKKIIKVEAVEKHFGNQVIIPPLSLDIKEGEFLTILGPSGCGKTTLLRMIAGFETPTKGNLLLDDEKINDLPPYKRHMNLVFQHYALFPHMNVEKNICFGMKMQKVPVAEQKERAEEAMRLTQLLEFRNRKPAKLSGGQQQRVAIARAIVNNPRVLLLDEPLGALDFKLRKDLQRELKNLQRNLGITFIYVTHDQEEAMSMSDRIVVMNKGHIEQIGTPKEIYNKPKTLFVATFIGENNIVKNGEGYVAIRPENVKVRSVEEPILKEYHLGHIEDIEFVGNMEKLYVRDEKTSELLMAYQTAEEAAQWSIGDNVYVGWEQEDEVTLN

SEQ ID NO: 65914 - DNA, 1116 bp, Haemophilus ducreyi 35000HP
  CDS (1)..(1116): transl_table=11
atggaaaagttagaacaaaaaacaatcgtcgaacttcgcaatgtgaccaagagttatggtgacaaaacgattcttaaagatttaaatttaactattaatgatggtgaatttttaactattttaggtccttcaggttgtggtaaaactacagcgttgcgtttaattgcaggttttgaagatttaaccgaaggttcaatcattcttgacggtcaagatgtttctaatgtgtctgctgaaaaacgtccagttaatactgttttccagagctatgcactttttcctcatatgaccatttttgaaaatgtggcgtttggattacgcatgcaaaaagtacctaatgagcaaattactccgcgggtaatggaagcattgcgaatggtccgtttggaagatcgagcagaacagaagccggctcaactttcaggtggtcaacaacaacgtattgcgattgcacgtgcggtagtaaacaaaccgaaagtgttattacttgatgaatcattgtcagcacttgattataaattgcgcaaagaaatgcagaatgaattaaaagcattacagcgtcaattaggtattacttttattttcgtgactcatgatcaggaagaagcgttgacgatgtcagatcgtattatcgtgatgaatgcgggcaaagtagctcaagatggtacgccacgtgaaatttatgaagaacccaaaaacctatttgtagcacgttttatcggtgaaattaatgtatttgatgcgactgttattgaacgtattgatgcgcgtaatgtaaaagcgaatgtggaagggcgcatttgtcacattaaagtggaagatatgcaagtcgtgccgaatcagaaactgaaagtattattacgtccggaagatattgtgattgaagagcttgatgaagaccaaagttctaaagcaattattggccacattattgatcgtaactataaaggaatgactttggaatcaagcgtaaaacttgatcataatggtatgaatgtattagttagcgaattttttaatgaagatgatccacatattgatcattccgttgggcagaaagtggcattgacgtggcatgaaggttgggaggttgtactcaacgatgaagattgctaa

SEQ ID NO: 65915 - protein, 371 aa, Haemophilus ducreyi 35000HP
MEKLEQKTIVELRNVTKSYGDKTILKDLNLTINDGEFLTILGPSGCGKTTALRLIAGFEDLTEGSIILDGQDVSNVSAEKRPVNTVFQSYALFPHMTIFENVAFGLRMQKVPNEQITPRVMEALRMVRLEDRAEQKPAQLSGGQQQRIAIARAVVNKPKVLLLDESLSALDYKLRKEMQNELKALQRQLGITFIFVTHDQEEALTMSDRIIVMNAGKVAQDGTPREIYEEPKNLFVARFIGEINVFDATVIERIDARNVKANVEGRICHIKVEDMQVVPNQKLKVLLRPEDIVIEELDEDQSSKAIIGHIIDRNYKGMTLESSVKLDHNGMNVLVSEFFNEDDPHIDHSVGQKVALTWHEGWEVVLNDEDC

SEQ ID NO: 65916 - DNA, 1077 bp, Bordetella pertussis Tohama I
  CDS (1)..(1077): transl_table=11
atgtcccggggcagcgacgcattcctgtcgatacgcaatctggtcaagcactatggcgcccatcgggcgctggccgacgtgtcgctggacatcggggcgggcgagctggtgtgcctgctcggcccctcgggctgcggcaagaccaccctgctgcgcgccatcgccggcctggagcgccaggacggcggcgccatcgtgctgggcggccgcgatatctcgaacgagccgccgcaggcgcgcgactacggcatcctgttccagtcgtatgcgctgtttcccaacctgacggtggcgcagaacgtggcctacgggctgagcggccggcgcggcgaccgcgagcgcgtggccgcccgcgtcgatgaaatgctggccctggtcgggctgagcggcgcggcccgcaagtatccggggcagatttccggcggccagcagcagcgcgtggcgctggcgcgcgccctggcgccggcgccgtcgctgctgctgctcgacgagcccatgtcggcgctggatgcgcgcgtgcgcgaccgcctgcgcggcgaactgcgcgccttgcagcggcgcctttccatcaccacgctgatggtgacccacgaccaggaagaggccatggtcatggccgaccggatcgcggtgatgaacggcggcgtcatcgagcagtacggcacgccgcgcgaactctatcgcgatccccgttcggcattcatcgccgacttcgtgggcgaggccaactggctgcggtaccagcgcatcgacgcccaccgcgcgcgcgtcggccagctcgaactggacgtcgagcagccgctggaggccgacagcggccgcctgttcgtgcggccggaggcggtgcggctgagcgcatcgggtacgccggcctcggccaacaccgtgctggccgatgtgctcgatggcgttttcctggggcgcggctatcgcatctcgctgcggctggaaggaataccgggcgccaccgtgcagtccgtggtttccgctgaaaccggtgacgccctgctgggcgcccatgctgccggccgttgctgggtggagctgccgcgccatgcgctaagtgcctacgcttga

SEQ ID NO: 65917 - protein, 358 aa, Bordetella pertussis Tohama I
MSRGSDAFLSIRNLVKHYGAHRALADVSLDIGAGELVCLLGPSGCGKTTLLRAIAGLERQDGGAIVLGGRDISNEPPQARDYGILFQSYALFPNLTVAQNVAYGLSGRRGDRERVAARVDEMLALVGLSGAARKYPGQISGGQQQRVALARALAPAPSLLLLDEPMSALDARVRDRLRGELRALQRRLSITTLMVTHDQEEAMVMADRIAVMNGGVIEQYGTPRELYRDPRSAFIADFVGEANWLRYQRIDAHRARVGQLELDVEQPLEADSGRLFVRPEAVRLSASGTPASANTVLADVLDGVFLGRGYRISLRLEGIPGATVQSVVSAETGDALLGAHAAGRCWVELPRHALSAYA

SEQ ID NO: 65918 - DNA, 1128 bp, Bordetella parapertussis 12822
  CDS (1)..(1128): transl_table=11
atgagcgacatccgctattcggcgcagcattccgccgatccggacgaattcgtcaaggtctccgacgtcgtcaagattttcggcgacgtggtggccgtgcagtcggtcaacctgtccgtacggcgcaacgagatcttcgcgctgctgggcagctctggcagcggcaagtcgacgctgctgcgcatgctggccggcttcgaggacgccacctcggggcagatcctgctcgacggcgaggacatcaccaatgtgccgccgtaccgccggccggtgaacatgatgttccagtcgtacgcgctgtttccgcacatgacggtcgaggccaacgtggccttcggcctgaagcaggaaggggtggaccgcgccgagatccatgaccgcgtgttcgaggcgctggacctggtccagatggccggctacgcgcgccgcaagccgcaccagctgtccggcgggcagcagcagcgcgtggcgctggcgcgcagcctggtcaagcggcccaagctgctgttgctcgacgagccgatgtcggcgctggacaagcagatccgccagaaaacgcagatcgagctggtcaagatcctgcagcaggtcggcgtgacctgcatcatggtgacgcacgaccagcaagaggccatgaccatggcgcaccgcctggccgtcatgaccgaaggccagatcgtgcagtgcggcaccccgcaggacgtctacgagtttccgaattcgcgtttcgtggcgggcttcatcggctcgaccaacctgttctcgggcaccatcgtggtcgacgagcccgaccatgtcgccatcgagtcgggcgagctgacccggccgctgtacgtcagccacggcgtaagcgagccgctgggcatggaagtgcacgtatcgatccggcccgagcggctggtggtcctgcgcgagcagcccgaggccgagcacaactgggcgcatggcatggtcacccacatggcctggatgggcagctacggcctctaccagatccgcctggactcgggcaagatcgtcgaggccagcgtccccagcctgcaactggcgcgccaggacgcgcccggcatcgacgaggaggtcttcgtcagctgggacgccgatagcgcgacggtgttctcgtcatga

SEQ ID NO: 65919 - protein, 375 aa, Bordetella parapertussis 12822
MSDIRYSAQHSADPDEFVKVSDVVKIFGDVVAVQSVNLSVRRNEIFALLGSSGSGKSTLLRMLAGFEDATSGQILLDGEDITNVPPYRRPVNMMFQSYALFPHMTVEANVAFGLKQEGVDRAEIHDRVFEALDLVQMAGYARRKPHQLSGGQQQRVALARSLVKRPKLLLLDEPMSALDKQIRQKTQIELVKILQQVGVTCIMVTHDQQEAMTMAHRLAVMTEGQIVQCGTPQDVYEFPNSRFVAGFIGSTNLFSGTIVVDEPDHVAIESGELTRPLYVSHGVSEPLGMEVHVSIRPERLVVLREQPEAEHNWAHGMVTHMAWMGSYGLYQIRLDSGKIVEASVPSLQLARQDAPGIDEEVFVSWDADSATVFSS

SEQ ID NO: 65920 - DNA, 1086 bp, Bordetella bronchiseptica RB50
  CDS (1)..(1086): transl_table=11
atgaagaaagtcagcgtcgaatgccgcaacatccggctttcctatggcaggaacgaagtcctcaaggacatcagcatccatatcgagcccggcgaattcttcgccctgctcggcccgtcgggatcgggcaaatccaccctgctgcgcctgatcgccggcttcaaccggcaaagccatgggcagctgctggtcgacggccgcgacatcggcgccacgccgccctgggaccgcaatatcggcatggtgttccagaactatgcgctgtggccgcacatgacggtgtgggacaacgttgccttcggcctggtcgagcggcgcctgccgcgcgccgagatccgcgacaaggtcgccgccgcgctcgaactcgtgggcctggccgacttcgggcggcgccgtcccaaccaactgtccggcggccagcagcagcgcgtggcgctggcgcgcaccattgtcatcgagccgcaggtgctgctgctggacgaacccctgtccaacctggacaagaagctgcgggtgcagatgcgccaggacctgctgtcgctgcagcggcggctgggcatcaccaccatcttcgtcacccacgaccaggaagaggccatgaccacggccgaccgcatggcggtgctggaccatggcgtggtgcagcagatcggcgcgcccagcacgctgttcgactatccggtcaaccgcttcgtggccaacttcgtcggcaccatgaacgtgctggaaggcgaggtgcgcgagcgctcgcgcggcggcgtggtgctggccgtcgacggcgtgggcgagctgcacctgccggtcaatggcgacgcgccgcaggccgggcgcctcgcggccagtttccggccccacactgtgctgatcgaaatggccgacggcacgggcgacgcgcgctatgtgtggctgcccggcgtggtcgaaagcagcgagttcctgggcgagttcacccgctaccaggtgcaggtcggcgaacagcggctgacggcggaccagcaccatctggccggcctgtcgccgtttcccgtcggcgcgcccgtggccgtgggcctggagcccacccagatcaggctgctggcggcatga

SEQ ID NO: 65921 - protein, 361 aa, Bordetella bronchiseptica RB50
MKKVSVECRNIRLSYGRNEVLKDISIHIEPGEFFALLGPSGSGKSTLLRLIAGFNRQSHGQLLVDGRDIGATPPWDRNIGMVFQNYALWPHMTVWDNVAFGLVERRLPRAEIRDKVAAALELVGLADFGRRRPNQLSGGQQQRVALARTIVIEPQVLLLDEPLSNLDKKLRVQMRQDLLSLQRRLGITTIFVTHDQEEAMTTADRMAVLDHGVVQQIGAPSTLFDYPVNRFVANFVGTMNVLEGEVRERSRGGVVLAVDGVGELHLPVNGDAPQAGRLAASFRPHTVLIEMADGTGDARYVWLPGVVESSEFLGEFTRYQVQVGEQRLTADQHHLAGLSPFPVGAPVAVGLEPTQIRLLAA

SEQ ID NO: 65922 - DNA, 1077 bp, Bordetella bronchiseptica RB50
  CDS (1)..(1077): transl_table=11
atgtcccggggcagcgacgcattcctgtcgatacgcaatctggtcaagcactatggcgtccatcgggcgctggccgacgtgtcgctggacatcggtgcgggcgagctggtgtgtctgctcggcccctcgggctgcggcaagaccaccctgctgcgcgccatcgccggcctggagcgccaggatggcggcgccatcgtgctgggcggccgcgatatctcgaacgagccgccgcaggcgcgcgactacggcatcctgttccagtcgtatgcgctgtttcccaacctgacggtggcgcagaacgtggcctatgggctgagcggccggcgcggcgaccgcgagcgcgtggccgcccgcgtcgatgaaatgctggccctggtcgggctgagcggcgcggcccgcaagtatccggggcagatttccggcggccagcagcagcgcgtggcgctggcgcgcgccctggcgccggcgccgtcgctgctgctgctcgacgagcccatgtcggcgctggatgcgcgcgtgcgcgaccgcctgcgcggcgaactgcgcgccttgcagcggcgcctttccatcaccacgctgatggtgacccacgaccaggaagaggccatggtcatggccgaccggatcgcggtgatgaacggcggcgtcatcgagcagtacggcacgccacgcgaactctatcgcgatccccgttcggcattcatcgccgacttcgtgggcgaggccaactggctgcagtaccagcgcatcgacgcccaccgcgcgcgcgtcggccagctcgaactggacgtcgagcagccgctgcaggccgacagcggccgcctgttcgtgcggccggaggcggtgcggctgagcgcatcgggtacgccggcctcggccaacaccgtgctggccgatgtgctcgatggcgttttcctggggcgcggctatcgtatctcgctgcggctggaaggaataccgggcgccaccgtgcagtccgtggtttccgctgaaaccggtgatgccctgctgggcgcccatgctgccggccgttgctgggtggagctgccgcgtcatgcgctacgtgcctacgcttga

SEQ ID NO: 65923 - protein, 358 aa, Bordetella bronchiseptica RB50
MSRGSDAFLSIRNLVKHYGVHRALADVSLDIGAGELVCLLGPSGCGKTTLLRAIAGLERQDGGAIVLGGRDISNEPPQARDYGILFQSYALFPNLTVAQNVAYGLSGRRGDRERVAARVDEMLALVGLSGAARKYPGQISGGQQQRVALARALAPAPSLLLLDEPMSALDARVRDRLRGELRALQRRLSITTLMVTHDQEEAMVMADRIAVMNGGVIEQYGTPRELYRDPRSAFIADFVGEANWLQYQRIDAHRARVGQLELDVEQPLQADSGRLFVRPEAVRLSASGTPASANTVLADVLDGVFLGRGYRISLRLEGIPGATVQSVVSAETGDALLGAHAAGRCWVELPRHALRAYA

SEQ ID NO: 65924 - DNA, 1089 bp, Bordetella bronchiseptica RB50
  CDS (1)..(1089): transl_table=11
atggaaggtcactccccgcagcgcggctcccgaatcctcgagatatccggcgtcaccaaaacgttcggtccgaccacggccctggccggcatagacctggacgtgcgcgaaggcgaattcctcaccttgctgggccccagcggctgcggcaagaccacgctgatccgcatcatcgccggcttcgagacgcccaccgccggcgacgtgcgcatcgacggccgctccatcgtcgccgcgccgccctaccgccgcccgctgggcatggtgttccagagcctggcgctgtttccccatctcaacgtggccgagaacatcggctatggcctgaagatccgccgcgtgccgccggcccggcgccaggccaaggtggcgcaggcgctggagatggtgggcctggccggctacggcgagcgctacatcggccagatatccggcggccagaagcagcgcgtggcgctggcccgcgccatcgtgaccgagccgcgcgtgctgctgctcgacgagccgctgggcgcgctggacatgaagatccggcgccagatgcagaccgaactcaagcagatccaggagtcgctgggcacgaccttcatcttcgtcacgcacgaccaggaggaagccctgaccatgtccgaccgcatcgcggtgttccgcaacggcgcgatcgagcaggtcgacacgccggccgccgtctacgaacgtccggctacccgcttcgtggccgagttcgtcggcgacaccaattttctcgaaggcaccgtcgaccgccaggccggcggcgcgccgcgcgtgcggctggccgactgggattgcagcctgcagccgcccgccgcgcagtgggccgagggcgcgcgggtcggcgtctcgctgcgcccgcaacacttgcgcatcgccgcgctcgagcaaggccgcctgcgcgccaccgtgctgcgccgcgtctatgccgggcagaacacacgcctgtggctggccgtgggccagcgcaagctgctggccgactggcacggcgccgaggacggcgcgccgcccgagccgggcgccaccgtcggcctgacctgggacgaccggcgcgtctgtgtcgtttccctttga

SEQ ID NO: 65925 - protein, 362 aa, Bordetella bronchiseptica RB50
MEGHSPQRGSRILEISGVTKTFGPTTALAGIDLDVREGEFLTLLGPSGCGKTTLIRIIAGFETPTAGDVRIDGRSIVAAPPYRRPLGMVFQSLALFPHLNVAENIGYGLKIRRVPPARRQAKVAQALEMVGLAGYGERYIGQISGGQKQRVALARAIVTEPRVLLLDEPLGALDMKIRRQMQTELKQIQESLGTTFIFVTHDQEEALTMSDRIAVFRNGAIEQVDTPAAVYERPATRFVAEFVGDTNFLEGTVDRQAGGAPRVRLADWDCSLQPPAAQWAEGARVGVSLRPQHLRIAALEQGRLRATVLRRVYAGQNTRLWLAVGQRKLLADWHGAEDGAPPEPGATVGLTWDDRRVCVVSL

SEQ ID NO: 65926 - DNA, 1128 bp, Bordetella bronchiseptica RB50
  CDS (1)..(1128): transl_table=11
atgagcgacatccgctattcggcgcagcattccgccgatccggacgaattcgtcaaggtctccgacgtcgtcaagattttcggcgacgtggtggccgtgcagtcggtcaacctgtccgtacggcgcaacgagatcttcgcgctgctgggcagctctggcagcggcaagtcgacgctgctgcgcatgctggccggcttcgaggacgccacctcggggcagatcctgctcgacggcgaggacatcaccaatgtgccgccgtaccgccggccggtgaacatgatgttccagtcgtacgcgctgtttccgcacatgacggtcgaggccaacgtggccttcggcctgaagcaggaaggggtggaccgcgccgagatccatgaccgcgtgttcgaggcgctggacctggtccagatggccggctacgcgcgccgcaagccgcaccagctgtccggcgggcagcagcagcgcgtggcgctggcgcgcagcctggtcaagcggcccaagctgctgttgctcgacgagccgatgtcggcgctggacaagcagatccgccagaaaacgcagatcgagctggtcaagatcctgcagcaggtcggcgtgacctgcatcatggtgacgcacgaccaggaagaggccatgaccatggcgcaccgcctggccgtcatgaccgaaggccagatcgtgcagtgcggcactccgcaggacgtctacgagtttccgaattcgcgtttcgtggcgggcttcatcggctcgaccaacctgttctcgggcaccatcgtggtcgacgagcccgaccatgtcgccatcgagtcgggcgagctgacccggccgctgtacgtcagccacggcgtaagcgagccgctgggcatggaagtgcacgtatcgatccggcccgagcggctggtggtcctgcgcgagcagcccgaggccgagcacaactgggcgcatggcatggtcacccacatggcctggatgggcagctacggcctctaccagatccgcctggactcgggcaagatcgtcgaggccagcgtccccagcctgcaactggcgcgccaggacgcgcccggcatcgacgaggaggtcttcgtcagctgggacgccgatagcgcgacggtgttctcgtcatga

SEQ ID NO: 65927 - protein, 375 aa, Bordetella bronchiseptica RB50
MSDIRYSAQHSADPDEFVKVSDVVKIFGDVVAVQSVNLSVRRNEIFALLGSSGSGKSTLLRMLAGFEDATSGQILLDGEDITNVPPYRRPVNMMFQSYALFPHMTVEANVAFGLKQEGVDRAEIHDRVFEALDLVQMAGYARRKPHQLSGGQQQRVALARSLVKRPKLLLLDEPMSALDKQIRQKTQIELVKILQQVGVTCIMVTHDQEEAMTMAHRLAVMTEGQIVQCGTPQDVYEFPNSRFVAGFIGSTNLFSGTIVVDEPDHVAIESGELTRPLYVSHGVSEPLGMEVHVSIRPERLVVLREQPEAEHNWAHGMVTHMAWMGSYGLYQIRLDSGKIVEASVPSLQLARQDAPGIDEEVFVSWDADSATVFSS

SEQ ID NO: 65928 - DNA, 1176 bp, Chromobacterium violaceum ATCC 12472
  CDS (1)..(1176): transl_table=11
atgtcggaagccatcgcggccagcaagcaagcagccagccccatcgccagcgccgccccggcgcatgccgtcgccgggaacgaaccgccgtatctgcggatcagcggcgtggtgaagaagttcggcgaccacctggcggtggatcatatcgacctcgacatccgccgcaacgagatcttcgccttgctgggcagctccggctgcggcaagtccacgctgctgcgcatgctggcgggcatggagacgcccaccgccgggcgcatcatcctggacgggcaggacatgcagggactgcggccgtacgagcggccggtcaacatgatgttccagaattacgcgctgttcccgcacatgacggtggagcagaacgtcgccttcggcctgaagcaggacggcgcgccgcgcgacgagatcgccgagcgggtggcgaaaatgctggacctggtgcagatgcgcaaatacgccggccgcaagccgcaccagctgtccggcggccagcagcagcgggtggcgctggcgcgcagcctggtgaagcggcccaagctgctgctgctggacgagccgctgggcgcgctggacaagaagctcaggcagcagacccagctggagctggtcaacaccatcgaggcggtgggcgtcacctgcatcatggtcacccacgaccaggaagaggcgatgaccatgtccagccgcatcggcatcatgagcgaaggcaaactgctgcaggtgggcacgccgaccgagatctacgaatacccaagctgccgcttcaccgccgaattcatcggcgagaccaatatgttcgaaggcgcggtggtggtggacgagccggaccgggtggagatcaattcccgggagctgggcggcgtcatccacatcgaccacggcatcaccggccccaagggcatgcacgtgtgggccagcgtgcggccggaggacgtgcggctggacaagcagccgctgccgccgggcgccaaccgcgccgccggcacggtgcgcgacatcgcctatctggggagctactccgtctatcacgtgcaactggcgggcggcaagatcgtcaaagccgtggtgccatcgtcgcgctggtgcgacgccaacgagaccgcccccacctgggacgagacggtctacctcagctggcgcgccgattcgccggtggtgctgacccagtga

SEQ ID NO: 65929 - protein, 391 aa, Chromobacterium violaceum ATCC 12472
MSEAIAASKQAASPIASAAPAHAVAGNEPPYLRISGVVKKFGDHLAVDHIDLDIRRNEIFALLGSSGCGKSTLLRMLAGMETPTAGRIILDGQDMQGLRPYERPVNMMFQNYALFPHMTVEQNVAFGLKQDGAPRDEIAERVAKMLDLVQMRKYAGRKPHQLSGGQQQRVALARSLVKRPKLLLLDEPLGALDKKLRQQTQLELVNTIEAVGVTCIMVTHDQEEAMTMSSRIGIMSEGKLLQVGTPTEIYEYPSCRFTAEFIGETNMFEGAVVVDEPDRVEINSRELGGVIHIDHGITGPKGMHVWASVRPEDVRLDKQPLPPGANRAAGTVRDIAYLGSYSVYHVQLAGGKIVKAVVPSSRWCDANETAPTWDETVYLSWRADSPVVLTQ

SEQ ID NO: 65930 - DNA, 1008 bp, Chromobacterium violaceum ATCC 12472
  CDS (1)..(1008): transl_table=11
atggcatttctgcaaatcgaccatctgaacaaacgcttcggccagcaggccgtggtccacgatttcaacatgcaggtggaggccggcgagttcgtcaccttcctcggcccgtccggctgcggcaagaccacggtgctgcgcatgatcgccggcttcgagacgcccagcggcggcagcatccgcctggccggcgacgacatcacccgccagtcgccgcaaaaacgcggcatcggcatggtgttccagagctacgcgctgtttcccaacatgaacgtggccgacaacatcgccttcggcctgaagatgcagaagcgctccgccgacgagatccgccgcaaggtgggcgaggtgatcgcgctggtggagttgaacggccgcgagaagcacttcccgcaccagctgtccggcggccagcgccagcgcgtggccctggcccgggcgctggtggtggagccgcgcgtgctgctcttggacgagccgctgtctgcgctggatgcccgcatccgcaagaacctgcgcgagcagatccgcgacatccagcgccgcctgggcctgaccaccgtcttcgtcacccacgatcaggaagaggcgctgaccatgtcggaccgcatcttcgtgatgaaccagggcaaggtggagcaggaaggcgcggccgagaccatctacacccagccggccaccgagttcgtcgcccgcttcatgggcaactacaacctgctgtcggccgagcagagccatgcgctgctggggctggaagttcgcggccacctggcggtgcggccggaatcgatagaactgctcggcaacgatgacgccgacgacaaccaggcgctgccggcggtgatccgccagcaccagctcctgggcaacatcatccgctaccaggtggacgccggcggcgcgacgctgcaagtggaccggctcaaccgccacgcgggcgacctgctgccggccggcgcgccggtgcggctgcgcttcgaccgcgacaatctgcgcgaggtgcgctga

SEQ ID NO: 65931 - protein, 335 aa, Chromobacterium violaceum ATCC 12472
MAFLQIDHLNKRFGQQAVVHDFNMQVEAGEFVTFLGPSGCGKTTVLRMIAGFETPSGGSIRLAGDDITRQSPQKRGIGMVFQSYALFPNMNVADNIAFGLKMQKRSADEIRRKVGEVIALVELNGREKHFPHQLSGGQRQRVALARALVVEPRVLLLDEPLSALDARIRKNLREQIRDIQRRLGLTTVFVTHDQEEALTMSDRIFVMNQGKVEQEGAAETIYTQPATEFVARFMGNYNLLSAEQSHALLGLEVRGHLAVRPESIELLGNDDADDNQALPAVIRQHQLLGNIIRYQVDAGGATLQVDRLNRHAGDLLPAGAPVRLRFDRDNLREVR

SEQ ID NO: 65932 - DNA, 1086 bp, Chromobacterium violaceum ATCC 12472
  CDS (1)..(1086): transl_table=11
atggctctcctggaaatcaaaaatgtggtcaaacgcttcggcgactacacggctgtcaacgacgtcagcctgtcggtcgaggcgggcgagttcttcaccctgccgggaccctccggctgcggcaagaccaccttgctgcgcatgctggccggtttcgaacaaccggacgccggccagattctgctggacggccaggacatgtcgcaggtggcgccggagaagcgtccggtgcataccgtgttccagagctacgcgctgttcccgcacatgacggtgcgcgagaacatcgccttcccgctgaagatggccaagtgggacaagcgcaagatcgccgcccaggtggatgaattgctggaagacgtgcgtctcacccagttcggcgaccgctatccgcacgagatgtcgggcggccagcgccagcgcgtggccatcgcccgcgcgctggtggaccgtccgcgcttgttgctgctggacgagccgctgtccgccctcgacgccaagctgcgcgaggaaatgcagatcgagctgatcaatctgcagaaggaagtgggcatcaccttcgtctacgtcacccacgaccaaggcgaggcgttggcgctgtcgcaccgcatcgcggtgatgagccacggcaaggtggagcagctagacgcgccggagaagctgtacagctatccgaagaaccgcttcgtcgccgacttcctcggccagtgcaacgtgctggaaggcacggtcaaggcgctgcacggcgacgccatgaccgtggcgctgaagggctgcggcgacgtcaagtgccaggcggtggcgggcgtcaaggaaggccagcagggctggctggcgctgcggccggagaaggtgaagctggacaaggagttgccggaactgccggacgaggcctattttaagggccgcgtccatgattgcctgtacctgggcgacgtcaccctctacgtggtggaggtggccgacggcgtgctggtggaggcgatgcagcccaacaacattcccggcgtggccaagttcttcgacgacggcgacgtggtcgagatcgcctggcgcttcgacgccggcagcttcctgacggagtaa

SEQ ID NO: 65933 - protein, 361 aa, Chromobacterium violaceum ATCC 12472
MALLEIKNVVKRFGDYTAVNDVSLSVEAGEFFTLPGPSGCGKTTLLRMLAGFEQPDAGQILLDGQDMSQVAPEKRPVHTVFQSYALFPHMTVRENIAFPLKMAKWDKRKIAAQVDELLEDVRLTQFGDRYPHEMSGGQRQRVAIARALVDRPRLLLLDEPLSALDAKLREEMQIELINLQKEVGITFVYVTHDQGEALALSHRIAVMSHGKVEQLDAPEKLYSYPKNRFVADFLGQCNVLEGTVKALHGDAMTVALKGCGDVKCQAVAGVKEGQQGWLALRPEKVKLDKELPELPDEAYFKGRVHDCLYLGDVTLYVVEVADGVLVEAMQPNNIPGVAKFFDDGDVVEIAWRFDAGSFLTE

SEQ ID NO: 65934 - DNA, 1119 bp, Gloeobacter violaceus PCC 7421
  CDS (1)..(1119): transl_table=11
ttgctgccgccgttgaacgtcgtcgagttggaccaggtcgtcaagtgcttcagtgagcccggcggcaagccactgcgcgccgtggacgcggtgagtctcgcggtgcgggcgggcgaatttttttcgctgttgggcgaaagcggctgcggcaaaaccacggtactcaggctcatcggcggcttcgagcaaccggatggcggcacgatcgcgattgccggtcagccgatggcgggggtaccgccctaccgtcggccggtcaacacggtctttcaaagttacgcgcttttcccgcacctgaacgtgtaccggaacgtcgccttcggcctggagatggagcggttggggcgcggcgaggtgcgtttgcgcgtcgaggagatgctcgccctggtgcgcctggagaagctggccgctcgcaaaccccagcaactttccggcggccagaagcagcgggtggccctggcccgggcgcttgccaaacgcccggcggtgctgctgctcgatgaacctttaagtgcactggatttgcagttgcgccggcagttgcggttggaattgaaggcattgcagcggcagacgggaattacgtttatctttgtcacccacgaccaggaggaggctttgagcctgtctgatcgggtgggggtgatgcgcgcgggaaggcttttgcaggtagggaccgctgcggaaatttacgagcggccgaccagccgcttcgtggccgagttcgtgggcgagaccaactggcttaccgggagcgtcgaatcggtcgaggcgggcgtggtgtcggtgttcgtaccggggatcgatcaggtggtgcggggaatggcgaccgcagccgtggtatcgggggagcgcgtatcggttgcgattcggcccgagaagctggtgctgttgggcgcggacgctgtggcgtgtgccggggtgaaccggttcgccgcgacgttgggagctacccgctacgaaggtgccctgacccgtcaggaggtgctcctggctgggggggagcgcttctggctgttgctgaccaatcgcaatggccgggaagtattggcggagggagcggcgtgtgttttgagcgctgattgtcatgacacgatcgtgcttgcggaggggaattga

SEQ ID NO: 65935 - protein, 372 aa, Gloeobacter violaceus PCC 7421
MLPPLNVVELDQVVKCFSEPGGKPLRAVDAVSLAVRAGEFFSLLGESGCGKTTVLRLIGGFEQPDGGTIAIAGQPMAGVPPYRRPVNTVFQSYALFPHLNVYRNVAFGLEMERLGRGEVRLRVEEMLALVRLEKLAARKPQQLSGGQKQRVALARALAKRPAVLLLDEPLSALDLQLRRQLRLELKALQRQTGITFIFVTHDQEEALSLSDRVGVMRAGRLLQVGTAAEIYERPTSRFVAEFVGETNWLTGSVESVEAGVVSVFVPGIDQVVRGMATAAVVSGERVSVAIRPEKLVLLGADAVACAGVNRFAATLGATRYEGALTRQEVLLAGGERFWLLLTNRNGREVLAEGAACVLSADCHDTIVLAEGN

SEQ ID NO: 65936 - DNA, 1143 bp, Vibrio vulnificus YJ016
  CDS (1)..(1143): transl_table=11
ttggccaatgtgggagaaatacagacgttgaacgctaaacaaaatgcaggacaaccagtaatccgtttatctggtatcagtaagagtttcgatggtaaggaaatcatcggtaatttaaacctggacgttaatcacggtgaatttttaacgattctaggtccttctggctgtggtaaaacaaccgttttacgcatgatcgcaggttttgaaactgcagataatggccaaattacgatcgacaatcaggatgtcactaacgttcctgcagaacaaaggcatgtcaacacggtattccaaagttacgcattgttcccacatatgactgtgtttgataatgttgcgtttggcttacgtatgcagaaggtccctgctgctgaaatcgaacctcgcgtaatggacgcgcttaaaatggttcgtctagagagcatggctcagcgtaaacctcatcagctttctggtggtcaacagcagcgtattgcaattgcgcgtgctgtggtgaacaagccaaaagtactattacttgatgaatccctatcagcgcttgattacaaattacgtaagcaaatgcagattgagcttaagcagctacagcgacagcttggcatcacctttattttcgtgacgcacgatcaggaagaagcactatcgatgtcagaccgcattatcgtcatgcgctcaggcgttatcgagcaagatggctctcctcgtgaaatctacgaagatccgaaaaacttatttgttgcgcgctttatcggcgaaatcaacgtgtttgaagcaacggccaaagaacgccttgatgaaaaccgtattcgtgctgagattgaaggcgtcgactcagtggtttacttcgatcaaccggtaacggaaggtcagaaactgcaagtgctacttcgtccagaagacttacgtattgaagagatcaaagaatccgaagagaaaggtattgtcggtcatgttaccgagcgtacttacaaagggatgactcttgattctgttattgaaacggaatctggcatgcgtgtaatggtaagcgagttctttaacgaagatgatcctgatgtggaccactctttgggacaaaaagtcgccattacttgggttgaaagctgggaagtggtgctaagcgatgagcaagaaatttag

SEQ ID NO: 65937 - protein, 380 aa, Vibrio vulnificus YJ016
MANVGEIQTLNAKQNAGQPVIRLSGISKSFDGKEIIGNLNLDVNHGEFLTILGPSGCGKTTVLRMIAGFETADNGQITIDNQDVTNVPAEQRHVNTVFQSYALFPHMTVFDNVAFGLRMQKVPAAEIEPRVMDALKMVRLESMAQRKPHQLSGGQQQRIAIARAVVNKPKVLLLDESLSALDYKLRKQMQIELKQLQRQLGITFIFVTHDQEEALSMSDRIIVMRSGVIEQDGSPREIYEDPKNLFVARFIGEINVFEATAKERLDENRIRAEIEGVDSVVYFDQPVTEGQKLQVLLRPEDLRIEEIKESEEKGIVGHVTERTYKGMTLDSVIETESGMRVMVSEFFNEDDPDVDHSLGQKVAITWVESWEVVLSDEQEI

SEQ ID NO: 65938 - DNA, 1143 bp, Rhodopseudomonas palustris CGA009
  CDS (1)..(1143): transl_table=11
atgacggagcacgctgatcccgcgccggccgaggttgccggtgaaccgctgttacgtatcgaagccgtggagaaacggttcggcgggttcgtcgccgtcgaccggctgtcgctggacatcaaggccggcgagttcttcgcgctgctgggtcccagcggttgcggcaagacgacgctgttgcggatgctagcgggattcgagacgccggatgccgggcgcatcctgctgaacggcgtggatatcgccgcggtgctgccgcacgagcgcccggtcaacatgatgttccagaactacgcgctgtttccgcacctcacggtcgcggccaacatcgcgttcggcctgaagcgggcccggctgccgcgcaaggagatcaaggcgcgggtcgccgaaatgctggcgctggtgaggctcgaaggactgggcaagcgcaagccggatcagctctccggcggtcagcagcagcgcgtcgcgctggcgcgggcgctggcgctgcggccgaagttgctgctgctcgacgagccgatggcggcgctggacaagaagctgcgcgaaagcactcaactcgaactgatggcgctgcagaagcggctcggaatgaccttcgtgatcgtcacccacgatcagcaggaggcgatgacgatggcggaccgtatcggcgtgatgcgcgccggcaagctcgaccaggtcgcagtgccgcggcagctctacgaagcgccggcgtcgcgctgggtcgccgagttcgtcggtgacgtcaacatgctggaaggcagcgtcgccggccgcgacaacggacgcatcaccgttgcgaccggcggggccggcgaggtcgtggtggccgaaccgcgcgaggcgctgcagaccgaagcgatctcggtcgcgatccggccggagaagatcaagctgtcgctgcgcggcccggccgccgatgccggccacgccgatgcgatcaaccggctcgacggcaccatcaccgacatcggctatgccggcggcatgaccagctacaaggttcggctcgatcacggcgccaccttgctggccgcgatggccaatacgacgcggctcgacgtcgatgcgtatcacgccggccagcacgtggtggcgtggttctcgcccgacgactgcgtggtgctgacccgatga

SEQ ID NO: 65939 - protein, 380 aa, Rhodopseudomonas palustris CGA009
MTEHADPAPAEVAGEPLLRIEAVEKRFGGFVAVDRLSLDIKAGEFFALLGPSGCGKTTLLRMLAGFETPDAGRILLNGVDIAAVLPHERPVNMMFQNYALFPHLTVAANIAFGLKRARLPRKEIKARVAEMLALVRLEGLGKRKPDQLSGGQQQRVALARALALRPKLLLLDEPMAALDKKLRESTQLELMALQKRLGMTFVIVTHDQQEAMTMADRIGVMRAGKLDQVAVPRQLYEAPASRWVAEFVGDVNMLEGSVAGRDNGRITVATGGAGEVVVAEPREALQTEAISVAIRPEKIKLSLRGPAADAGHADAINRLDGTITDIGYAGGMTSYKVRLDHGATLLAAMANTTRLDVDAYHAGQHVVAWFSPDDCVVLTR

SEQ ID NO: 65940 - DNA, 1146 bp, Rhodopseudomonas palustris CGA009
  CDS (1)..(1146): transl_table=11
atggccgagccagtggctctgcgcgcaggaggtttcggcgcgcgaggagcaggatcgcaggccgcacaagagcggcaggtcatcggctccagcatcgcggtacgcgaagcagaaaagcgctacggtcagtttcacgcggtcgaccggatcaatctcgacatcgagcccggcgaattcatcacgctgctcggcccgtcgggcagcggcaagacgacgctgctcaatctgctcgccggcttccagaccctcgatggcggcgaaatcctggtcgacggcaagccggtgcacaacgtgccgacgcacaagcgcggcttcggcatggtgtttcaaagctacgcgctgtttcccaacatgacggtgacgcagaacgtcgcgttcccgctgcgcatggcgggcgtcgaccgcgccaccacggcgcgccgcgtcgccgagacgctggagatcatgcggctgtcggcccatgccaacaaatcgccgtcggaaatgtcgggcggtcagcagcagcgcgtcgccatcgcacgcgcgatcgtgatgcggccgaaggtcgtgctgatggatgagccgctcagcgcgctcgaccgccgcctgcgcgagtcgatccagatcgaaattcgcgaccttcaccagaccatcggcagcaccatcctgttcgtcacccatgaccagggcgaagcgctgaccatgagcgatcgcattgctgtgctggatgccggcaagatcgtgcagatcggccgtccgctcgacatctaccgtcaccccgccaatcgcttcgtggcctcgttcgtcggtgagagcaatctgatcgaagcggagatcatgcagaagcgcggcaccacggtgacgctcaagaaccggtccggctacgtgttcgacgccgagagccgcgacgccatcgacgtcggccgcgtcaccgtgctggtacggcccgagcggatcgcgattgcggacgagccgaccgcgaactcgaccccggtgaccgtgacctcggcgatcttcctcggtgagacactgcgtatcgaagcgcagatggaaagcggcgagacgctgcttgtgcgctgccccgacagcgccaagcggccgttgccgaatgtcggcgaccgactgcatgtcggctggggtccggaagactgctgggtgctggcatga

SEQ ID NO: 65941 - protein, 381 aa, Rhodopseudomonas palustris CGA009
MAEPVALRAGGFGARGAGSQAAQERQVIGSSIAVREAEKRYGQFHAVDRINLDIEPGEFITLLGPSGSGKTTLLNLLAGFQTLDGGEILVDGKPVHNVPTHKRGFGMVFQSYALFPNMTVTQNVAFPLRMAGVDRATTARRVAETLEIMRLSAHANKSPSEMSGGQQQRVAIARAIVMRPKVVLMDEPLSALDRRLRESIQIEIRDLHQTIGSTILFVTHDQGEALTMSDRIAVLDAGKIVQIGRPLDIYRHPANRFVASFVGESNLIEAEIMQKRGTTVTLKNRSGYVFDAESRDAIDVGRVTVLVRPERIAIADEPTANSTPVTVTSAIFLGETLRIEAQMESGETLLVRCPDSAKRPLPNVGDRLHVGWGPEDCWVLA

SEQ ID NO: 65942 - DNA, 879 bp, Bdellovibrio bacteriovorus HD100
  CDS (1)..(879): transl_table=11
atgttggaacttctgaatatcggcaagagtttttccagtcaaacggccctgaagggaatcaacctttccattggggaaggggagttcttttccctgttgggtcccagcggctgtggaaaaacaacacttcttcgcatcattgccggtcttgaaagtgccacttccggtcaaattctgctggatggtcagcgcgtggatcatcttcctgctcaaaaacgtccctttaacatggtctttcagcgctatgctctttttccgcacatgacggtgggggaaaatatcgcctatggtctgcgcctgaaggggttggggaaagaccagatcgaggccaaggtggcagaagtcctggccttggtggatatgggcgagttccgggaccgcaagcctgaaactttgtccggcggtcagtcgcagcgtgtggctgtggcccgcgccttggtgaatgaaccccgtgtgcttttgctggatgagcctttgtcggcgctggattaccgcatgcgtgagcacatgcaaaaagagctgcgcgctttgcaacaaaagctgggtctgacatttatctgtgtgactcacgatcaggaagaagctctggcgctgtcagatcgtatcggtatcatgagtcgcggggttttggaacaggtcagctctccgcgtgagatttatgagaatccggaaacgatcttcgcctctcagtttgtagaatccaccagtctgctgcgtggtgagttggtggaggtcagtcaggatctggccaccatccgtctgggagatggcagccttatcaaaggtaaaatcaatgtcccaccggatcagatccgcctggggatgagcattgaagcctacgtccgtcgcgccatggtctttggcgagcgtgaaaagtga

SEQ ID NO: 65943 - protein, 292 aa, Bdellovibrio bacteriovorus HD100
MLELLNIGKSFSSQTALKGINLSIGEGEFFSLLGPSGCGKTTLLRIIAGLESATSGQILLDGQRVDHLPAQKRPFNMVFQRYALFPHMTVGENIAYGLRLKGLGKDQIEAKVAEVLALVDMGEFRDRKPETLSGGQSQRVAVARALVNEPRVLLLDEPLSALDYRMREHMQKELRALQQKLGLTFICVTHDQEEALALSDRIGIMSRGVLEQVSSPREIYENPETIFASQFVESTSLLRGELVEVSQDLATIRLGDGSLIKGKINVPPDQIRLGMSIEAYVRRAMVFGEREK

SEQ ID NO: 65944 - DNA, 984 bp, Bacillus cereus ATCC 10987
  CDS (1)..(984): transl_table=11
atgaaaaagattattaaagttgaagcagtagaaaaacattttggaaatcaagtgattatcccaccgctttctttagatattaaagaaggggaatttttaactattttagggccgagtggttgcgggaaaacgacgttacttcgtatgatcgcaggatttgaaacgccaactaaagggaatcttttattagatgatgaaaagattaacgatttgccaccatataagcgtcatatgaacctagtgttccaacattatgcgctattcccacatatgaatgtggagaaaaatatttgtttcggtatgaaaatgcagaaagtaccggcagcagagcagaaagagcgtgctgaagaggcaatgcgtttaacgcagttacttgagttccgtaatcgtaaacctgcaaagctttctggtggacagcagcagcgtgtagcaattgcgagagcgattgtaaataacccgcgtgtattattactagacgagccacttggggcgttagactttaagttaagaaaagacttgcaacgtgaattaaaaaacttacaacgtaatttaggaattacgttcatatacgtaacgcacgatcaagaagaagcgatgagcatgagtgatcgtatcgttgttatgaataaaggccatattgaacaaatcggaacgccgaaagaaatttataataagccgaaaacgttgttcgttgcgacatttatcggtgaaaataatattgtgaaaaacggggaaggctatgtagcaattcgccctgaaaatgtaaaagtgcgttcggttgaagagccaattttaaaagaataccaccttggccatattgaagacattgagtttgttggaaatatggaaaagctttatgtacgtgatgagaaaacatcagaattactaatggcatatcaaactgctgaagaagcagcacagtggagcattggagataatgtatacgtaggctgggagcaagaggacgaggtgaccttaaattga

SEQ ID NO: 65945 - protein, 327 aa, Bacillus cereus ATCC 10987
MKKIIKVEAVEKHFGNQVIIPPLSLDIKEGEFLTILGPSGCGKTTLLRMIAGFETPTKGNLLLDDEKINDLPPYKRHMNLVFQHYALFPHMNVEKNICFGMKMQKVPAAEQKERAEEAMRLTQLLEFRNRKPAKLSGGQQQRVAIARAIVNNPRVLLLDEPLGALDFKLRKDLQRELKNLQRNLGITFIYVTHDQEEAMSMSDRIVVMNKGHIEQIGTPKEIYNKPKTLFVATFIGENNIVKNGEGYVAIRPENVKVRSVEEPILKEYHLGHIEDIEFVGNMEKLYVRDEKTSELLMAYQTAEEAAQWSIGDNVYVGWEQEDEVTLN

SEQ ID NO: 65946 - DNA, 1002 bp, Bacillus cereus ATCC 10987
  CDS (1)..(1002): transl_table=11
atgagcgaatatttatcaattcaacacattcaaaaacagtttgatgcatttacagcgttaaaagatatttcttttactgtgaaaaaaaatgagtttgtatgtttattaggcccaagtggttgtgggaaaacaacattgcttcgaattttagcagggctagaagaggcgacaacaggtagtatagctgtgaatggaaaagatattacagcattacctcctggaaagaggaatttcggaatggtgtttcaatcctatgcgttatttccgaatttaacagcacttgaaaacattgaatacggcttaaagacaaaaaagtatggaaaagcagaagtaaaagagaaggcgctatcggcgttagaactagttgatttactgaatgtaaaagataaatatcctgctcaaatgtctggtggacaacagcagcgagtagcacttgcacgtgcactcgctctgtctccggatattttgttactcgatgagccgttatctgctttagatgcaaaagtacgtgaaaagttacgtagagaaatgcgtgatttgcaagaaaaagtaggagtgacaactattatggtcacgcatgatcaagaagaggcattaacgatggctgataaaattgttgtaatgaatcatgcggaaattatgcagattggcacaccagaggagatttaccaaaggccagccaatccatttgtggcagattttattggttctattaatttcttttcgaaaaataacgaagaacatgcaattcgtccggaacatgtaacagtcgtacaaaataatggtatgaaaacaattgtagaaagcatggagtttcgcggatctgtataccggacagaagtgcgcgttatagatgaggaaacgcatctatataatgagaaaatcgttgtagatatattggcatcagaagtagaaaaaacagctattaggaaaggaaagccgattcaaatctctttctcagaaaatcatatgttgtcatatggaaagaaggttgttgtatag

SEQ ID NO: 65947 - protein, 333 aa, Bacillus cereus ATCC 10987
MSEYLSIQHIQKQFDAFTALKDISFTVKKNEFVCLLGPSGCGKTTLLRILAGLEEATTGSIAVNGKDITALPPGKRNFGMVFQSYALFPNLTALENIEYGLKTKKYGKAEVKEKALSALELVDLLNVKDKYPAQMSGGQQQRVALARALALSPDILLLDEPLSALDAKVREKLRREMRDLQEKVGVTTIMVTHDQEEALTMADKIVVMNHAEIMQIGTPEEIYQRPANPFVADFIGSINFFSKNNEEHAIRPEHVTVVQNNGMKTIVESMEFRGSVYRTEVRVIDEETHLYNEKIVVDILASEVEKTAIRKGKPIQISFSENHMLSYGKKVVV

SEQ ID NO: 65948 - DNA, 1095 bp, Yersinia pestis biovar Medievalis str. 91001
  CDS (1)..(1095): transl_table=11
gtgtgcgcaatgagaacctatgtcagcttcaaaaatatcaagaagagctacgatggcgacaagttggtcgttaaaaacctgaatctggacattcatgagggggattttttaaccctgctcggtccttctggttcaggtaaaaccaccagcctaatgatgctagccgggtttgaaacccccactcaaggcgagattacgctgcgtgataaacccctgcataacctgccccctcaccaacgggggatcggtatggttttccaaaattatgccctcttcccacatatgaccgtaactgaaaatctggcctttccactcacgatccgccgattgaataaggctgatatcaaagagaaaattgaccgtatattggatatggtgaagttgaagaatttggctgaccgctatcccgcgcagatgtctggtgggcagcagcaacgggttgcattggcacgtgccttggtatttgagcccaaactggtgctgatggatgaaccactcggggcgctggataagcagttacgtgagcatatgcaattggaaatcaaacagttacataaaatgcttgaattgaccattgtctacgtcacccatgaccaaagcgaagcaatgactctgtcaaatcgggtggtggtatttaacgatggtattattcagcaaatggatagcccaagcgtgatttatgaacagccaagcaatacttttgtggcgcaatttattggtgaaaacaactgcttactggccgttaatcagggcagtgacggggaatattaccgtgccatgttggacgatggcacccgcctgcaagcattaaaagtgtgccccagctcaccgggtaaaaaaattatgttatgtattcggccggagcgcgtcagtgtgaatcatcctgcggcgggcagccagcagatcaaggcccgcattcagcaatttatttatctgggggatcatgtgcggatgatgacggaagttgcaggccaagggaatttcatggtgaaactctctgccgcgcatatcgaaccacactggcagccgggaagtgaggtgttgctgtcgtggatgcctgcgcatttaagggcactggagggggtgacacactga

SEQ ID NO: 65949 - protein, 364 aa, Yersinia pestis biovar Medievalis str. 91001
MCAMRTYVSFKNIKKSYDGDKLVVKNLNLDIHEGDFLTLLGPSGSGKTTSLMMLAGFETPTQGEITLRDKPLHNLPPHQRGIGMVFQNYALFPHMTVTENLAFPLTIRRLNKADIKEKIDRILDMVKLKNLADRYPAQMSGGQQQRVALARALVFEPKLVLMDEPLGALDKQLREHMQLEIKQLHKMLELTIVYVTHDQSEAMTLSNRVVVFNDGIIQQMDSPSVIYEQPSNTFVAQFIGENNCLLAVNQGSDGEYYRAMLDDGTRLQALKVCPSSPGKKIMLCIRPERVSVNHPAAGSQQIKARIQQFIYLGDHVRMMTEVAGQGNFMVKLSAAHIEPHWQPGSEVLLSWMPAHLRALEGVTH

SEQ ID NO: 65950 - DNA, 1104 bp, Thermus thermophilus HB27
  CDS (1)..(1104): transl_table=11
ttgccccccggggcggcgcgccctaaactgggcgtcgtggccgaggtgctggtgcgtctccagggggtgcggaagcgctacggaaccaccgtggccctggacggggtggacctcgaggtccataggggcgagttcttcagcctcctcgggccctcgggctgcggcaagaccacccttttgcggctcctcgccgggtttgagaccccggacgcgggccggatagagatcggcggccgggacatggcccgggttcccccctacgagcgcccggtgaacaccgtctttcagaactacgccctcttcccccacatgaccgtggaggcgaacatcgccttcggcctcaggatgaaaggccttcccccggaggccatccgggagaaggtggcctgggcgttggagctcgtggacctcctgggcctggagaagcgctaccccagggagctttccggggggcagaagcagcgggtggccctggcccgggccctggtcttggagccccaggtcctcctcctggacgagcccctctccgccctggacgcaaggctccgccaggacctcagggtggagctcatgcagctccagaggcggcttggcaccaccttcatcttcgtcacccacgaccaggaggaggccctggtcatgtccgaccgcatcgccgtgatgcgctcgggccgcattgagcaggtggggcttcccgacgaggtctacgagcgccccaagacccgcttcgtggcggcctttctcggccgctccaacttcctccccgcaaggccccaccccttgggggccgaaacccctttggggcctctgcgccttaaggcccctttggcgcgggaggcccttttggccatccgcccggagaagatccggctctacccggcccaggggggggttcccgcccgggagaacctggtgcgggcggtggtggaggagatcgtctacacgggggcggagaaccagtactacctgagggcgggggaggtgaggcttctggcctataccctgaaccaggacctgcaggagcccggggccgaggagttcgggtacggggaagaggtcctctgctacctccccccggagaacctggtggtggtccatgaatga

SEQ ID NO: 65951 - protein, 367 aa, Thermus thermophilus HB27
MPPGAARPKLGVVAEVLVRLQGVRKRYGTTVALDGVDLEVHRGEFFSLLGPSGCGKTTLLRLLAGFETPDAGRIEIGGRDMARVPPYERPVNTVFQNYALFPHMTVEANIAFGLRMKGLPPEAIREKVAWALELVDLLGLEKRYPRELSGGQKQRVALARALVLEPQVLLLDEPLSALDARLRQDLRVELMQLQRRLGTTFIFVTHDQEEALVMSDRIAVMRSGRIEQVGLPDEVYERPKTRFVAAFLGRSNFLPARPHPLGAETPLGPLRLKAPLAREALLAIRPEKIRLYPAQGGVPARENLVRAVVEEIVYTGAENQYYLRAGEVRLLAYTLNQDLQEPGAEEFGYGEEVLCYLPPENLVVVHE

SEQ ID NO: 65952 - DNA, 1122 bp, Parachlamydia sp. UWE25
  CDS (1)..(1122): transl_table=11
atggtagaaggcatcgtttttgaacatgtttcaaaaaaatttgcagatagtatagccctgaatgatgtgtcatttgctattaataaaggagagtttttttctcttctaggccctagtggatgtggaaaaacaacactattaaggattttggcaggatttgaaaaacctgatcaaggaaggattttacttgacgggcaagacatcactaaactccctgcgaataaacgacctatcaacaccgtttttcaaaactatgctttatttcctcatttaacgatttgggaaaatatcgcttttggccttcgcatcgctcagcgttctgaaacagaaatcaaacgagaagtcgagcagatgctgggtttaattcagatgaaagaacacggacataaaaagcctgatcaaattagcggggggcaaaagcaacgtgtagctattgcaagagctttagtcaaccatcctcgcattttattactagatgaacccttagcggcattggatttaaaattacgccaaaaaatgctcttagatttagatcgtattcatgatgaagtgggaatcacatttatttttgttactcatgatcaaagcgaggctatggctgttagtgatcgcattgctgttttacataaagggagtttagagcaaattggaaatcctatagaaatttatgaaatgcccaaaagtagttttgtggcagattttattggtgacaccaatttttttgatggttgggtaaaagagacggctcaaaaggaatacagtcttgttgatgtagaaggatttcctcaaatttattgttttaatgataaacaactatcgaaaggagatgctgttcatcttagtgtaaggccagaaaaaattcatatctctcgcgaacaaattcaggcccatcctctccaaaatgtttttcaggggattgtcgatgatgtcatttacaaaggggatcatactcattttggtattcaagtcggagatcgaaaaatttctgtcaatcaacaacacagtcgtttccttctcgatgaagcccccattaaatggaaagatgtagtgtggatttggtggcattcagatgatggatttatcttggagcgatgccaaaagctcgagaataacaatgaatag

SEQ ID NO: 65953 - protein, 373 aa, Parachlamydia sp. UWE25
MVEGIVFEHVSKKFADSIALNDVSFAINKGEFFSLLGPSGCGKTTLLRILAGFEKPDQGRILLDGQDITKLPANKRPINTVFQNYALFPHLTIWENIAFGLRIAQRSETEIKREVEQMLGLIQMKEHGHKKPDQISGGQKQRVAIARALVNHPRILLLDEPLAALDLKLRQKMLLDLDRIHDEVGITFIFVTHDQSEAMAVSDRIAVLHKGSLEQIGNPIEIYEMPKSSFVADFIGDTNFFDGWVKETAQKEYSLVDVEGFPQIYCFNDKQLSKGDAVHLSVRPEKIHISREQIQAHPLQNVFQGIVDDVIYKGDHTHFGIQVGDRKISVNQQHSRFLLDEAPIKWKDVVWIWWHSDDGFILERCQKLENNNE

SEQ ID NO: 65954 - DNA, 1107 bp, Desulfovibrio vulgaris subsp. vulgaris str. Hildenborough
  CDS (1)..(1107): transl_table=11
atggcggaaaaggacaacatcattgaattgcgcggcgtcacgaagaacttcgaagacacctgcgcactcgacaatatcgacctcgaaatccgtaacggcgaattcctgacgctgctcggcccttcgggctgcggcaagaccaccatcctgcggctcatctccggcttcgagaagcccgatgcgggtgtcatcaccctcaagggacagcgcatggatgacgccccgcccgaggcgcggcaggtcaacacggtgttccagaactacgcgctcttcccgcacatgtcggtgcgcgagaacgtggggttcggcctgcggatgcagcgtcgccccaaggacgagatcgcccggcgcgtgcacgacgccctgcgcatggtgcatctcgaagcccacgccgaccgccgcccccgccagctttcgggcgggcagcagcagcgcgtggccatcgcccgcgccgtggtcaacaacccgctggtgctgctgctcgacgaaccgttcagcgcactcgactacaagctgcgcaagcagatgcagctcgagatcaagcacctgcaacggcagctcggcatcaccttcgtcttcgtcacccacgatcaggaagaggcatttgccatgtccgaccgtgtggtggtcatgaacgacggcaagatcgaacagataggctcgccgcaggaaatctacgaagaacccgccaacctgtacgtggcgcgcttcgtgggtgagatcaacatcctgaacgcggtcatcgccgcgaaccacggcgacgggctgtacgatgccgtcatcgagggagtgaccttcccgatacgcagccagcgcaccttcgcccccggcgacaaggtgaacgtgctgctgcgccccgaagacctgcgcgtgtacaccctcaccgaagaccgccccgcggggccgcatctcaccggacgcatcgaggagtcggtgtacaagggtgccacggtggacctcatcgtcaccctctccgatggtcgcaggctcatggctgccgagttcttcaacgaggacgacgtcgacatcaactacaatcccggcgagaccgtcacggtgagctgggtcgacggctgggaggtcgtgctgcccgatggcgaagcgtaa

SEQ ID NO: 65955 - protein, 368 aa, Desulfovibrio vulgaris subsp. vulgaris str. Hildenborough
MAEKDNIIELRGVTKNFEDTCALDNIDLEIRNGEFLTLLGPSGCGKTTILRLISGFEKPDAGVITLKGQRMDDAPPEARQVNTVFQNYALFPHMSVRENVGFGLRMQRRPKDEIARRVHDALRMVHLEAHADRRPRQLSGGQQQRVAIARAVVNNPLVLLLDEPFSALDYKLRKQMQLEIKHLQRQLGITFVFVTHDQEEAFAMSDRVVVMNDGKIEQIGSPQEIYEEPANLYVARFVGEINILNAVIAANHGDGLYDAVIEGVTFPIRSQRTFAPGDKVNVLLRPEDLRVYTLTEDRPAGPHLTGRIEESVYKGATVDLIVTLSDGRRLMAAEFFNEDDVDINYNPGETVTVSWVDGWEVVLPDGEA

SEQ ID NO: 65956 - DNA, 996 bp, Bacillus thuringiensis serovar konkukian str. 97-27
  CDS (1)..(996): transl_table=11
ttggacgggaaaatgaaaaagattattaaagttgaagcagtagaaaaacattttggaaatcaagtgattatcccaccgctttctttagatattaaagaaggggaatttttaacgattttagggccgagtggttgcgggaaaacgacgttacttcgtatgatcgcaggatttgaaacgccaactaaagggaatcttttattagatgatgaaaagattaacgatttgccaccatataagcgtcatatgaacctagtgttccagcattatgcgctattcccacatatgaatgtggagaaaaatatttgtttcggtatgaaaatgcagaaagtaccggcagcagagcagaaagagcgtgctgaagaggcaatgcgtttaacgcagttacttgagttccgtaatcgtaaacctgcgaagctttctggtggacagcagcagcgtgtagcaattgcgagagcgattgtaaataacccgcgtgtattattactagatgagccacttggggcgttagactttaagttaagaaaagacttgcaacgtgaattgaaaaacttacaacgtaatttaggaattacgttcatatacgtaacgcacgatcaagaagaagcgatgagcatgagtgatcgtatcgttgttatgaataaaggccacattgaacaaatcggaacaccgaaagaaatttataataagccgaaaacgttattcgttgcgacatttatcggtgaaaataatattgtgaaaaacggggaaggctatgtagcaattcgccctgaaaatgtaaaagtgcgttcggttgaagagcggattttaaaagaatatcaccttggacatattgaagacattgagtttgttggaaatatggaaaagctttatgtacgtgatgagaaaacatcagaattactaatggcatatcaaactgctgaagaagcagcgcagtggagcattggagataatgtatacgtaggctgggagcaagaggacgaggtgaccttaaattga

SEQ ID NO: 65957 - protein, 331 aa, Bacillus thuringiensis serovar konkukian str. 97-27
MDGKMKKIIKVEAVEKHFGNQVIIPPLSLDIKEGEFLTILGPSGCGKTTLLRMIAGFETPTKGNLLLDDEKINDLPPYKRHMNLVFQHYALFPHMNVEKNICFGMKMQKVPAAEQKERAEEAMRLTQLLEFRNRKPAKLSGGQQQRVAIARAIVNNPRVLLLDEPLGALDFKLRKDLQRELKNLQRNLGITFIYVTHDQEEAMSMSDRIVVMNKGHIEQIGTPKEIYNKPKTLFVATFIGENNIVKNGEGYVAIRPENVKVRSVEERILKEYHLGHIEDIEFVGNMEKLYVRDEKTSELLMAYQTAEEAAQWSIGDNVYVGWEQEDEVTLN

SEQ ID NO: 65958 - DNA, 1101 bp, Bacillus thuringiensis serovar konkukian str. 97-27
  CDS (1)..(1101): transl_table=11
gtgggcagcagaaaatcgcgacaaaattttagaaaaatgggaaaaagagtttggtcaaaaagcagaaccgaaaaagtaagtgagtgggagagagaaaaaatgagcgaatatttatcaattcaacacattcaaaaacagtttgatgcatttacagcgttaaaggatatttcttttactgtgaaaaaaaatgagtttgtatgtttattaggtccaagtggctgtgggaaaacaacattgcttcgaattttagcagggctagaagaggcgacaacaggtagtatagctgtgaatggaaaagatattacagcattacctcctggaaagaggaatttcggaatggtatttcaatcatatgcattatttccgaatttaacagcacttgaaaacattgaatacggcttaaaggcaaaaaagtatggaaaagcagaagtaaaagagaaggcgctatcggcgctagaactagttgatttactgaatgtaaaagataaatatcctgctcaaatgtctggtggacaacagcagcgagtagcacttgcacgtgcactcgctctgtctccggatattttgttactagatgagccgttatctgctttagatgcaaaagtacgtgaaaagttacgtagagaaatgcgtgatttgcaagaaaaagtaggagtaacaactattatggtcacgcatgatcaagaagaggcattaacgatggctgataaaattgttgtaatgaatcatgcggaaattatgcagattggcacaccagaggagatttaccaaagaccagcaaatccgtttgtggcagattttattggttctattaatttcttttcgaaaaataacgaagaacatgcaattcgtccggagcatgtaacagtcgtacaaaataatggtatgaaaacaattgtagagagcatggagtttcgtgggtctgtataccggacagaagtgcgagttatagatgagaaaacacacctatataatgagaaaatcgttgtagatatattggcatcagaagtagaaaaaacagccattaggaaaggacagccaattcaaatctctttctcagaaaatcatatgttgtcatatggaaagaaggttgttgtatag

SEQ ID NO: 65959 - protein, 366 aa, Bacillus thuringiensis serovar konkukian str. 97-27
MGSRKSRQNFRKMGKRVWSKSRTEKVSEWEREKMSEYLSIQHIQKQFDAFTALKDISFTVKKNEFVCLLGPSGCGKTTLLRILAGLEEATTGSIAVNGKDITALPPGKRNFGMVFQSYALFPNLTALENIEYGLKAKKYGKAEVKEKALSALELVDLLNVKDKYPAQMSGGQQQRVALARALALSPDILLLDEPLSALDAKVREKLRREMRDLQEKVGVTTIMVTHDQEEALTMADKIVVMNHAEIMQIGTPEEIYQRPANPFVADFIGSINFFSKNNEEHAIRPEHVTVVQNNGMKTIVESMEFRGSVYRTEVRVIDEKTHLYNEKIVVDILASEVEKTAIRKGQPIQISFSENHMLSYGKKVVV

SEQ ID NO: 65960 - DNA, 1152 bp, Erwinia carotovora subsp. atroseptica SCRI1043
  CDS (1)..(1152): transl_table=11
ttgatctgccaaatcaggaaacagagctataccttaatgaaagaaaactccctgactgtgccggtcgttgaattgctcaacgtccataaaggctttgatggcaaagacatcatttcgcattttaatctcaccattaataacggtgaattcctgacgatcctcgggccatccggctgcggaaaaaccaccgtactgcgtctgattgccggtctggaaacagtcgatagcggcaatatcatgctggaaaagcaggatattacccaccagcccgccgagcagcggcacgttaataccgtattccaaagttacgcattgttccctcatctcagcgtgtttgaaaacgtagcatttggcctgcgtatgcagaaaacacccgccgtagaaatgactccgcgcgtgattgaagcgctaaaaatggtgcagttggacgagctggcgcagcgtcgcccgcaccaattatccggcggccagcaacaacgcgtcgctatcgcccgcgccgtcgtcaaccagccaaaggttctgctgctggatgaatctttgtccgcactcgattataagctgcgtaaacagatgcagaacgagttgaaagcgctgcaacgtaagctgggtattacctttattttcgtcacgcacgatcaggaagaagccctgaccatgtccgaccgcatcgtggtgatgcgtgatggccgcatcgagcaagacggcacgccgcgtgaaatctacgaagaaccaaaaaatctatttgtcgccagttttatcggtgaaatcaatatttttgatgccatcgtactagatctgttggatgaacagcgagtgcgcgctctggtcgaaggccacgaatgtgttatcaccgtcagctttttggtcaacatcggccaacacctcaacgtgctgctgcggccggaagatttacgcgttgaagagctgggcgacggcatgcaggcggaagggatggttggctacgtgcgcgagcgcaactataaaggcatgacgctggaatccaacatcgagttggaaaacggcaaaatggtcatggtcagcgagttctttaacgaagacgatcccgacttcgatcactcactcgaccagaaggtggacgttacctgggtggaaagttgggaggtagtcctgcacgatgaagacgtcgcgtaa

SEQ ID NO: 65961 - protein, 383 aa, Erwinia carotovora subsp. atroseptica SCRI1043
MICQIRKQSYTLMKENSLTVPVVELLNVHKGFDGKDIISHFNLTINNGEFLTILGPSGCGKTTVLRLIAGLETVDSGNIMLEKQDITHQPAEQRHVNTVFQSYALFPHLSVFENVAFGLRMQKTPAVEMTPRVIEALKMVQLDELAQRRPHQLSGGQQQRVAIARAVVNQPKVLLLDESLSALDYKLRKQMQNELKALQRKLGITFIFVTHDQEEALTMSDRIVVMRDGRIEQDGTPREIYEEPKNLFVASFIGEINIFDAIVLDLLDEQRVRALVEGHECVITVSFLVNIGQHLNVLLRPEDLRVEELGDGMQAEGMVGYVRERNYKGMTLESNIELENGKMVMVSEFFNEDDPDFDHSLDQKVDVTWVESWEVVLHDEDVA

SEQ ID NO: 65962 - DNA, 1134 bp, Erwinia carotovora subsp. atroseptica SCRI1043
  CDS (1)..(1134): transl_table=11
gtgaatgacgcgatcccccgccctcaatcaaaacctcaaaaagcggccacgccgctgctggaagtgcgcaacctgacgaagtcgttcgatggtcaggccgccgttgatgatgtcagcctgacgatttataaaggcgaaatttttgctctgctgggtgcatccggctgtgggaaatccacgctgctgcgcatgctggcaggttttgagctccccacgcaggggcagattgttctggatggtcaggatttgtcattggtgccgccttaccagcgtcccatcaatatgatgtttcagtcttatgcgctgttcccacacatgacggtggagaagaatatcgcgtttggtttgaaacaggacaagttaccgcgtgcagaaatcaaagatcgcgtggaagagatgctgtcgctggtgcatatgcaggagttcgctaatcgtaagccgcatcagctttccggcggtcagcgtcagcgtgttgcgctggcacgtagtctggcgaagcgtccaaaactgttgttgctagacgagccgatgggagcgctggacaagaaattgcgtgaccgcatgcagcttgaagtggtcgatattctggaacgcgtaggggcgacctgcgtgatggtgacgcacgatcaggaagaagccatgactatggctggtcgtattgccatcatgaatcgcggcaagttcgtacagattggcgagccagaagagatctatgagcacccgaatacgcgtttcagcgcggaatttatcggctcggttaatatgtttgaagggatattgcaggaacgtcaggacgatgctctgatcatcaaaagtcccgggctggtgcattcgctgaaagtagattcggatgtctcggtggtggatggcgttccggtttacatcgcgttgcgtcctgaaaaaatcatgctgtgcgaagaggtgccagctgacggctgtaatttcgcggtgggggaagtggtgcacatcgcttatctgggcgatttgtcgatttaccacgtcaggctcaacagcgggcaaactatcagcgcacagttacaaaacgcctaccgctatcgcaaaggcacaccgacctggggagatgaggttcggttgtgttgggatgcggatagctgtgtcgttctgacggtgtaa

SEQ ID NO: 65963 - protein, 377 aa, Erwinia carotovora subsp. atroseptica SCRI1043
MNDAIPRPQSKPQKAATPLLEVRNLTKSFDGQAAVDDVSLTIYKGEIFALLGASGCGKSTLLRMLAGFELPTQGQIVLDGQDLSLVPPYQRPINMMFQSYALFPHMTVEKNIAFGLKQDKLPRAEIKDRVEEMLSLVHMQEFANRKPHQLSGGQRQRVALARSLAKRPKLLLLDEPMGALDKKLRDRMQLEVVDILERVGATCVMVTHDQEEAMTMAGRIAIMNRGKFVQIGEPEEIYEHPNTRFSAEFIGSVNMFEGILQERQDDALIIKSPGLVHSLKVDSDVSVVDGVPVYIALRPEKIMLCEEVPADGCNFAVGEVVHIAYLGDLSIYHVRLNSGQTISAQLQNAYRYRKGTPTWGDEVRLCWDADSCVVLTV

SEQ ID NO: 65964 - DNA, 1167 bp, Erwinia carotovora subsp. atroseptica SCRI1043
  CDS (1)..(1167): transl_table=11
gtgcaaaaaacaacgtcctctgcggtagccccgcacattgtcattgaccatctacatgttggatacggcacgacagacgtattgaacgatatccatctggagattgcgcagggcgaattcgttgcgttactcggttcatcgggatgcggcaaaacgacgctattacgcacggtcgctgggttctcttcaccgcgttcgggagcgattcgcgttaacgggcaggatatgacacaagcgccgccagagaaacgcggaatggcgctggtgtttcagagttatgcgctgtggccgcatatgacggtagcgcagcatattgcgtacgggctgcgcttgcgccgtgtaccgcgtgcggaaatagccagtcgcgtagcggaactggaaacgatgctgggtttgacgggattgagcgcccgtaagcctgcggaactgtccggtgggcagcgccagcgcgtcgccctgggtcgcgcactggcggtacggcccgatattctgctgctggacgaaccactctccaatctggatacccgtattcgtctacaactgcgagatgaaatccgtgcgctgcaacagcggctggggttgaccgcgatccacgttacgcacgatcgggaagaagcgatggtgatggcggatcgcatcgtgattttgaatcagggtcgcatcatgcaggcgggtagcccacaagaggtgtatcaccatccagccagctcgtttgtcgcggcgtttatgggcgcggaaaatcggcttgtgctggacgctcgctatgacggcgatacgctgatgattcctggggatgcagaaagccactcactggtgcctgcgaacacgtcgctacagcccggcccgatagaggcgcgcttccgtgcggaggctgctcagctttacgatccggcagacgttcctctcatccagcccggcatgttgatgcgctacggcacggtgctgtcacaaagttatcccggtggatactggctgcatacgattgccagtggatcgtggcggatacaagttcatgccactcatccttatgccattggacagcgggttgccgtgcagatccccgccgaggcactgtttcttttcccgctggcagaagagcccacgtcgctgacggcggaacccaatacgacttcactttattccccgcttcctggcctgacggcctga

SEQ ID NO: 65965 - protein, 388 aa, Erwinia carotovora subsp. atroseptica SCRI1043
MQKTTSSAVAPHIVIDHLHVGYGTTDVLNDIHLEIAQGEFVALLGSSGCGKTTLLRTVAGFSSPRSGAIRVNGQDMTQAPPEKRGMALVFQSYALWPHMTVAQHIAYGLRLRRVPRAEIASRVAELETMLGLTGLSARKPAELSGGQRQRVALGRALAVRPDILLLDEPLSNLDTRIRLQLRDEIRALQQRLGLTAIHVTHDREEAMVMADRIVILNQGRIMQAGSPQEVYHHPASSFVAAFMGAENRLVLDARYDGDTLMIPGDAESHSLVPANTSLQPGPIEARFRAEAAQLYDPADVPLIQPGMLMRYGTVLSQSYPGGYWLHTIASGSWRIQVHATHPYAIGQRVAVQIPAEALFLFPLAEEPTSLTAEPNTTSLYSPLPGLTA

SEQ ID NO: 65966 - DNA, 1134 bp, Yersinia pseudotuberculosis IP 32953
  CDS (1)..(1134): transl_table=11
gtgaatgatgttattccccgcccacagccaaaatcccagaaggtgtttacccctttactggaaatccgtaacttaaccaagtcattcgacggtcaggcggctgtggatgatgtcaatctgaccatttataaaggtgagatttttgcgctattgggggcatcaggttgtggtaaatctaccctgttacggatgctggccggttttgaacagccaacgcaaggccagatcgtccttgatgggcaggatttatcccatgttccaccgtatcgacgccctatcaatatgatgttccagtcttacgcgctattcccgcacatgaccgtggagcaaaacatcgcattcggcttgaagcaggataagctgccgtctaatgaaattaaaagccgggtcgccgagatgctgacactggtccatatgcaagagtttgctaaacgtaaaccgcatcaattatccggtggtcagcgccagcgtgtggcattggcacgtagcttggctaaacggccaaaactgctgcttttggatgagccaatgggggcgctggataaaaaactacgcgaccgtatgcaactggaagtgttggatattttggagcgggtgggcgcaacctgtgtgatggtcacccatgaccaagaagaagcgatgaccatggccgggcgcattgccattatgaaccggggcaagtttgtgcagattggtgagccagaagagatttatgagcatccgaacagcagattcagcgctgagtttatcggctcagtgaatgtgttcgaaggcgtgctaaaagagcgtttagatgacgcgttggtgattgatagccctggcctgcgccatccgctaaaagtggattccgatgcctcggtcgttgacggagtgcctgtgctggtcgccctacgcccggaaaaagtgatgttatgtgatcaggtccccaaagatggctgcaattttgctgtaggcgaagtggtacacattgcctatctgggcgatttatccatttatcacgtgaaattacacagtggtcagatgctaagtgcgcagttacagaatggtcatcgctaccgtaaaggcatgccaacgtggggtgatgaagtgcaactctgttgggatgctgacagttgcgtggttttagggagctaa

SEQ ID NO: 65967 - protein, 377 aa, Yersinia pseudotuberculosis IP 32953
MNDVIPRPQPKSQKVFTPLLEIRNLTKSFDGQAAVDDVNLTIYKGEIFALLGASGCGKSTLLRMLAGFEQPTQGQIVLDGQDLSHVPPYRRPINMMFQSYALFPHMTVEQNIAFGLKQDKLPSNEIKSRVAEMLTLVHMQEFAKRKPHQLSGGQRQRVALARSLAKRPKLLLLDEPMGALDKKLRDRMQLEVLDILERVGATCVMVTHDQEEAMTMAGRIAIMNRGKFVQIGEPEEIYEHPNSRFSAEFIGSVNVFEGVLKERLDDALVIDSPGLRHPLKVDSDASVVDGVPVLVALRPEKVMLCDQVPKDGCNFAVGEVVHIAYLGDLSIYHVKLHSGQMLSAQLQNGHRYRKGMPTWGDEVQLCWDADSCVVLGS

SEQ ID NO: 65968 - DNA, 1047 bp, Symbiobacterium thermophilum IAM 14863
  CDS (1)..(1047): transl_table=11
atggtcgagtttcggggcgtgtcgaagcggttcgattcgaccgaagccctaaacgatcttaccctcgaaattcgtccgggcgagttcctgacgcttctcgggcccagcggctgcggcaagaccacgaccctcaggctgctggccgggttcgaggaacccacctccggagagatctggctggcgggcagaccggttcagggactcccagcgtacaagcgacccgtcaatacggtcttccagcactacgcgctgttcccgcacatgaccgtattcgacaacgtcgcgttcggcctgcgcatgaagaaggtagccccggcagagatccggcggcgggtcgcggaggccctggagttggttcggctgggcgacatggggagccgacgtccccatgagctctccggaggccagcagcagcgggtcgccctggcgcgcgccctggtcatggagccgaaggtgctgctgctggacgagccgctgggggcgctggacctccagctgcggcgtgcgatgcaggtggaactcaggcagctccagcgcaagctgggagcgaccttcctatatgtgacacacgaccaggaggaagcgctcgcgatgtccgaccgcatcgcggtgatgcgcaacggccgggtggagcaggtcggcactcccgaggaggtctacctgcgcccggccacccgcttcgttgcgcagttcctgggcgaggccaacctgctggagggcgagggtgcggccaacggccggctgcggtggggcgactaccacctgcaggtgagccgccacctgtcgcccggcaagacgacggtggcgctgcgccccgagcaggtgcaggtccggtggcccgggtcgacggagccggcgcggccggcggagaaccgggtccacggcatcgtggccgagcggctcttcgtcggcaccggcacccggctgatggtggaggtggccggccgacggctggccgctctgctgcccgcaggcccgggaccggatatcggcgaccaggtcgagctccgcttcgccgcggagcactgcgtggtggtggcgccatga

SEQ ID NO: 65969 - protein, 348 aa, Symbiobacterium thermophilum IAM 14863
MVEFRGVSKRFDSTEALNDLTLEIRPGEFLTLLGPSGCGKTTTLRLLAGFEEPTSGEIWLAGRPVQGLPAYKRPVNTVFQHYALFPHMTVFDNVAFGLRMKKVAPAEIRRRVAEALELVRLGDMGSRRPHELSGGQQQRVALARALVMEPKVLLLDEPLGALDLQLRRAMQVELRQLQRKLGATFLYVTHDQEEALAMSDRIAVMRNGRVEQVGTPEEVYLRPATRFVAQFLGEANLLEGEGAANGRLRWGDYHLQVSRHLSPGKTTVALRPEQVQVRWPGSTEPARPAENRVHGIVAERLFVGTGTRLMVEVAGRRLAALLPAGPGPDIGDQVELRFAAEHCVVVAP

SEQ ID NO: 65970 - DNA, 1113 bp, Symbiobacterium thermophilum IAM 14863
  CDS (1)..(1113): transl_table=11
gtgaacagggaaggggagtctggcatgggcgaggcgcagtccgtcaccctggagcgcgtgtcgaagagcttcaacggcaccgtgctcacggtgaaaaatgtcgacctgcatatcgccggaggcgagttcttcacgctgctcggaccctcgggctgtggcaagaccacaaccctccgcatgatcgccggtttctactaccccacgtcgggccgcatcctcttcggcgaccgcgacgtgacctacatgccgcccaacgaccggaacatcggcatggtcttccagaactacgcgctgttcccgcacatgtccgtgtttgagaacgtggccttcggcctccgggtgcgcaaggtgccccgcgaggagatgaagcgccgggtgagcgaggcgctggcgctggtgcggctggagggcatggagcagcggcgcatcgaccagctctccggtggtcagcaacagcgggtcgccctggcccgcgccctggtcatccggccggccttgctcctgctggacgagccgctctccaacctcgacgcgaagctccgggacgagacccggaccgagatccgccgcatccagacggaatccaacatcacggccgtctacgtgacccacgaccaggccgaggcgatggccatctccgaccgcatcgccgtcatggaaggcggcgtggttcaccaggtgggcacgccgcaggagatctaccaccggccggccacccggttcgtggcgaccttcatcggcaagtccaacctgctggaggggacgctgaccgaggtggatggcaccgccggcgtggtggagctgcccggcaccggccgcatccgggtggacctggagcggcggaacccgcaggtccccacggcggtcggcagccgcgtggtcatgacggtgcggcccgagggcatccaggtggtggcacagcccgaaggccccaacgtcctgaccgggcgggtcgtggcggccgagttcaccggcgcctacaccgagtacctggtcaaggcgggcgagagcacgctggtcgcctcgtcggccgaccggtacggcgaggtgcggcggcccggggatcccatccacctgtacatcccgcctgagcgagtctatctggtggagtga

SEQ ID NO: 65971 - protein, 370 aa, Symbiobacterium thermophilum IAM 14863
MNREGESGMGEAQSVTLERVSKSFNGTVLTVKNVDLHIAGGEFFTLLGPSGCGKTTTLRMIAGFYYPTSGRILFGDRDVTYMPPNDRNIGMVFQNYALFPHMSVFENVAFGLRVRKVPREEMKRRVSEALALVRLEGMEQRRIDQLSGGQQQRVALARALVIRPALLLLDEPLSNLDAKLRDETRTEIRRIQTESNITAVYVTHDQAEAMAISDRIAVMEGGVVHQVGTPQEIYHRPATRFVATFIGKSNLLEGTLTEVDGTAGVVELPGTGRIRVDLERRNPQVPTAVGSRVVMTVRPEGIQVVAQPEGPNVLTGRVVAAEFTGAYTEYLVKAGESTLVASSADRYGEVRRPGDPIHLYIPPERVYLVE

SEQ ID NO: 65972 - DNA, 1047 bp, Symbiobacterium thermophilum IAM 14863
  CDS (1)..(1047): transl_table=11
atgcgctcgactctgcgattggcgaacctggtgaaagagttcgaatcccagaagcggaccgtgcgggcggtgaacgatgtctcgctggacttcccggcgggcgccttcgtcaccctgctcggcccttccggctgcggcaagacgacgatcctccggatgatcgcgggcctggagacccccacctccggggagatctacctggacgacaagcccatcacccatgtgccgcccaacaagcgcgaaacggcgatggtcttccagaactacgccctcttcccgcaccttaccgtctttgagaacgtcgcctacggcctgcggctccggaaggtgcccgaggcggagctgaagcgggcggttcacgagaagttggagatgatgggcctcagcaacatggcggacaggcagcccaaccagctctccggcggccagcagcagcgggtcgcactcgcccgggcgctggtgatgtcgccgaagatcctgctcttcgacgagccgctctccaacctggatgcgaagctgcgcatccaggtgcggcaggacatccgtgagctgcagcggaacctgggcgtcaccaccgtctacgtcacccacgaccaggaggaggcgatggccatctccgattacgtggtgatcatgaacggcggccaggtggagcaggcgggctcgcccgaggagatctacttccagccccgcaacagcttcgtggcggacttcatcggcggggtgaacctcatccccgggcgcatgaccggtcccgacgaggccgagctcctgggccggaaggtgcaggtccgcaatccgtacgggattgcagcgggccaggaggtgaaggtggcggtccggccggaggaggtcacgctgggcgacggccccttcaccgggacggttcggcgggccgtgttcctgggccgggtgaccgagtacgtgatccaggtcggggaccagcggctggtggcggtgatgcacgggcagcaccgccggatgccggagggcgcggagacgaccttcaacttcaacgccggggcgccgctggcgcttgcccggtga

SEQ ID NO: 65973 - protein, 348 aa, Symbiobacterium thermophilum IAM 14863
MRSTLRLANLVKEFESQKRTVRAVNDVSLDFPAGAFVTLLGPSGCGKTTILRMIAGLETPTSGEIYLDDKPITHVPPNKRETAMVFQNYALFPHLTVFENVAYGLRLRKVPEAELKRAVHEKLEMMGLSNMADRQPNQLSGGQQQRVALARALVMSPKILLFDEPLSNLDAKLRIQVRQDIRELQRNLGVTTVYVTHDQEEAMAISDYVVIMNGGQVEQAGSPEEIYFQPRNSFVADFIGGVNLIPGRMTGPDEAELLGRKVQVRNPYGIAAGQEVKVAVRPEEVTLGDGPFTGTVRRAVFLGRVTEYVIQVGDQRLVAVMHGQHRRMPEGAETTFNFNAGAPLALAR

SEQ ID NO: 65974 - DNA, 1119 bp, Bacillus licheniformis ATCC 14580
  CDS (1)..(1119): transl_table=11
atgagcgcaattcagattaggcatgtcagccggcatttcggaaacaccatcgcattggaagacgtacagcttgaagtcaaagaaggggagtttttctccctccttggtccgagcggctgcggaaagtcaacgctcctgaatattattgccgggttccttgaaccgacgtcaggttttgtatatataggaggacgagatgtaactgatttgccgccatacgaccgacatatcggaatggtttttcaggattatgctttattcccgcatctcagcgtttttgacaatgttgcatacggcttgaaagtccgaaaatggccccgccgcaagattgaagaacgggtgatggaatgcctcgctcttgtcaggcttgaagcgtttgctaatcgcatgccccatcagctgagcgggggtcagcagcagcgggtggcgattgcccgggcattggccgttcagccgtctgtgcttttgctagacgagccgctgagcaacctggatgcgaaacttcgaaaagaaatgcagacggagctgcgcagcatccaaaagcgcgtcggcattacaacgattttagtgacgcacgaccaggaggaggctttaagcttatcggacaggattggaattctcggatgcgggaggcttcagcagctcggcactccgttggacgtgtaccgcacgcctgccaatcaatttgtggccgaatttatcggacaggtcaatttactgaaagcgcgtgcgtcgaagatacagccttcatcgggcggctatggatacgaaacggtcgatttcgaagtgtatgaaggcgttccgctgacatttgaaatcaaccaggaactctcaaaaaaaacttctgtattgttcatggtgcggcctgagaggatctcagtctccttcgagaagcaaaagaacaggctgattgaaatgcctgcaacaattaccgaagtcagttacgccgggcatgatctcaggctgaaagccgctgttttcaaaggagaatggatcattcaggcgcccgatcctcaattccctagattgccgaaggcgggagatcaagtgtatctttctttggagccgggcgattttgttccgctggatgttaaggaggatgcagatgagggctgttga

SEQ ID NO: 65975 - protein, 372 aa, Bacillus licheniformis ATCC 14580
MSAIQIRHVSRHFGNTIALEDVQLEVKEGEFFSLLGPSGCGKSTLLNIIAGFLEPTSGFVYIGGRDVTDLPPYDRHIGMVFQDYALFPHLSVFDNVAYGLKVRKWPRRKIEERVMECLALVRLEAFANRMPHQLSGGQQQRVAIARALAVQPSVLLLDEPLSNLDAKLRKEMQTELRSIQKRVGITTILVTHDQEEALSLSDRIGILGCGRLQQLGTPLDVYRTPANQFVAEFIGQVNLLKARASKIQPSSGGYGYETVDFEVYEGVPLTFEINQELSKKTSVLFMVRPERISVSFEKQKNRLIEMPATITEVSYAGHDLRLKAAVFKGEWIIQAPDPQFPRLPKAGDQVYLSLEPGDFVPLDVKEDADEGC

SEQ ID NO: 65976 - DNA, 996 bp, Bacillus cereus E33L
  CDS (1)..(996): transl_table=11
ttggacgggaaaatgaaaaagattattaaagttgaagcagtagaaaaacattttggaaatcaagtgattatcccaccgctttctttagatattaaagaaggggaatttttaacgattttagggccgagtggttgcgggaaaacgacgttacttcgtatgatcgcaggatttgaaacgccaactaaaggaaatcttttattagatgatgaaaagattaacgatttgccaccatataagcgtcatatgaacctagtgttccaacattatgcgctattcccacatatgaatgtggagaaaaatatttgtttcggtatgaaaatgcagaaagtaccggcagcagagcagaaagagcgtgctgaagaggcaatgcgtttaacgcagttacttgagttccgtaatcgtaaacctgcgaagctttctggtggacagcagcagcgtgtagcaattgcgagagcgattgtaaataacccgcgtgtattattactagatgagccacttggggcgttagactttaagttaagaaaagacttgcaacgtgaattgaaaaacttacaacgtaatttaggaattacgttcatatacgtaacgcacgatcaagaagaagcgatgagcatgagtgatcgtatcgttgttatgaataaaggacatattgaacaaattggaacgccgaaagaaatttataataagccgaaaacgttgttcgttgcgacatttatcggtgaaaataatattgtgaaaaacggggaaggctatgtagcaattcgccctgaaaatgtaaaagtgcgttcggttgaagagccgattttaaaagaatatcatcttggacatattgaagacattgagtttgttggaaatatggaaaagctttatgtacgtgatgagaaaacatcagaattactaatggcatatcaaactgctgaagaagcagcgcagtggagcattggagataatgtatacgtaggctgggagcaagaggacgaggtgaccttaaattga

SEQ ID NO: 65977 - protein, 331 aa, Bacillus cereus E33L
MDGKMKKIIKVEAVEKHFGNQVIIPPLSLDIKEGEFLTILGPSGCGKTTLLRMIAGFETPTKGNLLLDDEKINDLPPYKRHMNLVFQHYALFPHMNVEKNICFGMKMQKVPAAEQKERAEEAMRLTQLLEFRNRKPAKLSGGQQQRVAIARAIVNNPRVLLLDEPLGALDFKLRKDLQRELKNLQRNLGITFIYVTHDQEEAMSMSDRIVVMNKGHIEQIGTPKEIYNKPKTLFVATFIGENNIVKNGEGYVAIRPENVKVRSVEEPILKEYHLGHIEDIEFVGNMEKLYVRDEKTSELLMAYQTAEEAAQWSIGDNVYVGWEQEDEVTLN

SEQ ID NO: 65978 - DNA, 1122 bp, Mannheimia succiniciproducens MBEL55E
  CDS (1)..(1122): transl_table=11
gtggaaaatattgttcaaagcaaaccaattattgaactgcgttctctcaaaaaatcgtataacgaaaatacgatcattgataattttaatttaaccattaacaatggtgaatttttaactattttaggcccttcgggttgcggtaaaacgacggtattacgtttgattgccggctttgaagaagccaatggtggtcagattatccttgatggcgaggatgtgactgatttgccggctgaacatcgcccggtaaatacggttttccaaagctatgcactattcccccacatgactattttcgaaaacgtcgcttttggtttgcgtatgcaaaaagtgccgaacgaagaaattaagcctcgcgtattggaagctttgcgcatggttcaattggaagaaatggcggatcgtaaaccgactcaattatccggtggtcagcaacaacgtattgctatcgcgcgcgcggtggtaaataaaccgaaagtactattactggacgaatcattatccgcactggactacaaattacgtaaacaaatgcaaaacgaattgaaagcattacaacgtaaattaggcattaccttcatttttgtaacccatgaccaagaagaagcgttaactatgtccgatcgtattatcgtgttacgtaaaggtaatattgaacaagacggttcaccgcgcgaaatctatgaagaaccgagcaatttatttgtggcgaaattcattggcgaaatcaatatctttgatgcgcaagtattaaatcgtgttgatgaaaaacgcgttcgcgctaatgtagaaggacgtgtttgcgatatttatacggatttagcggtaaaagaaggacaaaaactgaaagtattattacgcccggaagacgttcaattggaagaacttgatgaaaatgagcagtcaagcgccatcatcgggcatattcgtgagcgtaactacaaaggaatgactttagagtcaaccgttgagctggaacacaataacaaacttgtattagtaagcgaattctttaatgaagatgatccgaacattgatcactcattagaccaacgcgtaggtgtaacttggattgaaaaatgggaagtggtattgaacgatgaaaatgacaacgcgtaa

SEQ ID NO: 65979 - protein, 373 aa, Mannheimia succiniciproducens MBEL55E
MENIVQSKPIIELRSLKKSYNENTIIDNFNLTINNGEFLTILGPSGCGKTTVLRLIAGFEEANGGQIILDGEDVTDLPAEHRPVNTVFQSYALFPHMTIFENVAFGLRMQKVPNEEIKPRVLEALRMVQLEEMADRKPTQLSGGQQQRIAIARAVVNKPKVLLLDESLSALDYKLRKQMQNELKALQRKLGITFIFVTHDQEEALTMSDRIIVLRKGNIEQDGSPREIYEEPSNLFVAKFIGEINIFDAQVLNRVDEKRVRANVEGRVCDIYTDLAVKEGQKLKVLLRPEDVQLEELDENEQSSAIIGHIRERNYKGMTLESTVELEHNNKLVLVSEFFNEDDPNIDHSLDQRVGVTWIEKWEVVLNDENDNA

SEQ ID NO: 65980 - DNA, 1149 bp, Legionella pneumophila subsp. pneumophila str. Philadelphia 1
  CDS (1)..(1149): transl_table=11
ctggacaagataagtcacagcacacataattgcagtttttatttaataaagcagatgacaacaccgctcattgaaatccgtcagatttataaatcatacggcaatacaccaattttgaataatgtttcgctaaacgtcaatcacggtgaatttttaaccttactgggcccttcaggttgtggaaaaacaacccttcttcggcttatatctggttttgaacaaccaacgcaaggtgagattttcattaatggtcaatgtgttaatcaattaccacctcaaaaacgggatgtgcatactgtttttcaaagttatgcccttttccctcatttatccgtttttgaaaatgtcgcatttgccttgcgctgcaaaaaaacgcccaaccaggaaatcaggaagcgagtctttgatgcgttaaaacttgtacaacttgaatcgttagctgaaagaaatgtgaaacagttaagtggaggccaacaacaacgtgttgcgattgctcgagcaatcatcaatagacctcaagtactgttgttagatgagccattgagttcccttgactacaggcttaggaaagccatgcaatccgaattgaaacaattacaaaaaaccttgaatatgacgtttatttttgtaacgcatgatcaggaagaagccttatcaatgtctgaccgtattgtcgtctttaatcatggccacattgaacaaattggtactcccaaggctgtctatgaaacccctgccaacctgcatgttgccatgtttattggcgaagcgaatatatttgatattcaggttcacacagtaaaggatcaagacatcataacgaacattgaaggaatccagctatcctgtaaaaacactggcaattatcaagtcaacgaccggcttcatttgatcgttcgtccagaggatattcgagtttggagcttatccgaagtagaaaaaacagaaggaatgttgcctggtcgtattgttgatatcatttataaaggctctacggttgatctcaaagtggaattgtcatcaggcaaaatcatcaatgcttcggagttttttgatgaagacgatgataagctggaatacactctccatgaaaccgtttgggtacaatggttgcctggctgggaggttttattaccttatgaaggctaa

SEQ ID NO: 65981 - protein, 382 aa, Legionella pneumophila subsp. pneumophila str. Philadelphia 1
MDKISHSTHNCSFYLIKQMTTPLIEIRQIYKSYGNTPILNNVSLNVNHGEFLTLLGPSGCGKTTLLRLISGFEQPTQGEIFINGQCVNQLPPQKRDVHTVFQSYALFPHLSVFENVAFALRCKKTPNQEIRKRVFDALKLVQLESLAERNVKQLSGGQQQRVAIARAIINRPQVLLLDEPLSSLDYRLRKAMQSELKQLQKTLNMTFIFVTHDQEEALSMSDRIVVFNHGHIEQIGTPKAVYETPANLHVAMFIGEANIFDIQVHTVKDQDIITNIEGIQLSCKNTGNYQVNDRLHLIVRPEDIRVWSLSEVEKTEGMLPGRIVDIIYKGSTVDLKVELSSGKIINASEFFDEDDDKLEYTLHETVWVQWLPGWEVLLPYEG

SEQ ID NO: 65982 - DNA, 1137 bp, Burkholderia pseudomallei K96243
  CDS (1)..(1137): transl_table=11
gtggcgggcgcgccgtcctatcggccgcagacgggcgccgacgggcgcgccgaaaactttgtccagatcatcgacgtcgtcaagaagttcggcgagaccgtcgcggtgcgcaacgtcgagctgagcgtgcgcaagggcgagctgttcgcgctcctcggcagctccggctgcgggaagtcgacgctgctgcgcatgctcgccggcctcgagacgatcacgtcgggcaagatcctgatcgacggcgaggatctcgcgcagatgccgccgtacaagcggcccgtgaacatgatgttccagtcgtacgcgctgttcccgcacatgacggtcgaggcgaacgtcgccttcggcctcaagcaggaaggcgtgccgaaggccgagctcaaggagcgcgtgcgcgatgcgctcgagctcgtgcagatggcgcgctacgcgagccgcaagccgcatcagctctccggcggccagcagcagcgcgtcgcgctcgcgcgctcgctcgtcaagcggccgaagctgctgctgctcgacgagccgatgtcggcgctcgacaagcagatccgccagcgcacgcagatcgagctcgtcaacatcctcgacaaggtcggcgtcacctgcatcatggtcacgcacgatcaggaggaggcgatgacgatggcggggcgtctcgccgtgatgagcgaaggccagatcgtgcagatcggcacgccgcacgaagtctacgaatatccgaactgccgcttctccgccgagttcatcggctcgacgaacctgttcgagggcgtgaccgtcgaggacgagcccgatcacgtgttcatcgaatcgccggacctgccgtgccggctgtacgtgaaccacgggatcacgggcccgctcggcatgcccgtcacggtgtcggtgcgccccgagcgcatcgcgctgacccgcaagcccgccgacggcgcgtacaactgggggcgcggcgtcgtcacgaacgtcgcgtacatgggcggctattcgctgtatcacgtgaagctcgattccgggaagacggtgatcgcgaacgtgtcgagcctcgcgatcgccgatctcgattcgcccggctggggcgatgaaatctacgtgcgctggagcgccgcggccggcgtggtgctgacgtcatga

SEQ ID NO: 65983 - protein, 378 aa, Burkholderia pseudomallei K96243
MAGAPSYRPQTGADGRAENFVQIIDVVKKFGETVAVRNVELSVRKGELFALLGSSGCGKSTLLRMLAGLETITSGKILIDGEDLAQMPPYKRPVNMMFQSYALFPHMTVEANVAFGLKQEGVPKAELKERVRDALELVQMARYASRKPHQLSGGQQQRVALARSLVKRPKLLLLDEPMSALDKQIRQRTQIELVNILDKVGVTCIMVTHDQEEAMTMAGRLAVMSEGQIVQIGTPHEVYEYPNCRFSAEFIGSTNLFEGVTVEDEPDHVFIESPDLPCRLYVNHGITGPLGMPVTVSVRPERIALTRKPADGAYNWGRGVVTNVAYMGGYSLYHVKLDSGKTVIANVSSLAIADLDSPGWGDEIYVRWSAAAGVVLTS

SEQ ID NO: 65984 - DNA, 1092 bp, Burkholderia pseudomallei K96243
  CDS (1)..(1092): transl_table=11
atgacagctgcatttttgcaaatccagcgcttgcgcaagacctacgacgacgtagtcgcgatcgatcacgtgtccctggacgtgcgcaagggcgaattcatgacattcctcgggccgtccggctcgggcaagagcacgacgctctacatcgtcgcgggcttccaggaaccgaccgaagggtgcgtcttgctcgacggaaggccgttgctgtcggtggcgcccaataagcgcaataccggcatggtgtttcagcgatacacgctgtttcctcacttgaccgtgggcgaaaacgtcgcgtttccgttgcgtgtgcgtcgtcgtcccgatgcgcaggtgaaggcgaaggtcgagcagatgctgaagcttgttcatctggccgactgccgtgatcgtatgcctgcccaattgtcaggcgggcagcagcaacgcgttgcgatcgcacgtgcgttggcctacgatccgcccgtattgctgatggacgaaccgctcgccgcactcgacaaaaagctacgcgaggaaattcagctcgaattgcgtcgcattcaccaagagacgggcgtgacgattctctacgtcacgcacgaccaagaggaggcacttcgtctttccgatcgtattgccgtcttcaacaaaggcgcaatcgaacaggtcggaacgggcgaggagctgtacgccaacccgacgtcgcgcttcgtggcgagcttcatcggtaattcaaatttccttccggtcagggtcacagcgaacgccaatggcggcatgagcggcatattcccgaacggtctcgcagtggcgacggccggccaaggcccggcactgacggccggccatgacggcgcgctgatgatccgccccgagcagatgcgcattcgtgcgttgcaaggcgcgaagggggaggtcgggttacctgtcaccgtgcgcgacataacgtacctcggtgatgcgatgcattacgcggttgccacaccttggcagcaggaaatttcgattcgaatgccggcaagccatcgccatgacagcggactatcgatcggcacgcaggctttcgtcgagtgggatgcgcgcgacgcgcgtgtttttgtcgaggcatag

SEQ ID NO: 65985 - protein, 363 aa, Burkholderia pseudomallei K96243
MTAAFLQIQRLRKTYDDVVAIDHVSLDVRKGEFMTFLGPSGSGKSTTLYIVAGFQEPTEGCVLLDGRPLLSVAPNKRNTGMVFQRYTLFPHLTVGENVAFPLRVRRRPDAQVKAKVEQMLKLVHLADCRDRMPAQLSGGQQQRVAIARALAYDPPVLLMDEPLAALDKKLREEIQLELRRIHQETGVTILYVTHDQEEALRLSDRIAVFNKGAIEQVGTGEELYANPTSRFVASFIGNSNFLPVRVTANANGGMSGIFPNGLAVATAGQGPALTAGHDGALMIRPEQMRIRALQGAKGEVGLPVTVRDITYLGDAMHYAVATPWQQEISIRMPASHRHDSGLSIGTQAFVEWDARDARVFVEA

SEQ ID NO: 65986 - DNA, 1155 bp, Burkholderia pseudomallei K96243
  CDS (1)..(1155): transl_table=11
atgaaatcgacgccttcaatcgacaccgcgcaactggcgcgtcccccggtcggcacgccggccggaacgaacgagttcgtccgcatcgagaacgtcgtgaaaaaattcgcagacagcaccgccgtcgacaacgtcagcctgtcgatcgcgaaaaacgagctgttcgcgctgctcggcagctcgggctgcggcaaatccaccctgctgcggatgctcgccgggctcgagacggccacgtccgggcgcatcttcgtcgacggagaggatctcgcgacgctgccgccatatcgccggcccgtgaacatgatgttccagtcgtacgcgctctttccgcacatgagcgtcgagtcgaacgtcgcgttcggactgaagcaggaaggcacgccgaagcacgagattcgcgagcgcgtcgccgacgcgctgaacctcgtgcagatgagccgctacgcgcggcgcaagccgcatcagctctcgggcggccagcagcagcgtgtcgcgctcgcgcgctcgctcgtcaagcggccgaaactgctgctgctcgacgagccgatgtccgcgctcgacaagaagatccgccagaagacgcagctcgagctcgtgaacatcatcgagaaggtcgacgtgacctgcgtgatggtcacgcacgatcaggaagaagcgatgacgatggcgagccgcctcgcggtgatgagcgaaggccggatcgtgcagatcggcacgccgagccaggtctacgaatttccgaacagccgcttctcggccgaattcatcggctcgacgaatctgttcgagggcgtcgtcgtcgaggacgagcccgatcacatcttcgtcgaaagcgaggatctcgaagcgcgcatgtacgtgagccacggcgtcacgggcccgctcgggatgccggtcggcatctcggttcgcccggagcgcgtgcgcgtgtcgcgcgagcggccgagcgcaccgcacaactgggcgcgcggcgtcgtcaccgacgtcgcgtacatgggcagctattcgctgtatcacgtgcgtctgccgagcggcaagacggtcgtatccaatctctcgagctcgcacctgatgcaggacggtgcgcccgcgtacaacgacgacgtgttcgtctcctggtcgcccgcaagcggcgtggtgctgacgcaatga

SEQ ID NO: 65987 - protein, 384 aa, Burkholderia pseudomallei K96243
MKSTPSIDTAQLARPPVGTPAGTNEFVRIENVVKKFADSTAVDNVSLSIAKNELFALLGSSGCGKSTLLRMLAGLETATSGRIFVDGEDLATLPPYRRPVNMMFQSYALFPHMSVESNVAFGLKQEGTPKHEIRERVADALNLVQMSRYARRKPHQLSGGQQQRVALARSLVKRPKLLLLDEPMSALDKKIRQKTQLELVNIIEKVDVTCVMVTHDQEEAMTMASRLAVMSEGRIVQIGTPSQVYEFPNSRFSAEFIGSTNLFEGVVVEDEPDHIFVESEDLEARMYVSHGVTGPLGMPVGISVRPERVRVSRERPSAPHNWARGVVTDVAYMGSYSLYHVRLPSGKTVVSNLSSSHLMQDGAPAYNDDVFVSWSPASGVVLTQ

SEQ ID NO: 65988 - DNA, 1158 bp, Methylococcus capsulatus str. Bath
  CDS (1)..(1158): transl_table=11
atgcgcccatcccgacggcccaggttccggaacatcctggaaaatcggacaatagcggccatgacccgatccaccatcgccagtttccgcgccgtttccaagcactacggcagtcactgcgccctccgcgacttcaatctggaactccgggaaggcgagctgctcaccctcctcggcccgtcgggctgcggcaagaccacggtgctgcgccttttggccggtctggagattcccgattcgggcgaaatcttcctggacgggcgaacactcgccggcgtgccgccggaagcgcgtaacgtcaacacggtattccagagctatgcccttttcccccatctgagcgtggccgagaatgtcgccttcggcctgcggatgaaaaagctcggcagcgcggaaatccgggcgagaaccgcggaggcattgcgcatggtgcgtctggacgggctgggcgggcaccggccgctacagctgtcgggcggccagcagcagcgcgtggcgctggcccgcgctctggtcaaccgtccgcgggtcctgctgctggatgaatgcttgagcgccctggactatcaactgcggcgcgagatgcagctggaactcaagggtctgcagaggcagaccggcatcaccttcgtcttcgtgacccacgaccgggaagaagctttgtcgatgtcggaccgtatcgccgtgatgcggacgggacggatcgaacaactgggaccgccccgcgacatctacgagcggccggcgaacctgttcgtggcgcagttcgcgggtgagagcaacgttctggaagcgaccgtcacggcgatcacggctccggacagcctgatcgtcgagctggcagggacgccgctgaccgtgcgaaccgaccggcgattccgcgtcggcgccaggctcgtcctggtgctccggccggaggacctgcacgtgcacgatgatgccgccgccgaaggcggcctcgccggacatgtgctggaacgaacctaccgcggcgtgaccctggacacagtgatcgccctggatgccggaccgcggatcaagaccagcgaattcttccgcgaggacacgccggctctggatcatccgcccggccagcgggtacgggtgagctggacgccgggctgggaaatcgtgcttccccatgacccagagacctga

SEQ ID NO: 65989 - protein, 385 aa, Methylococcus capsulatus str. Bath
MRPSRRPRFRNILENRTIAAMTRSTIASFRAVSKHYGSHCALRDFNLELREGELLTLLGPSGCGKTTVLRLLAGLEIPDSGEIFLDGRTLAGVPPEARNVNTVFQSYALFPHLSVAENVAFGLRMKKLGSAEIRARTAEALRMVRLDGLGGHRPLQLSGGQQQRVALARALVNRPRVLLLDECLSALDYQLRREMQLELKGLQRQTGITFVFVTHDREEALSMSDRIAVMRTGRIEQLGPPRDIYERPANLFVAQFAGESNVLEATVTAITAPDSLIVELAGTPLTVRTDRRFRVGARLVLVLRPEDLHVHDDAAAEGGLAGHVLERTYRGVTLDTVIALDAGPRIKTSEFFREDTPALDHPPGQRVRVSWTPGWEIVLPHDPET

SEQ ID NO: 65990 - DNA, 1095 bp, Legionella pneumophila str. Paris
  CDS (1)..(1095): transl_table=11
atgacaacaccgctcattgaaatccgtcaaatttataaatcatacggcaatacaccaattttgaataatgtttcgctaaacgtcaatcacggtgaatttttaaccttactgggcccctcaggttgtggaaaaacaacccttcttcggcttatatctggttttgaacaaccaacgcaaggtgagattttcattaatggccaatgtgttaatcagttaccacctcaaaaacgagatgtacacacggtctttcaaagttatgcccttttcccccatttatccgttttcgaaaatgtcgcatttgccttgcgctgcaaaaaaacgtccaaccaggaaatcaaggagcgagtctttgatgcgttgaaacttgtacaactcgaattgttagccgaaagaaatgtaaaacagttaagtggaggccaacaacaacgtgttgcgattgcacgagcaatcatcaacagacctcaagtactgttgttagatgagccattgagttcccttgactataggcttaggaaagccatgcaatccgagttgaagcaattacaaaaaaccttgaatatgacgtttatttttgtaacgcatgatcaggaagaagccttatcaatgtctgaccgtattgtcgtctttaatcatggccacattgaacaaattggaacgcctaaggctgtctatgaaacccctgccaacctgcatgtcgccatgtttattggcgaagcgaatatatttgatattcaggttcacacagtaaaggatcaagacatcgtaacgaatattgaaggaatccagctatcctgtaaaaacactggcaattatcaagtcaatgagtggcttcatttgatcgttcgtccagaagatattcgagtttggagcttatccgaagtagaaaaaacagaaggaatgttgcctggtcgtattgttgatatcatttataaaggctctacggttgatctcaaagtggaattgtcatcaggcaaaatcatcaatgcttcggagttttttgatgaagacgatgataagctggaatatactctccatgaaaccgtttgggtacaatggctgcctggctgggaggttttattaccttatgaaggctaa

SEQ ID NO: 65991 - protein, 364 aa, Legionella pneumophila str. Paris
MTTPLIEIRQIYKSYGNTPILNNVSLNVNHGEFLTLLGPSGCGKTTLLRLISGFEQPTQGEIFINGQCVNQLPPQKRDVHTVFQSYALFPHLSVFENVAFALRCKKTSNQEIKERVFDALKLVQLELLAERNVKQLSGGQQQRVAIARAIINRPQVLLLDEPLSSLDYRLRKAMQSELKQLQKTLNMTFIFVTHDQEEALSMSDRIVVFNHGHIEQIGTPKAVYETPANLHVAMFIGEANIFDIQVHTVKDQDIVTNIEGIQLSCKNTGNYQVNEWLHLIVRPEDIRVWSLSEVEKTEGMLPGRIVDIIYKGSTVDLKVELSSGKIINASEFFDEDDDKLEYTLHETVWVQWLPGWEVLLPYEG

SEQ ID NO: 65992 - DNA, 1095 bp, Legionella pneumophila str. Lens
  CDS (1)..(1095): transl_table=11
atgacaacaccgctcattgaaatccgtcagatttataaatcatacggcaatacaccaattttgaataatgtttcgctaaacgtcaatcacggtgaatttttaaccttactgggcccttcaggttgcggaaaaacaacccttcttcggcttatatctggttttgaacaaccaacgctaggggagattttcattaatggtcaatgtgttaatcaattaccacctcaaaaacgggatgttcatactgtttttcaaagttatgcccttttccctcatttatccgtttttgaaaatgtcgcatttgccttgcgctgcaaaaaaacgcccaaccaggaaatcagaaagcgagtctttgatgcgttaaaacttgtacaacttgaatcgttagctgaaagaaatgtgaagcagttaagtggagggcaacaacaacgtgttgcgattgcacgagcaatcatcaacagacctcaagtactgttgttagatgagccattgagttcgcttgactataggcttaggaaggcaatgcaatccgaattgaaacaattacaaaaaaccttgaatatgacgtttatttttgtaacgcatgatcaggaagaagccttatcaatgtctgaccgtattgtcgtctttaatcatggccacattgaacaaattggtactcccaaggctgtctatgaaacccctgccaacctgcatgttgccatgtttattggcgaagcgaatatatttgatattcaggttcacacagtaaaggatcaagacatcgtaacaaacattgaaggaatccaactatcctgtaaaaacactggcaattatcaagtcaatgagtggcttcatttgatcgtccgtccagaagatattcgagtttggagtttatctgaagtagaaaaaacagaaggaatgttgcctggtcgtattgttgatatcatttataaaggctctacggttgatctcaaagtggaattgtcatcaggcaaaatcatcaatgcttcggagttttttgatgaagacgatgataagctggaatacactctccatgaaaccgtttgggtacaatggttgcctggctgggaggttttattacctcatgaaggctaa

SEQ ID NO: 65993 - protein, 364 aa, Legionella pneumophila str. Lens
MTTPLIEIRQIYKSYGNTPILNNVSLNVNHGEFLTLLGPSGCGKTTLLRLISGFEQPTLGEIFINGQCVNQLPPQKRDVHTVFQSYALFPHLSVFENVAFALRCKKTPNQEIRKRVFDALKLVQLESLAERNVKQLSGGQQQRVAIARAIINRPQVLLLDEPLSSLDYRLRKAMQSELKQLQKTLNMTFIFVTHDQEEALSMSDRIVVFNHGHIEQIGTPKAVYETPANLHVAMFIGEANIFDIQVHTVKDQDIVTNIEGIQLSCKNTGNYQVNEWLHLIVRPEDIRVWSLSEVEKTEGMLPGRIVDIIYKGSTVDLKVELSSGKIINASEFFDEDDDKLEYTLHETVWVQWLPGWEVLLPHEG

SEQ ID NO: 65994 - DNA, 1137 bp, Haloarcula marismortui ATCC 43049
  CDS (1)..(1137): transl_table=11
atgtcggagatagaactacagaacctctcgaaatcgttcggggagctcgatgcggtgacagatgtctccctatccgttcgggacggggaactgttgtgcttactcggtcccagtggctgtggcaagtcgacgacgatgcgaatgatcagtgggctggagacaccgtcgtccgggacagtctacatcggagatgcggacgtgaccgacgaaccggcctacgacagggacacctcgatggtgttccagaactgggcgctgttcccttacaagaccgtacttgagaacgttgcgttcggtctcaagatgcgtggcatgggaaaacagcagcggcgtgaccgcgccagcgagatgctggaccgcgttcacatggatgggtatgaaagtcacagtccgaccgacctctcgggtggccagaaacagcgtgtcgcgctggcacggtcgctggcagtggaccctgacgtgctactgcttgatgaacccctctcgaacttggataagcgactgcgtgaggagatggagatcgagctgaaagatattcgcgaagagtttcagaaaacgttcgttcacgtcacacacaatcaggacgaagcgttcacccttgctgatcgtatcggcataatgaacgatgggcgactggtgcaggtcggagagccgaatgaagtgtatcgggacccgaaaaacaagtttgtcgaggaattcctgggtgatacaaacttcgtcagtggtactgtaagcgacagtgacggccagtacagctatctggtgacggagttcgactcggagatccgtgtaccggtgacttcgaaaatccagcccgaagcgtcccttactgtctcgctccgtcccgagttcatgcaaatagctcctctcaccgatgaatcaacccgggcatctcaccagacccgtgccgacggtaacggcggtggtggtggtgtttccgggaccgtagagagtactatttatcgcggctccagcatccgccatgtcgtcgacatcggcggggagcaactgttcgtcgaacagagcgttactgaccaatcagcaattgatgaaggagatacggttgagctcagctgggatatcgatgacatactgctgttccgtcccgacggcacgagggtgagggaccgacaatga

SEQ ID NO: 65995 - protein, 378 aa, Haloarcula marismortui ATCC 43049
MSEIELQNLSKSFGELDAVTDVSLSVRDGELLCLLGPSGCGKSTTMRMISGLETPSSGTVYIGDADVTDEPAYDRDTSMVFQNWALFPYKTVLENVAFGLKMRGMGKQQRRDRASEMLDRVHMDGYESHSPTDLSGGQKQRVALARSLAVDPDVLLLDEPLSNLDKRLREEMEIELKDIREEFQKTFVHVTHNQDEAFTLADRIGIMNDGRLVQVGEPNEVYRDPKNKFVEEFLGDTNFVSGTVSDSDGQYSYLVTEFDSEIRVPVTSKIQPEASLTVSLRPEFMQIAPLTDESTRASHQTRADGNGGGGGVSGTVESTIYRGSSIRHVVDIGGEQLFVEQSVTDQSAIDEGDTVELSWDIDDILLFRPDGTRVRDRQ

SEQ ID NO: 65996 - DNA, 1119 bp, Thermus thermophilus HB8
  CDS (1)..(1119): transl_table=11
gtgccaggcctggggttgccccccggggcggcgcgccctaaactgggcgtcgtggccgaggtgctggtgcgtctccagggggtgcggaagcgctacggaaccaccgtggccctggacggggtggacctcgaggtccataggggcgagttcttcagcctcctcgggccctcgggctgcggcaagaccacccttttgcggctcctcgccgggtttgagaccccggacgcgggccggatagagatcggcggccgggacatggcccgggtccccccctacgagcgcccggtgaacaccgtctttcagaactacgccctcttcccccacatgaccgtggaggcgaacatcgccttcggcctcaggatgaaaggccttcccccggaggccatccgggagaaggtggcctgggcgttggagctcgtggacctcctgggcctggagaagcgctaccccagggagctttccggggggcagaagcagcgggtggccctggcccgggccctggtcttggagccccaggtcctcctcctggacgagcccctctccgccctggacgcaaggctccgccaggacctcagggtggagctcatgcagctccagaggcggcttggcaccaccttcatcttcgtcacccacgaccaggaggaggccctggtcatgtccgaccgcatcgccgtgatgcgctcgggccgcattgagcaggtggggcttcccgacgaggtctacgagcgccccaagacccgcttcgtagcggcctttctcggccgctccaacttcctccccgcaaggccccaccccttgggggccgaaacccctttggggcctttgcgccttaaggcccctttggcgcgggaggcccttttggccatccgcccggagaagatccggctctacccggcccaggggggggttcccgcccgggagaacctggtgcgggcggtggtggaggagatcgtctacacgggggcggagaaccagtactacctgagggcgggggaggtgaggcttctggcctataccctgaaccaggacctgcaggagcccggggccgaggagttcgggtacggggaggaggtcctctgctacctccccccggagaacctggtggtggtccatgaatga

SEQ ID NO: 65997 - protein, 372 aa, Thermus thermophilus HB8
MPGLGLPPGAARPKLGVVAEVLVRLQGVRKRYGTTVALDGVDLEVHRGEFFSLLGPSGCGKTTLLRLLAGFETPDAGRIEIGGRDMARVPPYERPVNTVFQNYALFPHMTVEANIAFGLRMKGLPPEAIREKVAWALELVDLLGLEKRYPRELSGGQKQRVALARALVLEPQVLLLDEPLSALDARLRQDLRVELMQLQRRLGTTFIFVTHDQEEALVMSDRIAVMRSGRIEQVGLPDEVYERPKTRFVAAFLGRSNFLPARPHPLGAETPLGPLRLKAPLAREALLAIRPEKIRLYPAQGGVPARENLVRAVVEEIVYTGAENQYYLRAGEVRLLAYTLNQDLQEPGAEEFGYGEEVLCYLPPENLVVVHE

SEQ ID NO: 65998 - DNA, 1062 bp, Geobacillus kaustophilus HTA426
  CDS (1)..(1062): transl_table=11
gtgaacggggaagagatcatccgcttcgagcgagtgacgaaggaatacgacggaacggtcgtattggatgacgtcagttttgcgatggagcgcgggaagttttatacgctgcttggcccgtcagggtgcgggaagacgacgattttgcggctgattgccgggtttatcgaaccgacggaaggaacgatttatttccacgggaagccgattcaaaacgtcccgccgaacaaacggcaagtcaacactgtctttcaagactatgcgttgtttcctcacctcgatgtgtttgaaaacgtggcatttggcttgcgcgtgaaaaagatgaaagaagcggacatccgccaaaaagtgagcgaagcgctccggtttgtcaacttggaaggctatgagcgccgccgcattcaagagatgtccggcggccaacgccagcgcgtcgccattgcccgggcgattgtcaatgaacctgaggtgttgctcttggatgaaccgctgtcagccttggatttgaaattgcgcacggaaatgcagtatgaattgcgtgagctccaacgtcgattgggcattacgtttatttttgtcacgcatgaccaagaagaagcgctggcgatgtccgattacatttttgttctgaataaagggaaaattcagcagttcgggacgccgaaagacatttacgacgagcccatcaaccgattcgtcgccgatttcatcggggaatcgaacattttgtcggggcgcatgatcgacgatttcctcgtcgaatttgccggcaaacagtttgcgtgtgttgaccgcggcttcgcgccaaacgaaccggtcgatgtcgtcatccgcccggaagatttggagctcgcggcgccggaagacgggcagatcgtcatccgcgtcgattcgctcttattccgcggtgtccattatgaaatttgcggctatgacgaaaacggcaacgaatggcttgtccattcgacgaaaaaggcggaagtcggggaaacggtcggcctccgttttgaaccggaagcgattcacgtcatgcgagtcgaaagggaggatgagggcgcatga

SEQ ID NO: 65999 - protein, 353 aa, Geobacillus kaustophilus HTA426
MNGEEIIRFERVTKEYDGTVVLDDVSFAMERGKFYTLLGPSGCGKTTILRLIAGFIEPTEGTIYFHGKPIQNVPPNKRQVNTVFQDYALFPHLDVFENVAFGLRVKKMKEADIRQKVSEALRFVNLEGYERRRIQEMSGGQRQRVAIARAIVNEPEVLLLDEPLSALDLKLRTEMQYELRELQRRLGITFIFVTHDQEEALAMSDYIFVLNKGKIQQFGTPKDIYDEPINRFVADFIGESNILSGRMIDDFLVEFAGKQFACVDRGFAPNEPVDVVIRPEDLELAAPEDGQIVIRVDSLLFRGVHYEICGYDENGNEWLVHSTKKAEVGETVGLRFEPEAIHVMRVEREDEGA

SEQ ID NO: 66000 - DNA, 1137 bp, Salmonella enterica subsp. enterica serovar Paratyphi A str. ATCC
  CDS (1)..(1137): transl_table=11
atgggacagagtaagaaattgaataaacaaccgcgttcgctttcaccgctggtgcttttgtcgggaattagcaaaagtttcgatggcaaagaggtcatttcacagctggatttgaccatcaacaatggcgaattcctcacgctgcttggcccttccggctgcggtaaaacaaccgttcttcgcctgattgccggcctggaaaccgttgatgccgggcatatcatgttggataaccaggatatcacccacgttcccgccgaaaatcgttatgtaaataccgtatttcaaagctacgctttatttccgcatatgacggtgtttgaaaatgtcgcgtttggcttacgaatgcaaaaaacaccagccgccgagatagcgcctcgcgtgaccgatgcgctgcgtatggtgcagcttgaagagtttgcacaacgtaaaccgcaccagctttccggcggacagcagcagcgtgtggctatcgctcgcgcggtggtgaataaacctcgcctgttattactggacgaatcgctctccgcgctggactataaattgcgcaaacaaatgcagaacgagcttaaagcattacagcgtaaactcggtatcacgtttgtttttgtcactcacgatcaggaagaagcgctcaccatgtccgatcgtatcgtggtaatgcgtaatggcgtgattgagcaagacggcacgccgcgtgaaatctatgaagagccaaaaaacctgtttgtcgctggttttatcggcgaaattaaccgctttgacgcaaccgtcattgaacggcttgatgaacagcgcgtccgcgccagcgtagaaggtcgggagtgcaatatatacgtcaatttcgctgtcgaaccgggccaaaaactgaacgtcctgctgcgaccggaagatctacgcgtcgaagagatcaacgatgataaccacatcgaagggcttatcggctacgtgcgcgagcgcaattacaaaggtatgacgctggagtcggtggttgaactggaaaatggcaaaatggtgatggtcagcgaattcttcaacgaagacgatcctgacttcgaccattcacttgaccaaaaaatggccattagttgggtagaaagctgggaggtcgtactggctgatgaagaacacaagtaa

SEQ ID NO: 66001 - protein, 378 aa, Salmonella enterica subsp. enterica serovar Paratyphi A str. ATCC
MGQSKKLNKQPRSLSPLVLLSGISKSFDGKEVISQLDLTINNGEFLTLLGPSGCGKTTVLRLIAGLETVDAGHIMLDNQDITHVPAENRYVNTVFQSYALFPHMTVFENVAFGLRMQKTPAAEIAPRVTDALRMVQLEEFAQRKPHQLSGGQQQRVAIARAVVNKPRLLLLDESLSALDYKLRKQMQNELKALQRKLGITFVFVTHDQEEALTMSDRIVVMRNGVIEQDGTPREIYEEPKNLFVAGFIGEINRFDATVIERLDEQRVRASVEGRECNIYVNFAVEPGQKLNVLLRPEDLRVEEINDDNHIEGLIGYVRERNYKGMTLESVVELENGKMVMVSEFFNEDDPDFDHSLDQKMAISWVESWEVVLADEEHK

SEQ ID NO: 66002 - DNA, 1134 bp, Salmonella enterica subsp. enterica serovar Paratyphi A str. ATCC
  CDS (1)..(1134): transl_table=11
gtgaatgatgtccccaaccgcccgcaggtgaaagcccgtaaagcgctgacgccgcttctggaaattcgcaacctgacgaagtcattcgacgggcaacatgctgtcgatgatatcagtctgactatctataaaggcgagatttttgccctgctgggcgcgtcaggttgtggaaaatcgactctgctacggatgctggcaggttttgaaccgccgagcagcgggcaaattatgctcgacggcgtcgatctggcgcatgttccgccgtatcagcgtccgattaatatgatgtttcagtcctatgcgttgtttccgcatatgacggtagagcagaacatcgcttttggtctgaagcaggacaaactgccgaaggcggagattactagccgcgtcaatgagatgctgggtctggtgcacatgcaggagtttgcgaaacgtaagccgcatcagctttccggcggtcagcgtcagcgcgtggccctggcgcgcagcctggcgaaacgtcctaagctgctcttgttggatgaaccgatgggcgcgctggataaaaaattacgcgaccggatgcagcttgaagtagttgatatccttgagcgcgtcggcgtgacctgcgtcatggtgacgcacgatcaggaagaagccatgacgatggcggggcgcattgccatcatgaaccgtggaaaatttgtgcaaattggcgaaccggaggagatttacgagcatccgacgacccgctatagcgccgaatttatcggatcggtaaatgtttttgagggcttactgaaagcgcgtgaagaggacggtctggtcattgacgcgcccggtttggtacatccgttaaaagtcgatgcggatgcctctgtcgttgataatgtgccggtatatgtggcgctacgtccggaaaaaatcatgctgtgtgagtcgctgcccgccgatggctataatttcgccgtcggcgaagtggcgcatattgcgtatctcggcgatctgtctatttatcatgtgcggctaaaaagcgggcagatgatcagcgctcaactgcagaatgcgcaccgttaccggaaagggttaccgacctggggcgatgaagtgcgtttgtgctgggaagcggatagctgcgtggtcctgacggtataa

SEQ ID NO: 66003 - protein, 377 aa, Salmonella enterica subsp. enterica serovar Paratyphi A str. ATCC
MNDVPNRPQVKARKALTPLLEIRNLTKSFDGQHAVDDISLTIYKGEIFALLGASGCGKSTLLRMLAGFEPPSSGQIMLDGVDLAHVPPYQRPINMMFQSYALFPHMTVEQNIAFGLKQDKLPKAEITSRVNEMLGLVHMQEFAKRKPHQLSGGQRQRVALARSLAKRPKLLLLDEPMGALDKKLRDRMQLEVVDILERVGVTCVMVTHDQEEAMTMAGRIAIMNRGKFVQIGEPEEIYEHPTTRYSAEFIGSVNVFEGLLKAREEDGLVIDAPGLVHPLKVDADASVVDNVPVYVALRPEKIMLCESLPADGYNFAVGEVAHIAYLGDLSIYHVRLKSGQMISAQLQNAHRYRKGLPTWGDEVRLCWEADSCVVLTV

SEQ ID NO: 66004 - DNA, 1104 bp, Silicibacter pomeroyi DSS-3
  CDS (1)..(1104): transl_table=11
ttgcgagggtttgttttgacctccacaaccaacgaagccctgccgatctcggtgaagaacgtgaccaagacctatggtcctgtgcatgcgctcaacgatgtgtcgctcgaggtgcgaagcggcgagttcctgacgctgctgggcccgtccggctcgggcaagacgacgctgttgatggtgctggcggggttcacccggcccgattgcggcagtctgaaattcggtgaccgcgaggtgatccgcacgccgccgcatctgcgcgatgtggggatgacatttcaaagctatgcgctgttcccgcatatgacggtggcgggcaacgtgggctatccgctgaaactgcgcaaggtgcccaaggccgagatcgcccagcgggtcgaggcggcgctggaaaccgtgcagctgggcgggtttggcgagcggcgcatcgaccagctgtcgggcggccagcgccagcgtgtcgccgttgcccgcgccatcgtgttcgaaccgcgcatcctgttgatggacgagccgctgtcggcgctggacaagaagctgcgcgaccagatgcagatcgagctgcgccacctgcatgaaaagctgggcatgaccacggtctatgtcacccatgaccagcgcgaggcgctgaccatgtcggaccggatcgccgtggtgaaccatggccgcatcatgcagctggccaccccgcgcgacctgtacgagcggcccgccaatcgcttcgtggcggatttcatcggggaatccacctttttgccggtgtcgcgccagggcgatacggtgctgttcgacggcacgcccctgttgcatgacagcccgccgcccgaggcggcgagcctgctgttgatgatccgccccgaacgggtggtgctgtcgcgcgaggggccgcgcgagggggccaacaactttgccgccaccgcgaccgaggtggtctatcagggcgacagtttcctgctgcatgcggcgctggccaatggcgagcagatcgtgctgcgcggcgccatgcggggtgccaatgtcaccgccttgccagcggtgggcgaggcgctgaccctgtgcctggcgcccgaggataccgtgctgatcgacggaagcgaggcctag

SEQ ID NO: 66005 - protein, 367 aa, Silicibacter pomeroyi DSS-3
MRGFVLTSTTNEALPISVKNVTKTYGPVHALNDVSLEVRSGEFLTLLGPSGSGKTTLLMVLAGFTRPDCGSLKFGDREVIRTPPHLRDVGMTFQSYALFPHMTVAGNVGYPLKLRKVPKAEIAQRVEAALETVQLGGFGERRIDQLSGGQRQRVAVARAIVFEPRILLMDEPLSALDKKLRDQMQIELRHLHEKLGMTTVYVTHDQREALTMSDRIAVVNHGRIMQLATPRDLYERPANRFVADFIGESTFLPVSRQGDTVLFDGTPLLHDSPPPEAASLLLMIRPERVVLSREGPREGANNFAATATEVVYQGDSFLLHAALANGEQIVLRGAMRGANVTALPAVGEALTLCLAPEDTVLIDGSEA

SEQ ID NO: 66006 - DNA, 1101 bp, Silicibacter pomeroyi DSS-3
  CDS (1)..(1101): transl_table=11
atggtgccaccgacgggggaacgatccttgaccaaagccatcagcgcacgtgcgttgcgcaaggtgtatccgggcacgccgcccgtcgaggccctgggcggcgtcgacatcgacatcgccgataacgagttcttcaccctgctggggccctcggggtgcggcaagacgacgatcctgcggctgatcgcggggtttgaacaccccacttctggttcgctggacatgttcgggcaaagcctgctggacctgcccccctacaagcgccagatcaacaccgtcttccagagctatgcgctgtttccgcatatgagcgttgccgagaacatcggctttggcctggaaatgctgggcaagcccaaatccgagatcaagagcaccgtggccgagatgatggatctggtgcagatgtcccatctcgccgaccgccagaccagccagatctcgggcggccagcaacagcgcgtggccctggcccgggctctggcgcccaaaccccgggtgctgctgctggacgagccactgagcgcgctggatttcaagctgcgcaaaaacatgcagctggagctgaagaggcttcagaccgaaaccggcatcaccttcatctttgtcacccatgaccaggaagaggcgctgaccatgtcggaccggatcgcggtgatgtccgatggcgccatccgccagatcggctctccgcgcgacatctacgaccatcccgccgaccggttcgtggccgatttcatcggcgacaccaatttcctgcccgctgacgtgatcgccaccgagggtgagcgcgtgtcgctgcggctggggtcaggcaagaccatcaccgcgcccgcccgccatgccggcggcggccgggtcacactggcggtgcgccccgaacatgcccgcctggaagccgaggacagcggcctgttgcccggcgtgctgagcgatgcggtctatttcggcaccgacacccatttccacatcgcgctggatgacggcaccgcctttgtcctgcgccagcagaacagccccgataccgagacccgctttgccaagggggagagggtttcggtcagcttcccgggcgaggtggcccaggtgctgagggactga

SEQ ID NO: 66007 - protein, 366 aa, Silicibacter pomeroyi DSS-3
MVPPTGERSLTKAISARALRKVYPGTPPVEALGGVDIDIADNEFFTLLGPSGCGKTTILRLIAGFEHPTSGSLDMFGQSLLDLPPYKRQINTVFQSYALFPHMSVAENIGFGLEMLGKPKSEIKSTVAEMMDLVQMSHLADRQTSQISGGQQQRVALARALAPKPRVLLLDEPLSALDFKLRKNMQLELKRLQTETGITFIFVTHDQEEALTMSDRIAVMSDGAIRQIGSPRDIYDHPADRFVADFIGDTNFLPADVIATEGERVSLRLGSGKTITAPARHAGGGRVTLAVRPEHARLEAEDSGLLPGVLSDAVYFGTDTHFHIALDDGTAFVLRQQNSPDTETRFAKGERVSVSFPGEVAQVLRD

SEQ ID NO: 66008 - DNA, 1002 bp, Silicibacter pomeroyi DSS-3
  CDS (1)..(1002): transl_table=11
atggccgaggcgttctctggcggcagtctgcggatcgcgggtgtgtcgaagtattttggcacgttccgggcggtcaacgcggtcgatctggaaatccgcaagggagagttcctgaccctgctgggcccttcgggctcgggcaagacgacgctgttgatgatgatcgcggggtttctggacatcaccagcggtgacatcgcgctggacggaagctcgattgccaatgtgccggcggaaaaacgcaacttcgggatggtgtttcagggctatgccctgttcccgcatatgacggtgcgcgacaatatcggctatgcgctgagcgtgcgcaaacgtcccgaggccgagatccggacccgtgtcgacgagatgctggaactggtgcagttgcaggatttcgccaaccgcaagcccggccagctgtcgggcggtcagcaacaacgcgtggcgctggcgcgggcgctgtgtttcgcgccgccggtcctgctgctggacgagccgctgggcgcgctcgacaagaagctgcgggtcgaggtgcaggaacagctcaaggacattcaccgccgcgtcggcacgaccttcatctacgtcacccatgaccaggaagaggcgctgtcgatgtccgaccgcatcgtcatcatgcgggacggggccatcgaacaggtgggctctccgcaagagctgtacgagcggcccgcaacccgctttgccgccagtttcctgggcaagtcgaactttgttcaacagaacggccagacctatgcgctgcgccccgagaagatcgacattcacctgggcaccggtcacccgcaggcccggcgtaagggaactattaccagcatcacctatttcgggtcgatgcagcggatcatcgtcgaaaccaccgaggccgaacagatcgaagtggatatcgacgtctggcgcaaccagcagcccctgcacgagggcgagaccgtcgagctgagctggcaggacgcggcggcggtggacctgaaggaaagctga

SEQ ID NO: 66009 - protein, 333 aa, Silicibacter pomeroyi DSS-3
MAEAFSGGSLRIAGVSKYFGTFRAVNAVDLEIRKGEFLTLLGPSGSGKTTLLMMIAGFLDITSGDIALDGSSIANVPAEKRNFGMVFQGYALFPHMTVRDNIGYALSVRKRPEAEIRTRVDEMLELVQLQDFANRKPGQLSGGQQQRVALARALCFAPPVLLLDEPLGALDKKLRVEVQEQLKDIHRRVGTTFIYVTHDQEEALSMSDRIVIMRDGAIEQVGSPQELYERPATRFAASFLGKSNFVQQNGQTYALRPEKIDIHLGTGHPQARRKGTITSITYFGSMQRIIVETTEAEQIEVDIDVWRNQQPLHEGETVELSWQDAAAVDLKES

SEQ ID NO: 66010 - DNA, 1128 bp, Silicibacter pomeroyi DSS-3
  CDS (1)..(1128): transl_table=11
ttgcaatcatcgacctttgcgccttgggaagatcccaacgcgaaaccgctgatccgtttcaagaacgtgaccaaacggtttggcgaattcaccgctatcgacaacctgacgctggatatcttcgagcgcgagttctttgccctgcttggcccgtccggctgcggcaagaccacgatgatgcgtatgctggccggcttcgagaccgccaccgagggtgttatcgaactggccgggcaggatatcgcgccggtgccgccgaacaagcgcgcagtgaacatgatgttccagtcctacgcgctgttcccgcatctcagcgtgtgggacaacatcgcctttggcctgcgccgcgaccgcaagtccaaggccgagatcgaagcccgggtcgaagagatgctgcgcctggtccggctggagaagtttgcccaacgcaaaccgcaccagatctcgggcgggcagcggcagcgggtggcacttgcccgatcgctggcaaaggcgccgaaactcttgctgctggacgagccgctgggtgcgctggacaagaagctgcgccaggatacccagttcgaactgatggacattcaggagaaaaccggcaccaccttcgtgatcgtgacccacgatcaggaagaggcgatgaccgtggccagccgcgtcgcggtcatggatcagggccagctgatgcaggttgccacgcctgaccgcatctatgaaactccaaattcggtttatgtggccgacttcatcggcgacgtgaacatcatcgaaggccgcgccacacccgagggcgaagacggctatcgcatcgactgggccgagggacagccggcgctgaccgcaaaatccgccaccaggttcgacaaggggcagaaatgccatctggcgatccgccccgaaaaggtggcgatcagcgccgaacgccccgccgacgctgccaatgcggtgcagggtcgggtgcatgacatcgcctatctcggcaacctctcaacctattacgtggaacttgccgacggcacgatcatcaaggcgcagacctcgaacacgcgccgcatctcgcgccgcagctttacctgggaagacaccgtctggctgtcatggacagccacggcgggtgtgctgctggcaaactga

SEQ ID NO: 66011 - protein, 375 aa, Silicibacter pomeroyi DSS-3
MQSSTFAPWEDPNAKPLIRFKNVTKRFGEFTAIDNLTLDIFEREFFALLGPSGCGKTTMMRMLAGFETATEGVIELAGQDIAPVPPNKRAVNMMFQSYALFPHLSVWDNIAFGLRRDRKSKAEIEARVEEMLRLVRLEKFAQRKPHQISGGQRQRVALARSLAKAPKLLLLDEPLGALDKKLRQDTQFELMDIQEKTGTTFVIVTHDQEEAMTVASRVAVMDQGQLMQVATPDRIYETPNSVYVADFIGDVNIIEGRATPEGEDGYRIDWAEGQPALTAKSATRFDKGQKCHLAIRPEKVAISAERPADAANAVQGRVHDIAYLGNLSTYYVELADGTIIKAQTSNTRRISRRSFTWEDTVWLSWTATAGVLLAN

SEQ ID NO: 66012 - DNA, 1119 bp, Silicibacter pomeroyi DSS-3
  CDS (1)..(1119): transl_table=11
gtgtacggggagctggcattgaccacacgcaccagcagcgacacgttcgttgaattcgaacgtgtccagaagagttatgacggcgaaacgcttgttgtaaaagacctcaatctgaccatgcccaaaggcgagtttctgacgatgctcggcccctcgggttccggtaagacaacctgtctgatgatgctggccggctttgaaaccgccacccatggcgagatcaagctcgacgggcgtccgatcaacaacatccctccgcacaaacgcgggatcggcatggtgttccagaactacgccctgttcccgcacatgacgattgccgagaacctgtcctttccgctggaagtgcgcaagatcggcaaatccgaccgcgaggccaagatcaagcgcgcgttggacatggtcgagatgggcgcctttggcggccgccgcccggcccagctctcgggtggccagcaacagcgggtcgcattggcccgcgcgctggtattcgaaccggaactggtgctgatggacgaaccgctgggcgcgctggacaagcagctgcgcgaaaagatgcagttcgaaatcacccgtctggcgcatgagctgggaatcaccgtggtctatgtgacccatgaccagaccgaggcgctgaccatgtcggaccgcgtcgcggtgttcaacgatggcgtgatccagcagctggcgccgcctgacgagctttatgaacagcctgccaacagcttcgttgcccaattcatcggcgagaacaacaccctcgaaggtgaggtgcaggagattcgcgacggtatcgcagtggtccggctcgacgatggcgggctgatcgactgcaaaccggtcaatgtcagccgcccgggcgaacgcacccgcgtgtcgatccgccccgaacgggtcgaattcaacaagagccgcctgcaaaaaggtgtccacacgctcaaggccgaggtgatggaattcatctacatgggcgacatcttccgcacccgcgtgcgcgttgccggtaatgacgaattcatcatcaagacccggaacgcgcccgaccaggtgcggctggaacccggcgcccagatcgagatcggctggctgcccgaagattgccgcgcgctggacgcctga

SEQ ID NO: 66013 - protein, 372 aa, Silicibacter pomeroyi DSS-3
MYGELALTTRTSSDTFVEFERVQKSYDGETLVVKDLNLTMPKGEFLTMLGPSGSGKTTCLMMLAGFETATHGEIKLDGRPINNIPPHKRGIGMVFQNYALFPHMTIAENLSFPLEVRKIGKSDREAKIKRALDMVEMGAFGGRRPAQLSGGQQQRVALARALVFEPELVLMDEPLGALDKQLREKMQFEITRLAHELGITVVYVTHDQTEALTMSDRVAVFNDGVIQQLAPPDELYEQPANSFVAQFIGENNTLEGEVQEIRDGIAVVRLDDGGLIDCKPVNVSRPGERTRVSIRPERVEFNKSRLQKGVHTLKAEVMEFIYMGDIFRTRVRVAGNDEFIIKTRNAPDQVRLEPGAQIEIGWLPEDCRALDA

SEQ ID NO: 66014 - DNA, 1122 bp, Francisella tularensis subsp. tularensis SCHU S4
  CDS (1)..(1122): transl_table=11
atgcaaaaatcttcaaaaaaacctttggtttctataaagaacctatctaaacaatttgatgatggtcacctagctgttgactctgtaaaccttgatgtctatccaaaagaatttttttctttgcttggcggatctggaagtggtaaaagtacactacttagaatgctcgcaggatttgaaagacctactgatggtaagataattatcgatggtgtagatatgtcaaatactccatcatacaaaagacctgtaaacatgatgtttcaatcttatgcattatttccgcatatgaatgtaaagcaaaatatcatgtttggcttaaaacaagagaagtcccttaaaaaagaagaaattgagaaagcaacagacgcagctttgaaaattattaagatggatcatcttgctaaaagaaaaccacatcaattatctggtggacaacgtcaacgtgtggctctagcaagatgtttggcaaaaagacctaaattgattctcctagatgaaccattatctgcactagacaaaaacctacgtgaccaaatgcagtttgaacttgtagatattcaagaacaaacaggtagtacttttataatggtaactcatgatcaagaagaagctatgacaatgtcgacaagaattggtatcatgacagatggttggctagagcaagtaagtactccttcagaaatttatgaattccctaaaagtcgatttgtagcgaattttattggtaaaagtacaatttttgagggtcgtgtagaagcagtaagtagaactcgaagcattataacttcagagcaagctggcactaattttgtattaagaagaaatatagaagctattgaagatcaagaaatctgggttggattgcgacctgaaaagatagttataagtaaagacaaacccgaagattacaatcctaataaacctgtgaattgtattaaaggtattgttgaagatattgcttatatgggcggcttatctacttaccatgttaggactgctaacggcaatataattaagtctactgacttcaatattgagagaaatgcagatcatccttcttgggatgatgaagtatatctcacttgggaatcagaaaatatcatggtgctatactcataa

SEQ ID NO: 66015 - protein, 373 aa, Francisella tularensis subsp. tularensis SCHU S4
MQKSSKKPLVSIKNLSKQFDDGHLAVDSVNLDVYPKEFFSLLGGSGSGKSTLLRMLAGFERPTDGKIIIDGVDMSNTPSYKRPVNMMFQSYALFPHMNVKQNIMFGLKQEKSLKKEEIEKATDAALKIIKMDHLAKRKPHQLSGGQRQRVALARCLAKRPKLILLDEPLSALDKNLRDQMQFELVDIQEQTGSTFIMVTHDQEEAMTMSTRIGIMTDGWLEQVSTPSEIYEFPKSRFVANFIGKSTIFEGRVEAVSRTRSIITSEQAGTNFVLRRNIEAIEDQEIWVGLRPEKIVISKDKPEDYNPNKPVNCIKGIVEDIAYMGGLSTYHVRTANGNIIKSTDFNIERNADHPSWDDEVYLTWESENIMVLYS

SEQ ID NO: 66016 - DNA, 1095 bp, Bacillus clausii KSM-K16
  CDS (1)..(1095): transl_table=11
atgggtgtagcaattgatattgacaatgtggtcaaaatgtacgatgagcatacggttattgatgggttgtcgctcacgattcagccaggtgaattgtttacgttattaggtccgtctggttgtgggaaaacgacgctcttgcgaatgattatcggttttaattctgtggacggcggtgcgattaaagtcgatggccagcgcatcaatgatgttcctgtcagcaagcggaaaatggggatggtgtttcaaaactatgcgattttcccccatatgacagtggcagagaacatcgcctttgggttgaagacgctcaaggatagcaaggcgcaaatgcaaagcaagattgatcatataatgaaggtcgtgcacattcaagaccaccatagcaaaaagccagataagctttcagggggccaacaacaacgggttgcacttgcccgggcgcttgtgattaatccgaatgttttgttaatggatgagccgctttcgaacttggatgcgaaactgcggattgagatgagaaatgcgattaaagaaattcagcaagaagtggggataacgaccgtttatgtgacccatgaccaagaagaggcgctggcgatttctgaccggattgctgtcatgaataaaggggtgatccaacaaattggcaaacctgaacaaatttatttgcgtccgtcaaatttgttcgttgcccagtttattggcacttccaatgtgattaaagcgaaggttgaaaagcaaggcactgatacgttcatcgtctttaatggcgaatacaaagaaaagcttgataacgttgtagaaacggttgaaaatgggcaggaagtgctggtgtctgtccgtccacaggaatttacgattacgcaagaagcaagtgccatcgctggcgttgtcgaaagcacgatgtttttagggatcaatactcattatctcgtcacccttacgactggagagcgagtggaagtggtgcaacatatcgaagacaaagcgatcattccagagggaacgaatatttatgtaaaggtgaagccgcatttaattaacttgtttgatgtggcgaatgaacaaacgctcatgaaggcaggtgagtga

SEQ ID NO: 66017 - protein, 364 aa, Bacillus clausii KSM-K16
MGVAIDIDNVVKMYDEHTVIDGLSLTIQPGELFTLLGPSGCGKTTLLRMIIGFNSVDGGAIKVDGQRINDVPVSKRKMGMVFQNYAIFPHMTVAENIAFGLKTLKDSKAQMQSKIDHIMKVVHIQDHHSKKPDKLSGGQQQRVALARALVINPNVLLMDEPLSNLDAKLRIEMRNAIKEIQQEVGITTVYVTHDQEEALAISDRIAVMNKGVIQQIGKPEQIYLRPSNLFVAQFIGTSNVIKAKVEKQGTDTFIVFNGEYKEKLDNVVETVENGQEVLVSVRPQEFTITQEASAIAGVVESTMFLGINTHYLVTLTTGERVEVVQHIEDKAIIPEGTNIYVKVKPHLINLFDVANEQTLMKAGE

SEQ ID NO: 66018 - DNA, 1284 bp, Xanthomonas oryzae pv. oryzae KACC10331
  CDS (1)..(1284): transl_table=11
ttgtgctggtctgcattgggaggagtgaggagttcgatggcatccaccgagaccacgccgcagccgcatgttgccccttacgacagcggttatctcagcattagcgaggtccgcaaggagttcgatggattcgttgccgtggacgctgtcagcctgcagatccgcaagggcgaaatgttcgcgttgctgggaggctcgggcagtggcaaatccacgctgctgcgttgtcttgcggggttcgaccggccaagcagtgggcgcatcgttctggacggtcagcccatcgatgcgctgccgccgtacgaacgcccgatcaatatgatgttccagtcgtatgcgctgtttccgcatatgagcgtggagcagaacatcgccttcggcctgaaacaggaaggcttgtccaaggctgcgatcgccgcccgtgtcggcgagatgctcgagctggtgcagcttggcgcgctggccaagcgcaagccgcatctgctctccggcgggcagcagcaacgcgtggccctggcgcgctcgctggccaagcggcccaagctgttgttgctggacgaaccgatgggcgcgctggacaagaagctgcgctcgcagatgcagctggagctggtcaacatcatcgaaacctccggcgtcacctgcgtcatgctgacccacgatcaggaagaggccatgacgatggccacccgcatcgcgctgatggaccagggctggattcaacaagtcggcacgcccgacgaaatctacgagcagccagcgaatcgctttgcggccgagttcatcggctcggtcaatctgatcgatgcggtcatcgccgacgacgcgcccgattacgtcggcttgaagacctctgcgttcgatgcctgcatccgcatcggtcacggcatcaccggcttcgaagggcaggcggtggcgttcgcgctgcgcccggaaaagctcgccatcggcaaggacgagccgacgcaggcgtgcaacaaggcgcagggcgtgatcgaggacatcgcctatttcggcagccattcggtgtatcacgtgcgcctgcccagcgggatcaagctgatggccaacttcgccaatcgccagcgctgggccagcgaagcgctgacctggggcgacaccgtgtgggtgggctggggcgaagacgacggcgtagtgctcaccgttatacacgccaatcgccgcctacatcggcatcgtgtactgctatttgccgttcatggtgttgccgctgtacgccaacctggtcaagcacgacaaccgtctgctcgaagccgcctatga

SEQ ID NO: 66019 - protein, 427 aa, Xanthomonas oryzae pv. oryzae KACC10331
MCWSALGGVRSSMASTETTPQPHVAPYDSGYLSISEVRKEFDGFVAVDAVSLQIRKGEMFALLGGSGSGKSTLLRCLAGFDRPSSGRIVLDGQPIDALPPYERPINMMFQSYALFPHMSVEQNIAFGLKQEGLSKAAIAARVGEMLELVQLGALAKRKPHLLSGGQQQRVALARSLAKRPKLLLLDEPMGALDKKLRSQMQLELVNIIETSGVTCVMLTHDQEEAMTMATRIALMDQGWIQQVGTPDEIYEQPANRFAAEFIGSVNLIDAVIADDAPDYVGLKTSAFDACIRIGHGITGFEGQAVAFALRPEKLAIGKDEPTQACNKAQGVIEDIAYFGSHSVYHVRLPSGIKLMANFANRQRWASEALTWGDTVWVGWGEDDGVVLTVIHANRRLHRHRVLLFAVHGVAAVRQPGQARQPSARSRL

SEQ ID NO: 66020 - DNA, 1119 bp, Vibrio fischeri ES114
  CDS (1)..(1119): transl_table=11
ttgaacgttacacaacaatccgaaaaagaagcagttattaaattaactggtatttctaaaagctttgatggcaaagaagtgatttctaattttgacttagatgtaaatcacggtgaatttttaacaattcttggtccttcaggttgtggtaaaaccacagtgttacgcatgatcgcaggtttcgaaaccgctgatgcaggaacaattttattggattcgacagatgtaacgtcagtgcccgcagaacagaggcatgtgaataccgtattccaaagctacgccctattcccgcacatgacggtgtttgagaacgttgcgtttggtttacgtatgcaaaaagttgcagaatcagaaattgagcctcgtgtaacagaagctctgcaaatggttcgtttagctcaaatggcaaaccgtaagcctcatcagttatctggtggtcaacaacaacgtatcgcaattgctcgtgcagttgtaaacaagcctaaggttcttcttcttgatgaatctttatctgcgcttgattacaaactacgtaagcaaatgcaaattgaacttaaacaattacaacgtcaattaggtattacttttattttcgtaactcacgaccaggaagaagctctttcaatgtctgaccgtattatcgtgatgcgtgatggtgttattgaacaagacggtactcctcgtgaaatatacgaagaaccaaagaacttatttgttgctcgcttcatcggtgaaatcaacgtatttgctgctacagtgcaagaacgtcttgatgaaaaacgtattaaagcagaaatcgaagatacttcagctatcgtatattgcgaccttgatgttgctcctggcgataaagtgaaagtattacttcgtcctgaagatttacgcctagaagaaatcaaagagtctgataataaaggcatcactggctatgtacgtgaacgtacgtacaaaggtatgactttagactctgtacttgagttagattcaggtatgcgtgtaatgatcagtgagttctttaatgaagatgatccagatgttgatcactctttaggtcaaaaagtagcaattacttgggttgaaagctgggaagtggtgttagcagatgaacaagaagtttaa

SEQ ID NO: 66021 - protein, 372 aa, Vibrio fischeri ES114
MNVTQQSEKEAVIKLTGISKSFDGKEVISNFDLDVNHGEFLTILGPSGCGKTTVLRMIAGFETADAGTILLDSTDVTSVPAEQRHVNTVFQSYALFPHMTVFENVAFGLRMQKVAESEIEPRVTEALQMVRLAQMANRKPHQLSGGQQQRIAIARAVVNKPKVLLLDESLSALDYKLRKQMQIELKQLQRQLGITFIFVTHDQEEALSMSDRIIVMRDGVIEQDGTPREIYEEPKNLFVARFIGEINVFAATVQERLDEKRIKAEIEDTSAIVYCDLDVAPGDKVKVLLRPEDLRLEEIKESDNKGITGYVRERTYKGMTLDSVLELDSGMRVMISEFFNEDDPDVDHSLGQKVAITWVESWEVVLADEQEV

SEQ ID NO: 66022 - DNA, 1293 bp, Neisseria gonorrhoeae FA 1090
  CDS (1)..(1293): transl_table=11
atgcggggttctttagaacccctttttatttcatgctgcccgtgcgcttcacaagagtttcagacggcatcagacgttgcgactcccgccagcaatcaaacagctttttatcacccattcgaaaatccgttttgccggtactcgtctttttattggagtattgccattatgaccgcaaccacagcgtcttcagccaaaccttatctgcaaatccaaggtttggtgaaaaagtttggtgacaattacgctgtcgataacatcgacttggacatttatcaaaacgaaatcttcgcccttttgggcagttccggcagcggaaaatctacgctgctgcgtatgctggcgggtatggaaagtcccaatcagggaaaaatcatccttgatggtcaagatattaccaaacttgcaccctatgaccgccccatcaatatgatgttccaaagttacgcgctttttccgcatatgacggtggagcaaaacattgccttcggtctgaaacaggacaaaatgcctaaaggcgaaatcgatgcgcgcgtcgaagaaatgctgcgtctggttcagatgaccaaatttgccaaacgcaaaccgcaccaattgtccggtggtcagcagcaacgtatcgccttggcgcgcagtttggcaaaacgtccgaaaatcctgttgcttgacgaacctttgggggcgttggataagaaattgcgccagcaaacccagctcgagttggtcaatacgctggaacaagtcggcgtaacctgcattatggttacgcacgaccaagaagaggcgatgacgatggcgacccgcatcgccattatgtccgacggtcagttgcagcaggtcggcacgcccagcgacgtgtacgactatcccaacagccgcttcactgccgagtttatcggcgaaaccaacatctttgacggtgtggtgattgaaaatcatgccgactatgccgttatcgaatgcgaaggtttggaaaaccacgtccgtatcgaccatggtttgggtggcccgagcgagcaggatctttgggttagtattcgaccagaggatattgatttatataaagaaaaacccgaatatttgggcgactacaactgggcgaaaggcacggtaaaagaaattgcctatttgggcagcttcgccatataccatatcaaactcgccaacgggcgcgtcgtcaaaagccaagttcctgcaccttactggtatgtgcgtaacatcacgccgccgacttgggatgaaaccgtctatatcagctggccggaaaaccaaccgactccgttgttccgttga

SEQ ID NO: 66023 - protein, 430 aa, Neisseria gonorrhoeae FA 1090
MRGSLEPLFISCCPCASQEFQTASDVATPASNQTAFYHPFENPFCRYSSFYWSIAIMTATTASSAKPYLQIQGLVKKFGDNYAVDNIDLDIYQNEIFALLGSSGSGKSTLLRMLAGMESPNQGKIILDGQDITKLAPYDRPINMMFQSYALFPHMTVEQNIAFGLKQDKMPKGEIDARVEEMLRLVQMTKFAKRKPHQLSGGQQQRIALARSLAKRPKILLLDEPLGALDKKLRQQTQLELVNTLEQVGVTCIMVTHDQEEAMTMATRIAIMSDGQLQQVGTPSDVYDYPNSRFTAEFIGETNIFDGVVIENHADYAVIECEGLENHVRIDHGLGGPSEQDLWVSIRPEDIDLYKEKPEYLGDYNWAKGTVKEIAYLGSFAIYHIKLANGRVVKSQVPAPYWYVRNITPPTWDETVYISWPENQPTPLFR

SEQ ID NO: 66024 - DNA, 1134 bp, Salmonella enterica subsp. enterica serovar Choleraesuis str
  CDS (1)..(1134): transl_table=11
gtgaatgatgtcccccaccgcccgcaggtgaaaacccgtaaagcgctgacgccgcttctggaaattcgcaacctgacgaagtcattcgacaggcaacatgctgtcgatgatgtcagtctgactatctataaaggcgagatttttgccctgctgggcgcgtcaggttgtggaaaatcgactctgctacggatgctggcaggttttgaaccgccgagcagcgggcaaattatgctcgacggcgtcgatctggcgcatgttccgccgtatcagcgtccgattaatatgatgtttcagtcctatgcgttgtttccgcatatgacggtagagcagaacatcgcttttggtctgaagcaggacaaactgccgaaggcggagattaccagccgcgtcaatgagatgctgggtctggtgcacatgcaggagtttgcaaaacgtaagccgcatcagctttccggcggtcagcgccagcgcgtggccctggcgcgcagcctggcgaaacgtcctaagctgctcttgttggatgaaccgatgggcgcgctggataaaaaattacgcgaccggatgcagcttgaagtggtggatatccttgagcgcgtcggcgtgacctgcgtcatggtgacgcacgatcaggaagaagcgatgacgatggcggggcgcattgccatcatgaaccgtggaaaatttgtgcaaattggcgaaccggaggagatttacgagcatccgacgacccgctatagcgccgaatttatcggatcggtaaatgtttttgagggcttactgaaagcgcgtgaggaggacggtctggtcattgacgcgcccggtttggttcatccgttaaaagtcgatgcagatgcctctgtcgttgataatgtgccggtatatgtggcgctacgtccggaaaaagtcatgctgtgtgagtcgccgcctgccgatggctataatttcgccgtcggcgaagtggcgcatattgcgtatctcggcgatctgtctatttatcatgtgcggctaaaaagcgggcagatgatcagcgctcaactgcagaatgcgcaccgttaccggaaagggttaccgacctggggcgatgaagtgcgtttgtgctgggaagcggatagctgcgtggtcctgacggtataa

SEQ ID NO: 66025 - protein, 377 aa, Salmonella enterica subsp. enterica serovar Choleraesuis str
MNDVPHRPQVKTRKALTPLLEIRNLTKSFDRQHAVDDVSLTIYKGEIFALLGASGCGKSTLLRMLAGFEPPSSGQIMLDGVDLAHVPPYQRPINMMFQSYALFPHMTVEQNIAFGLKQDKLPKAEITSRVNEMLGLVHMQEFAKRKPHQLSGGQRQRVALARSLAKRPKLLLLDEPMGALDKKLRDRMQLEVVDILERVGVTCVMVTHDQEEAMTMAGRIAIMNRGKFVQIGEPEEIYEHPTTRYSAEFIGSVNVFEGLLKAREEDGLVIDAPGLVHPLKVDADASVVDNVPVYVALRPEKVMLCESPPADGYNFAVGEVAHIAYLGDLSIYHVRLKSGQMISAQLQNAHRYRKGLPTWGDEVRLCWEADSCVVLTV

SEQ ID NO: 66026 - DNA, 1062 bp, Brucella abortus biovar 1 str. 9-941
  CDS (1)..(1062): transl_table=11
atggcttttctgaatatcaaaaacctgaaaaagagcttcggcaccaatacggtcgtccatgatttcaacctcgccgtggaaaagggtgaattcgtctcctttctcggcccatcgggctgcggcaagaccacagttctgcgcatgattgccggctttgaaacctcggacgacggctcgattgaaatcgacggcaaggacgtggtgaacctgaggcccaaccagcgcaatatcggcatggtgtttcaggcttatgcgctctttcccaatatgaccgttgcacagaacgtttcgttcggcctgcgcgtttcgggcaagtcccgctcggaaatcgatgccaccgtgaaggaaatgctgagcctcatccggctcgaccatctggccgaccgctacccctaccagatgtccggtggccagcagcagcgcgtggcgcttgcccgtgcactcgccaccaagccgcaggttctcctgctcgacgagccactttcggcgctcgatgcgaaaatccgcatatccttgcgggaagaaatccgcgccatccagcaaaagctcggcatcaccacggttttcgtcacgcatgaccaggaagaggcgctgtcgatctccgaccgcatcgtggtgatgcatgaaggccgcgccgaccagatcggctcacccttcgatatttataaccgcccggcctcgcgcttcgtcgcatccttcgtcggcacgctcaacatgctggaagcttctgtcagcgaaccggcacagaacagcatcgatctcgacgggcgccagatcaccgtgcaggaaacgctcgctcatcaccccaagggcaagccattgacgctggcgctccgcccggaggcggtgagccttgaagcccgcaagagccacgacacttcgctggaagccactattgatgacgtgcacttcctcggctccgtcatccgtacgcgcgtgatactcggcaagaaccggctgtccttcgacacgtttaacgacccgacccacccgccgccacaacgcggcgacaaggtgacagtgcatttcgcctcacacgatcttctcgtgctggcagattag

SEQ ID NO: 66027 - protein, 353 aa, Brucella abortus biovar 1 str. 9-941
MAFLNIKNLKKSFGTNTVVHDFNLAVEKGEFVSFLGPSGCGKTTVLRMIAGFETSDDGSIEIDGKDVVNLRPNQRNIGMVFQAYALFPNMTVAQNVSFGLRVSGKSRSEIDATVKEMLSLIRLDHLADRYPYQMSGGQQQRVALARALATKPQVLLLDEPLSALDAKIRISLREEIRAIQQKLGITTVFVTHDQEEALSISDRIVVMHEGRADQIGSPFDIYNRPASRFVASFVGTLNMLEASVSEPAQNSIDLDGRQITVQETLAHHPKGKPLTLALRPEAVSLEARKSHDTSLEATIDDVHFLGSVIRTRVILGKNRLSFDTFNDPTHPPPQRGDKVTVHFASHDLLVLAD

SEQ ID NO: 66028 - DNA, 1068 bp, Brucella abortus biovar 1 str. 9-941
  CDS (1)..(1068): transl_table=11
ttgacggactatcgcatccgctttgaaaatatcagtaaatcctatggcgatttcaaagttatagacggcctgaacctcgatatcgaacggggcgaattcgtaagcctgctggggccctcggggtcgggcaagaccacccttttgatgatgctcgccggttttgaaaatccaagtagcggcacgatccatgtggacggaaagtccatcaactccgtcccttcctataagcgcaatatgggcgtcgttttccagaattatgcgctgtttccacatatgacggtggcggaaaacattgcctttcccttgcagatgcggggggtgggcaaggcgcaagcagctgagaaggtcgcgcgcgtgctggatatggtgcagctttcggccatgagcgagcgtaaaccatcgcaactttcgggtggtcagcaacagcgtgtcgctttggcgcgtgcgctggtgttcgagccgcatgtggtgctgatggatgagccgctcggcgcgctcgacaagcagttgcgcgagcagatgcagcttgatatccgcgccctgcacaaccggcttggcctcaccatcgttttcgtcacacatgaccagagcgaggcactcaccatgtcggaccgcatcgcggtcttcaacaagggcaagatcgagcagatcggctcgccacgcgctatttatgacgagccgcagacacgtttcgtcgccgaattcatcggcgagacgaacctggccgaaggcacggtggaaagcgttgaaggttcaagaattcttatccgtttgaaggacggcaccgccattgccgcttcatccgcttccaggcccatcagcggccagaatgtgcttctttccattcgcccggagcgcatcgagcttggagaggcggatggcgcggaaaaccggctggcggcgcgcgtgatggacagtgtttatcagggcgaccatctgcgtatccagcttgaggccaaggcgcataattttgtggttcgccttgatcgcaaggcgcgcgaatggcagccgggtgcggacgtggccgcaagcttcaaggccgccgattgctggaccatcctcgtatga

SEQ ID NO: 66029 - protein, 355 aa, Brucella abortus biovar 1 str. 9-941
MTDYRIRFENISKSYGDFKVIDGLNLDIERGEFVSLLGPSGSGKTTLLMMLAGFENPSSGTIHVDGKSINSVPSYKRNMGVVFQNYALFPHMTVAENIAFPLQMRGVGKAQAAEKVARVLDMVQLSAMSERKPSQLSGGQQQRVALARALVFEPHVVLMDEPLGALDKQLREQMQLDIRALHNRLGLTIVFVTHDQSEALTMSDRIAVFNKGKIEQIGSPRAIYDEPQTRFVAEFIGETNLAEGTVESVEGSRILIRLKDGTAIAASSASRPISGQNVLLSIRPERIELGEADGAENRLAARVMDSVYQGDHLRIQLEAKAHNFVVRLDRKAREWQPGADVAASFKAADCWTILV

SEQ ID NO: 66030 - DNA, 1029 bp, Pseudomonas syringae pv. syringae B728a
  CDS (1)..(1029): transl_table=11
atggcatttctgcagctcgaaggtctctccaaacgctacggctccattgacgcggtggttgccaccaacctggccgtcgacaagggcgaattcgtttcactgctcggcccttccggctgcggcaaaaccaccaccctgcaaatgatcgccggtttcgttgaagtcagtgacgggcgcattgtgctcgacgggcgcgacatcacccacgccaaacccagcagccgaggcctcggcgtagtgtttcaaagctatgcgctgtttccgcacatgaccgtggccgacaacgttgcatttggcctgcggatgcgcaaggtggctgccgccgagttgcacccgcgtgtcaaacgggtgctggagctggtgcgcctcggtcagcatgccgagcgctacccgcgcgagctgtccggtggtcagcgccagcgggtcgcattggcccgcgcactggtaatcgagccgccagtgctgctgctcgacgagccgctgtccaacctggacgccaacctgcgcgaagagatgcagttcgagatccgccgcattcagaacgaagtcggcattaccacgctgatggtcacccatgatcaggccgaagccctgtcgatcagcgatcgggtggtggtgatgcaggccggtcgtatcacccagatcgacgagccatacaagctctacgaacacccgcgcacacgcttcatctcgggttttgtcggcaaggccaacatgttgcagggtgatctggacagcagcggcattccgcagattcgtcaggtgcccggcgatggcagcctgaccctcagcctgcgtcccgagaagatcgatctggtggcgcctggctgcggacggctgtccgggcgcatcgtcacgcgttattttctcggcagccagtggctgtatcggattgagaccggcattggcgaagtgacggtagtacgtcgcaacgacggccaggcgccgctggaacaaggcgcggcggtcgacatggactggcccgacgagttgctgcgcgtgctggatgccgacgaggtgcgcgcatga

SEQ ID NO: 66031 - protein, 342 aa, Pseudomonas syringae pv. syringae B728a
MAFLQLEGLSKRYGSIDAVVATNLAVDKGEFVSLLGPSGCGKTTTLQMIAGFVEVSDGRIVLDGRDITHAKPSSRGLGVVFQSYALFPHMTVADNVAFGLRMRKVAAAELHPRVKRVLELVRLGQHAERYPRELSGGQRQRVALARALVIEPPVLLLDEPLSNLDANLREEMQFEIRRIQNEVGITTLMVTHDQAEALSISDRVVVMQAGRITQIDEPYKLYEHPRTRFISGFVGKANMLQGDLDSSGIPQIRQVPGDGSLTLSLRPEKIDLVAPGCGRLSGRIVTRYFLGSQWLYRIETGIGEVTVVRRNDGQAPLEQGAAVDMDWPDELLRVLDADEVRA

SEQ ID NO: 66032 - DNA, 1155 bp, Pseudomonas syringae pv. syringae B728a
  CDS (1)..(1155): transl_table=11
atgagtgccgtgatcaaagaccccgcccatcagccacacaacacactggtcagcctgtgtaatctgaacaagcactatggaaatttcgccgccgtcgacgacatttccctggacatccaggacggcgaattcctgaccttcctgggctccagcggctcgggaaaaagcaccacgctgtcgatgctcgccggcttcgaaacgcccagctcgggcgagattctggtgggtggcaaatcgctggtgaatgtgccgccacacaagcgcgacatcggcatggtgtttcagcgctactcgctgttcccgcacctgtcggtacgcgacaacattgccttcccgctggcgatccgcaagctgcctgcggccgagcgcgagaagaaagtcgatgcgatgctcaagctggttcagctggaagcctttgctcatcggcgcccgtcgcaactgtcaggcggccagcagcagcgggtcgccatcgcccgagcgctggtttacgagccgcgcatcctgctgatggacgagcctctgggcgcactggacaagaagctgcgcgaagacctgcaggacgaactgcgccagttgcatcgccggctgggcatcaccatcgtttacgtaacccatgatcaggaagaagccatgcgcctgtcacagcgcatcgccattttcagccatggcaagatcgtcggtctgggctcgggctatgacctgtatcaggatccgccgaatgccttcgtcgcctcgtttctcggcaactcgaacttcctcaggctcaaggcccagggcaatgccgtggcaaccttcgaaggcagcacactggcgattcgcctgaccgcagggctgaagaccgatcaggaggtgctgctcatggtgcgcccggagaaagcccaggcgctgagcgtgtcccaggcagcggccatgccgcttgaagcaggctggaacgaggtaaacgccacggttgctgaagtgctttttctcggcgagagccagacatgctcggtggtctcagccggaggcactgccatgacggtcaaagcgctttctgcgaacggcatggcgctcaaggcgggcgacccggtgcgcgtgcgttgggccgcggcagacgcgtgcatctacaccgagtggaccgacagcgacctgaacaaggccgccggcacgcactga

SEQ ID NO: 66033 - protein, 384 aa, Pseudomonas syringae pv. syringae B728a
MSAVIKDPAHQPHNTLVSLCNLNKHYGNFAAVDDISLDIQDGEFLTFLGSSGSGKSTTLSMLAGFETPSSGEILVGGKSLVNVPPHKRDIGMVFQRYSLFPHLSVRDNIAFPLAIRKLPAAEREKKVDAMLKLVQLEAFAHRRPSQLSGGQQQRVAIARALVYEPRILLMDEPLGALDKKLREDLQDELRQLHRRLGITIVYVTHDQEEAMRLSQRIAIFSHGKIVGLGSGYDLYQDPPNAFVASFLGNSNFLRLKAQGNAVATFEGSTLAIRLTAGLKTDQEVLLMVRPEKAQALSVSQAAAMPLEAGWNEVNATVAEVLFLGESQTCSVVSAGGTAMTVKALSANGMALKAGDPVRVRWAAADACIYTEWTDSDLNKAAGTH

SEQ ID NO: 66034 - DNA, 1125 bp, Pseudomonas syringae pv. syringae B728a
  CDS (1)..(1125): transl_table=11
atgagcgacgtcgatacaagcgctggagcaaatgatgttctggtcagctttcgtggtgtgcagaagagctacgacggcgaagcactgatcgtcaaagacctcaacctggacattcgcaagggcgagttcctgaccctgctcggtccttccggctccggcaagaccaccagtctgatgatgctggccggtttcgagaccccgacggccggtgaaatcctcctcggtggccgcgccatcaacaacgtgccaccgcataaacgcgacatcggcatggtgttccagaactacgccttgtttccgcacatgaccgtggccgagaacctggcgttcccgttatcggtgcgtggcatgagcaagacagacgtcggcgagaaggtcaaaaaggcactgggcatggtccagctcgatacctttgcgcatcgctatccggcgcagctgtccggtggccagcagcagcgcgttgcgctggcgcgtgcgctggtcttcgaaccgcaactggtgctgatggatgagccgctcggcgccctcgacaagcagctgcgcgaacacatgcagatggagatcaagcacttgcaccagcgcctgggtgtgaccgtggtctatgtgactcacgaccagggcgaagcgctgaccatgtcggaccgggtcgcggtcttccatcagggcgagatccagcagatcgcgccgccccgcagcttgtacgaagaaccgaagaacaccttcgtcgccaacttcatcggcgagaacaaccgcctcaacggacgtctggtcagtcaggacggcgaccgctgtgtggtcgagctggagcgtggcgaaaaagtccacgcgctggcaatcaatgtcggtcagccaggtggcccggtcaccctgtcgatccgtcccgagcgcatcaacctcaatggccgcagcgagagctgcgccaaccgtttttccggtcgtgtggccgagttcatctatctgggcgaccacgttcgcgtgcgtctggaagtggcaggcaagcacgacttcttcgtcaaacagccgattgccgaactggaccccggcctgagcgtgggcgacgtggtgcccatcggctggcaagtcgagcacgtccgagcgctcgaccccttgcagcaagtgcattga

SEQ ID NO: 66035 - protein, 374 aa, Pseudomonas syringae pv. syringae B728a
MSDVDTSAGANDVLVSFRGVQKSYDGEALIVKDLNLDIRKGEFLTLLGPSGSGKTTSLMMLAGFETPTAGEILLGGRAINNVPPHKRDIGMVFQNYALFPHMTVAENLAFPLSVRGMSKTDVGEKVKKALGMVQLDTFAHRYPAQLSGGQQQRVALARALVFEPQLVLMDEPLGALDKQLREHMQMEIKHLHQRLGVTVVYVTHDQGEALTMSDRVAVFHQGEIQQIAPPRSLYEEPKNTFVANFIGENNRLNGRLVSQDGDRCVVELERGEKVHALAINVGQPGGPVTLSIRPERINLNGRSESCANRFSGRVAEFIYLGDHVRVRLEVAGKHDFFVKQPIAELDPGLSVGDVVPIGWQVEHVRALDPLQQVH

SEQ ID NO: 66036 - DNA, 1143 bp, Pseudomonas syringae pv. syringae B728a
  CDS (1)..(1143): transl_table=11
atggcagttgcctccggcgcctacaagaaagccctcgaaggcggtcagcaacccaaagaggtgctggtcaggattgatcgggtcacgaaaaagttcgacgagacgatcgcggtggacgatgtgtccctgcagatcaacaagggcgagatcttcgccctgcttggcggctctggctccggcaaatcgacactgctgcgcatgctggccgggttcgaacggccgaccgaaggccgcatctacctcgacggcgtcgacatcaccgacatgccgccgtacgaacgcccgatcaacatgatgttccagtcctacgcgctgttcccgcacatgaccgtggcggacaacatcgccttcggcctgaagcaggacaagctgggcaagccggaaatcgaagcccgcgtggcggagatgctcaagctggtgcagatgacccagtacgccaagcgcaagccgcatcagctctctggcggtcagcgtcagcgcgtggccctggctcgttcgctggcgaaaaagcccaagctgttgctgctcgacgagccgatgggtgcgctggacaagaaactgcgttcgcagatgcaactggagctggtggagatcatcgagcgcgtcggcgtgacctgcgtgatggtgactcacgatcaggaagaggccatgaccatggccgagcgcatcgcgatcatgcacctgggctggatcgcgcagatcggcagcccgatcgacatctacgagaccccgaccagccgtctggtctgcgaattcatcggcagcgtcaacctcttcgaaggtgacgtgatcgaggacatggaagcccatgcgctgatccgcagtcccgagctggagcgcaatatctatgtcggccacggcgtcagtacgtcggtggaagacaagcacattacctacgcactgcgtccggagaagctgctgatcaccaccgagcagccaggcttcgaatacaactggtcgcgtggcaaggtccacgacatcgcctatctgggcggtcattcggtgttctacgtcgagctgccgggcggcaagctggtgcagtcgttcgtcgccaacgccgagcgtcagggcgcgcggcctacctggggcgatgaagtctacgtctggtgggaagacgacagcggcgtggtactgcgctcatga

SEQ ID NO: 66037 - protein, 380 aa, Pseudomonas syringae pv. syringae B728a
MAVASGAYKKALEGGQQPKEVLVRIDRVTKKFDETIAVDDVSLQINKGEIFALLGGSGSGKSTLLRMLAGFERPTEGRIYLDGVDITDMPPYERPINMMFQSYALFPHMTVADNIAFGLKQDKLGKPEIEARVAEMLKLVQMTQYAKRKPHQLSGGQRQRVALARSLAKKPKLLLLDEPMGALDKKLRSQMQLELVEIIERVGVTCVMVTHDQEEAMTMAERIAIMHLGWIAQIGSPIDIYETPTSRLVCEFIGSVNLFEGDVIEDMEAHALIRSPELERNIYVGHGVSTSVEDKHITYALRPEKLLITTEQPGFEYNWSRGKVHDIAYLGGHSVFYVELPGGKLVQSFVANAERQGARPTWGDEVYVWWEDDSGVVLRS

SEQ ID NO: 66038 - DNA, 1152 bp, Xanthomonas campestris pv. campestris str. 8004
  CDS (1)..(1152): transl_table=11
ttgttgtcaccgagaggatgcatggccctttccgaagccgtcttgcccgcacctgccgccgccgatgcggggtatctgtcgatccgtgaggtccgcaaggagttcgacggcttcgtggcggtggacgatgtcagcctgcagatccgcaagggcgagatcttcgcgctgctgggcggctcgggcagcggcaaatccaccttgctgcgctgtcttgccggcttcgagcggcccaccaagggcagcatcgtgctcgatggccagcccatcgacgcgttaccgccgtacgagcggccgatcaacatgatgttccaatcgtatgcgctgttcccgcatatgacggtggagcagaacatcgccttcgggctcaagcaggaaggcttgcccaaggcggcggtggcccagcgggtgggcgagatgctcgagctggtgcaacttgcgcgcctggccaagcgcaagccgcatgagttgtccggtgggcagcagcagcgcgtggcgctggcgcgctcgttggccaagcggcccaagctgctgctgctggacgagccgatgggcgcgctggacaagaagctgcgttcgcagatgcagctggaactggtcaacatcattgaaacctccggcgtcacctgcgtgatggtcacccacgaccaagaagaagccatgaccatggcgacgcgcatcgcactgatggaccacggctggatccagcaggtgggcacgccggatgaaatctacgagcagccggccaaccgtttcgcggccgaattcatcggctcggtcaatctgatcgaggccgtcatcgccgaagacgcgcccgattcggtcagcctcaccaccgcggcgttcgccgcgccaattcgcatcggccacggcatcaccgggttcgaagggcaggctgtggcatttgcagtgcgcccggaaaaactcggcatcggcaagcaggagccggcgcaggcctgcaacaaggcgcagggcgtgatcgaagacattgcctatttcggcagccactcggtctaccacgtgcgcctgcccagcggcatcaagctgatggcgcatttcgccaatcggcaacgctgggccagcgaagcgctgacctggggcgatgcagtgtgggtggggtggggcgaggacgacggcgtggtcctcaccgcatga

SEQ ID NO: 66039 - protein, 383 aa, Xanthomonas campestris pv. campestris str. 8004
MLSPRGCMALSEAVLPAPAAADAGYLSIREVRKEFDGFVAVDDVSLQIRKGEIFALLGGSGSGKSTLLRCLAGFERPTKGSIVLDGQPIDALPPYERPINMMFQSYALFPHMTVEQNIAFGLKQEGLPKAAVAQRVGEMLELVQLARLAKRKPHELSGGQQQRVALARSLAKRPKLLLLDEPMGALDKKLRSQMQLELVNIIETSGVTCVMVTHDQEEAMTMATRIALMDHGWIQQVGTPDEIYEQPANRFAAEFIGSVNLIEAVIAEDAPDSVSLTTAAFAAPIRIGHGITGFEGQAVAFAVRPEKLGIGKQEPAQACNKAQGVIEDIAYFGSHSVYHVRLPSGIKLMAHFANRQRWASEALTWGDAVWVGWGEDDGVVLTA

SEQ ID NO: 66040 - DNA, 1146 bp, Haemophilus influenzae 86-028NP
  CDS (1)..(1146): transl_table=11
gtgaaattagggagaaaaccaaagctagtggaaaatcagcctcaaaacaagcctattattgagcttcgttcaatcaaaaaatcctatggttctaacaccattattaacgatttcaatcttgcaattaataacggtgagtttgtcactattcttggcccttcaggctgtggtaagaccacagttttacgcttacttgcaggcttagaagaattggattcaggtagcattattttagatggtgaagatatcaccaatgtgccagcggaaaaacgtcatattaatacggtattccaaagctatgcgctatttccacatatgacaatttttgagaacgtggctttcggtttgcgtatgcaaaaagtaccaaacgaggaaattaaaccgcgtgttttagaagccttgcgtatggtacaactagaagaaatggctgatcgtaagccaactcaactttctggcggacaacaacaacgtattgctatcgctcgtgccgtagtaaataaaccaaaagtgttgttacttgatgagtctttatctgcattggattacaaattgcgtaaacaaatgcaacaagaactcaaaatgttacaacgtcagcttggcattacctttatttttgtcacccacgatcaagaagaagcgattacaatgtctgatcgtattgtattattgcgtaaaggtaaaatcgcacaggatggttctccacgtgaaatctatgaagatccagctaacttattcgttgctcgtttcattggcgaaattaacgtatttgaagccactgtgattgaacgaaaatcagaacaagttgtactggcaaatgttgaaggtcgtatttgtgatatttatacggatatgcctgtggaaaaagatcaaaaacttcaagtactccttcgccctgaagatattgtgattgaagaattagatgaaaatgaacattctaaagcaattatcggtcatattattgaccgcacttataaaggaatgacattagaatcaacggtagagtttgatcataacggaatgcgtgtccttgtaagtgaattctttaatgaagatgatccacatatggatcatagcataggacaacgcgtaggtatcacatggcacgaaggctgggaggttgtactcaacgatgaagataatcaataa

SEQ ID NO: 66041 - protein, 381 aa, Haemophilus influenzae 86-028NP
MKLGRKPKLVENQPQNKPIIELRSIKKSYGSNTIINDFNLAINNGEFVTILGPSGCGKTTVLRLLAGLEELDSGSIILDGEDITNVPAEKRHINTVFQSYALFPHMTIFENVAFGLRMQKVPNEEIKPRVLEALRMVQLEEMADRKPTQLSGGQQQRIAIARAVVNKPKVLLLDESLSALDYKLRKQMQQELKMLQRQLGITFIFVTHDQEEAITMSDRIVLLRKGKIAQDGSPREIYEDPANLFVARFIGEINVFEATVIERKSEQVVLANVEGRICDIYTDMPVEKDQKLQVLLRPEDIVIEELDENEHSKAIIGHIIDRTYKGMTLESTVEFDHNGMRVLVSEFFNEDDPHMDHSIGQRVGITWHEGWEVVLNDEDNQ

SEQ ID NO: 66042 - DNA, 1143 bp, Pseudomonas fluorescens Pf-5
  CDS (1)..(1143): transl_table=11
atggcaaacgcctccagcacttaccgcaaggccctcgaaggcactccgagcccgcagaaggtcctggtcaagatcgaccgcgtgaccaagaagttcgatgaaaccgtggccgtggacgatgtgtccctggagatccaccaaggcgagatctttgccctgctgggcggttccggctccggcaaatccaccctgctgcgcatgctcgccggcttcgaacgccccaccgaaggccgcatcctgctggatggcgtggacatcaccgacatgccgccctacgagcggccgatcaacatgatgttccagtcctacgccctgttcccccacatgaccgtggcccagaacattgccttcggcctcaagcaggaccgcctgccggccagcgagatcgacgcccgggtcgaggaaatgctcaagctggtgcacatgacccagtacgccaagcgcaagccgcaccagctctccggtggccagcgccagcgcgtggccctggcccgctccctggccaagcgccccaagctgctcttgctggacgaacccatgggcgccctggacaagaagctgcgctcgcagatgcaactggaactggtggagatcatcgagcgcgtgggcgtgacctgcgtgatggtgacccacgaccaggaagaggccatgaccatggcccagcgcatcgccatcatgcacctgggctggatcgcccagaccggcagcccggtggacatctacgaagcgccggtgagccgcctggtgtgcgaattcatcggcaacgtcaacgccttcgacggcaccgttaccgaagacctggaaggctacgccatcatcgactgcgcggacctcgagcagcagatctacgtcggccacggggtcagcacctcggtgcaggacaagtcggtgacctacgccatccgcccggaaaagatgctggtcaccaccctcaagcccgacgcccgctacaactggtccaagggcaaggtgcatgacatcgcctacctgggcggtcactcggtgttctacgtcgagctgcctggcggcaagatcgtccagtcgttcatggccaacgccgagcgccgtggctcgcggccgacctgggatgacgaagtctacgtctggtgggaagacgacagcggcgtggtactgcgagcatga

SEQ ID NO: 66043 - protein, 380 aa, Pseudomonas fluorescens Pf-5
MANASSTYRKALEGTPSPQKVLVKIDRVTKKFDETVAVDDVSLEIHQGEIFALLGGSGSGKSTLLRMLAGFERPTEGRILLDGVDITDMPPYERPINMMFQSYALFPHMTVAQNIAFGLKQDRLPASEIDARVEEMLKLVHMTQYAKRKPHQLSGGQRQRVALARSLAKRPKLLLLDEPMGALDKKLRSQMQLELVEIIERVGVTCVMVTHDQEEAMTMAQRIAIMHLGWIAQTGSPVDIYEAPVSRLVCEFIGNVNAFDGTVTEDLEGYAIIDCADLEQQIYVGHGVSTSVQDKSVTYAIRPEKMLVTTLKPDARYNWSKGKVHDIAYLGGHSVFYVELPGGKIVQSFMANAERRGSRPTWDDEVYVWWEDDSGVVLRA

SEQ ID NO: 66044 - DNA, 1119 bp, Pseudomonas fluorescens Pf-5
  CDS (1)..(1119): transl_table=11
atgaatgccctgcatgcgctgcaaacgctggcggtgtccatccgttcagtgcgcaaggtctacggcgatccacacagcggcccggtggccctgaagaacatcgacctggatatccgcgacaacgaattcttcacccttctcggcccctcgggctgtggcaagaccaccctcttgcggatgatcgccgggttcgagttcccgacccagggcgagatccttctctatggcgagaacatcgccgaccggccgcccttcgagcgcccggtgaacacggtgttccagcattacgcactgttcccccacatgaccctggccgagaacctggccttcggcctggaatcgcgccctatgggccaggtattgagcaaggcgcagatcgacgagcgggtgcgcgagatgctggccctggtgcagatggaacgctttgcggcgcgcaagcccaaccagctgtccggcggccagcagcaacgcatcgccctggcccgagccctggctccccaccccaaggtactgctgctggacgagccgctgtcggccctggacctcaagctgcgccaggccatgcgcgaagaactcaaggccatccaggccaagaccggtatcaccttcatcttcgtcacccacgaccaggaagaagccctgaccctgtccgaccgcatcgctgtgctctccgaaggtgaagtgcaacaggtgggtcgcccggaagaaatctacgagcagccgcgcaatcgcttcgtcgccgacttcatcggtgaaaccaacttcatcccggccatggtcagccgtgtcgaagcgggcctggcctggttcagcgggcccgccgggcaggcgctgccggcgcaaccctgcaccaccgccaaggtcggccagcaggtcaccctgtcggtgcgccccgagcgcttgcacctgcgcggtgatgcctcgcaaggcgccctggcgtgccgcatcgaagcgctgatctacctgggcaccgacctgcaataccaggtcagcctcggcgacggcacgcgcctcaccgtgcgcacgcccaacagcctcgaacaccacccgcgtctgagcgtaggcagcagcgccgggctgctgttcgaacgcggcagcgccagcgtcctgctggattga

SEQ ID NO: 66045 - protein, 372 aa, Pseudomonas fluorescens Pf-5
MNALHALQTLAVSIRSVRKVYGDPHSGPVALKNIDLDIRDNEFFTLLGPSGCGKTTLLRMIAGFEFPTQGEILLYGENIADRPPFERPVNTVFQHYALFPHMTLAENLAFGLESRPMGQVLSKAQIDERVREMLALVQMERFAARKPNQLSGGQQQRIALARALAPHPKVLLLDEPLSALDLKLRQAMREELKAIQAKTGITFIFVTHDQEEALTLSDRIAVLSEGEVQQVGRPEEIYEQPRNRFVADFIGETNFIPAMVSRVEAGLAWFSGPAGQALPAQPCTTAKVGQQVTLSVRPERLHLRGDASQGALACRIEALIYLGTDLQYQVSLGDGTRLTVRTPNSLEHHPRLSVGSSAGLLFERGSASVLLD

SEQ ID NO: 66046 - DNA, 1125 bp, Pseudomonas fluorescens Pf-5
  CDS (1)..(1125): transl_table=11
atgagcgaggtcgtttcaagtgctggggccaacgatgttctggtcagctttcgtggtgtgcagaagagctacgacggcgagaacctgatcgtcaaagacctcaacctggaaattcgcaaaggcgagttcctcaccctgctggggccgtccggttccggcaagaccaccagcctgatgatgctggccggtttcgaaaccccgaccgccggcgagatccagctggccgggcgttcgatcaacaatgtgccgccgcacaagcgcgacatcggcatggtgttccagaactacgcgctgttcccccacatgaccgtggccgagaacctggcctttccgctgtcggtgcgcggcctcggcaagaccgacatcagcgagcgggtcaagcgcgtgctgagcatggtccagctcgacgctttcgcccagcgctacccggcccagctgtccggcggccagcagcagcgggtggccctggcccgggccctggtgttcgagccacagctggtgctgatggacgaaccccttggtgccctcgacaagcaactgcgcgaacacatgcagatggagatcaagcacctgcaccagcgcctgggcgtgaccgtggtctatgtgacccacgaccagggcgaagccctgaccatgtccgaccgggtggcggtgttccaccagggcgagatccagcagatcgcgccgccgcgcactctctacgaagaaccgaagaacaccttcgtcgccaacttcatcggcgagaacaaccgcctcaacggccgcctgcacagccacaacggcgagcgttgcgtggtggagctggggcgtggcgagaaggtcgaggcgctggcggtgaatgtcggccaggtcggcggcccggtgaccttgtccatccgcccggagcgggtgagcctcaacggttccagcgaaagctgcgtcaaccgcttctccggccgggtggcggaattcatctatctgggcgaccacgtccgggtgcgcctggaagtctgcggcaagagcgacttcttcgtgaaacagccgattgccgagctcgatcctgcgctggcagtgggtgacgtggtgccgcttggctggcaagtcgagcacgttcgcgcgctcgacccgcttctagaggcgaattga

SEQ ID NO: 66047 - protein, 374 aa, Pseudomonas fluorescens Pf-5
MSEVVSSAGANDVLVSFRGVQKSYDGENLIVKDLNLEIRKGEFLTLLGPSGSGKTTSLMMLAGFETPTAGEIQLAGRSINNVPPHKRDIGMVFQNYALFPHMTVAENLAFPLSVRGLGKTDISERVKRVLSMVQLDAFAQRYPAQLSGGQQQRVALARALVFEPQLVLMDEPLGALDKQLREHMQMEIKHLHQRLGVTVVYVTHDQGEALTMSDRVAVFHQGEIQQIAPPRTLYEEPKNTFVANFIGENNRLNGRLHSHNGERCVVELGRGEKVEALAVNVGQVGGPVTLSIRPERVSLNGSSESCVNRFSGRVAEFIYLGDHVRVRLEVCGKSDFFVKQPIAELDPALAVGDVVPLGWQVEHVRALDPLLEAN

SEQ ID NO: 66048 - DNA, 1143 bp, Pseudomonas fluorescens Pf-5
  CDS (1)..(1143): transl_table=11
atggcagttgcctccggcgcctataagaaagccctcgagggcgaccagacacctaagcaggtgctggtcaaaatcgaccgggtcacgaagaagttcgacgagacggttgccgtggacgatgtgtccctggaaatcaagaagggcgagattttcgccctgctcggcggttcgggttcaggcaagtccaccttgctgcggatgctggccggtttcgaacggccaacggaggggcgaatcttcctcgatggtgtagacatcaccgacatgccgccctacgagcggccgatcaacatgatgttccagtcctacgccctgttcccccacatgaccgtggcgcaaaacatcgccttcggtctcaagcaggacaagatccccagcgcggaaatcgacgcccgggtggcggagatgctcaagctggtgcagatgagccagtacgccaagcgcaagccgcaccagctctccggcggccagcgccagcgcgtggccctggcccgttccctggccaagcgtcccaagctgctcttgctggacgagcccatgggcgccctggacaagaagctgcgctcgcagatgcagttggagctggtggagatcatcgagcgcgtgggcgtgacctgcgtaatggtgacccacgaccaggaagaggccatgaccatggccgaacgcatcgccatcatgcacctgggctggatcgcccagatcggcagcccgatcgacatctacgagaccccggtcagccgcctggtctgcgaattcatcggcaacgtcaacatcttcgagggtgaagtggtggacgatgccgagggccacgccctgatcacctgcaaggacctggaccgcagcatctatgtcggccacggcatcagcacttcggtgcaggacaaatcggtgacctacgcgatccgcccggaaaagctcctggtgactgccgagatgccgacctgcgagtacaactggtccagcggcaaggtccacgacattgcctacctgggcggccactcggtgttctacgtcgagctgccgagcggcaaactggtgcaatccttcgtcgccaacgccgagcgccgtggtgcgcggccgacctggggtgaccaggtctacgtctggtgggaagacgacagcggcgtggtactgcgctcatga

SEQ ID NO: 66049 - protein, 380 aa, Pseudomonas fluorescens Pf-5
MAVASGAYKKALEGDQTPKQVLVKIDRVTKKFDETVAVDDVSLEIKKGEIFALLGGSGSGKSTLLRMLAGFERPTEGRIFLDGVDITDMPPYERPINMMFQSYALFPHMTVAQNIAFGLKQDKIPSAEIDARVAEMLKLVQMSQYAKRKPHQLSGGQRQRVALARSLAKRPKLLLLDEPMGALDKKLRSQMQLELVEIIERVGVTCVMVTHDQEEAMTMAERIAIMHLGWIAQIGSPIDIYETPVSRLVCEFIGNVNIFEGEVVDDAEGHALITCKDLDRSIYVGHGISTSVQDKSVTYAIRPEKLLVTAEMPTCEYNWSSGKVHDIAYLGGHSVFYVELPSGKLVQSFVANAERRGARPTWGDQVYVWWEDDSGVVLRS

SEQ ID NO: 66050 - DNA, 1089 bp, Candidatus Pelagibacter ubique HTCC1062
  CDS (1)..(1089): transl_table=11
atgactaaaaacaaagaatttgtaaaatttgacaatgtagacaagagctatgatggcaaagtattggtcgttaaaggattaaatctagacattgaagaaggtgaatttgtaactatgctaggaccctctggttctggtaaaacaacttgtcttatgatgctggctggttttgaaacaccaactcatggagaaatttatttagatggtaaggttatttcaaatattccacctcacaaaagaggaataggaatggtattccagaactatgctttatttccacacatgactgtttatgaaaatttagcttttccattaagagttagaaaaattccaaaagatgaagctgataaaaaaatagataaagctttatccatggtttcacttcatggttttgaagcaagaatgccgatgcaattatcaggtggacaacaacagcgtgttgctgttgcaagatcattagtttttgatccacaagtggtattaatggatgaaccacttggagcattagataaaaatttaagagaaagcatgcaatatgaaattaaacatattcacgaaagtattggtgtaacagttgtgtatgttacacacgatcaaacggaagcattaacaatgtcaaaccgtattgcagttttcaatgatggtaaagttcagcaactatcaagtcctgatgaattgtatgaaaaaccagttaattcgtttgttgctgagttcattggagaaaataataaattttcaggtcaagttttagatatttcaggagataaatgtaaagttaaattagaaaatggcacagaaattttagcaaatccagttgctgttaaagcaaaaggggataagactaaagtttcactaagacccgaaagagcaattatagatccttcagataagatggataataatcataaaggaaaaatagaagaaataatttatcacggcgatcacacaagacttagagttgacttactaggtaataaagattttatccttaaagtaccaaatagtactgcaagattagaccttaaaaagggtaatgtactagatataggctggaatagtattgactgtagagccttagatccaaaataa

SEQ ID NO: 66051 - protein, 362 aa, Candidatus Pelagibacter ubique HTCC1062
MTKNKEFVKFDNVDKSYDGKVLVVKGLNLDIEEGEFVTMLGPSGSGKTTCLMMLAGFETPTHGEIYLDGKVISNIPPHKRGIGMVFQNYALFPHMTVYENLAFPLRVRKIPKDEADKKIDKALSMVSLHGFEARMPMQLSGGQQQRVAVARSLVFDPQVVLMDEPLGALDKNLRESMQYEIKHIHESIGVTVVYVTHDQTEALTMSNRIAVFNDGKVQQLSSPDELYEKPVNSFVAEFIGENNKFSGQVLDISGDKCKVKLENGTEILANPVAVKAKGDKTKVSLRPERAIIDPSDKMDNNHKGKIEEIIYHGDHTRLRVDLLGNKDFILKVPNSTARLDLKKGNVLDIGWNSIDCRALDPK

SEQ ID NO: 66052 - DNA, 1071 bp, Colwellia psychrerythraea 34H
  CDS (1)..(1071): transl_table=11
atgagtcacgctataagtataaaaaatgtcagtaaattttacggcgattaccgcgcgataaaagatatctcttttgacatacaagacaatgaatttttcaccttactcggccctagtggttgtggtaaaacaaccttattgagaatgattgctggttttgagataccaagtggcggggtaattaaactgcacggcacagatattcaatcgctgccggcccatcaacgtcgtgttaatacggtgttccaaaattacgcactatttccacatatgactttagcgcaaaatattggcttcggtttgcagatgcttaaatggagtaaagaaaagatcgcagctcgggtagatgaaatgcttgagttagttcacatgcggtcatttgcatcacgtatgccttcggcactttcgggaggacaacaacagcgaatcgcattggctcgtgcgcttgcacctaagccagaagtactacttttagatgaacccttatcagctctggatttaaagttacgccaatcaatgcgcgatgagttacagcaactacagcgcgatacagggattacctttattttcgtcacccacgatcaggaagaagcgttggcgatgtcggacagaatctgtgtgttagctgaaggcactgttcagcaaataagcagtcctaatgagatttacgaaaatccgaataataagtttgttgcagattttattggcgaaaccaattttatgcctgtcactattaacagtcatgacaaagcaacggtatcagttacaaaccctctcggcattgagttgaatgtgcctaataagggctttagtcaaggacaagaagctacgatgtccttgcgtcctgaaaagatttcaatcaacacccctggattagaggtgaatttacaaggcaagatagtacaccgaacctatatgggtggttatacccactataaggtacgcactgagaatgccacagaattacgaatttctaaacgtaatactattagtaacgatactgaatataaccttgatcaacaagtagccattggctttagcaaagcgtctgtaagggtgttaagccaatga

SEQ ID NO: 66053 - protein, 356 aa, Colwellia psychrerythraea 34H
MSHAISIKNVSKFYGDYRAIKDISFDIQDNEFFTLLGPSGCGKTTLLRMIAGFEIPSGGVIKLHGTDIQSLPAHQRRVNTVFQNYALFPHMTLAQNIGFGLQMLKWSKEKIAARVDEMLELVHMRSFASRMPSALSGGQQQRIALARALAPKPEVLLLDEPLSALDLKLRQSMRDELQQLQRDTGITFIFVTHDQEEALAMSDRICVLAEGTVQQISSPNEIYENPNNKFVADFIGETNFMPVTINSHDKATVSVTNPLGIELNVPNKGFSQGQEATMSLRPEKISINTPGLEVNLQGKIVHRTYMGGYTHYKVRTENATELRISKRNTISNDTEYNLDQQVAIGFSKASVRVLSQ

SEQ ID NO: 66054 - DNA, 1131 bp, Colwellia psychrerythraea 34H
  CDS (1)..(1131): transl_table=11
atgactcaagaaacaactatgcctctttggaaacaagatggcgctaaaccttttattcaaataaaaaacgtgactaaaaaattcggtgaatttaccgccgtagataatgtttcgttagatatttatgaaaatgaattattttgtttattaggaggttcgggatcaggaaaaagcaccctgttaaggatattagccggttttgaggacctcacctctggtcaggtactcatcgatggcgttgatatggctaatattgagccatggaatcgaccgataaatatgatgtttcagtcatacgcattatttcctcatatgaccgtggctaagaatattgcttttggtttaaagcgagataacgtgccgaaaaaagaaattgcagaacgtgttactgaaatgcttaccatgatgcaaatagaagcatttgcagatagaaaacccgatcaattatcaggcggtcagcgccaacgtgttgcgttagcaagatcattgatcaaacgccctaaattactattacttgatgagcctttaggtgcactggataaaaagcttagagaagaaactcaatttgaattagttaatattcaagataagttaggagttacctttgttgtggtgactcatgaccaagaagaagccatgacactagcgacccgcattggcgttatgggtaatggtattattacccaagttgatgaacctcgcgatgtttatgaatatccaagcagccgttttgttgcagaatttgttggctctattaatttatttgagggtcgtatttatgaagatgaagttgagcatgtaaaaataaagtcaaaagaagctggttgtaacttttttgtcaatcatggcattagctgtgcccctaatcaaaaagtgacagttgctgttcgtcctgaaaaaatgaaagtcacccgtagaaaaccagatcaggaatataactgcttacacgggcaaatcatcgacattgcctatatgggtaacctgtcaatttttagggtcaagttagagagtggcgtcattgttcgtgtcaccttacctaatcttgtcagagaaaaccgcaatccattaacatgggatgattttgtttaccttgcatgggatgacgacagcagcgtggtattaacatcatga

SEQ ID NO: 66055 - protein, 376 aa, Colwellia psychrerythraea 34H
MTQETTMPLWKQDGAKPFIQIKNVTKKFGEFTAVDNVSLDIYENELFCLLGGSGSGKSTLLRILAGFEDLTSGQVLIDGVDMANIEPWNRPINMMFQSYALFPHMTVAKNIAFGLKRDNVPKKEIAERVTEMLTMMQIEAFADRKPDQLSGGQRQRVALARSLIKRPKLLLLDEPLGALDKKLREETQFELVNIQDKLGVTFVVVTHDQEEAMTLATRIGVMGNGIITQVDEPRDVYEYPSSRFVAEFVGSINLFEGRIYEDEVEHVKIKSKEAGCNFFVNHGISCAPNQKVTVAVRPEKMKVTRRKPDQEYNCLHGQIIDIAYMGNLSIFRVKLESGVIVRVTLPNLVRENRNPLTWDDFVYLAWDDDSSVVLTS

SEQ ID NO: 66056 - DNA, 1125 bp, Pseudomonas syringae pv. phaseolicola 1448A
  CDS (1)..(1125): transl_table=11
atgagcgacgtcgatacaagcgctggagcaaatgatgttctggtcagctttcgtggtgtgcagaagagctacgacggcgaagcactgatcgtcaaagaccttaacctggatattcgcaagggtgagttcctgacgctgctcggtccgtccggctcgggcaagaccacaagcctgatgatgctggccggtttcgagaccccgacggctggtgaaatcctcctcggcgggcgcgccatcaacaacgtgccgccgcacaagcgcgacatcggcatggtgttccagaactacgcattgtttccacacatgacggtggccgagaacctggcgttcccgttgtcagtgcgtggcatgagcaagaccgatgttggcgagaaagttaaaaaggcgctgggcatggtccagctggacacctttgcacatcgttacccgacgcagttgtccggtggccagcagcagcgcgtggcgctggcgcgtgcgctggtgttcgaaccgcaactggtgctgatggacgaaccgctcggcgcgctcgacaaacagctgcgtgagcacatgcagatggagatcaagcacctgcatcagcgtctgggtgtgaccgtggtctacgtgacccacgaccagggcgaagccctgaccatgtccgaccgggtcgccgtcttccatcagggcaagatccagcagatcgcaccgccccgcagcctgtacgaagagccgaagaacacctttgtggccaatttcattggcgaaaacaaccggctgaacggacttctggtcagtcaggatggcgaccactgtgtcgtcgagcttgagcgcggcgaaaaagtacatgcgctggcgatcaacgtcggccagcctggcggcccggtgaccctgtcgatccgccctgagcgcatcaacctcaatggtcgcagcgagaattgtgcaaaccgtttttccggccgcgtggccgagttcatctacctgggcgaccacgttcgcgtgcgtctggaggtagccggcaagaacgacttcttcgtcaaacagccgattgctgaactggacccgacgctcagcgtgggcgatgtcgtgccgatcggctggcaagtcgagcacgtccgcgcgctcgaccccttgcagcaagtgcattga

SEQ ID NO: 66057 - protein, 374 aa, Pseudomonas syringae pv. phaseolicola 1448A
MSDVDTSAGANDVLVSFRGVQKSYDGEALIVKDLNLDIRKGEFLTLLGPSGSGKTTSLMMLAGFETPTAGEILLGGRAINNVPPHKRDIGMVFQNYALFPHMTVAENLAFPLSVRGMSKTDVGEKVKKALGMVQLDTFAHRYPTQLSGGQQQRVALARALVFEPQLVLMDEPLGALDKQLREHMQMEIKHLHQRLGVTVVYVTHDQGEALTMSDRVAVFHQGKIQQIAPPRSLYEEPKNTFVANFIGENNRLNGLLVSQDGDHCVVELERGEKVHALAINVGQPGGPVTLSIRPERINLNGRSENCANRFSGRVAEFIYLGDHVRVRLEVAGKNDFFVKQPIAELDPTLSVGDVVPIGWQVEHVRALDPLQQVH

SEQ ID NO: 66058 - DNA, 990 bp, Pseudomonas syringae pv. phaseolicola 1448A
  CDS (1)..(990): transl_table=11
atgagttttgtcagcattgaaaacctgcagaaaagctatgccagcacgtcagtgttcagcgacatcaactgcagtatcacgaaaggcgagtttgtcaccttgctcggcccgtccggctgtggcaagtccacgttattgcgctgcattgccgggctgacaccggtcaatagcgggcgcatcctgcttgatggcactgacctggtgccgctcactccacaaaaacgcaacatcggcatggtgttccagagctacgcgctgtttcccaacatgaccgtcgagcaaaacgtcgcgttcggcctgcggattcagaaagtcagtgcggccgacagcgaaaagcgcgttgccgatattctgcgcatggtcgagctgcacgactttgccacgcgttacccgcatcagttgtccggcgggcaatgccagcgcgtggctctggcgcgctcgctggtcactcgcccacgcctgctgttgcttgatgagccgctgtcggcactggatgcgcgaattcgcaaaaacctgcgtgagcagatccgcgccattcagcgcgagctgggccttaccacgatcttcgtgacccacgatcaggaggaggcgctgaccatgtccgaccgcatcttcctgatgaacgaaggccggatcgtgcagagtggtgacgcagaaaccctttacaccgctccggttgacgtgttcgctgcgggcttcatcggcaactacaacctgctggaagccgaagatgccacacgcctgatgcaacgcccgatcaccagccgcattgcgattcgccctgaatcgatccaattgagcctgaccggcgaactggaaggcgaagtacgcagtcacagtctgctcggcaacgtcatccgctaccggatacaggcccgcggcgtggaactggtggtcgacgtactgaaccgcagcgccgacgacctgcacccggatggaaggcgtgtaacactgaacatcgaaccgtcggcgctctgtgctctgaactaa

SEQ ID NO: 66059 - protein, 329 aa, Pseudomonas syringae pv. phaseolicola 1448A
MSFVSIENLQKSYASTSVFSDINCSITKGEFVTLLGPSGCGKSTLLRCIAGLTPVNSGRILLDGTDLVPLTPQKRNIGMVFQSYALFPNMTVEQNVAFGLRIQKVSAADSEKRVADILRMVELHDFATRYPHQLSGGQCQRVALARSLVTRPRLLLLDEPLSALDARIRKNLREQIRAIQRELGLTTIFVTHDQEEALTMSDRIFLMNEGRIVQSGDAETLYTAPVDVFAAGFIGNYNLLEAEDATRLMQRPITSRIAIRPESIQLSLTGELEGEVRSHSLLGNVIRYRIQARGVELVVDVLNRSADDLHPDGRRVTLNIEPSALCALN

SEQ ID NO: 66060 - DNA, 1155 bp, Pseudomonas syringae pv. phaseolicola 1448A
  CDS (1)..(1155): transl_table=11
atgagtgccgtgatcaaagaccccgcccatcaggatcagaaaacgctggtcagcctgtgcaacctgaacaagcactacggtgatttcgccgctgtcgacaacatttccctggatattcaggacggcgaattcctgacctttctcggttccagtggctcgggcaaaagcaccacgctgtcaatgctcgccggtttcgagacgcccagttcgggcgagattctggtcagtggcaaatcgctggtcaatgtgccgccgcacaagcgcgacatcggcatggtgtttcagcgctactcgctgttcccgcacctgtcggtacgcgacaacattgctttcccgctggcgatccgcaagttgcctgcggctgagcgcgaaaagaaagtcgatgcgatgctcaagctcgtccagctggaagagtttgctcaccgccgcccttcgcaactgtccggtggccagcagcaacgagtcgccattgccagggcgctggtctacgagccacgcatcctgctgatggacgagccgctgggcgcactggacaagaagctgcgtgaagacctgcaggacgaactgcgtcagttgcatcgtcggctgggcatcaccatcgtctatgtgacccacgatcaggaggaagccatgcgcctgtcccagcgcatcgcgattttcagccacggcaaaatcgtcggtctgggctcgggttatgacctgtatcaggacccgccaaatgccttcgttgcgtcgtttctcggcaactcgaacttcctcaggctcaaagcacagggcaacgccgtagctacgtttgaaggccttgcgctggcgattcgcctgaccccgggcctgaagaccgatcaggacgttctgctgatggttcgcccggagaaagcccagacgctgagcgttgaacaggctgctggcacaccactggaagcaggctggaacgaagtgagtgccatggtcaatgaggtgctttttctcggcgagagccagacctgctcggtggtcaccacaggcggcactgccatgactgtcaaagcgctttcagcgaccggcatgctgctcagggctggcgacccggtgcgggtacgctgggccgctgccgacgcgtgtatctacactgaatggacggacagcgacctgaacaaggcagcgggagcgcactga

SEQ ID NO: 66061 - protein, 384 aa, Pseudomonas syringae pv. phaseolicola 1448A
MSAVIKDPAHQDQKTLVSLCNLNKHYGDFAAVDNISLDIQDGEFLTFLGSSGSGKSTTLSMLAGFETPSSGEILVSGKSLVNVPPHKRDIGMVFQRYSLFPHLSVRDNIAFPLAIRKLPAAEREKKVDAMLKLVQLEEFAHRRPSQLSGGQQQRVAIARALVYEPRILLMDEPLGALDKKLREDLQDELRQLHRRLGITIVYVTHDQEEAMRLSQRIAIFSHGKIVGLGSGYDLYQDPPNAFVASFLGNSNFLRLKAQGNAVATFEGLALAIRLTPGLKTDQDVLLMVRPEKAQTLSVEQAAGTPLEAGWNEVSAMVNEVLFLGESQTCSVVTTGGTAMTVKALSATGMLLRAGDPVRVRWAAADACIYTEWTDSDLNKAAGAH

SEQ ID NO: 66062 - DNA, 1029 bp, Pseudomonas syringae pv. phaseolicola 1448A
  CDS (1)..(1029): transl_table=11
atggcatttctgcagctcgaaggtctctccaaacgctacggttccatagacgctgtggtcgccacgaacctggccgtcgacaagggcgaattcgtttcactgctcggcccttccggctgcggcaagaccaccactctgcaaatgatcgccggcttcgttgaagtcagtgacggacgcattgtgctcgacgggcgcgacatcactcacgccaaacccagcagccggggcctcggcgtagtgttccaaagctatgcgctgtttccgcacatgactgtggctgacaacgttgcgtttggcctgcgtatgcgcaaggtgcctgccgccgagttgcacccgcgtgtcaaacgggtgctggagctggtgcgcctcggtcagcatgccgagcgctatccgcgcgagttgtccggtgggcagcgccagcgggtcgcattggcccgcgcactggtcatcgagccgccagtactgctgctcgacgagccgctgtccaacctggatgccaacctgcgcgaagagatgcagttcgaaatccgccgcattcagaacgaagtcggcattaccatgctgatggtcacccatgatcaggccgaagccctgtcgatcagcgatcgggtggtggtgatgcaggccggtcgtatcacccagatcgacgagccttacaagctctacgaacacccgcgtacacgcttcatctcgggtttcgtcggcaaggccaacatgttgcagggagatctggacagcagcggcatcccgcagattcgtcaggtgcccggcgatggcagcctgaccctcagcctgcgtcccgagaagatcgatcttgtagcacctggctgcggacgactgtccgggcgcatcgtcacccgttactttcttggcagccagtggctgtatcgcatccagaccagaattggcgaagtgacggttgtacgccgtaacgatggccaagcgccgctggaacaaggcgcagcggtcgacatggactggcccaccgagttgctgcgcgtgctggatgccgacgaggtgcgcgcatga

SEQ ID NO: 66063 - protein, 342 aa, Pseudomonas syringae pv. phaseolicola 1448A
MAFLQLEGLSKRYGSIDAVVATNLAVDKGEFVSLLGPSGCGKTTTLQMIAGFVEVSDGRIVLDGRDITHAKPSSRGLGVVFQSYALFPHMTVADNVAFGLRMRKVPAAELHPRVKRVLELVRLGQHAERYPRELSGGQRQRVALARALVIEPPVLLLDEPLSNLDANLREEMQFEIRRIQNEVGITMLMVTHDQAEALSISDRVVVMQAGRITQIDEPYKLYEHPRTRFISGFVGKANMLQGDLDSSGIPQIRQVPGDGSLTLSLRPEKIDLVAPGCGRLSGRIVTRYFLGSQWLYRIQTRIGEVTVVRRNDGQAPLEQGAAVDMDWPTELLRVLDADEVRA

SEQ ID NO: 66064 - DNA, 1143 bp, Pseudomonas syringae pv. phaseolicola 1448A
  CDS (1)..(1143): transl_table=11
atggcagttgcctccggcgcctacaagaaagccatcgaaggcggtcagcaacccaaagaggtgctggtcaggatcgatcgggtcacgaagaagttcgacgagacgattgcggtggacgacgtgtcgctgcaaatcaacaagggtgagatctttgccctgcttggcggctccggttccggaaagtccacactgctgcgcatgctggccgggttcgaacggccaaccgaaggccgtatctacctcgacggtgtcgacatcaccgacatgccgccgtacgaacgcccgatcaacatgatgttccagtcctacgcgctgttcccgcacatgaccgtggcggacaacatcgcctttggcctgaaacaggacaagctggccaagccggaaatcgaagcccgcgtggcggagatgctcaagctggtgcagatgacccagtacgccaagcgcaagccgcaccagctctcgggcggccagcgtcaacgtgtggccctggcccgctcgctggccaaaaagcccaagctgctgttgcttgatgagccaatgggtgcgctggacaagaaactgcgttcgcagatgcagctggaactggtggagatcatcgagcgcgtcggcgtgacctgcgtaatggtgactcacgatcaggaagaggccatgaccatggccgagcgcatcgcaatcatgcacctgggctggatcgcgcagatcggcagcccgatcgatatctacgaaaccccgaccagccgtctggtctgcgaattcatcggcagcgtcaacctgttcgaaggtgacgtgatcgaagacatggaagcccacgcgctgatccgcagtcccgagctggagcgcaatatctatgtcggccacggcgtcagtacgtcggtggaagacaagcacatcacctacgccctgcgccctgagaaactgctgatcaccaccgagcagccaggcttcgaatacaactggtcacgcggcaaggtccacgacatcgcctatctgggcggtcattcggtgttctacgtcgagctgccgggcggcaagctggtgcaatcgttcgtcgccaacgccgagcgtcagggcgcacggcctacctggggcgatgaagtctacgtgtggtgggaagacgacagcggcgtggtactgcgctcatga

SEQ ID NO: 66065 - protein, 380 aa, Pseudomonas syringae pv. phaseolicola 1448A
MAVASGAYKKAIEGGQQPKEVLVRIDRVTKKFDETIAVDDVSLQINKGEIFALLGGSGSGKSTLLRMLAGFERPTEGRIYLDGVDITDMPPYERPINMMFQSYALFPHMTVADNIAFGLKQDKLAKPEIEARVAEMLKLVQMTQYAKRKPHQLSGGQRQRVALARSLAKKPKLLLLDEPMGALDKKLRSQMQLELVEIIERVGVTCVMVTHDQEEAMTMAERIAIMHLGWIAQIGSPIDIYETPTSRLVCEFIGSVNLFEGDVIEDMEAHALIRSPELERNIYVGHGVSTSVEDKHITYALRPEKLLITTEQPGFEYNWSRGKVHDIAYLGGHSVFYVELPGGKLVQSFVANAERQGARPTWGDEVYVWWEDDSGVVLRS

SEQ ID NO: 66066 - DNA, 1155 bp, Thermobifida fusca YX
  CDS (1)..(1155): transl_table=11
atggcgaccacgacggaaaaaacaccggccgcgcctggcgtagtagcgacagagagcaaccaggcagtccccgccatcagtctggaaaaagtcagcaagacctaccgatccgggcaggtcaccaccaccgcggtcgaatccatcgacttggagatccgtcaaggggagttcttctccctgctcgggccttccggttgcggcaagaccaccaccatgcggatgatcgccggcttcgaggagcccacttcaggagtcgtgcgcctgtccggtaaagacgtcaccggggttcccccgaaccgccgcgacgtcaacatggtcttccaaagctacgccctgttcccgcacatgaccgtcgcggagaacgtggccttcggactgaaacgcaagaaagtccccgcggccgagatccgcactcgggtcgctgaaatgctcgaactcgtcgagttgggggaccgggccaagtacaagcccaggcagctttctgggggtcagcagcagcgtgtcgcactggcccgcgccctcgtcaaccggccgagcgcactcctgctcgacgaacctctcggtgctcttgacctgaaactgcgccaggccatgcagttggagctcaaacgcatccaacgcgaggtcggcatcaccttcgtctacgtcactcacgaccagagtgaagcgttgaccatgtccgaccgcatcgccgtcatgaacaagggccggatcgaacagctcggcacgccagcgcagatctacgagacccccgcgacccggttcgtggccgggttcatcggcacctccaacatcctcaccgggaccgcgcagcgggtctctgacactctcgtccgcattgactacggcggcgaccagcacgtcctcgcgaacaccccgcaacaaatgtcggatttggggctcgtaattaccgttcgtcctgaaaagatccgacttgggaaagatgtgccggatgccaatgtaagccgcattcgcggtacggtgcgtgaggttgtctatttgggagcaacgacgcactacactgtgcgaacggttgacgacaccgacatcgtggtgtttcaacagaactcctccgacgccagcaacctcgcagatcacggagacaccgtgtggctgtcctggcgtcccgagcactcttacgtgcttccaggctga

SEQ ID NO: 66067 - protein, 384 aa, Thermobifida fusca YX
MATTTEKTPAAPGVVATESNQAVPAISLEKVSKTYRSGQVTTTAVESIDLEIRQGEFFSLLGPSGCGKTTTMRMIAGFEEPTSGVVRLSGKDVTGVPPNRRDVNMVFQSYALFPHMTVAENVAFGLKRKKVPAAEIRTRVAEMLELVELGDRAKYKPRQLSGGQQQRVALARALVNRPSALLLDEPLGALDLKLRQAMQLELKRIQREVGITFVYVTHDQSEALTMSDRIAVMNKGRIEQLGTPAQIYETPATRFVAGFIGTSNILTGTAQRVSDTLVRIDYGGDQHVLANTPQQMSDLGLVITVRPEKIRLGKDVPDANVSRIRGTVREVVYLGATTHYTVRTVDDTDIVVFQQNSSDASNLADHGDTVWLSWRPEHSYVLPG

SEQ ID NO: 66068 - DNA, 1149 bp, Nitrobacter winogradskyi Nb-255
  CDS (1)..(1149): transl_table=11
atgacggacgaggcgagacttggttccgaagcgacggcacaggccgacaagccattgttgcaggtcgatgcggccgtcaagcgctttggcggatttaccgcggtggatcatctgtcgctcgacatcaggacgggggagttctttgcgctgctggggccgagcggctgcggcaagaccacgctgctccggatgctgggagggttcgagacgcctgatggcgggcgcatccttctcgacggtcaggacatatccggcgttccgccgcatcggcgaccggtcaacatgatgttccagaactacgcgctgtttccgcatctgtcggtgcgggacaacatcgcgttcgggctgaggcgggcgggcatgccgcgcgccgacatcgaagcgcgggtcgcggagatggtggcgctggtgagtctggagggcatggagaagcgcaagccggagcaactatcgggcggccagaggcagcgcgtggcgctggcgcgcgcgctcgcccggcgtccgcggctgttgctgctcgatgaaccgatggccgcgctcgacaagaagctgcgcgagaacacgcaagccgaattgatgcggctgcagcgccagctcggcatgaccttcatcatcgtcacccatgaccaggaggaggcgatgatgatggcggatcgcatcggcgtcatgaatgcggggcgtctgcaacaggtggcgacgccgcgtgagctctatgaggtgccgaactcccgctggatcgccgagttcgtcggcggaatcaacatcatcgatggcgcggtggagtcgagcggcggcggccgcatcacggtcgcgacgcaggccgccggttcggtgacggtggcgacgcccttgcaggcgctgacgacggatcaggtgtgcgttgcgatacgcccggagaagattcgcctgtcgagcggcgaggcggcacccgatgcgggagatgcggccgggaccaaccgcgtggaaggcgtcattgccggcgttagctatcttggcggccagacccgctatcaggtcaggctcgatcgcggcgcgctgctgcatgcgtcggtcgccaacaccgttcggcgggaggccgaagccttcgatacggcgcagcgcgtggtggcgtgtttcgcgccggacgattgcatggtgcttgaccgatga

SEQ ID NO: 66069 - protein, 382 aa, Nitrobacter winogradskyi Nb-255
MTDEARLGSEATAQADKPLLQVDAAVKRFGGFTAVDHLSLDIRTGEFFALLGPSGCGKTTLLRMLGGFETPDGGRILLDGQDISGVPPHRRPVNMMFQNYALFPHLSVRDNIAFGLRRAGMPRADIEARVAEMVALVSLEGMEKRKPEQLSGGQRQRVALARALARRPRLLLLDEPMAALDKKLRENTQAELMRLQRQLGMTFIIVTHDQEEAMMMADRIGVMNAGRLQQVATPRELYEVPNSRWIAEFVGGINIIDGAVESSGGGRITVATQAAGSVTVATPLQALTTDQVCVAIRPEKIRLSSGEAAPDAGDAAGTNRVEGVIAGVSYLGGQTRYQVRLDRGALLHASVANTVRREAEAFDTAQRVVACFAPDDCMVLDR

SEQ ID NO: 66070 - DNA, 1146 bp, Anabaena variabilis ATCC 29413
  CDS (1)..(1146): transl_table=11
atgaatatggctcaaactgtcacgcagaatcccaggggcgtaaaaacacttctacccctcgatgttgaactacgtaacgtgttcaagtttttcaaccaagaaccggcggtacatggagtggacttagatgtaaaacaaggggaattctttagtattctcggcccttctggttgtggtaagacaacgacactacgtttaatagccggatttgaacaagttgatgctggtaaattattgattcagggtcagccgatgaccaatattcccccttaccgccgaccagttaatacagtatttcaaagttacgctctatttaatcaccttaacgtctgggataatgttgctttcgggttgcggctgaagaaatcccggaaatcagaagtagaaagcagagttaaagaggctttaaaactggtaaaaatggaaagtttgcgatcgcgctttcctagtcaactgtccggtggtcaacagcagcgcgttgctttggctagggctttggtgaatcgtccggctgtggtgttactagatgaacctttaggggcgttggatttaaagttacgtaaggaaatgcaggttgagttatcaaatttacataaaaacctgggtttgacctttattatggtaactcatgaccaagaggaggcgttatctttaagcgatcgcattgcggtgatgaaccaggggaaaattgaacaaattggtactccccaagagatttacgaacgtcctaaaacttcctttgtcgccgattttatcggtgatactaatttgtttagtggtgaaatcaccgtattagaagctgaatatattcaaattgttaccaaaactggactcacgattgtagttgcccggaatgaagatacacccgcagaattattaaaatctgtagttgtaagtgtacgaccagaaaaaattcaactttccctttatccgcctagttcgctcaataactgttttgaaggaaggctgataaatgtcatgtatttaggaactcacgttaattatcttgtccaattaattaacggcattaatattaatgttttacaacctaatacatttggtaatttaccagaccgtgaaacacctatttatgcttggtgggcggaaagtgattgtttggctattaatcaaatgactaatgactaa

SEQ ID NO: 66071 - protein, 381 aa, Anabaena variabilis ATCC 29413
MNMAQTVTQNPRGVKTLLPLDVELRNVFKFFNQEPAVHGVDLDVKQGEFFSILGPSGCGKTTTLRLIAGFEQVDAGKLLIQGQPMTNIPPYRRPVNTVFQSYALFNHLNVWDNVAFGLRLKKSRKSEVESRVKEALKLVKMESLRSRFPSQLSGGQQQRVALARALVNRPAVVLLDEPLGALDLKLRKEMQVELSNLHKNLGLTFIMVTHDQEEALSLSDRIAVMNQGKIEQIGTPQEIYERPKTSFVADFIGDTNLFSGEITVLEAEYIQIVTKTGLTIVVARNEDTPAELLKSVVVSVRPEKIQLSLYPPSSLNNCFEGRLINVMYLGTHVNYLVQLINGININVLQPNTFGNLPDRETPIYAWWAESDCLAINQMTND

SEQ ID NO: 66072 - DNA, 1155 bp, Natronomonas pharaonis DSM 2160
  CDS (1)..(1155): transl_table=11
gtgtctagcgaactcaagcgaaccgaccagtctgccggccccgcagcggccgccgcgggtcagaccgtactcgagctggatgacgtgcagaaatcctacgatgggatggatgtcatccgcgacctctcgttggatgtccgggacggagagctgctgacacttctgggaccgtccgggtgcgggaagacgacgacgctccggcttatcgcagggctcgaacgaccggataacgggactgtccgactcggctcaacgcccgtctccgggtcggagtttgtgccgccagaacagcgcgatgtcggtgttgtcttccaggagttcgcgctgtttccccacctctcggctcgtgaaaatatcgccttcggtatccaggagtggtccgaagccgaacagcaagagcgggtcgacgaactgctcgaactcgtcggcctggtcgaccacggcgacaagtccccggaggaactgtccggcggccaacaacagcgtgtcgcgctcgctcgctcgctggcccccgagccgaaactgcttctgcttgacgagccgttctcgaatctcgatgtcgacctccgtgtcgagatgcgcgaagaggtcagagatatcctcaaagaagcgggtgttacggccatttccgtgacccacgaccaagaggaggcgatgtcgatttcggaccgcgtcgcggtgatgaacaacggtcgcatcgaacaggtcggaacgcctgaaggggttttccagcagccgaagtcccgctttgtcgctgggttcctcggccacgcctctttcgtcagcggctatgtcgaggacggctgcgtcgaaacgggtgtcggctgcgttccgctcgagcaggtaaacggtctgaccgacgtctacgacggctccgaaatcgacctgatggtccggcctgacgatgtctgtgcccgccctgcatcccccgaggaggcaaacggcgaagtcgtccatcggcggtatctcggccccacggtgctgtatcgcgtcgaaatcgaatccggcgatgtcgtcggctgcatgcataaccacgccgacgaagtctcgcttgacgaccctgtttttgtctctatcgacgccgaccacgaactcgcctggttcccccgtggcgagcggaaaatggcagacggcggcccggacagtacggcataa

SEQ ID NO: 66073 - protein, 384 aa, Natronomonas pharaonis DSM 2160
MSSELKRTDQSAGPAAAAAGQTVLELDDVQKSYDGMDVIRDLSLDVRDGELLTLLGPSGCGKTTTLRLIAGLERPDNGTVRLGSTPVSGSEFVPPEQRDVGVVFQEFALFPHLSARENIAFGIQEWSEAEQQERVDELLELVGLVDHGDKSPEELSGGQQQRVALARSLAPEPKLLLLDEPFSNLDVDLRVEMREEVRDILKEAGVTAISVTHDQEEAMSISDRVAVMNNGRIEQVGTPEGVFQQPKSRFVAGFLGHASFVSGYVEDGCVETGVGCVPLEQVNGLTDVYDGSEIDLMVRPDDVCARPASPEEANGEVVHRRYLGPTVLYRVEIESGDVVGCMHNHADEVSLDDPVFVSIDADHELAWFPRGERKMADGGPDSTA

SEQ ID NO: 66074 - DNA, 1092 bp, Burkholderia pseudomallei 1710b
  CDS (1)..(1092): transl_table=11
atgacagctgcatttttgcaaatccagcgcttgcgcaagacctacgacgacgtagtcgcgatcgatcacgtgtccctggacgtgcgcaagggcgaattcatgacattcctcgggccgtccggctcgggcaagagcacgacgctctacatcgtcgcgggcttccaggaaccgaccgaagggtgcgtcttgcttgacggaaggccgttgctgtcggtggcgcccaataagcgcaataccggcatggtgtttcagcgatacacgctgtttcctcacttgaccgtgggcgaaaacgtcgcgtttccgttgcgtgtgcgtcgtcgtcccgatgcgcaggtgaaggcgaaggtcgagcagatgctgaagcttgttcatctggccgactgccgtgatcgtatgcctgcccaattgtcaggcgggcagcagcaacgcgttgcgatcgcacgtgcgttggcctacgatccgcccgtattgctgatggacgaaccgctcgccgcactcgacaaaaagctacgcgaggaaattcagctcgaattgcgccgcattcaccaagagacgggcgtgacgattctctacgtcacgcacgaccaagaggaggcacttcgtctttccgatcgtattgccgtcttcaacaaaggcgcaatcgaacaggtcggaacgggcgaggagctgtacgccaacccgacgtcgcgcttcgtggcgagcttcatcggtaattcaaatttccttccggtcagggtcacagcgaacgccaatggcggcatgagcggcatattcccgaacggtctcgcagtggcgacggccggccaaggcccggcactgacggccggcgatgacggcgcgctgatgatccgccccgagcagatgcgcattcgtgcgttgcaaggcgcgaagggggaggtcgggttgcctgtcaccgtgcgcgacataacgtacctcggtgatgcgatgcattacgcggttgccacaccttggcagcaggaaatttcgattcgaatgccggcaagccatcgccatgacagcggactatcgatcggcacgcaggctttcgtcgagtgggatgcgcgcgacgcgcgtgtttttgtcgaggcatag

SEQ ID NO: 66075 - protein, 363 aa, Burkholderia pseudomallei 1710b
MTAAFLQIQRLRKTYDDVVAIDHVSLDVRKGEFMTFLGPSGSGKSTTLYIVAGFQEPTEGCVLLDGRPLLSVAPNKRNTGMVFQRYTLFPHLTVGENVAFPLRVRRRPDAQVKAKVEQMLKLVHLADCRDRMPAQLSGGQQQRVAIARALAYDPPVLLMDEPLAALDKKLREEIQLELRRIHQETGVTILYVTHDQEEALRLSDRIAVFNKGAIEQVGTGEELYANPTSRFVASFIGNSNFLPVRVTANANGGMSGIFPNGLAVATAGQGPALTAGDDGALMIRPEQMRIRALQGAKGEVGLPVTVRDITYLGDAMHYAVATPWQQEISIRMPASHRHDSGLSIGTQAFVEWDARDARVFVEA

SEQ ID NO: 66076 - DNA, 1161 bp, Burkholderia pseudomallei 1710b
  CDS (1)..(1161): transl_table=11
atgaatagtcagtcgggcgcggcggtggcgggcgcgccgtcctatcggccgcagacgggcgccgacgggcgcgccgaaaactttgtccagatcatcgacgtcgtcaagaagttcggcgagaccgtcgcggtgcgcaacgtcgagctgagcgtgcgcaagggcgagctgttcgcgctcctcggcagctccggctgcgggaagtcgacgctgctgcgcatgctcgccggcctcgagacgatcacgtcgggcaagatcctgatcgacggcgaggatctcgcgcagatgccgccgtacaagcggcccgtgaacatgatgttccagtcgtacgcgctgttcccgcacatgacggtcgaggcgaacgtcgccttcggcctcaagcaggaaggcgtgccgaaggccgagctcaaggagcgcgtgcgcgatgcgctcgagctcgtgcagatggcgcgctacgcgagccgcaagccgcatcagctctccggcggccagcagcagcgcgtcgcgctcgcgcgctcgctcgtcaagcggccgaagctgctgctgctcgacgagccgatgtcggcgctcgacaagcagatccgccagcgcacgcagatcgagctcgtcaacatcctcgacaaggtcggcgtcacctgcatcatggtcacgcacgatcaggaggaggcgatgacgatggcggggcgtctcgccgtgatgagcgaaggccagatcgtgcagatcggcacgccgcacgaagtctacgaatatccgaactgccgcttctccgccgagttcatcggctcgacgaacctgttcgagggcgtgaccgtcgaggacgagcccgatcacgtgttcatcgaatcgccggacctgccgtgccggctgtacgtgaaccacgggatcacgggcccgctcggcatgcccgtcacggtgtcggtgcgccccgagcgcatcgcgctgacccgcaagcccgccgacggcgcgtacaactgggggcgcggcgtcgtcacgaacgtcgcgtacatgggcggctattcgctgtatcacgtgaagctcgattccgggaagacggtgatcgcgaacgtgtcgagcctcgcgatcgccgatctcgattcgcccggctggggcgatgaaatctacgtgcgctggagcgccgcggccggcgtggtgctgacgtcatga

SEQ ID NO: 66077 - protein, 386 aa, Burkholderia pseudomallei 1710b
MNSQSGAAVAGAPSYRPQTGADGRAENFVQIIDVVKKFGETVAVRNVELSVRKGELFALLGSSGCGKSTLLRMLAGLETITSGKILIDGEDLAQMPPYKRPVNMMFQSYALFPHMTVEANVAFGLKQEGVPKAELKERVRDALELVQMARYASRKPHQLSGGQQQRVALARSLVKRPKLLLLDEPMSALDKQIRQRTQIELVNILDKVGVTCIMVTHDQEEAMTMAGRLAVMSEGQIVQIGTPHEVYEYPNCRFSAEFIGSTNLFEGVTVEDEPDHVFIESPDLPCRLYVNHGITGPLGMPVTVSVRPERIALTRKPADGAYNWGRGVVTNVAYMGGYSLYHVKLDSGKTVIANVSSLAIADLDSPGWGDEIYVRWSAAAGVVLTS

SEQ ID NO: 66078 - DNA, 1038 bp, Pseudomonas fluorescens PfO-1
  CDS (1)..(1038): transl_table=11
atgacgcttgcagtccagttcactaacgtttcccggcagttcggcgaagtgaaagccgttgaccgggtttccatcgatatccaggacggcgagttcttttccatgctcggcccctccggttcgggcaagaccacgtgcctgcgcctgatcgccgggttcgagcaaccgagcgcgggctcgatccgcattcacggtgccgaagccgccggcctgccgccctatcaacgcgacgtcaacaccgtgtttcaggattacgcgctgttcccgcacatgaacgtgctggacaacgtcgcctacggtttgaaagtcaaaggcgtaaacaaaaccgaacgccacaagcgcgccgaagaagccttggacatggtcgccctcggcggctacggtgcccgtaaaccggtgcagttgtccggcggtcagcgccagcgtgtcgccctcgcccgcgccctggtcaatcgcccgcgagtgttgttgctcgacgagccgttgggcgctctcgacctgaagctgcgcgaacagatgcaaagcgagctgaagaagctgcaacgccagctcggcatcaccttcatcttcgtcactcacgaccagaccgaagcgctgtcaatgtccgaccgcgtggccgtgttcaacaagggccgcatcgaacaggtcgacacgccgcgcaatctgtacatgaaaccgaccactaccttcgtcgccgaattcgtcggcacttcgaacgtgattcgtggcgatctggcgcgccagctcagcggtcatccgcagccgttttcgatccgcccggaacacgtgcgtttcgccgaaggcccgctggccagccacgagatcgaagtcagtggtctgctccacgacatccagtatcagggcagcgccacgcgctatgaactgaagctggaaaacggccagaccctgagcatcagccaggccaacaatcagtggatcgacaccagctcgcagcaccagaccggtcagcgcatcagcgcgcgctgggcgcgggaagcgatgattccgttgcacgacaccgttgcgagcggggtgtga

SEQ ID NO: 66079 - protein, 345 aa, Pseudomonas fluorescens PfO-1
MTLAVQFTNVSRQFGEVKAVDRVSIDIQDGEFFSMLGPSGSGKTTCLRLIAGFEQPSAGSIRIHGAEAAGLPPYQRDVNTVFQDYALFPHMNVLDNVAYGLKVKGVNKTERHKRAEEALDMVALGGYGARKPVQLSGGQRQRVALARALVNRPRVLLLDEPLGALDLKLREQMQSELKKLQRQLGITFIFVTHDQTEALSMSDRVAVFNKGRIEQVDTPRNLYMKPTTTFVAEFVGTSNVIRGDLARQLSGHPQPFSIRPEHVRFAEGPLASHEIEVSGLLHDIQYQGSATRYELKLENGQTLSISQANNQWIDTSSQHQTGQRISARWAREAMIPLHDTVASGV

SEQ ID NO: 66080 - DNA, 1143 bp, Pseudomonas fluorescens PfO-1
  CDS (1)..(1143): transl_table=11
atggcaaacgcctccagcacttacaggaaggctcttgaaggtcatcagcaaccgaaaaaggttctggtgaaggtcgatcgagttaccaagaagttcgacgaaaccacggcggtggacgatgtgtccctggagatccatcagggcgaaatcttcgccctgctcggcggctccggctcgggcaaatcgaccctgctgcgcatgctcgccggtttcgaacggccgactgaaggacgcattctgctcgacggtgtcgacatcaccgacatgccgccgtacgagcggccgatcaacatgatgttccagtcctacgccctgttcccgcacatgaccgtggcgcagaacatcgccttcggcctcaagcaggaccgtttgccggccagcgaaatcgacgctcgcgtcgaagaaatgctgcgcctcgtccatatgacccaatacgccaagcgtcgcccgcatcaactgtccggcggtcagcgtcagcgcgtggccctcgcccgctccctggccaagcggccgaaactgttgctgctcgacgaaccgatgggcgcgctggataaaaagctgcgttcgcaaatgcagctggaactggtggaaatcatcgagcgcgtcggcgtgacctgcgtgatggtgacccacgaccaggaagaggccatgaccatggccgaacgcatcgcgatcatgcacctgggctggatcgcccagatcggcagcccggtcgacatctatgaagcgccggtcagtcgcatggtctgcgaattcatcggcaacgtgaacgccttcgacggcaccgtggtcgaggaccttgaaggtcacgcgatcattcacagtccggacttgcagcaaaagatctacgtcggtcatggcgtcagcacgtcggtgcaggacaagtcgatcacctacgcgatccgcccggaaaaaatgctggtcagcacgatcaagccggagacccgctacaactggtccgaaggcaaggtgcatgacatcgcctacctcggcggtcactcggtgttctacgtcgagttgccgagcggcaagatcgtccagtcgttcatggccaacgccgaacgtcgtggcgcgcggccgacctgggacgacaaggtctacgtctggtgggaagacgacagcggcgtggtactgcgctcatga

SEQ ID NO: 66081 - protein, 380 aa, Pseudomonas fluorescens PfO-1
MANASSTYRKALEGHQQPKKVLVKVDRVTKKFDETTAVDDVSLEIHQGEIFALLGGSGSGKSTLLRMLAGFERPTEGRILLDGVDITDMPPYERPINMMFQSYALFPHMTVAQNIAFGLKQDRLPASEIDARVEEMLRLVHMTQYAKRRPHQLSGGQRQRVALARSLAKRPKLLLLDEPMGALDKKLRSQMQLELVEIIERVGVTCVMVTHDQEEAMTMAERIAIMHLGWIAQIGSPVDIYEAPVSRMVCEFIGNVNAFDGTVVEDLEGHAIIHSPDLQQKIYVGHGVSTSVQDKSITYAIRPEKMLVSTIKPETRYNWSEGKVHDIAYLGGHSVFYVELPSGKIVQSFMANAERRGARPTWDDKVYVWWEDDSGVVLRS

SEQ ID NO: 66082 - DNA, 1086 bp, Pseudomonas fluorescens PfO-1
  CDS (1)..(1086): transl_table=11
atgggtcagccaatagccattgaagtgcgtaacgtatccaagcggtattctgatgaccctggcctcgcgcctgccctcgacaacgtctcggtgaacatcgccgacaacgaattcttcaccctcctcggcccctcaggctgcggcaagaccaccctgctgcgcgccatcgccggtttcgaacatgtcagcgacggcgagatccgtctggcaggcgaaacggtcaatcacctgccgccgttcaagcgtcgggtcaacacggtgttccagagttacgcgctgtttccgcacatgagtgtcgcgcagaatatcgccttcggcctcgagatgcagggtcttgatcgcaagacgattcccggacgggtcgacgaaatgctcgcgctggtgcagatggagcacctggccgggcgcaaaccggcgcaattatccggcggccagcagcagcgcgtggctctggcccgggccctggcgccgaagccgaaagtgctgttgctcgacgagccgctgtcggcgctggacctgaagctgcgcaaggaaatgcaggtcgaactcaagcgcgtgcagcaggaagccggcatcactttcatcttcgtcacccacgatcaggaagaagcgctgaccctgtccgaccggatcgcggtgatgtccgccggcaagatcctgcagatcggcaccccgatcgacatctatgaacgtccgcagcaccgcttcgtcgcccagtttatcggcgacatcaatttccttcccggccaactcaaacgcggggaacacaacgaaaacatcttcgtaccgaacggcatgccggtggaaatcccctgcccgccccaaggcgtcaatggcagcagcgtgcagctggcattccggcccgagcgctcgcaactggttgcagcggatcagccgcatcatctgcgcggtgtgatcgaagcggtgctgtatgtcggcaccgcgacgctttaccagtgccgcttgaacaacgacatcaaagtcatgctgcgggaaaacaacgaaggcctgaaccgtggtcgcgcagtcggtgagcccgtggcggtgcacctgccgccccaggcctgcctgttgatggaggcctga

SEQ ID NO: 66083 - protein, 361 aa, Pseudomonas fluorescens PfO-1
MGQPIAIEVRNVSKRYSDDPGLAPALDNVSVNIADNEFFTLLGPSGCGKTTLLRAIAGFEHVSDGEIRLAGETVNHLPPFKRRVNTVFQSYALFPHMSVAQNIAFGLEMQGLDRKTIPGRVDEMLALVQMEHLAGRKPAQLSGGQQQRVALARALAPKPKVLLLDEPLSALDLKLRKEMQVELKRVQQEAGITFIFVTHDQEEALTLSDRIAVMSAGKILQIGTPIDIYERPQHRFVAQFIGDINFLPGQLKRGEHNENIFVPNGMPVEIPCPPQGVNGSSVQLAFRPERSQLVAADQPHHLRGVIEAVLYVGTATLYQCRLNNDIKVMLRENNEGLNRGRAVGEPVAVHLPPQACLLMEA

SEQ ID NO: 66084 - DNA, 1155 bp, Pseudomonas fluorescens PfO-1
  CDS (1)..(1155): transl_table=11
atgagtgccgtgatcaaagacgcatcccagcagaacgacaaacccctggtcagcctgcgcaacctgaacaagcactacggcgatttcgcggccgtggacaacatctcgctggacatcaaggacggcgaattcctgaccttcctcggctccagcggctcgggcaaaagcaccacgctgtcgatgctcgccggtttcgaaacgccgagcagcggcgagatcctggtcaacggccagtcgctggtgaatgtgcctccgcacaaacgcgacatcggcatggtgttccagcgctattcgctgttcccgcatctgtcggtgcgcgacaacatcgcgttcccgctggcgatccgcaaactcgcggctgccgagcgcgacaagcgcgtcgatgcgatgttgaaactggtgcagctcgaacaatttgcccatcgccgcccttcgcaactctctggtggccagcagcaacgggttgccatcgctcgcgctctggtttacgagccacgcattctgctgatggacgaaccgctcggtgcgctggacaagaaactgcgcgaagacctgcaggatgaattgcgccagctgcaccgccgcctcggcatcaccatcgtctacgtgacccacgaccaggaagaagccatgcgcctgtcccagcgcattgcgattttcagtcacggcaagattgtcgggctcggcagcggttatgacctttatcagaatccgccaaatgcgtttgtggcgtcgtttctgggtaactcgaacttcctcaagctcaaggcgcagggcaatgcggcggcgagttttgaggggcagtcgctgtcgatccgtctcaccgctggattgccgaccgggcaggatgtgctgctgatggtgcgtccggaaaaggcgttggcgttgagtgtgcagcaggcgaatgatgagccattggcggccggctggaatgaggtttcggcgaaggtggtcgaggtgttgtttctgggtgagagccagacttgcagtgtggtgacgtcgggtggcacgtccatgaccgtgaaagcattgtcggcggcggggatgccgctgaaggctggggatccggttcgggtgcgttgggcgacggcggatgcttgcgtctataccgagtgggccgagagtgatttgaacaaagccgccggcgcgcactga

SEQ ID NO: 66085 - protein, 384 aa, Pseudomonas fluorescens PfO-1
MSAVIKDASQQNDKPLVSLRNLNKHYGDFAAVDNISLDIKDGEFLTFLGSSGSGKSTTLSMLAGFETPSSGEILVNGQSLVNVPPHKRDIGMVFQRYSLFPHLSVRDNIAFPLAIRKLAAAERDKRVDAMLKLVQLEQFAHRRPSQLSGGQQQRVAIARALVYEPRILLMDEPLGALDKKLREDLQDELRQLHRRLGITIVYVTHDQEEAMRLSQRIAIFSHGKIVGLGSGYDLYQNPPNAFVASFLGNSNFLKLKAQGNAAASFEGQSLSIRLTAGLPTGQDVLLMVRPEKALALSVQQANDEPLAAGWNEVSAKVVEVLFLGESQTCSVVTSGGTSMTVKALSAAGMPLKAGDPVRVRWATADACVYTEWAESDLNKAAGAH

SEQ ID NO: 66086 - DNA, 1056 bp, Pseudomonas fluorescens PfO-1
  CDS (1)..(1056): transl_table=11
atgtctggtctgattctggaaaacgtcgagaaacactacggctcggcctgcgcggtaaaagacgtcaacctgcatttgcccgagggcaaactggtgtgcttcctcggcccgtcgggctgcggcaagaccacgttgctgcgaatgatcgccgggctggaaaccctcaccggcggcgagatccgcctggacggcgaggacatcggccacaccccggcgcacctgcgcaacttcggcatggtgtttcagtcgctggcattgttcccgcacatgaccgtgggcgagaacatcgcctatccactgaaactgcgcggtgtgagcaagtctgatcaacagacacgggtggtggagttgcttgagttgatccagctgcaaccgatgatcgatcgcccggtggccaagctgtccggcggtcagcgtcagcgggtggcgattgcccgggcgattgcctcgcatccgaaaatcctgttgctcgacgaaccgctgtcggcgctggacgccaaattgcgtgagtcgatgcaggtggaaatccgccagctgcaacaacgcctgaacatcaccaccatcatggtgacccacgatcagcgcgaggccatgaccatggccgatatcgtggtggtgctgggtgagcatcgggtgcagcaggtggggacgccgattgaaatctatcggcatccggccaacgaattcgtcgcggattttatcggctcggggaatatttttccggccaccgcgctgggcgatggcaaggttgtgctgccgggcggcgatgccctgcaagtgccgatctgcagcagcatcgtggtcgggcagaaggtgaaaatgctgatccgccccgaagacctgcaactgtcaccgccccaggccacggcgggcaatcgtctgctgggcaaggtgacgttcgtgcgggatattggcgcgacgatcgagactacggtggagtgttccggcgtgaccttcacggcgctgagcacgccgtgtcagggcttcgggctggggatcgggcatccggtgtcggtgacattgccgagtgaggcgtgtcgggtactcggcgcctga

SEQ ID NO: 66087 - protein, 351 aa, Pseudomonas fluorescens PfO-1
MSGLILENVEKHYGSACAVKDVNLHLPEGKLVCFLGPSGCGKTTLLRMIAGLETLTGGEIRLDGEDIGHTPAHLRNFGMVFQSLALFPHMTVGENIAYPLKLRGVSKSDQQTRVVELLELIQLQPMIDRPVAKLSGGQRQRVAIARAIASHPKILLLDEPLSALDAKLRESMQVEIRQLQQRLNITTIMVTHDQREAMTMADIVVVLGEHRVQQVGTPIEIYRHPANEFVADFIGSGNIFPATALGDGKVVLPGGDALQVPICSSIVVGQKVKMLIRPEDLQLSPPQATAGNRLLGKVTFVRDIGATIETTVECSGVTFTALSTPCQGFGLGIGHPVSVTLPSEACRVLGA

SEQ ID NO: 66088 - DNA, 1125 bp, Pseudomonas fluorescens PfO-1
  CDS (1)..(1125): transl_table=11
atgagccaggtcgaatcaaacgcaggggccagcgatgtgctggtcagctttcgtggagtgcagaagagctacgacggcgagaacctgatcgtcaaagacctcaacctggacattcgcaagggcgaattcctcaccttgctcggaccgtccggctccggaaagaccaccagcctgatgatgctcgccggtttcgagacgccgaccgccggcgaaattctccttgccgggcgggcgatcaacaacgtgccgccgcacaagcgcgacatcggcatggtgttccagaactacgcgctgtttccgcacatgaccgtcgccgaaaacctggcgtttccgctgaccgtacgcggcctgaacaagagcgacgtcagcgacaaggttaagaaagtcctgagcatggttcagctcgacgcgttcgcatcgcgttatccggcgcagttgtccggcggccagcaacaacgtgtagcactggcccgtgcgctggtgttcgagccgcagctggtgctgatggacgaacccctcggcgccctcgacaaacaactgcgcgaacacatgcagatggaaatcaaacacctgcaccagcgccttggcgtaaccgtggtctatgtgacccacgaccagggcgaagccctgaccatgtccgaccgcgtcgccgtgttccaccagggcgagatccagcagatcgccccgccgcgcaccctctacgaagaaccgaaaaacaccttcgtcgccaacttcatcggcgagaacaaccgcctcaacggtcgcctgctcagccagaacggcgagcgctgcgtggtcgagctggggcgcggggaaaaggtcgaggcgctggcggtcaacatcggccagaccggcgaaccggtcaccctgtctatccgccccgagcgcgtcagcctcaacggttcgagcgaccaatgcgtcaaccgcttctccgggcgggtggccgaattcatctatctgggcgaccacgtccgggtgcgcctggaagtctgcggcaagaccgacttcttcgtgaaacaaccgattgccgagctcgatcctgcgctcgcagtcggtgacgtggttccgcttggctggcaggtcgagcacgttcgcgcgctcgatcctcttctagaggcgcactga

SEQ ID NO: 66089 - protein, 374 aa, Pseudomonas fluorescens PfO-1
MSQVESNAGASDVLVSFRGVQKSYDGENLIVKDLNLDIRKGEFLTLLGPSGSGKTTSLMMLAGFETPTAGEILLAGRAINNVPPHKRDIGMVFQNYALFPHMTVAENLAFPLTVRGLNKSDVSDKVKKVLSMVQLDAFASRYPAQLSGGQQQRVALARALVFEPQLVLMDEPLGALDKQLREHMQMEIKHLHQRLGVTVVYVTHDQGEALTMSDRVAVFHQGEIQQIAPPRTLYEEPKNTFVANFIGENNRLNGRLLSQNGERCVVELGRGEKVEALAVNIGQTGEPVTLSIRPERVSLNGSSDQCVNRFSGRVAEFIYLGDHVRVRLEVCGKTDFFVKQPIAELDPALAVGDVVPLGWQVEHVRALDPLLEAH

SEQ ID NO: 66090 - DNA, 1143 bp, Pseudomonas fluorescens PfO-1
  CDS (1)..(1143): transl_table=11
atggcagttgcctccggcgcctataagaaagccctcgagggcgaccagacaccgaaacaggtgctggtcaaaatcgaccgggtcacgaagaagttcgacgagacggttgccgtggacgatgtgtccctggaaatcaagaagggcgagatcttcgccctgctcggcggttcgggatcgggcaaatccactctgctgcggatgctggcagggttcgaacggcccacggaggggcgcattttcctcgacggtgtcgacatcaccgacatgccgccgtacgagcgaccgatcaacatgatgttccagtcctacgccctgttcccgcacatgaccgtggcgcagaacatcgcgttcggtctgcaacaggacaagattcccaaggccgagatcgacgcccgcgtggccgagatgctcaagctggtgcagatgagccagtacgccaagcgcaagccgcaccagttgtccggcggtcagcgtcagcgtgtggcattggcgcgttcgctggccaagcggccgaaactgctgctgctcgatgaaccgatgggtgcactggataaaaaactgcgttcgcagatgcagcttgagctggttgagatcatcgagcgcgtgggtgtgacctgcgtgatggtgacccacgaccaggaagaggccatgaccatggccgagcgcatcgcgatcatgcacctgggctggatcgcccagatcggcagcccgatcgacatctacgaaaccccgaccagccgcctggtctgcgaattcatcggtaacgtgaacatcttcgaaggcgaagtgatcgacgacgccgaaggccacgcgaccattacctgcaaggacctcgaccggcagatctacgtcggccacggcatcagcacctcggtgcaggacaagtccgtgacctacgcgatccgtccggaaaaactgctggtcaccgccgatcagccgacctgcgagtacaactggtcgagcggcaaggtgcatgacatcgcctacctcggcggtcactcggtgttctacgtcgaattgccgagcggcaagctggtgcagtcgttcgtggccaacgccgagcgccgtggtgcgcgtccgacctggggcgatcaggtctacgtctggtgggaagacgacagcggcgtggtacttcgctcatga

SEQ ID NO: 66091 - protein, 380 aa, Pseudomonas fluorescens PfO-1
MAVASGAYKKALEGDQTPKQVLVKIDRVTKKFDETVAVDDVSLEIKKGEIFALLGGSGSGKSTLLRMLAGFERPTEGRIFLDGVDITDMPPYERPINMMFQSYALFPHMTVAQNIAFGLQQDKIPKAEIDARVAEMLKLVQMSQYAKRKPHQLSGGQRQRVALARSLAKRPKLLLLDEPMGALDKKLRSQMQLELVEIIERVGVTCVMVTHDQEEAMTMAERIAIMHLGWIAQIGSPIDIYETPTSRLVCEFIGNVNIFEGEVIDDAEGHATITCKDLDRQIYVGHGISTSVQDKSVTYAIRPEKLLVTADQPTCEYNWSSGKVHDIAYLGGHSVFYVELPSGKLVQSFVANAERRGARPTWGDQVYVWWEDDSGVVLRS

SEQ ID NO: 66092 - DNA, 1104 bp, Rhodobacter sphaeroides 2.4.1
  CDS (1)..(1104): transl_table=11
gtggtggcttctacccaggacgacggttttgtcgttttcgaacatgtgcaaaaaagctatgatggcgagacgctcgtcgtcaaagatctcaacctgacgatcgggcagggtgagttcctgaccatgctggggccctccgggtcgggcaagaccacctgcctgatgatgctcgcgggcttcgagacggcgacgcacggcgagatccgcctcgacggtcgcccgatcaacacggtgcccccgcacaagcgcggcatcggcatggtgttccagaactacgcgctttttcctcacatgacggtaggcgagaacctctccttcccgctcgaggtgcgcggcatgtccaagtcggaccgcgagcgcaagatcaagcgtgcgctcgacatggtccagatgggcgccttcgccaaccgccgtccggcgcagctgtccggcgggcagcagcagcggatcgcgctggcccgggccctcgtgttcgacccgcagctcgtgctgatggacgagccgctcggcgcgctcgacaagcagctgcgcgagcatatgcagttcgagatcaagcatctgcacgaaagcctcgggatcacggtggtctatgtcacccacgatcagggcgaggcgctgaccatgtcggaccggatcgccgtcttcaacgacgggcgcatccagcagctggccccgccgtccgagctctacgagcggccgaagaacagcttcgtggccagcttcatcggcgagaacaaccgcctgcccggcaccgtcgaggagatcgccgacgggcgcgcgctggtgcggctcgagaccggcgagctgatcgacgccacgccggtgaacgtcgcccgcaagggccagcagacgctcgtctcgatccgtcccgagcgggtcgagttcaagccggagatgctgccgcccaacgcacatctcatcgatgccgaagtgctcgagttcatctacatgggcgatatcttccgcacgcggctgcgggtcgccggatccgaggatttcgtgatcaagtgccgcaacaccctcggccagcgcgtcatgcagccgggcgagaaggtcaggatcggctgggcgcctcaggacgcccgcgcgctcgatccgctttaa

SEQ ID NO: 66093 - protein, 367 aa, Rhodobacter sphaeroides 2.4.1
MVASTQDDGFVVFEHVQKSYDGETLVVKDLNLTIGQGEFLTMLGPSGSGKTTCLMMLAGFETATHGEIRLDGRPINTVPPHKRGIGMVFQNYALFPHMTVGENLSFPLEVRGMSKSDRERKIKRALDMVQMGAFANRRPAQLSGGQQQRIALARALVFDPQLVLMDEPLGALDKQLREHMQFEIKHLHESLGITVVYVTHDQGEALTMSDRIAVFNDGRIQQLAPPSELYERPKNSFVASFIGENNRLPGTVEEIADGRALVRLETGELIDATPVNVARKGQQTLVSIRPERVEFKPEMLPPNAHLIDAEVLEFIYMGDIFRTRLRVAGSEDFVIKCRNTLGQRVMQPGEKVRIGWAPQDARALDPL

SEQ ID NO: 66094 - DNA, 1005 bp, Rhodobacter sphaeroides 2.4.1
  CDS (1)..(1005): transl_table=11
gtggccgtccgcgcgctggacgatgtctcggtggggatccggcggagcgagttcttcaccctgctcggcccctcgggctgcggcaagaccacgcttctgcggctgatcgcggggttcgaggcgccgacctccggcgcgatcctgctcgacgggcgcgacatcaccgccctgccgccgaaccgccggccgatcaacacggtcttccagagctacgcgctgtttccgcatctgacggtggccgagaacgtgggcttcggcctccggatgcagggcaagccgcgcgccgagatcgagacggtgacggcgcggatgctggcgctcgtccggctcaaggcgctggcgcagcgcaaggtggcgcagctgtcgggcgggcagcagcagcgggtggcgctggcccgggcgctcgcgccgcagccgcgggtgctcctgctcgacgagccgctctcggcgctcgatctgaagcttcgcaaggagatgcagatcgagctgaagcggctccagcacgagacgggcatcaccttcgtcttcgtgacccacgatcaggaggaggcgctgaccatgtcggaccggatcggggtgatgagcgcgggccggatcctgcagatcggcccgccgcgcgagatctacacgcgcccggccaaccgcttcgtggcgagcttcatcggcgagacgaatttcctgccggcgcgccatgcgggcgggcgggtcacgctcgatgcgggcggagagctcgcggtcgaaggcgggcccgaggggcgggtgacggtcgccgtgcgccccgagcaggtgcgcctcgtggcccccgacgagccgggcgccctgcccgccacgatccgcgatctggtctatttcggaaccgacacccactgccacttggccctcgccgacgggaccgaggtggtggcgcgcctgcagagcagcgcctcgggcgatccggggctcgcccccggccagcccgcgggcctgcgctttgcaccgggcgccgtgcagctgctgggggactga

SEQ ID NO: 66095 - protein, 334 aa, Rhodobacter sphaeroides 2.4.1
MAVRALDDVSVGIRRSEFFTLLGPSGCGKTTLLRLIAGFEAPTSGAILLDGRDITALPPNRRPINTVFQSYALFPHLTVAENVGFGLRMQGKPRAEIETVTARMLALVRLKALAQRKVAQLSGGQQQRVALARALAPQPRVLLLDEPLSALDLKLRKEMQIELKRLQHETGITFVFVTHDQEEALTMSDRIGVMSAGRILQIGPPREIYTRPANRFVASFIGETNFLPARHAGGRVTLDAGGELAVEGGPEGRVTVAVRPEQVRLVAPDEPGALPATIRDLVYFGTDTHCHLALADGTEVVARLQSSASGDPGLAPGQPAGLRFAPGAVQLLGD

SEQ ID NO: 66096 - DNA, 1098 bp, Rhodobacter sphaeroides 2.4.1
  CDS (1)..(1098): transl_table=11
gtgaccgttgccgcgaaacccacgatgatcgagttccgcgacgtccacaaatattacggcgactatcacgcgctgcgcggcatctcggccacgatccgggcgggcgagttcttctcgctgctcgggccctcgggctgcggcaagaccacgctcctgcgcaccatcgcggggttcgaggagatctcgtcgggggtggtgctgatcgacggcaaggacaccaggggggtgcccgccaacaagcggcccaccaacatggtgttccagagctatgcgatcttcccgcatctgacggtggccgagaacgtgggcttcggcctgcgccgcgcgaacctctcgaaggaggagacgacgcgacgtgtggccgaggcgctggagatggtggggctgcgcggctacggcgcgcgggcggcccatgcgctctcgggcgggcagcggcagcgggtggcgctggcgcgcgcgctgatcctgaagcccaaggtgctgctcctggacgagccgctctcggcgctcgacaagaagatgcgcgagcagatgcaggtcgagctcatcaagctgcagcggcaggtgggcatcaccttcatcctcgtgacgcacgatcaggaagaggcgctggtcatgtccgaccggatcgccgtcatgttcgagggcgagatcgcgcagctggccgatcccgagacgctctatcggcggccaacctcgcgcaaggtggccgatttcatcgggacgatgaacttcctgccggcgcggatcctgagcgagacccagcaggggatcgaggtcgaggcgcaggggctcgggcggatgctgctcgatccgatgcaggcgccgggcgcggcctcgggcaccggcgtcaccgtgggctttcgacccgagacggcgacgatcctcttcgaggggcagaaggccgaccgcgaggccatggggaccatcgaggaggtcgtctactacggcgacatgacctattacgacatccgcctagacggcaccgaggcgcccatccggctctccatgcgcaacgtcttcggccgcgcggtgctggagatcggcgcgcgggcccgcgtcgcctggagccccggggcgctggtcctgttccgctga

SEQ ID NO: 66097 - protein, 365 aa, Rhodobacter sphaeroides 2.4.1
MTVAAKPTMIEFRDVHKYYGDYHALRGISATIRAGEFFSLLGPSGCGKTTLLRTIAGFEEISSGVVLIDGKDTRGVPANKRPTNMVFQSYAIFPHLTVAENVGFGLRRANLSKEETTRRVAEALEMVGLRGYGARAAHALSGGQRQRVALARALILKPKVLLLDEPLSALDKKMREQMQVELIKLQRQVGITFILVTHDQEEALVMSDRIAVMFEGEIAQLADPETLYRRPTSRKVADFIGTMNFLPARILSETQQGIEVEAQGLGRMLLDPMQAPGAASGTGVTVGFRPETATILFEGQKADREAMGTIEEVVYYGDMTYYDIRLDGTEAPIRLSMRNVFGRAVLEIGARARVAWSPGALVLFR

SEQ ID NO: 66098 - DNA, 1098 bp, Rhodobacter sphaeroides 2.4.1
  CDS (1)..(1098): transl_table=11
atggtcgggcaccgcatgcagagtcaaccgattgccgaactcaggaacgtgaccaagcgctacgggctggtcacggcggcgacgaacctgactctggccatcgaaccgggcgagttcctgtccttcctcggcccgtccggctgcggcaagaccaccgcgctgcgcatgctggccggcttcgagcaggcctccgaagggcaggtgctgatcgacggacgggacgccacggccctgcccgcctggcagcgcccggtgaacatggtgtttcagcagtatgcgctgttccctcatctgaccgtcgcgcagaatgtcggctacggcctgaaccagcggcggccgaaaccgcccagggccgaggtcgccgccgccgtcgatgaggcgcttgcgctggtgcagctctcgggcttcggcgcgcgccggacgtgggaattgtcgggcggccagcagcagagggtcgcgctggcccgcgcaatcgtcaacaagcccaagatcctgctgctcgacgagccgatggccgcgctggacaagaagctgcgccacgacatgcagatcgagttgaagtcgctgcagcgcgagctcggcatcaccttcgtcctcgtcacccacgatcaggaggaggcgctgtcgatgtcggaccggatcgtgatcatggaccatggccgcatcgcccagatcggcggcccggaagagctctacgaccggccgcagagccgttatgtcgcggatttcgtaggccgctccaacttcatcggcgccacgggccggggccgcgaggccgaaatcctcgtcgccgaggccggcggcctgatcttccacgcccgcggcggcgagaagatcggaccgggaagccccgtgaccctgtcgctgcgccccgaggagatccgccttgcgccttcgggcgagggtcatcgcatggtcgtcacgcaccggatcttcctcggcgagcataccgaataccacctgacctccggagccctcccgcatctggtggcggtcgtcccgcgcaccgccgaggcagggtcggcgctgctggccccgggcgccgaggtcatggcctcctggcgcgacggcgccgctctggcgctcgacgccggctga

SEQ ID NO: 66099 - protein, 365 aa, Rhodobacter sphaeroides 2.4.1
MVGHRMQSQPIAELRNVTKRYGLVTAATNLTLAIEPGEFLSFLGPSGCGKTTALRMLAGFEQASEGQVLIDGRDATALPAWQRPVNMVFQQYALFPHLTVAQNVGYGLNQRRPKPPRAEVAAAVDEALALVQLSGFGARRTWELSGGQQQRVALARAIVNKPKILLLDEPMAALDKKLRHDMQIELKSLQRELGITFVLVTHDQEEALSMSDRIVIMDHGRIAQIGGPEELYDRPQSRYVADFVGRSNFIGATGRGREAEILVAEAGGLIFHARGGEKIGPGSPVTLSLRPEEIRLAPSGEGHRMVVTHRIFLGEHTEYHLTSGALPHLVAVVPRTAEAGSALLAPGAEVMASWRDGAALALDAG

SEQ ID NO: 66100 - DNA, 1119 bp, Rhodobacter sphaeroides 2.4.1
  CDS (1)..(1119): transl_table=11
atgatggtcgagcgcgcgatgaccccggaggccgccctcgggaccccggagggtcccgatcacctggtcctgagcgaggtcggcatgaccttcgggacgctcgacgtcatcccctcgctgtcgctttcggtcaggcggggcgagatggtggctttcctcggcccctcgggctgcggcaagaccacgacgctgcgcatgatcgcgggcttgctcgatcccacgcgcggccggatctcggtgggcgggcgggagatcacccacctgccggtccacgaccgcgacatgggcatggtgttccagagctatgcgctctttccccacatgaccgtgtcgcagaacgtggccttcgggctcgagatgcggcgcatggccaaggccgagatccggtcgcgggtcgagcgggcgctggccatggtgcagctcggccatctggccgggcgcaagcccaaggcgctgtccggcgggcagcagcagcgggtggcgctggcccgcgcactggtggtcgagccctcgatcctgctgctcgacgagccgctttccaacctcgatgcgaagctgcgcgacgagatgcgggtgcagatccgcagcctccagcagcagagcgggatcaccgcggtcttcgtgacccacgatcaggtcgaggcgctcagcatgtgcgaccggatcgtggtgatgcgcggcggccatgtcgagcagttcggcacgccgaacgagatctacgagcggccggcgacgcccttcgtggcctccttcgtgggccgcaccaaccggctttcgggccgggtcgatccgtcggggcggctgctgatcgagggccggccggtcgccgctgaagggcggctgcccgagggcgcggtcgaggtgctggtgcgcccgcaccggatgagcctgcgcgccgccgcggaggatcagcctgtcggtctcaacagcctgcccggcgtgttgaccggggccaccttcgtgggcgacctcattcaggccacggtgcggatcggcggcgacgagatcaccgtcgagcagctcacgcgccgccgctcgggcctgcccgagccgggctcggccgtgaccgtcgcctgggaggccggcgacacgatggtctatcccgagggcagggcatga

SEQ ID NO: 66101 - protein, 372 aa, Rhodobacter sphaeroides 2.4.1
MMVERAMTPEAALGTPEGPDHLVLSEVGMTFGTLDVIPSLSLSVRRGEMVAFLGPSGCGKTTTLRMIAGLLDPTRGRISVGGREITHLPVHDRDMGMVFQSYALFPHMTVSQNVAFGLEMRRMAKAEIRSRVERALAMVQLGHLAGRKPKALSGGQQQRVALARALVVEPSILLLDEPLSNLDAKLRDEMRVQIRSLQQQSGITAVFVTHDQVEALSMCDRIVVMRGGHVEQFGTPNEIYERPATPFVASFVGRTNRLSGRVDPSGRLLIEGRPVAAEGRLPEGAVEVLVRPHRMSLRAAAEDQPVGLNSLPGVLTGATFVGDLIQATVRIGGDEITVEQLTRRRSGLPEPGSAVTVAWEAGDTMVYPEGRA

SEQ ID NO: 66102 - DNA, 990 bp, Rhodobacter sphaeroides 2.4.1
  CDS (1)..(990): transl_table=11
atgaccctcctcgccatctccgacatcaccaagagcttcgcgggccacaaggcgctcgatcatgtcacgctcgacatccggcagggtgagttcatctcgctgctcgggccttcgggctgcggcaagaccactctcctgcgcacggtcgcgggcttcatgaccgcggacaagggccggatcctgatcgatggcgaggatgtctcgcggctgccgcccgagcggcggccgctcaacacggtcttccagaactatgcgctgttcccgcacatgacggttctggagaacgtggcttacgggccgcggcgggcgggtctttcgcgcgccgaagcggaccggcgggccgaggaggcgctcgagatggtgggtctggccgccatgtcccgccgcaatcccgccgccatgtcgggcggccagcagcagcgcgtggcgctggcgcgcgccatcgtgaaccggccgaagctcctcctgctcgacgagccgctgtcggcgctcgatcttcagctgcgcaagcgcatgcagatcgagctgaagcagcttcaggtgcagctcggcatcaccttcatcttcgtgacccacgatcaggacgaggccatggccatgtccgaccgcatcgcggtcatgtcggccggccggctcgagcaatgcgacgcgcccgaggcgatctatcgccgtcctcggacgcgcttcgtggccgagttcatcggcgaggccaacttcctgccgctcgacggcacgggaccggagggcgtgctgcgccccgaggacctcagggtccttgccgagggcgaggcgctgccgccgggctggcgcggcctgcccgcgcgggtcacgggcgtgacctatgtgggcggcaccagcaacatctatctggccgacggtccgcgcgagcttctggcgcgcagctacggtctgccgcccgcggggatctcggccggacggacggtgcaggcgggcttcgatccggccaacctgcatccgctgggagcctga

SEQ ID NO: 66103 - protein, 329 aa, Rhodobacter sphaeroides 2.4.1
MTLLAISDITKSFAGHKALDHVTLDIRQGEFISLLGPSGCGKTTLLRTVAGFMTADKGRILIDGEDVSRLPPERRPLNTVFQNYALFPHMTVLENVAYGPRRAGLSRAEADRRAEEALEMVGLAAMSRRNPAAMSGGQQQRVALARAIVNRPKLLLLDEPLSALDLQLRKRMQIELKQLQVQLGITFIFVTHDQDEAMAMSDRIAVMSAGRLEQCDAPEAIYRRPRTRFVAEFIGEANFLPLDGTGPEGVLRPEDLRVLAEGEALPPGWRGLPARVTGVTYVGGTSNIYLADGPRELLARSYGLPPAGISAGRTVQAGFDPANLHPLGA

SEQ ID NO: 66104 - DNA, 1038 bp, Xanthomonas campestris pv. vesicatoria str. 85-10
  CDS (1)..(1038): transl_table=11
ttgcggtcgacgacgtcagcctgcagattcgcaagggcgagatcttcgcgttgctcggtggttccggtagcggcaaatccacgctgctgcgctgccttgccgggttcgagcggccgaccaagggggcgcattgtcctggatggtcaaccgatcgacgcactgccgccgtacgagcgcccgatcaacatgatgttccagtcgtacgcgctgtttccgcatatgagtgtggagcagaacatcgccttcgggttgaagcaggaaggcttgcccaaggctgcgatcgccagccgcgtcggcgagatgctcgaactggtgcagcttggcgcgctggccaagcgcaagccgcaccagctctccggcgggcagcagcaacgcgtggccctggcgcgctcgctggccaagcgccccaagctgctgttgctggacgaaccgatgggtgcgctggataaaaaactgcgctcgcagatgcagctggaactggtcaacatcatcgaaacctccggcgtgacctgcgtcatggtcacccacgatcaggaagaggccatgaccatggccacccggatcgcgctgatggaccagggctggatccagcaggtgggcacgcccgatgaaatctacgagcagccggccaaccggtttgcggccgagttcatcggctcggtcaatctgatcgatgcgctcatcgccgacgacgcgcccgagtacgtcaccttgaaaacgccggcgttcgatgcctgcatccgcatcggccacggcatcaccggcttcgaagggcaggcagtggcgttcgcgctgcgcccggaaaagctcgccatcggcaaggacgagccggcccaggcctgcaacaaggcccagggcgtgatcgaagacatcgcctatttcggcagccactcggtctaccacgtgcgcctgcccagcggggtcaagctgatggccaatttcgccaatcgccagcgctgggccagcgaagcgctgacctggggcgacaccgtgtgggtcgggtggggcgaagacgacggcgtggtgctcaccgcatga

SEQ ID NO: 66105 - protein, 345 aa, Xanthomonas campestris pv. vesicatoria str. 85-10
MRSTTSACRFARARSSRCSVVPVAANPRCCAALPGSSGRPRGRIVLDGQPIDALPPYERPINMMFQSYALFPHMSVEQNIAFGLKQEGLPKAAIASRVGEMLELVQLGALAKRKPHQLSGGQQQRVALARSLAKRPKLLLLDEPMGALDKKLRSQMQLELVNIIETSGVTCVMVTHDQEEAMTMATRIALMDQGWIQQVGTPDEIYEQPANRFAAEFIGSVNLIDALIADDAPEYVTLKTPAFDACIRIGHGITGFEGQAVAFALRPEKLAIGKDEPAQACNKAQGVIEDIAYFGSHSVYHVRLPSGVKLMANFANRQRWASEALTWGDTVWVGWGEDDGVVLTA

SEQ ID NO: 66106 - DNA, 1140 bp, Burkholderia sp. 383
  CDS (1)..(1140): transl_table=11
atgatccatacgctccctgccgcaccggttgcggccgacgctcgccgcgatgcgggcgcattcgtgcgcatcgaaaacgtcgtgaagaaattcggcgacagcaccgccgtcgacaacgtgaacctgacgatcgcgaagaacgaactcttcgcgctgctcggcagctcgggctgcggcaagtcgacgttgctgcgcatgctcgccgggctcgagacggccacctccggcaagatcttcgtcgacggcgaagatctcgcatcgctgccgccgtatcgccgcccggtgaacatgatgttccagtcgtacgcgctgttcccgcacatgtcggtcgaatcgaacgtcgcattcggcctgaagcaggaaggcacgccgaagcacgagatcagggagcgcgtggccgatgcgctcgcgctcgtgcagatgagcaagtacgcgcagcgcaagccgcaccagctctccggcggccagcagcagcgcgtcgcgctggcccgctcgctggtcaagcgtccgaagctcttgctgctcgacgagccgatgtccgcgctcgacaagaagatccgccagaagacccagctcgaactcgtgaacatcatcgagcaggtcgacgtgacctgcgtgatggtcacgcacgaccaggaagaggcgatgacgatggccagccgcctcgcagtgatgagcgaaggcaagatcgtgcagatcggtgcgcctggcgaggtgtacgagtttccgaacagccgcttctcggccgaattcatcggctcgacgaacctgttcgaagggcgtgtggtcgaggacgagcccgatcacatcttcgtcgaaagtgacgacctcgaagcgcgcatgcatgtgaaccatggtgtcaccggcccgctcgggatgccggtcggcatctcggtgcgccccgaacgcattcacgtgtcgcgcgagaaacccggttcgaaacacaactgggcgcgcggcgtcgtgaccgacatcgcgtacatgggcagctactcgctgtatcacgtgcgcttgccgagcggcaagacggtggtgtcgaacctgtcgagctcgcacctgatgaccgacaacgcaccggcgtggaacgacgacgtgttcgtgtcgtggtcgccggccagcggcgtcgtgctgacgcagtga

SEQ ID NO: 66107 - protein, 379 aa, Burkholderia sp. 383
MIHTLPAAPVAADARRDAGAFVRIENVVKKFGDSTAVDNVNLTIAKNELFALLGSSGCGKSTLLRMLAGLETATSGKIFVDGEDLASLPPYRRPVNMMFQSYALFPHMSVESNVAFGLKQEGTPKHEIRERVADALALVQMSKYAQRKPHQLSGGQQQRVALARSLVKRPKLLLLDEPMSALDKKIRQKTQLELVNIIEQVDVTCVMVTHDQEEAMTMASRLAVMSEGKIVQIGAPGEVYEFPNSRFSAEFIGSTNLFEGRVVEDEPDHIFVESDDLEARMHVNHGVTGPLGMPVGISVRPERIHVSREKPGSKHNWARGVVTDIAYMGSYSLYHVRLPSGKTVVSNLSSSHLMTDNAPAWNDDVFVSWSPASGVVLTQ

SEQ ID NO: 66108 - DNA, 1161 bp, Burkholderia sp. 383
  CDS (1)..(1161): transl_table=11
atgaatagccagtcgggtgcgccggtcgcgggcgcgccgtcctccgtttcctcctccggcgccgatgcgcgcgccgagacctttgtccagatcgtcgacgtcgtcaagaaattcggcgacaccgaagccgtgcgcagcgtcaacctgaccgtgcgccagggcgagctgttcgcgctgctcggcagttcgggctgcggcaagtcgacgttgttgcggatgctcgcgggcctcgagacggtcacgtcgggcaagatcctgatcgacggcgaggacctcgcgcagatgccgccgtacaagcggcctgtgaacatgatgttccagtcgtatgcgctgttcccgcacatgtcggtcgagtcgaacgtcgcgttcggcctcaagcaggaaggcacgccgaaggccgagctgaaggagcgtgtcgcatccgcgctcgaactcgtgcagatgagcaagtacgcgaagcgcaagccgcatcagttgtccggcggccagcagcagcgtgtcgcgctcgcgcgctcgctggtcaagcggccgaagctgctgctgctcgatgagccgatgtccgcgctcgacaagcagatccgccagcgcacgcagatcgagctcgtcaacatcctgaacaaggtcggcgtcacctgcatcatggtcacgcacgaccaggaagaagcgatgacgatggccaatcgtctcgcggtgatgagcgaagggcagatcgtgcagatcggctcgccgaacgaagtgtacgaatatccgaacagccgcttctcggccgaattcatcggctcgacgaacctgttcgacggcgtcaccgtcgaggacgaacccgaccacgtgtacatcgagtcgccggagctgccgagccggctgtacgtcagccacgggatctcgggcccgctcgggatgccggtcacggtgtcggtgcgccccgaacggatcgcgctcacgcgcaagccgcccgaaggcgcgttcaactgggcgcgcggccggatcagcaacgtcgcatatatgggcggctactcgctgtatcacgtgaagctcgatgcgggcaagacggtgatcgcgaacgtatcgagccttgcgatttcggagctcgacacgccggcgctcggcgacgagatctacgtgcgctggagcgcgaccgcgggcgtggtgctgacgtcatga

SEQ ID NO: 66109 - protein, 386 aa, Burkholderia sp. 383
MNSQSGAPVAGAPSSVSSSGADARAETFVQIVDVVKKFGDTEAVRSVNLTVRQGELFALLGSSGCGKSTLLRMLAGLETVTSGKILIDGEDLAQMPPYKRPVNMMFQSYALFPHMSVESNVAFGLKQEGTPKAELKERVASALELVQMSKYAKRKPHQLSGGQQQRVALARSLVKRPKLLLLDEPMSALDKQIRQRTQIELVNILNKVGVTCIMVTHDQEEAMTMANRLAVMSEGQIVQIGSPNEVYEYPNSRFSAEFIGSTNLFDGVTVEDEPDHVYIESPELPSRLYVSHGISGPLGMPVTVSVRPERIALTRKPPEGAFNWARGRISNVAYMGGYSLYHVKLDAGKTVIANVSSLAISELDTPALGDEIYVRWSATAGVVLTS

SEQ ID NO: 66110 - DNA, 1155 bp, Burkholderia sp. 383
  CDS (1)..(1155): transl_table=11
atgcaatcgataccctcttccgctgctgcacgacagacccaaccggcccccgcggcccgtacgcaaaacgacgctttcgtgcgcatcgaaaacgtcgtgaagaaattcggcgacagcaccgccgtcgacaacgtgaacctgacgatcgcgaagaacgagctgttcgcgctcctcggcagctcgggctgcggcaagtcgacgttgctgcgcatgctcgccggtctcgagacggccacctccggcaagatcttcgtcgacggcgaagatctcgcgtcgctgccgccgtatcgccgcccggtgaacatgatgttccagtcgtacgcgctgttcccgcacatgacggtcgaatcgaatgtcgcattcggcttgaagcaggaaggcacgccgaagaatgagatcaaggagcgcgtggccgatgcgctcgcactcgtgcagatgagcaagtacgcgcagcgcaagccgcaccagctctccggcggccagcagcagcgcgtcgcgttggcccgctcgctggtgaaacgcccgaagctcctgctgctcgacgagccgatgtccgcgctcgacaagaagatccgccagaagacccagctcgaactcgtgaacatcatcgagaaggtcgacgtgacctgcgtgatggtcacgcacgaccaggaggaggcgatgacgatggcgagccgcctcgcggtgatgagcgaaggcaagatcgtgcagatcggcgcgccgggcgaagtctacgaattcccgaacagccgcttctcggccgaattcatcggctcgaccaacctgttcgaagggcgtgtggtcgaggacgagccggatcacatcttcgtcgaaagcgacgacctcgaagcgcgcatgtacgtgagccacggcatcacgggcccgctcggcatgccggtcggcatctcggtgcgtccggaacgcattcacgtgtcgcgcgagaaaccggggtcgaagcataactgggcgcgcggcgtcgtgaccgacatcgcgtacatgggcagctactcgctgtatcacgtgcgcttgccgagcggcaagacggtggtgtcgaacctgtcgagctcgcacctgatgaccgacaacgcaccggcgtggaacgacgacgtgttcgtgtcgtggtcgccggccagcggcgtcgtgctgacgcagtga

SEQ ID NO: 66111 - protein, 384 aa, Burkholderia sp. 383
MQSIPSSAAARQTQPAPAARTQNDAFVRIENVVKKFGDSTAVDNVNLTIAKNELFALLGSSGCGKSTLLRMLAGLETATSGKIFVDGEDLASLPPYRRPVNMMFQSYALFPHMTVESNVAFGLKQEGTPKNEIKERVADALALVQMSKYAQRKPHQLSGGQQQRVALARSLVKRPKLLLLDEPMSALDKKIRQKTQLELVNIIEKVDVTCVMVTHDQEEAMTMASRLAVMSEGKIVQIGAPGEVYEFPNSRFSAEFIGSTNLFEGRVVEDEPDHIFVESDDLEARMYVSHGITGPLGMPVGISVRPERIHVSREKPGSKHNWARGVVTDIAYMGSYSLYHVRLPSGKTVVSNLSSSHLMTDNAPAWNDDVFVSWSPASGVVLTQ

SEQ ID NO: 66112 - DNA, 1092 bp, Burkholderia sp. 383
  CDS (1)..(1092): transl_table=11
atggcaccttatctgagcgcagaacgcatcgagaagcggtacaacgacacgcaggtcctgaccgacatcaacctgagcgtgatgaagggcgaaatgatctgcttcctggggccgtccggctgcgggaagaccacgctgctgcggatcatcgcggggctcgagacgcagaacgccggccacatcatgcaggacggccgcgacatctcgcggctgccgccgcaactgcgcgactacgggatcgtgttccagtcgtacgcgctgttccccaacctcacggtgtacgacaacgtcgcgtacgggctcgtgaaccgcaagatgaagcgcgacgcgatccacgagcgcgtgcacacgctgctcgcgctggtcggcctgcccgacagccatcgcaagcatccgggccagttgtccggcggccagcagcagcgcatcgcactggcacgcgcgctcgccacctcccccggcctgctgctgctcgacgagccgctgtcggcgctcgacgcgcgggtgcgcgtgcggttgcgccaggagattcgcgcgctgcagcagcggctcggcgtgacgacgatcatggtcacgcacgaccaggaagaagcgctgtcgatggccgaccgcatcgtcgtgatgaaccacggcgtgatcgagcagatcggcacgccgctcgaaatctaccggcagccggcgtcgccgttcgtcgcggacttcatcggccgcgtgaacacgattcccgccgaagtcgcgcaggacggcacgctgcgcgcgggcgcggtcggcctcgactgccgtcatggcacggcacgccccgcgcaaggcgcggcggtgtcggtgtacgtgcggccggaagacctgcgcatccgcgtaccgggcgagacggccgacaacgtgctggccggccgcgtcgagaagctcgaattcctcggtgcgttctgccgcgtgagcttccggatcgacgggctcgacggccaggagatcgtcgccgacctgtcgtatcacgacgtcgaccgcaccggcgtgcaggccggcgcgcgcatcgacctcgcgctcgatcgcgagcatgtccgcgtgttcccgagcgcgaaggagcgactgcaatga

SEQ ID NO: 66113 - protein, 363 aa, Burkholderia sp. 383
MAPYLSAERIEKRYNDTQVLTDINLSVMKGEMICFLGPSGCGKTTLLRIIAGLETQNAGHIMQDGRDISRLPPQLRDYGIVFQSYALFPNLTVYDNVAYGLVNRKMKRDAIHERVHTLLALVGLPDSHRKHPGQLSGGQQQRIALARALATSPGLLLLDEPLSALDARVRVRLRQEIRALQQRLGVTTIMVTHDQEEALSMADRIVVMNHGVIEQIGTPLEIYRQPASPFVADFIGRVNTIPAEVAQDGTLRAGAVGLDCRHGTARPAQGAAVSVYVRPEDLRIRVPGETADNVLAGRVEKLEFLGAFCRVSFRIDGLDGQEIVADLSYHDVDRTGVQAGARIDLALDREHVRVFPSAKERLQ

SEQ ID NO: 66114 - DNA, 1107 bp, Burkholderia sp. 383
  CDS (1)..(1107): transl_table=11
atgaagtccgatgatgtgatcgtcagctttcgcggcgtgcggaagacctacgacggcgaaacgctggtcgtcaaatcgctcgacctcgatatccaccgcggggaattcctgacgctgctcgggccgtcgggctcgggcaagaccacctgcctgatgatgctggccggcttcgaattcccgaccggcggcgagatccgcctcgacggcgaactgctgaacaacgtgccgccgcacaagcgcaacatcggcatggtgttccagaactacgcgctgtttccgcacctgacggtcgagcagaacgtcgcgtatccgctgaccgtgcgcaagctgccggccggcgagcgcgcggaacgcgtcgcgcatgcgctgaagatggtacagatggagcgcttcgcgaaacgctacccggcccagttgtcgggcggccagcagcagcgcatcgcgctggcgcgcgcgctcgtgttcgagccgaagctggtgctgatggacgagccgctcggcgcgctcgacaagcaactgcgcgaacacatgcagtacgaactgaaggcgctgcacgaaaagctcggcgtaactttcgtgtacgtgacgcacgaccagggcgaggcgctgacgatgtccgatcgcgtcgccgtgttcgacaagggcatcgtgcagcagctcgacaccgtcgaccgcctgtacgaatcgccctgcaacgaattcgtcgcgaacttcatcggcgacagcaaccggctgcgcggcaccatcgcgcgcgtcgacggcgaattctgcgaattccggctcgacgacggcacgaagctcgtcggccgccgcatcggcgatgcggccgagggggcgccggctgtcgcgtgcatccgccccgaacgcatgagcctcgccgcgcacggcgcgaacgggcacgcgaacggctcggccgccaaccggttgagcggcgaggcgcgcagcctcatctatttcggcgatcacgtgcgcatgcgctgtgcgctgcccggccaggacgaatgcttcgtgaaggtgccgctcggcaccggcgcgatcgatgcgttctcgcccggcgcaccggtcgcgctcgcatttgcacccgaacacctgcgcgtgttcgcttga

SEQ ID NO: 66115 - protein, 368 aa, Burkholderia sp. 383
MKSDDVIVSFRGVRKTYDGETLVVKSLDLDIHRGEFLTLLGPSGSGKTTCLMMLAGFEFPTGGEIRLDGELLNNVPPHKRNIGMVFQNYALFPHLTVEQNVAYPLTVRKLPAGERAERVAHALKMVQMERFAKRYPAQLSGGQQQRIALARALVFEPKLVLMDEPLGALDKQLREHMQYELKALHEKLGVTFVYVTHDQGEALTMSDRVAVFDKGIVQQLDTVDRLYESPCNEFVANFIGDSNRLRGTIARVDGEFCEFRLDDGTKLVGRRIGDAAEGAPAVACIRPERMSLAAHGANGHANGSAANRLSGEARSLIYFGDHVRMRCALPGQDECFVKVPLGTGAIDAFSPGAPVALAFAPEHLRVFA

SEQ ID NO: 66116 - DNA, 1155 bp, Burkholderia sp. 383
  CDS (1)..(1155): transl_table=11
atgaaacgggattcattcagtacacctgatgcgatgcatcgaccgccgacgaccatgctcaagccgaacgacacgttcgtgcgcatcgaaaacgtcgtgaagaaattcggcgacagcaccgccgtcgacaacgtgaacctgacgatcgcaaagaacgagctgttcgcgctgctcggcagctccggctgcggcaagtcgacgttgctgcgcatgctcgccgggctcgagacggctacgtccggcaagatcttcgtcgacggcgaagatctcgcgtcgctgccgccgtaccgccgcccggtgaacatgatgttccagtcgtacgcgctgttcccgcacatgacggtcgaatcgaacgtcgcattcggcctgaagcaggaaggcacgccgaagaatgagatcaaggagcgcgtggccgatgcgctcgcactcgtgcagatgagcaagtacgcgcagcgcaagccgcaccagctctccggcggccagcagcagcgcgtcgcgttggcccgctcgctggtgaaacgcccgaagctgctgctgcttgacgagccgatgtccgcgctcgacaagaagatccgccagaagacccagctcgaactcgtgaacatcatcgagaaggtcgacgtgacctgcgtgatggtcacgcacgaccaggaagaggcgatgacgatggccagccgcctcgcggtgatgagcgaaggcaagatcgtgcagatcggtgcgccgggcgaagtctacgaattcccgaacagccgcttctcggccgaattcatcggctcgaccaacctgttcgaagggcgtgtggtcgaggacgagcccgatcacatcttcgtcgaaagcgacgacctcgaagcgcgcatgtacgtgagccacggtatcacgggcccgctcgggatgccggtcggcatctcggtgcgcccggaacgcattcacgtgtcgcgcgaaaaaccgggttcgaaacacaactgggcgcgcggcgtcgtgaccgacatcgcgtacatgggcagctactcgctgtatcacgtgcgcttgccgagcggcaagacggtggtgtcgaacctgtcgagctcgcacctgatgaccgacaacgcaccggcgtggaacgacgacgtgttcgtgtcgtggtcgccggccagcggcgtcgtgctgacgcagtga

SEQ ID NO: 66117 - protein, 384 aa, Burkholderia sp. 383
MKRDSFSTPDAMHRPPTTMLKPNDTFVRIENVVKKFGDSTAVDNVNLTIAKNELFALLGSSGCGKSTLLRMLAGLETATSGKIFVDGEDLASLPPYRRPVNMMFQSYALFPHMTVESNVAFGLKQEGTPKNEIKERVADALALVQMSKYAQRKPHQLSGGQQQRVALARSLVKRPKLLLLDEPMSALDKKIRQKTQLELVNIIEKVDVTCVMVTHDQEEAMTMASRLAVMSEGKIVQIGAPGEVYEFPNSRFSAEFIGSTNLFEGRVVEDEPDHIFVESDDLEARMYVSHGITGPLGMPVGISVRPERIHVSREKPGSKHNWARGVVTDIAYMGSYSLYHVRLPSGKTVVSNLSSSHLMTDNAPAWNDDVFVSWSPASGVVLTQ

SEQ ID NO: 66118 - DNA, 1122 bp, Desulfovibrio desulfuricans G20
  CDS (1)..(1122): transl_table=11
atggctgaacaggattacatattcgagctgcgcggagtatcaaaatacttcgacgacacctgtgcgctcgaaaatatagatctgcagatcagaaacggcgagttccttacgctgctgggcccttcgggctgcggaaaaacaaccattctgcgtcttctttccggattcgaaacgccctcatcgggcgatgtcatcctgagcggccgtgtggtgaacgacgttccgcccgagcagcgtcaggtaaacaccgtgtttcagaattatgcgctttttccgcatatgacggtgcgtgataacgtgggcttcgggctgaaaatgcagaaacgtccgaaggatgaaatagccagacgtgtgcgcgaagcactgaagatggtgcatctggagcagttcggcgaccgcaagcccgcgcggctttccggcgggcagcagcaacgtgtggccattgcccgcgcagtggtgaacaacccctatgtgctgctgctggacgaacccttcagcgcccttgattttaagctgcgcaaaaaaatgcagctggaaatcaagcatctgcagcgtcagctgggcatcacctttgtctttgtgacacacgatcaggaagaggcgtttgccatgtccgaccgtgtggtggtgatgaatgacggccgcattgaacagataggctcgccgcaggaaatatacgaagaaccggccaacctgtatgtggcccgttttgtgggcgacataaacatactggacggtaccataaccgcccgccgcaacggcgtgctgtatgacgccacgctggaaggcgtgccttttcccgtgcagaccggaaagcagtttgaaaccggcgaccgcgtcaaggttctgctgcgtcccgaagacatccgcctgcacatgatgcacgacctgccggatggtgaatactttaccggcgccattgaagaaaccgtgtacaaaggcgccaccgttgatattgtggtgcggctggacagccccagcgaaggacagcccggcaaacagctgctggttgcagaattcttcaacgaggatgacgaagaaatcaactacactccgggcgaacgcgtggccgtcacctgggtaaacggctgggaggtagtgctgggagatgatggggagtaa

SEQ ID NO: 66119 - protein, 373 aa, Desulfovibrio desulfuricans G20
MAEQDYIFELRGVSKYFDDTCALENIDLQIRNGEFLTLLGPSGCGKTTILRLLSGFETPSSGDVILSGRVVNDVPPEQRQVNTVFQNYALFPHMTVRDNVGFGLKMQKRPKDEIARRVREALKMVHLEQFGDRKPARLSGGQQQRVAIARAVVNNPYVLLLDEPFSALDFKLRKKMQLEIKHLQRQLGITFVFVTHDQEEAFAMSDRVVVMNDGRIEQIGSPQEIYEEPANLYVARFVGDINILDGTITARRNGVLYDATLEGVPFPVQTGKQFETGDRVKVLLRPEDIRLHMMHDLPDGEYFTGAIEETVYKGATVDIVVRLDSPSEGQPGKQLLVAEFFNEDDEEINYTPGERVAVTWVNGWEVVLGDDGE

SEQ ID NO: 66120 - DNA, 1137 bp, Shigella boydii Sb227
  CDS (1)..(1137): transl_table=11
atgggacagagtaaaaaattgaataaacaaccgagttcgctttcaccgctggtgcaattggcgggaattcgcaaatgctttgatggtaaagaggtcattccccagctggatctgactatcaacaatggcgagttcctcacgctgcttggcccttctggctgcggtaaaacaaccgttcttcgcctgattgcaggtctggaaactgttgattccggacgcatcatgctggataacgaggacatcacccacgttccggcggaaaaccgctatgtgaacactgttttccaaagctacgcacttttcccccacatgaccgtgttcgaaaatgtggcctttgggttgcgcatgcaaaaaacccccgctgctgaaattacgccccgcgtgatggaagccctgcggatggtgcaactggaaaccttcgctcaacgtaaaccgcatcagctctctggtggtcaacagcaacgcgtcgccattgctcgcgcggtggttaacaagcctcgtctgttgttgctggatgagtcgctctcagcgctggattacaaactgcgtaagcaaatgcagaacgagctgaaagcgttacagcgtaagcttggcattacattcgtcttcgtgactcacgaccaggaagaagcactcaccatgtcagacaggattgtggtgatgcgcgagggtcgcattgagcaagacggcacgccgcgtgaaatctacgaagagccgaaaaacctgtttgttgccggcttcattggcgaaattaatatgtttaacgccacggtgatcgagcgactcgacgagcagcgcgtacgcgccaacgttgaaggccgcgaatgtaatatctacgttaacttcgccgttgaaccggggcaaaaactgcatgttctgctgcgcccggaagacttacgtgttgaagagattaacgacgacaaccacgctgaagggctgattggttacgttcgtgagcgtaactacaaaggcatgacgctggagtcggttgttgaactggaaaatggcaagatggtgatggtcagcgaattcttcaatgaagacgatcctgactttgaccactctctcgaccaaaaaatggccattaattgggtagaaagctgggaggtcgtactggctgatgaagaacacaagtaa

SEQ ID NO: 66121 - protein, 378 aa, Shigella boydii Sb227
MGQSKKLNKQPSSLSPLVQLAGIRKCFDGKEVIPQLDLTINNGEFLTLLGPSGCGKTTVLRLIAGLETVDSGRIMLDNEDITHVPAENRYVNTVFQSYALFPHMTVFENVAFGLRMQKTPAAEITPRVMEALRMVQLETFAQRKPHQLSGGQQQRVAIARAVVNKPRLLLLDESLSALDYKLRKQMQNELKALQRKLGITFVFVTHDQEEALTMSDRIVVMREGRIEQDGTPREIYEEPKNLFVAGFIGEINMFNATVIERLDEQRVRANVEGRECNIYVNFAVEPGQKLHVLLRPEDLRVEEINDDNHAEGLIGYVRERNYKGMTLESVVELENGKMVMVSEFFNEDDPDFDHSLDQKMAINWVESWEVVLADEEHK

SEQ ID NO: 66122 - DNA, 1074 bp, Rhodobacter sphaeroides 2.4.1
  CDS (1)..(1074)
atgatcgagttccgcgacgtccacaaatattacggcgactatcacgcgctgcgcggcatctcggccacgatccgggcgggcgagttcttctcgctgctcgggccctcgggctgcggcaagaccacgctcctgcgcaccatcgcggggttcgaggagatctcgtcgggggtggtgctgatcgacggcaaggacaccaggggggtgcccgccaacaagcggcccaccaacatggtgttccagagctatgcgatcttcccgcatctgacggtggccgagaacgtgggcttcggcctgcgccgcgcgaacctctcgaaggaggagacgacgcgacgtgtggccgaggcgctggagatggtggggctgcgcggctacggcgcgcgggcggcccatgcgctctcgggcgggcagcggcagcgggtggcgctggcgcgcgcgctgatcctgaagcccaaggtgctgctcctggacgagccgctctcggcgctcgacaagaagatgcgcgagcagatgcaggtcgagctcatcaagctgcagcggcaggtgggcatcaccttcatcctcgtgacgcacgatcaggaagaggcgctggtcatgtccgaccggatcgccgtcatgttcgagggcgagatcgcgcagctggccgatcccgagacgctctatcggcggccaacctcgcgcaaggtggccgatttcatcgggacgatgaacttcctgccggcgcggatcctgagcgagacccagcaggggatcgaggtcgaggcgcaggggctcgggcggatgctgctcgatccgatgcaggcgccgggcgcggcctcgggcaccggcgtcaccgtgggctttcgacccgagacggcgacgatcctcttcgaggggcagaaggccgaccgcgaggccatggggaccatcgaggaggtcgtctactacggcgacatgacctattacgacatccgcctagacggcaccgaggcgcccatccggctctccatgcgcaacgtcttcggccgcgcggtgctggagatcggcgcgcgggcccgcgtcgcctggagccccggggcgctggtcctgttccgctga

SEQ ID NO: 66123 - protein, 357 aa, Rhodobacter sphaeroides 2.4.1
MIEFRDVHKYYGDYHALRGISATIRAGEFFSLLGPSGCGKTTLLRTIAGFEEISSGVVLIDGKDTRGVPANKRPTNMVFQSYAIFPHLTVAENVGFGLRRANLSKEETTRRVAEALEMVGLRGYGARAAHALSGGQRQRVALARALILKPKVLLLDEPLSALDKKMREQMQVELIKLQRQVGITFILVTHDQEEALVMSDRIAVMFEGEIAQLADPETLYRRPTSRKVADFIGTMNFLPARILSETQQGIEVEAQGLGRMLLDPMQAPGAASGTGVTVGFRPETATILFEGQKADREAMGTIEEVVYYGDMTYYDIRLDGTEAPIRLSMRNVFGRAVLEIGARARVAWSPGALVLFR

SEQ ID NO: 66124 - DNA, 1116 bp, Rubrivivax gelatinosus PM1
  CDS (1)..(1116)
atggcgaacgacaacggcggcgcaaaggccgccagcggctacctgcagatccaggacgtggtgaaggacttcggcggcggtgccgtcgcggtcaaccacgtcagcatcgacatcgcccagggcgaaatctttgcgctgctgggctcgtcgggctgcggcaagaccacgctgctgcggatgctggcgggcttcgagacgccgacgtccgggcgcatcgtgctcaacgggcaggacctggccggcatgccgccctacgagcggccgatcaacatgatgttccagtcgtatgcgctgttcccgcacctcacggtgtgggacaacatcgcgttcggcctgcgtcgcgacggcatgccccgggatgaggtcgcgcagcgggtcgacgcgatgctcaagctggtccagctcggcaagtacggcaagcgcaagccgcaccagctctcgggtggtcagcagcagcgtgtcgcgctggcgcgcagcctggccaagcggcccaagctgctgctgctcgacgagccgctcggcgcgctcgacaagaagctgcgcgaggaaacgcagatcgagctggtcaacatcatcgaggaggtcggcgtgacctgcgtgatggtgacgcacgaccaggaagaagccatgaccatggcctcgcgcatcgcgatcatgagcgagggcaaggtgctgcaggtcggtgcgccggccgacgtctacgagacgccggccacgcgcttcgtggccgacttcatcggcaacgtgaacctgatggaagggacactgagcgaggaccaccccgatcacgttgtgatctcctgcaaggactgcagccacctcgtcggtcacggcatcaccggcaccgagggcatgacggtcagcgtcgcggtgcgacccgagaaaatcggcctcggccccgacgagccaccgggcccgcacaaccgcgcgcgcggcacgatcaaggacctgtcctacttcggcagcttcaccgtctaccacctccagctcgacagcggcgccgtgctgaagatcagccagagcaacgtcgagcggcatcgcgacgtcgagctgacctggggcgacaccgcctgggcctcgtggtcgccgtcgtcgcaagtggtgctgacgcaatga

SEQ ID NO: 66125 - protein, 371 aa, Rubrivivax gelatinosus PM1
MANDNGGAKAASGYLQIQDVVKDFGGGAVAVNHVSIDIAQGEIFALLGSSGCGKTTLLRMLAGFETPTSGRIVLNGQDLAGMPPYERPINMMFQSYALFPHLTVWDNIAFGLRRDGMPRDEVAQRVDAMLKLVQLGKYGKRKPHQLSGGQQQRVALARSLAKRPKLLLLDEPLGALDKKLREETQIELVNIIEEVGVTCVMVTHDQEEAMTMASRIAIMSEGKVLQVGAPADVYETPATRFVADFIGNVNLMEGTLSEDHPDHVVISCKDCSHLVGHGITGTEGMTVSVAVRPEKIGLGPDEPPGPHNRARGTIKDLSYFGSFTVYHLQLDSGAVLKISQSNVERHRDVELTWGDTAWASWSPSSQVVLTQ

SEQ ID NO: 66126 - DNA, 1122 bp, Microbulbifer degradans 2-40
  CDS (1)..(1122)
atgactaagaacccgacagcaatagaagacgctggcgatgagcctatcgtacagctacaaaacctcaccaaaacatttggcgctaattacgcagtagatgatattagcctcaccatttacaagggcgaatttttctcgttgcttggcgcatccggttgcggtaaatcgaccctactgcgcatgctcgcgggttttgaacaacccacaagtggacaaatttttatcgacggccaagaaatatctaaagttccggcttataaacgccctattaatatgatgtttcaaaactacgcactgtttccacatatgaacgtagcggacaacattggctttgggctaaagcaagaaggcatgccgcaaaatttgcgcaatgaacgcatcgccgaaatgatgagccttgtgcaaatagaaaaatttgcaaagcgtaaaccacaccaacttagtggcgggcaacgccagcgggttgcacttgcgcgcgcactggcaaaacaccctaaaattttattgttagatgaaccattgggcgcactagacaaaaaattgcgcgaaaaaacgcaatttgaattaatgaacattcaaaaccggttgggcacaacatttatcgtggtaacccacgatcaagaagaagcgatgactatgtcttcgcgtatagcgcttatgcgcgaaggtcgcattgaacaagttgacgccccccgccgcatgtacgagttccccactacgcgttatgcagctgactttattgggctaattaatttatttgagggcaaggtcgttacccaaacaggcgacgaagtaactattagctcagaaaccaccggcggcgatatagtggtgcaccatagccaaccactactaccgggcatggatgtgtgcattgctttgcgcccagaaaaactggtactgcacgcgcaacacgaaaatattcccaaccgcattgaaggtgttattcgcgaaattgcatacctaggcgatgtatctatttaccatgtagagcttgcctctgggtatatcgcgcgttttacccaatcgaatattttagcactagccgagcaaccgttaacatgggggcaaacggtaagtttgggctggcacaaccacagctgcggagtactcacccagtga

SEQ ID NO: 66127 - protein, 373 aa, Microbulbifer degradans 2-40
MTKNPTAIEDAGDEPIVQLQNLTKTFGANYAVDDISLTIYKGEFFSLLGASGCGKSTLLRMLAGFEQPTSGQIFIDGQEISKVPAYKRPINMMFQNYALFPHMNVADNIGFGLKQEGMPQNLRNERIAEMMSLVQIEKFAKRKPHQLSGGQRQRVALARALAKHPKILLLDEPLGALDKKLREKTQFELMNIQNRLGTTFIVVTHDQEEAMTMSSRIALMREGRIEQVDAPRRMYEFPTTRYAADFIGLINLFEGKVVTQTGDEVTISSETTGGDIVVHHSQPLLPGMDVCIALRPEKLVLHAQHENIPNRIEGVIREIAYLGDVSIYHVELASGYIARFTQSNILALAEQPLTWGQTVSLGWHNHSCGVLTQ

SEQ ID NO: 66128 - DNA, 1152 bp, Azotobacter vinelandii AvOP
  CDS (1)..(1152): transl_table=11
atggcgactgtcgccggtgttaacacgaatgctctcgccgccgatcagccggcgaaggaggtgctggtcaggatcgaccgggtgaccaagaagttcgacgccatggtggcggtggacggcatttccctgtccatccacaagggcgagatcttcgccctgctcggcggctccggctgcggcaagtcgaccctgctgcgcatgctcgccggtttcgagcggccgaccgaggggcgcatccatctggaagggcaggacatcaccgagctgccgccctacgagcggccgatcaacatgatgttccagtcctacgcgctgttcccgcacatgagcgtggagcagaacatcgccttcggcctcaagcaggaccgcctgcccagggccgagatcgacgagcgcgtggcggaaatgctcaggctggtgcagatgaccgagtacgcccggcgcaagccccaccagctctccggtggtcagcgccagcgcgtggcgctggcccgttcgctggcgaagcggccgaagttgctgctgctcgacgaaccgatgggcgcgctggacaagaagctgcgctcgcagatgcaactggaactggtgcagatcatcgagcgggtcggcgtgacctgcgtgatggtcacccacgatcaggaggaggcgatgaccatggccgcgcgcatcgccatcatgcatcaggggcggatcgtccaggtcggcagcccgatggacatctacgagagtccggccaaccggttggtctgcgagttcatcggcaacgtcaacctgttcgacggcgaactggtggacgacagccccgaccatgcggtcgtcgcctcgccgcaactggagcggcccatctacatcggccacggcatttccacccgcgccgaggaaaagcgcgtcacctacgccctgcgcccggaaaaggtgctgctcggcgcggacaagcccgagctgcagcacgaggggcacaactggtcgcaggggcgggtgaaggacatcgcctacctgggcgggcattccatgtactacgtcgagctgccctcgggacaggtggtgcaggccttcatggccaatgccgagcgccacggccagcggccgacctggggtgaccaggtgtacgtcagttggctcgacgacagcggggtggtgctgcacgcatga

SEQ ID NO: 66129 - protein, 383 aa, Azotobacter vinelandii AvOP
MATVAGVNTNALAADQPAKEVLVRIDRVTKKFDAMVAVDGISLSIHKGEIFALLGGSGCGKSTLLRMLAGFERPTEGRIHLEGQDITELPPYERPINMMFQSYALFPHMSVEQNIAFGLKQDRLPRAEIDERVAEMLRLVQMTEYARRKPHQLSGGQRQRVALARSLAKRPKLLLLDEPMGALDKKLRSQMQLELVQIIERVGVTCVMVTHDQEEAMTMAARIAIMHQGRIVQVGSPMDIYESPANRLVCEFIGNVNLFDGELVDDSPDHAVVASPQLERPIYIGHGISTRAEEKRVTYALRPEKVLLGADKPELQHEGHNWSQGRVKDIAYLGGHSMYYVELPSGQVVQAFMANAERHGQRPTWGDQVYVSWLDDSGVVLHA

SEQ ID NO: 66130 - DNA, 1161 bp, Burkholderia vietnamiensis G4
  CDS (1)..(1161): transl_table=11
atgaatagccagtcgggcgcgccggtcgcgggtgcgccgtccttcgttccttcttccggcgccgcgtcgcgcgcggagaactttgtccagatcgtcgacgtcgtcaagaagttcggcgaaaccgaagtggtccgcaatgtgaacctcacggtgcgccagggcgagctgttcgcgctgctgggcagctcgggttccggcaagtcgacgctgctgcggatgctcgccggcctcgagacggtcacgtcgggcaagatcctgatcgacggcgaagacctcgcgcaaatgccgccgtacaagcggcccgtgaacatgatgttccagtcgtatgcgctgttcccgcacatgtcggtcgaggcgaacgtcgcgtacggcctgaagcaggaaggcacgccgaaggccgagctgaaggagcgtgtggccgccgcgctcgagctcgtgcagatgagcaagtacgcgaagcgcaagccgcatcagttgtcgggcggccagcagcagcgcgtcgcgctcgcacgctcgctggtcaagcgtccgaaggtgctgctgctcgacgagccgatgtcggcgctcgacaagcagatccgccagcgtacgcagatcgagctcgtcaacatcctgcagaaggtcggcgtcacctgcatcatggtcacgcacgaccaggaagaggcgatgacgatggccaaccggctcgcggtgatgagcgaagggcagatcgtgcagatcggctcgccgagcgaggtctacgaatatccgaacagccgcttctcggccgagttcatcggctcgacgaacctgttcgagggcatcaccgtcgaggacgaacccgactacgtgtacatcgaatcgcccgagctgccgagccggctgtacgtgagccacggcatcaccggcccgctcgggatgccggtcacggtgtcggtgcgccccgagcgcatcgcgctgacccgcaagccgcccgaaggcgcgttcaactgggcgcacggccggatcgccaacgtcgcgtacatgggcggctattcgctgtatcacgtgaagctcgacgcgggcaagacggtgatcgcgaacgtgtcgagcctcgcgatcagcgagctcgaaacgcccgcgctcggcgacgagatctacgtgcgctggagcgcgaccgccggcgtggtgctgacgtcatga

SEQ ID NO: 66131 - protein, 386 aa, Burkholderia vietnamiensis G4
MNSQSGAPVAGAPSFVPSSGAASRAENFVQIVDVVKKFGETEVVRNVNLTVRQGELFALLGSSGSGKSTLLRMLAGLETVTSGKILIDGEDLAQMPPYKRPVNMMFQSYALFPHMSVEANVAYGLKQEGTPKAELKERVAAALELVQMSKYAKRKPHQLSGGQQQRVALARSLVKRPKVLLLDEPMSALDKQIRQRTQIELVNILQKVGVTCIMVTHDQEEAMTMANRLAVMSEGQIVQIGSPSEVYEYPNSRFSAEFIGSTNLFEGITVEDEPDYVYIESPELPSRLYVSHGITGPLGMPVTVSVRPERIALTRKPPEGAFNWAHGRIANVAYMGGYSLYHVKLDAGKTVIANVSSLAISELETPALGDEIYVRWSATAGVVLTS

SEQ ID NO: 66132 - DNA, 1191 bp, Burkholderia vietnamiensis G4
  CDS (1)..(1191): transl_table=11
atgcctgcaatccgtgaagaacgaatggtgaatcccatgcaatcgataccctcttccgctgctgcacgccaggcccagccggccgccgtggcccgttcgaagaacgacgcgttcgtgcgcatcgaaaacgtcgtgaagaagttcggcgacagcacggccgtcgacaacgtgaacctgaccatcgcgaagaacgagctgttcgcgctgctcggcagctcgggctgcggcaagtcgacgttgctgcgcatgctggccggcctcgagacggccacctccggcaagatcttcgtcgacggcgaagacctcgcgtcgctgccgccgtaccgccggccggtgaacatgatgttccagtcgtacgcgctgtttccgcacatgtcggtcgagtcgaacgtcgcgttcgggctcaagcaggaaggcacgccgaagaacgagatcaaggagcgcgtggccgacgcgctcgcgctcgtgcagatgagcaagtacgcgaagcgcaagccgcatcagctgtcgggcggccagcagcagcgcgtcgcgctcgcgcgctcgctggtcaagcggccgaagctgctgctgctcgacgagccgatgtcggcgctcgacaagaagatccgccagaagacccagctcgaactggtgaacatcatcgagaaggtcgacgtgacctgcgtgatggtcacgcacgaccaggaggaagcgatgacgatggcgagccggctcgcggtgatgagcgaaggcaagatcgtgcagatcggcacgcccggcgaagtctacgaatacccgaacagccgcttctcggccgaattcatcggctcgacgaacctgttcgaggggcgcgtggtcgaggacgaacccgatcacatcttcgtcgagagcgacgacctcgaggcgcgcatgtacgtgaaccacggcgtgaccggcccgctcgggatgccggtcggcatctcggtgcgcccggagcgcgtgaacgtgtcgcgcgagaagcccggctcgcatcacaactgggcgcgcggcgtggtgaccgacatcgcgtacatgggcagctactcgctgtatcacgtgcggctgccgagcggcaagacggtcgtgtcgaacctgtcgagctcgaacctgatgcgcgacgatgcgccgtcgtggaacgacgacgtgttcgtgtcgtggtcgccggcgagcggcgtcgtgctgacgcaatga

SEQ ID NO: 66133 - protein, 396 aa, Burkholderia vietnamiensis G4
MPAIREERMVNPMQSIPSSAAARQAQPAAVARSKNDAFVRIENVVKKFGDSTAVDNVNLTIAKNELFALLGSSGCGKSTLLRMLAGLETATSGKIFVDGEDLASLPPYRRPVNMMFQSYALFPHMSVESNVAFGLKQEGTPKNEIKERVADALALVQMSKYAKRKPHQLSGGQQQRVALARSLVKRPKLLLLDEPMSALDKKIRQKTQLELVNIIEKVDVTCVMVTHDQEEAMTMASRLAVMSEGKIVQIGTPGEVYEYPNSRFSAEFIGSTNLFEGRVVEDEPDHIFVESDDLEARMYVNHGVTGPLGMPVGISVRPERVNVSREKPGSHHNWARGVVTDIAYMGSYSLYHVRLPSGKTVVSNLSSSNLMRDDAPSWNDDVFVSWSPASGVVLTQ

SEQ ID NO: 66134 - DNA, 1155 bp, Burkholderia cenocepacia AU 1054
  CDS (1)..(1155): transl_table=11
atgcaatcgataccctcttccgctgctgcacgccagacccaaccggccgccgcgccccgtacgcaaaacgacgcattcgtgcgcatcgaaaacgtcgtgaagaaattcggcgacagcacggccgtcgacaacgtgaacctgacgatcgccaagaacgagctgttcgcgctgctcggcagctcgggctgcggcaagtccacgctgctgcgcatgctcgccgggctggaaacggccacctccggcaagatcttcgtcgacggcgaggatctcgcgtcgctgccgccgtaccgccgcccggtcaacatgatgttccagtcgtacgcgctgttcccgcacatgacggtcgaatcgaacgtcgcgttcggcctgaagcaggaaggcacgccgaaaaacgagatcaaggagcgcgtggccgacgcgctcgcgctcgtgcagatgagcaagtatgcgaagcgcaagccgcaccagctgtccggcggccagcagcagcgcgtcgcgctggcccgctcgctggtgaagcgcccaaagctgctgctgctcgacgagccgatgtccgcgctcgacaagaagattcgccagaagacccagctcgaactcgtgaacatcatcgagaaggtcgacgtgacctgcgtgatggtcacgcacgaccaggaagaggcgatgacgatggcgagccgcctcgcggtgatgagcgagggcaagatcgtgcagatcggctcgcccggcgaagtctacgaatacccgaacagccgcttctccgccgaattcatcggctcgaccaacctgttcgaggggcgcgtggtcgaggacgagcccgatcacatcttcgtcgaaagcgacgacctcgagacgcgcatgtacgtgagccacggcgtgaccggcccgctcgggatgccggtcggcatctcggtgcgcccggagcgcatccacgtatcgcgcgagaagccgggctcgaagcacaactgggcgcgcggcgtcgtcaccgacatcgcgtacatgggcagctattcgctgtaccacgtgcgtctgccgagcggcaagacggtggtgtcgaacctgtcaagctcgcacctgatgaacgacggcgcaccggcgtggaacgacgacgtgttcgtgtcgtggtcgccggccagcggcgtcgtgctgacgcagtga

SEQ ID NO: 66135 - protein, 384 aa, Burkholderia cenocepacia AU 1054
MQSIPSSAAARQTQPAAAPRTQNDAFVRIENVVKKFGDSTAVDNVNLTIAKNELFALLGSSGCGKSTLLRMLAGLETATSGKIFVDGEDLASLPPYRRPVNMMFQSYALFPHMTVESNVAFGLKQEGTPKNEIKERVADALALVQMSKYAKRKPHQLSGGQQQRVALARSLVKRPKLLLLDEPMSALDKKIRQKTQLELVNIIEKVDVTCVMVTHDQEEAMTMASRLAVMSEGKIVQIGSPGEVYEYPNSRFSAEFIGSTNLFEGRVVEDEPDHIFVESDDLETRMYVSHGVTGPLGMPVGISVRPERIHVSREKPGSKHNWARGVVTDIAYMGSYSLYHVRLPSGKTVVSNLSSSHLMNDGAPAWNDDVFVSWSPASGVVLTQ

SEQ ID NO: 66136 - DNA, 1140 bp, Mesorhizobium sp. BNC1
  CDS (1)..(1140): transl_table=11
atggcatcgctgggcagcattcgcaggagctttgcgccctgggcggaccccagtgcaaagccttatattcgcttcgagaatgtgagcaagcgcttcggcgacttcgtcgccgtggatgacctctcgctgacaatttatgagcgcgaattcttcgcgcttctaggcgcttccggctgcggtaagaccacgcttctgcgaatgctggccggtttcgagcagccgacttccgggcgcatcctgctcgacggacaggatctgctcagggtgccgccttaccgccgtcccgtgaatatgatgttccagtcatatgcgctgttcccgcatatgacggtcgaggccaatatcgccttcgggctcaagcaggacgggatgcccaaggcagaaatcgccgggcgcgtggcgcagatgctgaagctcgtgaagctcgagccatttgcgaaacgcaagccgcaccagctttccggcggccagcgtcagcgcgtggcgctggcgcgctccattgcgaaaaggccgaaggtcctgctgctggatgaaccgctgggagcgctggataagaagctccgcgaggagacccagttcgaactgatggatcttcagcacgacctgggcctcaccttcctggtcgtcacgcatgatcaggaagaggcgatgacgatggccgatcggatcgccatcatggataagggccgagtgttacaggtggcaacccccgcggaagtctatgaagcgccggcgtctcgcttcgttgcggattttgtcggttccatcaacatgttcgagggaagattggtgaaggagaacgccggcatcgcccacatccgcgatgcgagcggcgcggaattctgggtgggaggttcgacgcgcgccgcgcccggcgatacggtctggcttgcgatccgcccggaaaagatgcgcgtttcgcgcgaacgcccgccggaggcagaaaacgcgttcaacggtgagatctgggacatcgcctatcttggcgatatgacgatctacaatgtgaggctggatgatggccggattgtcaaggcgagcatgatcaacagcatgcgccggcttgaggatgcgctcacctggcacgaccgggcctggatctccttctcggccgatgccgtcgtgctgctgacggagtag

SEQ ID NO: 66137 - protein, 379 aa, Mesorhizobium sp. BNC1
MASLGSIRRSFAPWADPSAKPYIRFENVSKRFGDFVAVDDLSLTIYEREFFALLGASGCGKTTLLRMLAGFEQPTSGRILLDGQDLLRVPPYRRPVNMMFQSYALFPHMTVEANIAFGLKQDGMPKAEIAGRVAQMLKLVKLEPFAKRKPHQLSGGQRQRVALARSIAKRPKVLLLDEPLGALDKKLREETQFELMDLQHDLGLTFLVVTHDQEEAMTMADRIAIMDKGRVLQVATPAEVYEAPASRFVADFVGSINMFEGRLVKENAGIAHIRDASGAEFWVGGSTRAAPGDTVWLAIRPEKMRVSRERPPEAENAFNGEIWDIAYLGDMTIYNVRLDDGRIVKASMINSMRRLEDALTWHDRAWISFSADAVVLLTE

SEQ ID NO: 66138 - DNA, 1197 bp, Silicibacter sp. TM1040
  CDS (1)..(1197): transl_table=11
atgcacgccccgcccacctcacctacacaagatgacgggccggtaccaaccgcccgcatgggggaaaacttggcaataccggtattcgaaccctggaccgacccacaggctaagccactgattcagttccagaatgtcaccaaacgctttggcgatttcaccgcaatcgacgacctgacaatcgacatctacgagcgtgagttctttgcgcttctggggccgtctggctgtggcaagaccacgatgatgcgaatgttggccgggtttgaaacaccgacagagggaaagatctttctggccgggcaggatatcgcccccgtcccccccaaccagcgcgcggtcaacatgatgtttcagtcctatgcgctgtttccgcatctcagcgtttgggagaatatcgcctttggactcaagcgcgaaggcctgccccgcaatgagatcaacgcacgcgtcgacgagatgctgcgcctgacgcgactcgaaaaatttgcacgtcgcaagcctcatcagatctcgggaggtcagcggcagcgggttgctctggcccgcagtctggcaaaggcacccaaactgctgcttctggatgagcccctcggggcgctcgacaagaaactgcgcgaagaaacgcagttcgagttgatggacatccaggaaaagaccggcaccacatttgtcatcgtgacccacgaccaggaagaagcgatgaccgtcgcaagccgtgtggccgtgatggacaatggcaaggtgatgcaggtcgcaacccccgccgacatctacgaagccccgaattcagtctatgttgctgattttattggcgacgtgaaccttattgagggcaaggcaactgccacgggcgaagatagctacgctctgcattggcgtgagggcgcagccccgctcactgtaaaatcgcccaacaagatctctgacggccagaaagcacatctggccatccgccccgagaaagtgaccatcagttcagaaaagcctgaggccgccgacaatgttgttcagggcaaggtcctcgacattgcatatctcggcaacctttcgacatatcacgtcgagctacccaccggggatgtcatcaaggctcaaacggccaatacgcgccggatttcccgtcgcgcctacacatgggaagacaccgtctggctgtcctggacagccaccggcggtgtcttgttgggggaataa

SEQ ID NO: 66139 - protein, 398 aa, Silicibacter sp. TM1040
MHAPPTSPTQDDGPVPTARMGENLAIPVFEPWTDPQAKPLIQFQNVTKRFGDFTAIDDLTIDIYEREFFALLGPSGCGKTTMMRMLAGFETPTEGKIFLAGQDIAPVPPNQRAVNMMFQSYALFPHLSVWENIAFGLKREGLPRNEINARVDEMLRLTRLEKFARRKPHQISGGQRQRVALARSLAKAPKLLLLDEPLGALDKKLREETQFELMDIQEKTGTTFVIVTHDQEEAMTVASRVAVMDNGKVMQVATPADIYEAPNSVYVADFIGDVNLIEGKATATGEDSYALHWREGAAPLTVKSPNKISDGQKAHLAIRPEKVTISSEKPEAADNVVQGKVLDIAYLGNLSTYHVELPTGDVIKAQTANTRRISRRAYTWEDTVWLSWTATGGVLLGE

SEQ ID NO: 66140 - DNA, 1173 bp, Shewanella denitrificans OS-217
  CDS (1)..(1173): transl_table=11
atgtcaagcacctcgggcactgcccaacacacggcgccgcagccactaacaacacagccactagcaccacagcaagccgccgaaccacaagtgctgctaaagatagatggcgtgagtaagttgtttgatggcgtgcgtgccgtagacaaagtgtcactgactatcaataaaggcgaaatatttgcgttgcttggtggctcaggttctggcaagtcgaccctacttcgcatgcttgcaggctttgagcgccccagtgaaggccgaatttacttggatggcgtagacattaccgacatgccgccttatgagcggccaatcaatatgatgttccagtcctatgcgttatttccgcacatgacggttgagcaaaatattgccttcggcttgaagcaagataaattacctaaggatgaaatcactcagcgagtggcagagatgctcaagctggtgcacatggaaaaatacgctaagcgtaagccgcagcaattgtcaggtggccagcgtcagcgggtggccttggcgcgctcccttgccaaacggcctaagctgttgttattggatgagcccatgggggccttggataaaaaactgcgtactgaaatgcagctcgaagtggtcgaaattctcgagcgtgtcggcgtgacttgcgtcatggtgacccatgatcaagaagaagccatgaccatggcagggcgtatctccatcatgagtgaaggctggatagcccaaactggctcacccatggacatttacgagagccccaatagccgcatgatcgccgaatttatcggtacggttaacttgtttgaaggtgatatcgtcgaagatgaagcggcccatgtgatcatcgcctctaagaccttgtcgcagcagttttatgtggactatggcgtctcgaccagcgtggaagacaagcacgtttggctggcgctgcgtccagagaaaaccattatttgccgtgagcagccagagggtgaatacaactgggccaagggtgtggtgcatgacatcgcctatcttgggggcatttctgtgtactacatcaagcttgaagatggtcaaatcgtgcagtcgagcatggccaaccgtgaacgtcgaagcgatcgcccgacttgggaagaccaagtcttcatcagctgggaggccagcagcggcatggtattaagatcatga

SEQ ID NO: 66141 - protein, 390 aa, Shewanella denitrificans OS-217
MSSTSGTAQHTAPQPLTTQPLAPQQAAEPQVLLKIDGVSKLFDGVRAVDKVSLTINKGEIFALLGGSGSGKSTLLRMLAGFERPSEGRIYLDGVDITDMPPYERPINMMFQSYALFPHMTVEQNIAFGLKQDKLPKDEITQRVAEMLKLVHMEKYAKRKPQQLSGGQRQRVALARSLAKRPKLLLLDEPMGALDKKLRTEMQLEVVEILERVGVTCVMVTHDQEEAMTMAGRISIMSEGWIAQTGSPMDIYESPNSRMIAEFIGTVNLFEGDIVEDEAAHVIIASKTLSQQFYVDYGVSTSVEDKHVWLALRPEKTIICREQPEGEYNWAKGVVHDIAYLGGISVYYIKLEDGQIVQSSMANRERRSDRPTWEDQVFISWEASSGMVLRS

SEQ ID NO: 66142 - DNA, 1137 bp, Shewanella frigidimarina NCIMB 400
  CDS (1)..(1137): transl_table=11
atggtaaacacctcgagcgtcactaataaaccaaccacaaagacgcaagataaagtgctgctcaaaattgagcgtgtcagcaaacttttcgatgatgtgcgcgcagtagacgacgtctcgttaaccattaaccgtggtgaaatatttgcactactgggtggttcaggttcaggtaaatcaaccttgttacgcatgctcgcgggttttgaaaagccaacagaagggcgtatttttcttgatggtgtcgacattactgatatgccaccgtacgaacgccctattaatatgatgttccaatcgtatgctttatttccgcacatgacggttgaacagaatatcgcttttggattgaaacaagacaaaatgccgaaggctgatattgctgtgcgggttaaagaaatgcttaaactggtgcacatggacaaatacggtaaacgtaaaccgcatcagttatcaggtggtcaacgtcagcgtgtcgccttagctcgttcgttagcaaagcggcctaaattattattacttgatgagccaatgggcgcattagataaaaagctgcgtactcaaatgcagttagaagtggtcgatattttagaagccgtaggtgttacctgcgtgatggtaacccatgaccaagaagaagccatgaccatggccggacgtatttcgattatgcatgaaggttggattgcccaaacaggcagcccaatggacatttatgagtcgccagcgagtcgcatggttgcagagtttattggtacggttaatttatttgaaggtgaaattattgaagatgaagttgaccacgcgattattaaatcgccgactttatcgcagcagttttacattggtcacggtatttcaaccagtctagaaaacaaaaatgtattcttggccctacgaccagaaaaaaccattattacccgccaaaagcctgaaagtgaatataactgggctcacggcgtagtgcatgacattgcctatcttggtggtttgtcggtgtattacattaagttaaaaaacaaccaaattgttcaatgctcaatgattaaccgtgaacgccgcgccgatcacccaacgtgggaagacgaggtttacatcagttgggaagacaccagcggggttgtattaaactcatga

SEQ ID NO: 66143 - protein, 378 aa, Shewanella frigidimarina NCIMB 400
MVNTSSVTNKPTTKTQDKVLLKIERVSKLFDDVRAVDDVSLTINRGEIFALLGGSGSGKSTLLRMLAGFEKPTEGRIFLDGVDITDMPPYERPINMMFQSYALFPHMTVEQNIAFGLKQDKMPKADIAVRVKEMLKLVHMDKYGKRKPHQLSGGQRQRVALARSLAKRPKLLLLDEPMGALDKKLRTQMQLEVVDILEAVGVTCVMVTHDQEEAMTMAGRISIMHEGWIAQTGSPMDIYESPASRMVAEFIGTVNLFEGEIIEDEVDHAIIKSPTLSQQFYIGHGISTSLENKNVFLALRPEKTIITRQKPESEYNWAHGVVHDIAYLGGLSVYYIKLKNNQIVQCSMINRERRADHPTWEDEVYISWEDTSGVVLNS

SEQ ID NO: 66144 - DNA, 1161 bp, Burkholderia ambifaria AMMD
  CDS (1)..(1161): transl_table=11
atgaatagccagtcgggtgcgccggttgcgggcgcgccgtccttcgttccttcgtccggcgcgactacgcgcgccgagacctttgtccagatcgtcgacgccgtcaagaaattcggcgagaccgaagtggtgcgcaacgtgaacctgacggtgcgccagggcgagctgttcgcgctgctcggcagctcgggttccggcaagtcgacgctgctgcgcatgctcgcgggcctcgagacggtcacctcgggcaagatcctgatcgacggcgaggacctcgcgcagatgccgccgtacaagcggcccgtgaacatgatgttccagtcgtatgcgctgttcccgcacatgtcggtcgaggcgaacgtcgcctacggcctgaagcaggaaggcacgccgaaggccgagctgaaggagcgcgtcgccgcggcgctcgagctcgtgcagatgagcaagtacgcgaagcgcaagccgcaccagctgtcgggcggccagcagcagcgcgtcgcgctcgcgcgttcgctcgtcaagcgcccgaaggtgctgctgctcgacgagccgatgtcggcgctcgacaagcagatccgccagcgcacgcagatcgagctcgtcaatatcctgaagaaggtcggcgtcacctgcatcatggtcacgcacgaccaggaagaggcgatgacgatggcgaaccggctcgccgtgatgagcgaagggcagatcgtgcagatcggctcgccgaacgaagtctacgaatatccgaacagccgcttctcggccgagttcatcggctcgacgaacctgttcgacggcgtcacggtcgaggacgaacccgactacgtgtatatcgaatccccggagctgccgagccggctgtacgtgagccacgggatcacgggcccgctcgggatgccggtcacggtgtcggtgcgccccgagcgcatcgcgctcacgcgcaagccgcccgaaggcgcgttcaactgggcgcgcggcaggatcaccaacgtcgcgtacatgggcggctattcgctgtatcacgtgaagctcgacgcgggcaagacggtgatcgcgaacgtgtcgagcctcgcgatcaccgagctcgacacgccgtcgctcggcgacgagatctacgtgcgctggagcgcgaccgccggcgtggtgctgacgtcatga

SEQ ID NO: 66145 - protein, 386 aa, Burkholderia ambifaria AMMD
MNSQSGAPVAGAPSFVPSSGATTRAETFVQIVDAVKKFGETEVVRNVNLTVRQGELFALLGSSGSGKSTLLRMLAGLETVTSGKILIDGEDLAQMPPYKRPVNMMFQSYALFPHMSVEANVAYGLKQEGTPKAELKERVAAALELVQMSKYAKRKPHQLSGGQQQRVALARSLVKRPKVLLLDEPMSALDKQIRQRTQIELVNILKKVGVTCIMVTHDQEEAMTMANRLAVMSEGQIVQIGSPNEVYEYPNSRFSAEFIGSTNLFDGVTVEDEPDYVYIESPELPSRLYVSHGITGPLGMPVTVSVRPERIALTRKPPEGAFNWARGRITNVAYMGGYSLYHVKLDAGKTVIANVSSLAITELDTPSLGDEIYVRWSATAGVVLTS

SEQ ID NO: 66146 - DNA, 1137 bp, Shewanella putrefaciens CN-32
  CDS (1)..(1137): transl_table=11
atggcaagcacctcgggcgtcaccaataaacccacaacaaagacgcaagaacatgtactgctcaagattgagcgggtcagtaaattattcgacgatgtacgtgcagttgatgatgtgtcattgacgatcaataaaggtgaaattttcgccttacttggtggttctggatctgggaaatcgactttactgcgtatgctcgcaggctttgaaaaaccgacatcgggccgcatttatcttgatggtgaagatatcaccgacttaccgccctacgaacgtcctatcaatatgatgtttcaatcctatgctttatttccccatatgacggtggcgcaaaatattgcttttggtttgaagcaagacaagctacctaaagctgaaattgagcagcgcgtgcaagagatgcttaaacttgtgcacatggaacaatatggtaagcgtaaacctcaccagttatctggcggtcagcgtcagcgtgttgcgctggcacgctcgcttgctaagcgtcctaaattattgctgcttgatgaacctatgggcgcattggataaaaaactgcgtacccagatgcaactcgaagtggttgaaattcttgagcgtgttggtgtgacttgcgtaatggtgactcacgatcaagaagaagcgatgaccatggccggacggattgccattatgagtgatggctggattgctcaaacaggctcaccgatggacatttacgaaagcccgaacagtcgtatgattgccgagtttattggttcagtgaatttgtttggtggtgaaattgaagtggatgaagttgaccatttgatcattaaacccaatgaattagctcaatctttttatgtcggctacggagtaacgaccagccttgaagataagcatgtatggttagcggtacgccctgaaaagacgataattagccgtgagcaacccgaaggtgaatataattgggcgaaaggtattgtgcatgatatcgcttacttaggtggtatatcagtgtattacattcgcttagagaatggccaaattgtacagtgtagtatgactaaccgtgaacgccgcgccgatcatgctacttgggatgatgaagtgtttatcagttgggaggacaccagtggcgtggtgttgagatcatga

SEQ ID NO: 66147 - protein, 378 aa, Shewanella putrefaciens CN-32
MASTSGVTNKPTTKTQEHVLLKIERVSKLFDDVRAVDDVSLTINKGEIFALLGGSGSGKSTLLRMLAGFEKPTSGRIYLDGEDITDLPPYERPINMMFQSYALFPHMTVAQNIAFGLKQDKLPKAEIEQRVQEMLKLVHMEQYGKRKPHQLSGGQRQRVALARSLAKRPKLLLLDEPMGALDKKLRTQMQLEVVEILERVGVTCVMVTHDQEEAMTMAGRIAIMSDGWIAQTGSPMDIYESPNSRMIAEFIGSVNLFGGEIEVDEVDHLIIKPNELAQSFYVGYGVTTSLEDKHVWLAVRPEKTIISREQPEGEYNWAKGIVHDIAYLGGISVYYIRLENGQIVQCSMTNRERRADHATWDDEVFISWEDTSGVVLRS

SEQ ID NO: 66148 - DNA, 1119 bp, Marinobacter aquaeolei VT8
  CDS (1)..(1119): transl_table=11
gtggccgtaaccaacaacacctccgcgcaagcggaggtgctcctcagcatcaaaggcatttccaagagcttcgacagcaccttggcggtcgacgacgtcagcctggacatccacaagggcgagatctttgcccttctgggtggctccggctctggcaaatccaccctgctacgcatgctggcgggcttcgagaccccggattccggccgcattgtgctggatggtcaggacatcaccgccctgccgccgtacctgcgacccaccaacatgatgttccagtcctatgccctgttcccgcacatgaccgtggagcagaacattgctatgggtctgaaacaggacaagctgccaaagaacgaaatcaccgaccgtgtggccgccatgctcaagctggtgaagatggagccctacgccaggcgcaagccgcagcagctctcaggtggccagcagcagcgtgtggccctggcccgctcgctggcaaagcgaccaaagttgctgctgctggacgagcccatgggcgcactggacaaaaaactgcgcaccgaaatgcagctggaactggtggatattctggagaaggtgggcgtgacctgcctgatggtcacccacgaccaggaagaagccatgaccatggccagccggatagccattatgtcccacggccggatcgctcaggtgggttcgcccattgatatctacgaaagcccgaacagccgcatgacggcggagtttatcggctccgtgaatatctttgaggcgaacattctggaagacaattccgacagcctgtctctggccagcgagctgctggacgcaccggtgtttattgaccgcggtgtaaccacgccggcggaaaccacggaaaccctgatcgccctgcgcccggagaagatctacctgacgaccgagaagcccgaaggcgatagcaactggagctgcggcacggtggacaacattgcttacctgggggacatcacgtcttactacgtgaagctcgccagcggcaagcgggtgcaggccaccatggccaacgtggagcgccggggcgagcggcccacctggggtgaccgggtgtatgtgtcctgggaagcttccagtcctatcctgctctggaactga

SEQ ID NO: 66149 - protein, 372 aa, Marinobacter aquaeolei VT8
MAVTNNTSAQAEVLLSIKGISKSFDSTLAVDDVSLDIHKGEIFALLGGSGSGKSTLLRMLAGFETPDSGRIVLDGQDITALPPYLRPTNMMFQSYALFPHMTVEQNIAMGLKQDKLPKNEITDRVAAMLKLVKMEPYARRKPQQLSGGQQQRVALARSLAKRPKLLLLDEPMGALDKKLRTEMQLELVDILEKVGVTCLMVTHDQEEAMTMASRIAIMSHGRIAQVGSPIDIYESPNSRMTAEFIGSVNIFEANILEDNSDSLSLASELLDAPVFIDRGVTTPAETTETLIALRPEKIYLTTEKPEGDSNWSCGTVDNIAYLGDITSYYVKLASGKRVQATMANVERRGERPTWGDRVYVSWEASSPILLWN

SEQ ID NO: 66150 - DNA, 1119 bp, Actinobacillus actinomycetemcomitans
  CDS (1)..(1119): transl_table=11
gtggaaaatacagttcaaaacaagccaattatcgagcttcgttccattactaaatcctacggttccaacaccattattaaagacttcaatttaaccattaataacggtgaatttttgacaattctcggcccctccggctgcggcaaaacaacggtattgcgtttgcttgcaggcttggaagaattagattcgggcaacatcattttagacggtgaagacatcaccaacgtgccggcagagaaacgccacgttaacaccgtattccaaagctacgcactttttccgcacatgaccatctttgaaaacgtcgctttcggtttgcgtatgcaaaaagtgccggaggcggaaattaaaccgcgcgtgttagaagccctacgcatggtgcaattagaagaaatggcggatcgtaagccgacccagctttccggtggccagcaacaacgtattgccattgcccgggcggttgtaaataaacctaaagtgttattactcgacgaatccctctccgcgttggactacaaattgcgtaaacaaatgcaatacgaactgaaagtgttgcagcgccagttaggtatcacatttatttttgtaacccacgatcaggaagaagcgattaccatgtccgaccgtattgtgttgttacgtaaaggtaaaatcgcacaagacggttcgccgcgtgaaatttacgaagaacctgcaaacctgttcgtcgcacgttttatcggcgaaattaatgtgtttgatgccactgtgattgaacgtaaatcggaaaatgtggtgttggcgaacgtggaaggtcgcgtttgtgatatttatacggacattccggtgaaaaaagatcagcagcttcaagtgttgcttcgtcccgaagatattgtaattaaagaacttgacgagcatgaacattccaaagccattatcggtcatattatcgaccgcacttataaaggcatgaccttagaatccaccgtggaatttgaacaaaacggcaaacgcgggctggtcagcgaattctttaacgaagatgatcctcacatggatcacagtattggtcaacgtgtaggcattacatggcacgaaggttgggaggttgtactcaacgatgaagataatcaataa

SEQ ID NO: 66151 - protein, 372 aa, Actinobacillus actinomycetemcomitans
MENTVQNKPIIELRSITKSYGSNTIIKDFNLTINNGEFLTILGPSGCGKTTVLRLLAGLEELDSGNIILDGEDITNVPAEKRHVNTVFQSYALFPHMTIFENVAFGLRMQKVPEAEIKPRVLEALRMVQLEEMADRKPTQLSGGQQQRIAIARAVVNKPKVLLLDESLSALDYKLRKQMQYELKVLQRQLGITFIFVTHDQEEAITMSDRIVLLRKGKIAQDGSPREIYEEPANLFVARFIGEINVFDATVIERKSENVVLANVEGRVCDIYTDIPVKKDQQLQVLLRPEDIVIKELDEHEHSKAIIGHIIDRTYKGMTLESTVEFEQNGKRGLVSEFFNEDDPHMDHSIGQRVGITWHEGWEVVLNDEDNQ

SEQ ID NO: 66152 - DNA, 1128 bp, Rhizobium sp
  CDS (1)..(1128): transl_table=11
atgaaccccgagccgcgcatcaacggcgatctcgtacgcttcgaaggcgtggagaaaacatatgacggtgtgaccatcgtcgtcgagcgattggacttggcgatccgccgcggggagttcttgacgatgctgggaccttccggttcagggaaaactacgtcccttatgatgctggctggcttcgaaatgcctaccgcgggcaggatcattctagacggcaagccgatcgaacggctgccgcctcaccaacgcaacatcggcgtcgtttttcagaactacgccctgtttcccaatatgacagtcgcggagaacgtcgcgtttccgcttcagatgaggaaggtcgaaaaagccgaccagaaggcgagggtcgaggccgcgctcgacatggttcagatggccaagttcgccggccgcaggccggcgcagctttccggaggccaacagcagcgcatcgcgctggctcgcgcgctcgtcttcgagccgtccctcgtgctcatggacgagccgctcggagccttggacaagcagctccgcgagcacatgcagatcgagatcaagcacctccacgagcggctcgggatcacgatcgtctacgtcactcacgatcaaagcgaggcgttgacgatgtccgaccgcatcgcggtgttcgacaagggacggatccagcagttgggcaagcccgccgacgtctacgaacgtcctgccaacccattcgtggcccagttcattggcgacaacaacgcgcttcacggcaccatcctcgacgtctcgggtccgcattgcacggtccagatcgacggtgatcgccagacgataaaggcggcagtgggcgcaccgcttgcagccggcgagaaaacgaccctgtcaatccgtccggaaaggataaggatcggccacacctccgacagggcgaacaacatcaaagccagtgtcagagagctcatctatctcggcgaccatgtccgggtgagggtggcggcgctcggttccgaagaaatcatcatcaagatcccgaatggccacggtgtcccggcagacgtgtcgcccggcgcaaacgtgctcatcggctggaatttcgacgactgccccgcgctcactcgcgagcacgcggcgacggcgaaagcatga

SEQ ID NO: 66153 - protein, 375 aa, Rhizobium sp
MNPEPRINGDLVRFEGVEKTYDGVTIVVERLDLAIRRGEFLTMLGPSGSGKTTSLMMLAGFEMPTAGRIILDGKPIERLPPHQRNIGVVFQNYALFPNMTVAENVAFPLQMRKVEKADQKARVEAALDMVQMAKFAGRRPAQLSGGQQQRIALARALVFEPSLVLMDEPLGALDKQLREHMQIEIKHLHERLGITIVYVTHDQSEALTMSDRIAVFDKGRIQQLGKPADVYERPANPFVAQFIGDNNALHGTILDVSGPHCTVQIDGDRQTIKAAVGAPLAAGEKTTLSIRPERIRIGHTSDRANNIKASVRELIYLGDHVRVRVAALGSEEIIIKIPNGHGVPADVSPGANVLIGWNFDDCPALTREHAATAKA

SEQ ID NO: 66154 - DNA, 1083 bp, Rhizobium sp
  CDS (1)..(1083): transl_table=11
atgagcaaacccttcctgcaaatccgcggcatccgcaaggaatacgggcctgtcaccgccgttcacgacgtcaatctcgacgtggcgcagggggagttcctgaccttcctcgggccctccggctcgggaaagagcacgacgctctatattctcgccggcttcgaggatccgacccgcggcgacatcatgctgaacggccagtcgctgctgtcgacgccgtcgcacaagcgcaatatcggcatggtgttccagcgctatacgcttttcccgcatctctccgtcggcgagaacatcgccttcccgctgaaggtcaggcggcttccgaaggccgagatcgatgccaaggtgcgcgacatgctgaagctcgtgcggctcgaaggcttcgaggaccgcaagccggcgcagatgtccggtggccagcagcagcgcgttgcgctggcccgcgcgctcgcctacgacccgccggtcctgctgatggacgagccgctttcggcgctcgacaagaagctcagagaggaaatccagcacgagatccgccgcatccaccagcagaccgaggtgacgatcctctatgtcacccatgaccaggaggaggcgctgcggctttccgaccggattgccgtcttttcgaagggggtgatcgaccagatcggcacggggccggaactctatgccaacccggcgacccgtttcgtcgccgagttcatcggcgacagcgatttcctgccctgcgacctggtgacggcggcaaacggcagggcggacatcgcgctcgccggcacgacggtcatcccgaacgttccgatgcacggcaaggcggtcgcaggcggcaaggcggcgctgatgctgcggccggaacgcttgcggctgatgcgatcggcgccggggggcgcgacagcgcttcccgtcacggtcagcgacatcaccttcctcggcaacaacatccatgtcgcgactgagaccgcaaagggcgacgcgctggcggtccgccttcccttcggccatgaggcgatttccagcctcaaccgcggcgacagcgtctggctcggcttcgacccggcctcggcacacgtcttctgctga

SEQ ID NO: 66155 - protein, 360 aa, Rhizobium sp
MSKPFLQIRGIRKEYGPVTAVHDVNLDVAQGEFLTFLGPSGSGKSTTLYILAGFEDPTRGDIMLNGQSLLSTPSHKRNIGMVFQRYTLFPHLSVGENIAFPLKVRRLPKAEIDAKVRDMLKLVRLEGFEDRKPAQMSGGQQQRVALARALAYDPPVLLMDEPLSALDKKLREEIQHEIRRIHQQTEVTILYVTHDQEEALRLSDRIAVFSKGVIDQIGTGPELYANPATRFVAEFIGDSDFLPCDLVTAANGRADIALAGTTVIPNVPMHGKAVAGGKAALMLRPERLRLMRSAPGGATALPVTVSDITFLGNNIHVATETAKGDALAVRLPFGHEAISSLNRGDSVWLGFDPASAHVFC

SEQ ID NO: 66156 - DNA, 1188 bp, Rhizobium loti
  CDS (1)..(1188): transl_table=11
atgcccagaggtgaaccgctgcggttagagcgactttgtaaacagtacggcagcgtgcgaggggttaatgacttgtcggttcaaatcgaggccggcgaatttgtctcatttctcggaccaagtggttccggcaagacgacaacgttgatgatggtcgcggggttcgaaacgcccacctccggccaaatctttgtcggcgcccgaccaataaccgggctacccgtgcctagacgcaacatcggagttgtattccagaattatgcgctatttccacatctatccgttttcgagaacgtggcatttgcgctcaagatgcgcagagtatccggctctgaacttcgagccggtgtcgccgaagcgctcgatcttgttcaactgagcggctatgaagcgcggatgccgcacgagttatccggcggccaacagcagcgagttgccttggctcgcgcacttgtgtttcgcccaggcgtagtcctcatggacgaaccgcttggtgcgcttgacaaacagcttcgcgagcatatgcagcttgagctgaagcgccttcagaagtcccttggaataactgtggtcttcgtcacacacgatcaaagtgaagcgctcacgatgtctgatcgaatcgtggtgatgaataagggcaacgtcgagcaaatcgggacgcctgaagaaatatatgagactccgcaaacgcgcttcgttgcaggtttcatcggcgagtccaatttccttcgcactcatattgttgaaagtagaaaagacggccctctccttgacctggccggcctgcaaattcgagcgatgtggcagggatccgatagcctgcagggggctgtgaccctcatgatccgacccgacaagatcatccctctcgaccccggcgttcgcactgataatgaattcgaaggtgtggtcgaagaggccgtctaccagggaaatgtcattaagtatcgtattcggttacgtgcaaagattccagtgtttctcactttagcagcaccgagccacgcccgatctcagcgattccatgtcgaccaacaagttagaattggctgggacgcgcgggatggacgacttctttctgatgagggggaacaatcaatccccggcaaacccaataatcgcgtcgcggtgtcagctttcgcgggcgttactgcaactgcagatcgtatggcaatcgtatctttataa

SEQ ID NO: 66157 - protein, 395 aa, Rhizobium loti
MPRGEPLRLERLCKQYGSVRGVNDLSVQIEAGEFVSFLGPSGSGKTTTLMMVAGFETPTSGQIFVGARPITGLPVPRRNIGVVFQNYALFPHLSVFENVAFALKMRRVSGSELRAGVAEALDLVQLSGYEARMPHELSGGQQQRVALARALVFRPGVVLMDEPLGALDKQLREHMQLELKRLQKSLGITVVFVTHDQSEALTMSDRIVVMNKGNVEQIGTPEEIYETPQTRFVAGFIGESNFLRTHIVESRKDGPLLDLAGLQIRAMWQGSDSLQGAVTLMIRPDKIIPLDPGVRTDNEFEGVVEEAVYQGNVIKYRIRLRAKIPVFLTLAAPSHARSQRFHVDQQVRIGWDARDGRLLSDEGEQSIPGKPNNRVAVSAFAGVTATADRMAIVSL

SEQ ID NO: 66158 - DNA, 1143 bp, Pseudomonas fluorescens
  CDS (1)..(1143): transl_table=11
atggcagttgcctccggcgcctataagaaagccctcgagggcgaccagacacccaagcaggtgttggtcaaaatcgaccgggtcacgaagaagttcgacgagacgattgccgtggacgatgtgtccctggaaatcaagaaaggcgagatcttcgccttgctcggcggttcgggatcgggcaaatccaccttgctgcgcatgctggccggtttcgagcggcccaccgaagggcggatttacctcgacggtgtggacatcaccgacatgccgccctacgagcggccgatcaacatgatgttccagtcctacgccttgttcccccacatgaccgtggcgcagaacattgccttcggcttgcagcaggacaagatcccgaaagccgaggtcgatgcccgcgtggctgaaatgctcaagctggtgcagatgagccagtacgccaagcgcaagccacaccagctctccggcggccagcgccagcgcgtggccctggcccgttccctggccaagcggccgaagctgttgttgctcgacgagccgatgggggccctggacaagaagctgcgctcgcaaatgcaacttgagctggtggagatcatcgagcgggttggcgtgacttgcgtcatggtgacccacgatcaggaagaggccatgaccatggccgagcgcatcgcgatcatgcacctgggctggatcgcccagatcggcagcccgatcgacatctacgaaaccccgaccagccggctggtctgcgagttcatcggcaacgtcaacatcttcgagactgaagtggtggacgacgccgaaggccacgcggtgctgacctgcaaggacctggaccgcaacatctacgtgggccacggcatcagcacctcggtgcaggacaagtcggtgacctacgccatccgcccggaaaaactgctggtcaccgccgaacaaccgacctgcgagaacaactggtccagcggcaaggtccatgacatcgcgtacctgggtggccactcggtgttctacgtcgcgttgccgagcggcaagctggtgcagtccttcgtcgccaacgccgaacgccgcggccagcgtccgacttggggcgaccaggtattcgtctggtgggaagacgacagcggcgtggtgcttcgctcatga

SEQ ID NO: 66159 - protein, 380 aa, Pseudomonas fluorescens
MAVASGAYKKALEGDQTPKQVLVKIDRVTKKFDETIAVDDVSLEIKKGEIFALLGGSGSGKSTLLRMLAGFERPTEGRIYLDGVDITDMPPYERPINMMFQSYALFPHMTVAQNIAFGLQQDKIPKAEVDARVAEMLKLVQMSQYAKRKPHQLSGGQRQRVALARSLAKRPKLLLLDEPMGALDKKLRSQMQLELVEIIERVGVTCVMVTHDQEEAMTMAERIAIMHLGWIAQIGSPIDIYETPTSRLVCEFIGNVNIFETEVVDDAEGHAVLTCKDLDRNIYVGHGISTSVQDKSVTYAIRPEKLLVTAEQPTCENNWSSGKVHDIAYLGGHSVFYVALPSGKLVQSFVANAERRGQRPTWGDQVFVWWEDDSGVVLRS

SEQ ID NO: 66160 - DNA, 1119 bp, Photobacterium profundum
  CDS (1)..(1119): transl_table=11
ttgaacgcttcaacaacatctaagaaaccagtcattcagcttaaagggttaaacaagagcttcgatggtaagcaaattattgctggtttggatctaaatgttaatgatggtgaatttttaaccatcttaggtccatcaggttgtggtaaaaccacagtacttcgtcttattgctggttttgaaaactctgacgctggtcaggttattattgccaataaggatgttactcaggttccagctgaacaacgccatgtcaatacggtgtttcaaagctatgcactgttcccccatatgacagtatttgagaatgttgcgtttggtttacgcatgcaaaaagtaagcgagagtgaaatagagcctcgtgttatggatgcattgcgcatggtacagcttgataagtttgcacctcgtaagcctcatcagttgtctggtggacagcaacagcgagttgcaatagcgcgtgccgttgtaaacaaaccaaaagtattattattagatgaatcactctctgctcttgattacaaattacgtaaacaaatgcagctcgagctaaaacaactgcaaagaaaattaggcattacgtttattttcgttacgcacgatcaagaagaagcattgtcgatgtctgatcgtattattgttatgcgtgacggtaatattgaacaagatggctctccacgtgaaatatatgaagaacccactaacttgtttgttgcgcgcttcattggtgaaatcaacgtttttgatgctaccgtaaaagaacgtttagacgaaaaacgtattatggcagaggttgaaggtcgtacagcacagattcactgtgagcttgcagtcaaaaccggcgacaaactgaaagtactgctacgccctgaagatattcgccttgaagagatcaacaacgatgaacatgctaaaggtattatcggttacgtgcgtgaacgtacctataaagggatgacactcgattcagtcatagaattagaatcaggcatgtcagtaatggtaagtgagttctttaacgaagatgatccagacgttgaccactcactcaatcaaaaagttgctgtaacttgggtagaaagctgggaagtggtattagctgatgaacaagaagcttaa

SEQ ID NO: 66161 - protein, 372 aa, Photobacterium profundum
MNASTTSKKPVIQLKGLNKSFDGKQIIAGLDLNVNDGEFLTILGPSGCGKTTVLRLIAGFENSDAGQVIIANKDVTQVPAEQRHVNTVFQSYALFPHMTVFENVAFGLRMQKVSESEIEPRVMDALRMVQLDKFAPRKPHQLSGGQQQRVAIARAVVNKPKVLLLDESLSALDYKLRKQMQLELKQLQRKLGITFIFVTHDQEEALSMSDRIIVMRDGNIEQDGSPREIYEEPTNLFVARFIGEINVFDATVKERLDEKRIMAEVEGRTAQIHCELAVKTGDKLKVLLRPEDIRLEEINNDEHAKGIIGYVRERTYKGMTLDSVIELESGMSVMVSEFFNEDDPDVDHSLNQKVAVTWVESWEVVLADEQEA

SEQ ID NO: 66162 - DNA, 1137 bp, Escherichia coli O157
  CDS (1)..(1137): transl_table=11
atgggacagagtaaaaaattgaataaacaaccgagttcgctttcaccgctggtgcaattggcgggaattcgcaaatgctttgatggtaaagaggtcattccccagctggatctgactatcaacaatggcgagttcctcacgctgcttggcccttctggctgcggtaaaacaaccgttcttcgcctgattgcaggtctggaaactgttgattccggacgcatcatgttggataacgaggacatcacccacgttccggcggaaaaccgctatgtgaacactgttttccaaagctacgcacttttcccccacatgaccgtgttcgaaaatgtggcctttgggttgcgcatgcaaaaaacccccgctgctgaaattacgccccgcgtgatggaagccctgcggatggtgcagctggaaaccttcgctcaacgtaaaccgcatcagctctctggtggtcaacagcaacgcgtcgccattgctcgcgcggtggttaacaagcctcgtctgttgttgctggatgagtcgctctcagcgctggattacaaactgcgtaagcaaatgcagaacgagctgaaagcgttacagcgtaagcttggcattacattcgtcttcgtgactcacgatcaggaagaagcactcaccatgtcagacaggattgtggtgatgcgcgatggtcgcattgagcaagacggcacgccgcgtgaaatctacgaagagccgaaaaacctgtttgttgccgggttcattggcgaaatcaatatgtttaacgccactgtcatcgaacgtctcgacgagcagcgcgtacgcgccaacgttgaaggccgcgaatgtaatatctacgttaacttcgccgttgaaccggggcaaaaactgcatgttctgctgcgcccggaagacttacgtgttgaagagattaacgacgacaaccacgctgaagggctgattggttacgttcgcgagcgtaactacaaaggcatgacgctggagtcggttgttgaactggaaaatggcaagatggtgatggtcagcgaattcttcaatgaagacgatcctgactttgaccactctctcgaccaaaaaatggccattaattgggtagaaagctgggaggtcgtactggctgatgaagaacacaagtaa

SEQ ID NO: 66163 - protein, 378 aa, Escherichia coli O157
MGQSKKLNKQPSSLSPLVQLAGIRKCFDGKEVIPQLDLTINNGEFLTLLGPSGCGKTTVLRLIAGLETVDSGRIMLDNEDITHVPAENRYVNTVFQSYALFPHMTVFENVAFGLRMQKTPAAEITPRVMEALRMVQLETFAQRKPHQLSGGQQQRVAIARAVVNKPRLLLLDESLSALDYKLRKQMQNELKALQRKLGITFVFVTHDQEEALTMSDRIVVMRDGRIEQDGTPREIYEEPKNLFVAGFIGEINMFNATVIERLDEQRVRANVEGRECNIYVNFAVEPGQKLHVLLRPEDLRVEEINDDNHAEGLIGYVRERNYKGMTLESVVELENGKMVMVSEFFNEDDPDFDHSLDQKMAINWVESWEVVLADEEHK

SEQ ID NO: 66164 - DNA, 1137 bp, Salmonella typhimurium
  CDS (1)..(1137): transl_table=11
atgggacagagtaagaaattgaataatcaaccgcgttcgctttcaccgctggtgcttttgtcgggaattagcaaaagtttcgatggcaaagaggtcatttcgcaactggatttgaccattaacaatggcgaattcctcacgctgcttggcccttccggctgcggtaaaacaaccgttcttcgcctgattgccggcctggaaaccgttgatgccgggcatatcatgttggataaccaggatatcacccacgttcccgccgaaaatcgttatgtaaataccgtatttcaaagctacgctttatttccgcatatgacggtgtttgaaaatgtcgcgtttggcttacggatgcaaaaaacgccagccgccgagatagcgcctcgcgtgaccgatgcgctgcgtatggtgcagcttgaagagtttgcacaacgtaaaccgcaccagctttccggcggacagcagcagcgtgtggctatcgctcgcgcggtggtgaataaacctcgcctgttattactggatgaatcgctttccgcgctggactataaattgcgcaaacaaatgcagaacgagcttaaagcattacagcgtaaactcggtatcacgtttgtttttgtcactcacgatcaggaagaagcgctcaccatgtccgatcgtatcgtggtaatgcgtaatggcgtgattgagcaagacggcacgccgcgtgaaatctatgaagagccaaaaaacctgtttgtcgccggttttatcggcgaaattaaccgctttgacgcaaccgtcattgaacggcttgatgaacagcgcgtccgcgccagcgtagaaggtcgggagtgcaatatatacgtcaatttcgctgtcgaaccaggccaaaaactgaacgtcctgctgcgaccggaagatctacgcgtcgaagagatcaacgatgataaccacatcgaagggcttatcggctacgtgcgcgagcgcaattataaaggtatgacgctggagtcggtggttgaactggaaaatggcaaaatggtgatggtcagcgaattcttcaacgaagacgatcctgacttcgaccattcacttgaccaaaaaatggccattagttgggtagaaagctgggaggtcgtactggctgatgaagaacacaagtaa

SEQ ID NO: 66165 - protein, 378 aa, Salmonella typhimurium
MGQSKKLNNQPRSLSPLVLLSGISKSFDGKEVISQLDLTINNGEFLTLLGPSGCGKTTVLRLIAGLETVDAGHIMLDNQDITHVPAENRYVNTVFQSYALFPHMTVFENVAFGLRMQKTPAAEIAPRVTDALRMVQLEEFAQRKPHQLSGGQQQRVAIARAVVNKPRLLLLDESLSALDYKLRKQMQNELKALQRKLGITFVFVTHDQEEALTMSDRIVVMRNGVIEQDGTPREIYEEPKNLFVAGFIGEINRFDATVIERLDEQRVRASVEGRECNIYVNFAVEPGQKLNVLLRPEDLRVEEINDDNHIEGLIGYVRERNYKGMTLESVVELENGKMVMVSEFFNEDDPDFDHSLDQKMAISWVESWEVVLADEEHK

SEQ ID NO: 66166 - DNA, 20 bp, Artificial sequence
  (1)..(20): primer
atgccggaggggcgcaccac

SEQ ID NO: 66167 - DNA, 23 bp, Artificial sequence
  (1)..(23): primer
ttaaaccgtcagcaccacacagc

SEQ ID NO: 66168 - protein, 336 aa, Artificial sequence
  Variant (2)..(11): xaa in position 2 to 11 is any amino acid
  Variant (12)..(18): xaa in position 12 to 18 is any or no amino acid
  Variant (20)..(23): xaa in position 20 to 23 is any amino acid
  Variant (26)..(29): xaa in position 26 to 29 is any amino acid
  Variant (32)..(32): xaa in position 32 is any amino acid
  Variant (35)..(35): xaa in position 35 is any amino acid
  Variant (38)..(38): xaa in position 38 is any amino acid
  Variant (40)..(40): xaa in position 40 is any amino acid
  Variant (42)..(44): xaa in position 42 to 44 is any amino acid
  Variant (47)..(52): xaa in position 47 to 52 is any amino acid
  Variant (54)..(54): xaa in position 54 is any amino acid
  Variant (56)..(58): xaa in position 56 to 58 is any amino acid
  Variant (60)..(65): xaa in position 60 to 65 is any amino acid
  Variant (66)..(68): xaa in position 66 to 68 is any or no amino acid
  Variant (70)..(72): xaa in position 70 to 72 is any amino acid
  Variant (74)..(78): xaa in position 74 to 78 is any amino acid
  Variant (81)..(81): xaa in position 81 is any amino acid
  Variant (88)..(89): xaa in position 88 to 89 is any amino acid
  Variant (91)..(92): xaa in position 91 to 92 is any amino acid
  Variant (94)..(94): xaa in position 94 is any amino acid
  Variant (97)..(97): xaa in position 97 is any amino acid
  Variant (99)..(109): xaa in position 99 to 109 is any amino acid
  Variant (110)..(115): xaa in position 110 to 115 is any or no amino acid
  Variant (117)..(119): xaa in position 117 to 119 is any amino acid
  Variant (121)..(122): xaa in position 121 to 122 is any amino acid
  Variant (124)..(130): xaa in position 124 to 130 is any amino acid
  Variant (131)..(132): xaa in position 131 to 132 is any or no amino acid
  Variant (134)..(134): xaa in position 134 is any amino acid
  Variant (136)..(137): xaa in position 136 to 137 is any amino acid
  Variant (143)..(143): xaa in position 143 is any amino acid
  Variant (148)..(148): xaa in position 148 is any amino acid
  Variant (151)..(155): xaa in position 151 to 155 is any amino acid
  Variant (157)..(158): xaa in position 157 to 158 is any amino acid
  Variant (161)..(161): xaa in position 161 is any amino acid
  Variant (165)..(166): xaa in position 165 to 166 is any amino acid
  Variant (170)..(171): xaa in position 170 to 171 is any amino acid
  Variant (174)..(178): xaa in position 174 to 178 is any amino acid
  Variant (180)..(187): xaa in position 180 to 187 is any amino acid
  Variant (189)..(189): xaa in position 189 is any amino acid
  Variant (191)..(193): xaa in position 191 to 193 is any amino acid
  Variant (199)..(199): xaa in position 199 is any amino acid
  Variant (202)..(206): xaa in position 202 to 206 is any amino acid
  Variant (208)..(213): xaa in position 208 to 213 is any amino acid
  Variant (215)..(217): xaa in position 215 to 217 is any amino acid
  Variant (219)..(221): xaa in position 219 to 221 is any amino acid
  Variant (223)..(225): xaa in position 223 to 225 is any amino acid
  Variant (227)..(228): xaa in position 227 to 228 is any amino acid
  Variant (230)..(232): xaa in position 230 to 232 is any amino acid
  Variant (234)..(234): xaa in position 234 is any amino acid
  Variant (236)..(236): xaa in position 236 is any amino acid
  Variant (238)..(238): xaa in position 238 is any amino acid
  Variant (240)..(241): xaa in position 240 to 241 is any amino acid
  Variant (242)..(243): xaa in position 242 to 243 is any or no amino acid
  Variant (245)..(255): xaa in position 245 to 255 is any amino acid
  Variant (256)..(293): xaa in position 256 to 293 is any or no amino acid
  Variant (297)..(314): xaa in position 297 to 314 is any amino acid
  Variant (315)..(335): xaa in position 315 to 335 is any or no amino acid
KXXXXXXXXXXXXXXXXXLXXXXGEXXXXLGXSGXGKXTXLXXXAGXXXXXXGXIXXXGXXXXXXXXXPXXXRXXXXXFQXYALFPHXXVXXNXAFXLXXXXXXXXXXXXXXXXXVXXXLXXVXXXXXXXXXRXPXXLSGGQXQRVAXARXXXXXPXXLLXDEPXXALDXXLRXXXXXEXXXXXXXXGXTXXXVTHDQXEAXXXXXRXXXXXXGXXXQXXXPXXXYXXPXXXFXAXFXGXXXXNXXXXXXXXXXXXXXXXXXXXXXXXXXXXXXXXXXXXXXXXXXXXXXXXXRPEXXXXXXXXXXXXXXXXXXXXXXXXXXXXXXXXXXXXXXXG

SEQ ID NO: 66169 - protein, 34 aa, Artificial sequence
  Variant (2)..(2): xaa in position 2 is Phe, Ile or Leu
  Variant (3)..(3): xaa in position 3 is Phe, Ile, Leu, Met or Val
  Variant (4)..(4): xaa in position 4 is Ala, Cys, Ser, Thr or Val
  Variant (5)..(5): xaa in position 5 is Phe, Ile, Leu or Met
  Variant (8)..(8): xaa in position 8 is Ala, Gly, Pro or Ser
  Variant (11)..(11): xaa in position 11 is Cys or Ser
  Variant (14)..(14): xaa in position 14 is Ser or Thr
  Variant (16)..(16): xaa in position 16 is any or no amino acid
  Variant (18)..(20): xaa in position 18 to 20 is any amino acid
  Variant (21)..(21): xaa in position 21 is any or no amino acid
  Variant (24)..(24): xaa in position 24 is Phe, Leu or Met
  Variant (25)..(29): xaa in position 25 to 29 is any amino acid
  Variant (31)..(31): xaa in position 31 is any amino acid
  Variant (32)..(32): xaa in position 32 is Phe, Ile, Leu or Val
  Variant (33)..(33): xaa in position 33 is any amino acid
  Variant (34)..(34): xaa in position 34 is Phe, Ile, Leu, Met or Val
EXXXXLGXSGXGKXTXLXXXXAGXXXXXXGXXXX

SEQ ID NO: 66170 - protein, 30 aa, Artificial sequence
  Variant (2)..(3): xaa in position 2 to 3 is any amino acid
  Variant (4)..(4): xaa in position 4 is any or no amino acid
  Variant (6)..(9): xaa in position 6 to 9 is any amino acid
  Variant (10)..(10): xaa in position 10 is Leu, Met or Val
  Variant (13)..(13): xaa in position 13 is any amino acid
  Variant (19)..(19): xaa in position 19 is any amino acid
  Variant (20)..(20): xaa in position 20 is Leu or Met
  Variant (21)..(21): xaa in position 21 is Asp, Asn, Ser or Thr
  Variant (22)..(22): xaa in position 22 is Ala, Ile, Leu or Val
  Variant (23)..(24): xaa in position 23 to 24 is any amino acid
  Variant (26)..(26): xaa in position 26 is Ile, Leu or Val
  Variant (27)..(28): xaa in position 27 to 28 is any amino acid
  Variant (29)..(29): xaa in position 29 is Ala, Gly or Pro
PXXXRXXXXXFQXYALFPXXXXXXNXXXXL

SEQ ID NO: 66171 - protein, 37 aa, Artificial sequence
  Variant (5)..(6): xaa in position 5 to 6 is any or no amino acid
  Variant (8)..(9): xaa in position 8 to 9 is any or no amino acid
  Variant (12)..(12): xaa in position 12 is Ile, Leu or Val
  Variant (15)..(15): xaa in position 15 is Ala or Ser
  Variant (16)..(16): xaa in position 16 is Ile, Leu, Met or Val
  Variant (17)..(17): xaa in position 17 is Ala, Ile or Val
  Variant (18)..(19): xaa in position 18 to 19 is any amino acid
  Variant (21)..(22): xaa in position 21 to 22 is any amino acid
  Variant (23)..(23): xaa in position 23 is Phe, Ile, Leu, Met or Val
  Variant (25)..(25): xaa in position 25 is any amino acid
  Variant (29)..(29): xaa in position 29 is Phe, Leu or Met
  Variant (30)..(30): xaa in position 30 is Ala, Gly or Ser
  Variant (31)..(31): xaa in position 31 is Ala, Asn or Ser
  Variant (34)..(35): xaa in position 34 to 35 is any amino acid
  Variant (36)..(36): xaa in position 36 is Ile, Leu, Met or Val
SGGQXXRXXVAXARXXXXXPXXXLXDEPXXXLDXXXR

SEQ ID NO: 66172 - protein, 52 aa, Artificial sequence
  Variant (2)..(2): xaa in position 2 is any amino acid
  Variant (4)..(4): xaa in position 4 is any amino acid
  Variant (5)..(5): xaa in position 5 is Ile, Leu or Val
  Variant (6)..(6): xaa in position 6 is any amino acid
  Variant (12)..(12): xaa in position 12 is any amino acid
  Variant (15)..(15): xaa in position 15 is Phe, Ile, Leu or Met
  Variant (16)..(16): xaa in position 16 is any amino acid
  Variant (17)..(17): xaa in position 17 is Ile, Leu, Met or Val
  Variant (18)..(18): xaa in position 18 is Ala, Cys, Gly or Ser
  Variant (19)..(22): xaa in position 19 to 22 is any amino acid
  Variant (23)..(23): xaa in position 23 is Ile, Leu or Val
  Variant (24)..(24): xaa in position 24 is Phe, Leu, Met or Val
  Variant (25)..(26): xaa in position 25 to 26 is any amino acid
  Variant (28)..(30): xaa in position 28 to 30 is any amino acid
  Variant (32)..(32): xaa in position 32 is any amino acid
  Variant (33)..(33): xaa in position 33 is Ala, Asp, Glu, Gly or Ser
  Variant (34)..(34): xaa in position 34 is any amino acid
  Variant (35)..(35): xaa in position 35 is Ala, Gly, Pro or Val
  Variant (36)..(38): xaa in position 36 to 38 is any amino acid
  Variant (40)..(41): xaa in position 40 to 41 is any amino acid
  Variant (43)..(47): xaa in position 43 to 47 is any amino acid
  Variant (48)..(48): xaa in position 48 is Ala, Cys, Gly or Ser
  Variant (49)..(49): xaa in position 49 is any amino acid
  Variant (51)..(51): xaa in position 51 is Ile, Leu, Met or Val
GXTXXXVTHDQXEAXXXXXXXXXXXXGXXXQXXXXXXXYXXPXXXXXXXFXG

SEQ ID NO: 66173 - DNA, 1629 bp, Escherichia coli; identical to SEQ ID NO: 27642
  CDS (467)..(1513)

SEQ ID NO: 66174 - protein, 348 aa, Escherichia coli [sequence omitted]

SEQ ID NO: 66175 - DNA, 1053 bp, Vibrio cholerae O1 biovar eltor str. N16961; identical to SEQ ID NO: 27644
  CDS (1)..(1053): transl_table=11

SEQ ID NO: 66176 - protein, 350 aa, Vibrio cholerae O1 biovar eltor str. N16961; identical to SEQ ID NO: 27645

SEQ ID NO: 66177 - DNA, 1008 bp, Campylobacter jejuni subsp. jejuni NCTC 11168; identical to SEQ ID NO: 27646
  CDS (1)..(1008): transl_table=11

SEQ ID NO: 66178 - protein, 335 aa, Campylobacter jejuni subsp. jejuni NCTC 11168; identical to SEQ ID NO: 27647

SEQ ID NO: 66179 - DNA, 1047 bp, Salmonella typhimurium LT2; identical to SEQ ID NO: 27648
  CDS (1)..(1047): transl_table=11

SEQ ID NO: 66180 - protein, 348 aa, Salmonella typhimurium LT2; identical to SEQ ID NO: 27649

SEQ ID NO: 66181 - DNA, 1182 bp, Agrobacterium tumefaciens str. C58; identical to SEQ ID NO: 27650
  CDS (1)..(1182): transl_table=11

SEQ ID NO: 66182 - protein, 393 aa, Agrobacterium tumefaciens str. C58; identical to SEQ ID NO: 27651

SEQ ID NO: 66183 - DNA, 1077 bp, Plasmodium falciparum 3D7; identical to SEQ ID NO: 27652
  CDS (1)..(1077)

SEQ ID NO: 66184 - protein, 358 aa, Plasmodium falciparum 3D7; identical to SEQ ID NO: 27653

SEQ ID NO: 66185 - DNA, 1032 bp, Shewanella oneidensis MR-1; identical to SEQ ID NO: 27654
  CDS (1)..(1032): transl_table=11

SEQ ID NO: 66186 - protein, 343 aa, Shewanella oneidensis MR-1; identical to SEQ ID NO: 27655

SEQ ID NO: 66187 - DNA, 1044 bp, Vibrio vulnificus CMCP6; identical to SEQ ID NO: 27656
  CDS (1)..(1044): transl_table=11

SEQ ID NO: 66188 - protein, 347 aa, Vibrio vulnificus CMCP6; identical to SEQ ID NO: 27657

SEQ ID NO: 66189 - DNA, 1056 bp, Coxiella burnetii RSA 493; identical to SEQ ID NO: 27658
  CDS (1)..(1056): transl_table=11

SEQ ID NO: 66190 - protein, 351 aa, Coxiella burnetii RSA 493; identical to SEQ ID NO: 27659

SEQ ID NO: 66191 - DNA, 1050 bp, Nitrosomonas europaea ATCC 19718; identical to SEQ ID NO: 27660
  CDS (1)..(1050): transl_table=11

SEQ ID NO: 66192 - protein, 349 aa, Nitrosomonas europaea ATCC 19718; identical to SEQ ID NO: 27661

SEQ ID NO: 66193 - DNA, 1032 bp, Helicobacter hepaticus ATCC 51449; identical to SEQ ID NO: 27662
  CDS (1)..(1032): transl_table=11

SEQ ID NO: 66194 - protein, 343 aa, Helicobacter hepaticus ATCC 51449; identical to SEQ ID NO: 27663

SEQ ID NO: 66195 - DNA, 1050 bp, Wigglesworthia glossinidia endosymbiont of Glossina brevipalpis; identical to SEQ ID NO: 27664
  CDS (1)..(1050): transl_table=11

SEQ ID NO: 66196 - protein, 349 aa, Wigglesworthia glossinidia endosymbiont of Glossina brevipalpis; identical to SEQ ID NO: 27665

SEQ ID NO: 66197 - DNA, 1080 bp, Prochlorococcus marinus subsp. marinus str. CCMP1375; identical to SEQ ID NO: 27666
  CDS (1)..(1080): transl_table=11

SEQ ID NO: 66198 - protein, 359 aa, Prochlorococcus marinus subsp. marinus str. CCMP1375; identical to SEQ ID NO: 27667

SEQ ID NO: 66199 - DNA, 1080 bp, Bordetella pertussis Tohama I; identical to SEQ ID NO: 27668
  CDS (1)..(1080): transl_table=11

SEQ ID NO: 66200 - protein, 359 aa, Bordetella pertussis Tohama I; identical to SEQ ID NO: 27669

SEQ ID NO: 66201 - DNA, 1080 bp, Bordetella bronchiseptica RB50; identical to SEQ ID NO: 27670
  CDS (1)..(1080)

SEQ ID NO: 66202 - protein, 359 aa, Bordetella bronchiseptica RB50; identical to SEQ ID NO: 27671

SEQ ID NO: 66203 - DNA, 1050 bp, Prochlorococcus marinus subsp. pastoris str. CCMP1986; identical to SEQ ID NO: 27672
  CDS (1)..(1050): transl_table=11

SEQ ID NO: 66204 - protein, 349 aa, Prochlorococcus marinus subsp. pastoris str. CCMP1986; identical to SEQ ID NO: 27673

SEQ ID NO: 66205 - DNA, 1065 bp, Prochlorococcus marinus str. MIT 9313; identical to SEQ ID NO: 27674
  CDS (1)..(1065): transl_table=11

SEQ ID NO: 66206 - protein, 354 aa, Prochlorococcus marinus str. MIT 9313; identical to SEQ ID NO: 27675

SEQ ID NO: 66207 - DNA, 1032 bp, Synechococcus sp. WH 8102; identical to SEQ ID NO: 27676
  CDS (1)..(1032): transl_table=11

SEQ ID NO: 66208 - protein, 343 aa, Synechococcus sp. WH 8102; identical to SEQ ID NO: 27677

SEQ ID NO: 66209 - DNA, 1086 bp, Chromobacterium violaceum ATCC 12472; identical to SEQ ID NO: 27678
  CDS (1)..(1086): transl_table=11

SEQ ID NO: 66210 - protein, 361 aa, Chromobacterium violaceum ATCC 12472; identical to SEQ ID NO: 27679

SEQ ID NO: 66211 - DNA, 1014 bp, Wolinella succinogenes DSM 1740; identical to SEQ ID NO: 27680
  CDS (1)..(1014): transl_table=11

SEQ ID NO: 66212 - protein, 337 aa, Wolinella succinogenes DSM 1740; identical to SEQ ID NO: 27681

SEQ ID NO: 66213 - DNA, 1080 bp, Oryza sativa (japonica cultivar-group); identical to SEQ ID NO: 27682
  CDS (1)..(1080)

SEQ ID NO: 66214 - protein, 359 aa, Oryza sativa (japonica cultivar-group); identical to SEQ ID NO: 27683

SEQ ID NO: 66215 - DNA, 1044 bp, Vibrio vulnificus YJ016; identical to SEQ ID NO: 27684
  CDS (1)..(1044): transl_table=11

SEQ ID NO: 66216 - protein, 347 aa, Vibrio vulnificus YJ016; identical to SEQ ID NO: 27685

SEQ ID NO: 66217 - DNA, 1086 bp, Eremothecium gossypii; identical to SEQ ID NO: 27686
  CDS (1)..(1086)

SEQ ID NO: 66218 - protein, 361 aa, Eremothecium gossypii; identical to SEQ ID NO: 27687

SEQ ID NO: 66219 - DNA, 1074 bp, Neurospora crassa; identical to SEQ ID NO: 27688
  CDS (1)..(1074)

SEQ ID NO: 66220 - protein, 357 aa, Neurospora crassa; identical to SEQ ID NO: 27689

SEQ ID NO: 66221 - DNA, 957 bp, Gibberella zeae PH-1; identical to SEQ ID NO: 27690
  CDS (1)..(957)

SEQ ID NO: 66222 - protein, 318 aa, Gibberella zeae PH-1; identical to SEQ ID NO: 27691

SEQ ID NO: 66223 - DNA, 1185 bp, Ustilago maydis 521; identical to SEQ ID NO: 27692
  CDS (1)..(1185)

SEQ ID NO: 66224 - protein, 394 aa, Ustilago maydis 521; identical to SEQ ID NO: 27693

SEQ ID NO: 66225 - DNA, 1077 bp, Candida glabrata CBS138; identical to SEQ ID NO: 27694
  CDS (1)..(1077)

SEQ ID NO: 66226 - protein, 358 aa, Candida glabrata CBS138; identical to SEQ ID NO: 27695

SEQ ID NO: 66227 - DNA, 1095 bp, Kluyveromyces lactis NRRL Y-1140; identical to SEQ ID NO: 27696
  CDS (1)..(1095)

SEQ ID NO: 66228 - protein, 364 aa, Kluyveromyces lactis NRRL Y-1140; identical to SEQ ID NO: 27697

SEQ ID NO: 66229 - DNA, 1083 bp, Debaryomyces hansenii CBS767; identical to SEQ ID NO: 27698
  CDS (1)..(1083)

SEQ ID NO: 66230 - protein, 360 aa, Debaryomyces hansenii CBS767; identical to SEQ ID NO: 27699

SEQ ID NO: 66231 - DNA, 1038 bp, Yarrowia lipolytica CLIB99; identical to SEQ ID NO: 27700
  CDS (1)..(1038)

SEQ ID NO: 66232 - protein, 345 aa, Yarrowia lipolytica CLIB99; identical to SEQ ID NO: 27701

SEQ ID NO: 66233 - DNA, 1062 bp, Cryptococcus neoformans var. neoformans JEC21; identical to SEQ ID NO: 27702
  CDS (1)..(1062)

SEQ ID NO: 66234 - protein, 353 aa, Cryptococcus neoformans var. neoformans JEC21; identical to SEQ ID NO: 27703

SEQ ID NO: 66235 - DNA, 1083 bp, Plasmodium berghei; identical to SEQ ID NO: 27704
  CDS (1)..(1083)

SEQ ID NO: 66236 - protein, 360 aa, Plasmodium berghei; identical to SEQ ID NO: 27705

SEQ ID NO: 66237 - DNA, 1077 bp, Candida albicans SC5314; identical to SEQ ID NO: 27706
  CDS (1)..(1077): transl_table=12

SEQ ID NO: 66238 - protein, 358 aa, Candida albicans SC5314; identical to SEQ ID NO: 27707

SEQ ID NO: 66239 - DNA, 1035 bp, Acinetobacter sp. ADP1; identical to SEQ ID NO: 27708
  CDS (1)..(1035): transl_table=11

SEQ ID NO: 66240 - protein, 344 aa, Acinetobacter sp. ADP1; identical to SEQ ID NO: 27709

SEQ ID NO: 66241 - DNA, 1044 bp, Erwinia carotovora subsp. atroseptica SCRI1043; identical to SEQ ID NO: 27710
  CDS (1)..(1044)

SEQ ID NO: 66242 - protein, 347 aa, Erwinia carotovora subsp. atroseptica SCRI1043; identical to SEQ ID NO: 27711

SEQ ID NO: 66243 - DNA, 1080 bp, Legionella pneumophila subsp. pneumophila str. Philadelphia 1; identical to SEQ ID NO: 27712
  CDS (1)..(1080): transl_table=11

SEQ ID NO: 66244 - protein, 359 aa, Legionella pneumophila subsp. pneumophila str. Philadelphia 1; identical to SEQ ID NO: 27713

SEQ ID NO: 66245 - DNA, 1059 bp, Burkholderia mallei ATCC 23344; identical to SEQ ID NO: 27714
  CDS (1)..(1059): transl_table=11

SEQ ID NO: 66246 - protein, 352 aa, Burkholderia mallei ATCC 23344; identical to SEQ ID NO: 27715

SEQ ID NO: 66247 - DNA, 1044 bp, Methylococcus capsulatus str. Bath; identical to SEQ ID NO: 27716
  CDS (1)..(1044): transl_table=11

SEQ ID NO: 66248 - protein, 347 aa, Methylococcus capsulatus str. Bath; identical to SEQ ID NO: 27717

SEQ ID NO: 66249 - DNA, 1038 bp, Legionella pneumophila str. Paris; identical to SEQ ID NO: 27718
  CDS (1)..(1038): transl_table=11

SEQ ID NO: 66250 - protein, 345 aa, Legionella pneumophila str. Paris; identical to SEQ ID NO: 27719

SEQ ID NO: 66251 - DNA, 1038 bp, Legionella pneumophila str. Lens; identical to SEQ ID NO: 27720
  CDS (1)..(1038): transl_table=11

SEQ ID NO: 66252 - protein, 345 aa, Legionella pneumophila str. Lens; identical to SEQ ID NO: 27721

SEQ ID NO: 66253 - DNA, 1029 bp, Photobacterium profundum SS9; identical to SEQ ID NO: 27722
  CDS (1)..(1029): transl_table=11

SEQ ID NO: 66254 - protein, 342 aa, Photobacterium profundum SS9; identical to SEQ ID NO: 27723

SEQ ID NO: 66255 - DNA, 1047 bp, Salmonella enterica subsp. enterica serovar Paratyphi A str. ATCC; identical to SEQ ID NO: 27724
  CDS (1)..(1047): transl_table=11

SEQ ID NO: 66256 - protein, 348 aa, Salmonella enterica subsp. enterica serovar Paratyphi A str. ATCC; identical to SEQ ID NO: 27725

SEQ ID NO: 66257 - DNA, 1035 bp, Idiomarina loihiensis L2TR; identical to SEQ ID NO: 27726
  CDS (1)..(1035): transl_table=11

SEQ ID NO: 66258 - protein, 344 aa, Idiomarina loihiensis L2TR; identical to SEQ ID NO: 27727

SEQ ID NO: 66259 - DNA, 1035 bp, Azoarcus sp. EbN1; identical to SEQ ID NO: 27728
  CDS (1)..(1035): transl_table=11

SEQ ID NO: 66260 - protein, 344 aa, Azoarcus sp. EbN1; identical to SEQ ID NO: 27729

SEQ ID NO: 66261 - DNA, 1041 bp, Silicibacter pomeroyi DSS-3; identical to SEQ ID NO: 27730
  CDS (1)..(1041): transl_table=11

SEQ ID NO: 66262 - protein, 346 aa, Silicibacter pomeroyi DSS-3; identical to SEQ ID NO: 27731

SEQ ID NO: 66263 - DNA, 996 bp, Campylobacter jejuni RM1221; identical to SEQ ID NO: 27732
  CDS (1)..(996): transl_table=11

SEQ ID NO: 66264 - protein, 331 aa, Campylobacter jejuni RM1221; identical to SEQ ID NO: 27733

SEQ ID NO: 66265 - DNA, 1029 bp, Vibrio fischeri ES114; identical to SEQ ID NO: 27734
  CDS (1)..(1029): transl_table=11

SEQ ID NO: 66266 - protein, 342 aa, Vibrio fischeri ES114; identical to SEQ ID NO: 27735

SEQ ID NO: 66267 - DNA, 1047 bp, Salmonella enterica subsp. enterica serovar Choleraesuis str; identical to SEQ ID NO: 27736
  CDS (1)..(1047): transl_table=11

SEQ ID NO: 66268 - protein, 348 aa, Salmonella enterica subsp. enterica serovar Choleraesuis str; identical to SEQ ID NO: 27737

SEQ ID NO: 66269 - DNA, 1044 bp, Pseudomonas syringae pv. syringae B728a; identical to SEQ ID NO: 27738
  CDS (1)..(1044)

SEQ ID NO: 66270 - protein, 347 aa, Pseudomonas syringae pv. syringae B728a; identical to SEQ ID NO: 27739

SEQ ID NO: 66271 - DNA, 1041 bp, Rhodobacter sphaeroides 2.4.1; identical to SEQ ID NO: 27740
  CDS (1)..(1041)

SEQ ID NO: 66272 - protein, 346 aa, Rhodobacter sphaeroides 2.4.1; identical to SEQ ID NO: 27741

SEQ ID NO: 66273 - DNA, 1047 bp, Pseudomonas aeruginosa UCBPP-PA14; identical to SEQ ID NO: 27742
  CDS (1)..(1047)

SEQ ID NO: 66274 - protein, 348 aa, Pseudomonas aeruginosa UCBPP-PA14; identical to SEQ ID NO: 27743

SEQ ID NO: 66275 - DNA, 1077 bp, Psychrobacter sp. 273-4; identical to SEQ ID NO: 27744
  CDS (1)..(1077)

SEQ ID NO: 66276 - protein, 358 aa, Psychrobacter sp. 273-4; identical to SEQ ID NO: 27745

SEQ ID NO: 66277 - DNA, 1032 bp, Dechloromonas aromatica RCB; identical to SEQ ID NO: 27746
  CDS (1)..(1032)

SEQ ID NO: 66278 - protein, 343 aa, Dechloromonas aromatica RCB; identical to SEQ ID NO: 27747

SEQ ID NO: 66279 - DNA, 1035 bp, Ralstonia eutropha JMP134; identical to SEQ ID NO: 27748
  CDS (1)..(1035)

SEQ ID NO: 66280 - protein, 344 aa, Ralstonia eutropha JMP134; identical to SEQ ID NO: 27749

SEQ ID NO: 66281 - DNA, 1065 bp, Burkholderia cepacia R18194; identical to SEQ ID NO: 27750
  CDS (1)..(1065)

SEQ ID NO: 66282 - protein, 354 aa, Burkholderia cepacia R18194; identical to SEQ ID NO: 27751

SEQ ID NO: 66283 - DNA, 1047 bp, Rubrivivax gelatinosus PM1; identical to SEQ ID NO: 27752
  CDS (1)..(1047)

SEQ ID NO: 66284 - protein, 348 aa, Rubrivivax gelatinosus PM1; identical to SEQ ID NO: 27753

SEQ ID NO: 66285 - DNA, 1062 bp, Burkholderia fungorum LB400; identical to SEQ ID NO: 27754
  CDS (1)..(1062)

SEQ ID NO: 66286 - protein, 353 aa, Burkholderia fungorum LB400; identical to SEQ ID NO: 27755

SEQ ID NO: 66287 - DNA, 1041 bp, Novosphingobium aromaticivorans DSM 12444; identical to SEQ ID NO: 27756
  CDS (1)..(1041)

SEQ ID NO: 66288 - protein, 346 aa, Novosphingobium aromaticivorans DSM 12444; identical to SEQ ID NO: 27757

SEQ ID NO: 66289 - DNA, 1080 bp, Microbulbifer degradans 2-40; identical to SEQ ID NO: 27758
  CDS (1)..(1080)

SEQ ID NO: 66290 - protein, 359 aa, Microbulbifer degradans 2-40; identical to SEQ ID NO: 27759

SEQ ID NO: 66291 - DNA, 1035 bp, Thiobacillus denitrificans ATCC 25259; identical to SEQ ID NO: 27760
  CDS (1)..(1035)

SEQ ID NO: 66292 - protein, 344 aa, Thiobacillus denitrificans ATCC 25259; identical to SEQ ID NO: 27761

SEQ ID NO: 66293 - DNA, 996 bp, Chloroflexus aurantiacus; identical to SEQ ID NO: 27762
  CDS (1)..(996)

SEQ ID NO: 66294 - protein, 331 aa, Chloroflexus aurantiacus; identical to SEQ ID NO: 27763

SEQ ID NO: 66295 - DNA, 1005 bp, Campylobacter coli RM2228; identical to SEQ ID NO: 27764
  CDS (1)..(1005): transl_table=11

SEQ ID NO: 66296 - protein, 334 aa, Campylobacter coli RM2228; identical to SEQ ID NO: 27765

SEQ ID NO: 66297 - DNA, 993 bp, Campylobacter lari RM2100; identical to SEQ ID NO: 27766
  CDS (1)..(993): transl_table=11

SEQ ID NO: 66298 - protein, 330 aa, Campylobacter lari RM2100; identical to SEQ ID NO: 27767

SEQ ID NO: 66299 - DNA, 1002 bp, Campylobacter upsaliensis RM3195; identical to SEQ ID NO: 27768
  CDS (1)..(1002): transl_table=11

SEQ ID NO: 66300 - protein, 333 aa, Campylobacter upsaliensis RM3195; identical to SEQ ID NO: 27769

SEQ ID NO: 66301 - DNA, 1065 bp, Erythrobacter litoralis HTCC2594; identical to SEQ ID NO: 27770
  CDS (1)..(1065): transl_table=11

SEQ ID NO: 66302 - protein, 354 aa, Erythrobacter litoralis HTCC2594; identical to SEQ ID NO: 27771

SEQ ID NO: 66303 - DNA, 1080 bp, Azotobacter vinelandii AvOP; identical to SEQ ID NO: 27772
  CDS (1)..(1080): transl_table=11

SEQ ID NO: 66304 - protein, 359 aa, Azotobacter vinelandii AvOP; identical to SEQ ID NO: 27773

SEQ ID NO: 66305 - DNA, 1095 bp, Burkholderia vietnamiensis G4; identical to SEQ ID NO: 27774
  CDS (1)..(1095): transl_table=11

SEQ ID NO: 66306 - protein, 364 aa, Burkholderia vietnamiensis G4; identical to SEQ ID NO: 27775

SEQ ID NO: 66307 - DNA, 1095 bp, Burkholderia cenocepacia AU 1054; identical to SEQ ID NO: 27776
  CDS (1)..(1095): transl_table=11

SEQ ID NO: 66308 - protein, 364 aa, Burkholderia cenocepacia AU 1054; identical to SEQ ID NO: 27777

SEQ ID NO: 66309 - DNA, 1056 bp, Chromohalobacter salexigens DSM 3043; identical to SEQ ID NO: 27778
  CDS (1)..(1056): transl_table=11

SEQ ID NO: 66310 - protein, 351 aa, Chromohalobacter salexigens DSM 3043; identical to SEQ ID NO: 27779

SEQ ID NO: 66311 - DNA, 1059 bp, Burkholderia pseudomallei 668; identical to SEQ ID NO: 27780
  CDS (1)..(1059)

SEQ ID NO: 66312 - protein, 352 aa, Burkholderia pseudomallei 668; identical to SEQ ID NO: 27781

SEQ ID NO: 66313 - DNA, 1068 bp, Polaromonas sp. JS666; identical to SEQ ID NO: 27782
  CDS (1)..(1068): transl_table=11

SEQ ID NO: 66314 - protein, 355 aa, Polaromonas sp. JS666; identical to SEQ ID NO: 27783

SEQ ID NO: 66315 - DNA, 1341 bp, Jannaschia sp. CCS1; identical to SEQ ID NO: 27784
  CDS (1)..(1341): transl_table=11

SEQ ID NO: 66316 - protein, 446 aa, Jannaschia sp. CCS1; identical to SEQ ID NO: 27785

SEQ ID NO: 66317 - DNA, 1038 bp, Methylobacillus flagellatus KT; identical to SEQ ID NO: 27786
  CDS (1)..(1038): transl_table=11

SEQ ID NO: 66318 - protein, 345 aa, Methylobacillus flagellatus KT; identical to SEQ ID NO: 27787

SEQ ID NO: 66319 - DNA, 1023 bp, Sphingopyxis alaskensis RB2256; identical to SEQ ID NO: 27788
  CDS (1)..(1023): transl_table=11

SEQ ID NO: 66320 - protein, 340 aa, Sphingopyxis alaskensis RB2256; identical to SEQ ID NO: 27789

SEQ ID NO: 66321 - DNA, 1032 bp, Shewanella baltica OS155; identical to SEQ ID NO: 27790
  CDS (1)..(1032): transl_table=11

SEQ ID NO: 66322 - protein, 343 aa, Shewanella baltica OS155; identical to SEQ ID NO: 27791

SEQ ID NO: 66323 - DNA, 1029 bp, Shewanella amazonensis SB2B; identical to SEQ ID NO: 27792
  CDS (1)..(1029): transl_table=11

SEQ ID NO: 66324 - protein, 342 aa, Shewanella amazonensis SB2B; identical to SEQ ID NO: 27793

SEQ ID NO: 66325 - DNA, 1035 bp, Ralstonia metallidurans CH34; identical to SEQ ID NO: 27794
  CDS (1)..(1035): transl_table=11

SEQ ID NO: 66326 - protein, 344 aa, Ralstonia metallidurans CH34; identical to SEQ ID NO: 27795

SEQ ID NO: 66327 - DNA, 1041 bp, Mesorhizobium sp. BNC1; identical to SEQ ID NO: 27796
  CDS (1)..(1041): transl_table=11

SEQ ID NO: 66328 - protein, 346 aa, Mesorhizobium sp. BNC1; identical to SEQ ID NO: 27797

SEQ ID NO: 66329 - DNA, 1041 bp, Silicibacter sp. TM1040; identical to SEQ ID NO: 27798
  CDS (1)..(1041): transl_table=11

SEQ ID NO: 66330 - protein, 346 aa, Silicibacter sp. TM1040; identical to SEQ ID NO: 27799

SEQ ID NO: 66331 - DNA, 1044 bp, Paracoccus denitrificans PD1222; identical to SEQ ID NO: 27800
  CDS (1)..(1044): transl_table=11

SEQ ID NO: 66332 - protein, 347 aa, Paracoccus denitrificans PD1222; identical to SEQ ID NO: 27801

SEQ ID NO: 66333 - DNA, 1035 bp, Shewanella denitrificans OS-217; identical to SEQ ID NO: 27802
  CDS (1)..(1035): transl_table=11

SEQ ID NO: 66334 - protein, 344 aa, Shewanella denitrificans OS-217; identical to SEQ ID NO: 27803

SEQ ID NO: 66335 - DNA, 1038 bp, Shewanella frigidimarina NCIMB 400; identical to SEQ ID NO: 27804
  CDS (1)..(1038): transl_table=11

SEQ ID NO: 66336 - protein, 345 aa, Shewanella frigidimarina NCIMB 400; identical to SEQ ID NO: 27805

SEQ ID NO: 66337 - DNA, 1047 bp, Pseudomonas fluorescens; identical to SEQ ID NO: 27806
  CDS (1)..(1047): transl_table=11

SEQ ID NO: 66338 - protein, 348 aa, Pseudomonas fluorescens; identical to SEQ ID NO: 27807

SEQ ID NO: 66339 - DNA, 888 bp, Theileria parva; identical to SEQ ID NO: 27808
  CDS (1)..(888)

SEQ ID NO: 66340 - protein, 295 aa, Theileria parva; identical to SEQ ID NO: 27809

SEQ ID NO: 66341 - DNA, 1053 bp, Theileria annulata; identical to SEQ ID NO: 27810
  CDS (1)..(1053)

SEQ ID NO: 66342 - protein, 350 aa, Theileria annulata; identical to SEQ ID NO: 27811

SEQ ID NO: 66343 - DNA, 1005 bp, Aspergillus fumigatus Af293; identical to SEQ ID NO: 27812
  CDS (1)..(1005)

SEQ ID NO: 66344 - protein, 334 aa, Aspergillus fumigatus Af293; identical to SEQ ID NO: 27813

SEQ ID NO: 66345 - DNA, 1086 bp, Plasmodium chabaudi; identical to SEQ ID NO: 27814
  CDS (1)..(1086)

SEQ ID NO: 66346 - protein, 361 aa, Plasmodium chabaudi; identical to SEQ ID NO: 27815

SEQ ID NO: 66347 - DNA, 1086 bp, Plasmodium yoelii yoelii; identical to SEQ ID NO: 27816
  CDS (1)..(1086)

SEQ ID NO: 66348 - protein, 361 aa, Plasmodium yoelii yoelii; identical to SEQ ID NO: 27817

SEQ ID NO: 66349 - DNA, 1212 bp, Toxoplasma gondii; identical to SEQ ID NO: 27818
  CDS (1)..(1212)

SEQ ID NO: 66350 - protein, 403 aa, Toxoplasma gondii; identical to SEQ ID NO: 27819

SEQ ID NO: 66351 - DNA, 1038 bp, Beta vulgaris; identical to SEQ ID NO: 27820
  CDS (1)..(1038)

SEQ ID NO: 66352 - protein, 345 aa, Beta vulgaris; identical to SEQ ID NO: 27821

SEQ ID NO: 66353 - DNA, 1038 bp, Agrobacterium tumefaciens; identical to SEQ ID NO: 27822
  CDS (1)..(1038)

SEQ ID NO: 66354 - protein, 345 aa, Agrobacterium tumefaciens; identical to SEQ ID NO: 27823

SEQ ID NO: 66355 - DNA, 1269 bp, Aquifex aeolicus; identical to SEQ ID NO: 27824
  CDS (1)..(1269): transl_table=11

SEQ ID NO: 66356 - protein, 422 aa, Aquifex aeolicus; identical to SEQ ID NO: 27825

SEQ ID NO: 66357 - DNA, 1134 bp, Arabidopsis thaliana; identical to SEQ ID NO: 27826
  CDS (1)..(1134)

SEQ ID NO: 66358 - protein, 377 aa, Arabidopsis thaliana; identical to SEQ ID NO: 27827

SEQ ID NO: 66359 - DNA, 1053 bp, Buchnera aphidicola; identical to SEQ ID NO: 27828
  CDS (1)..(1053): transl_table=11

SEQ ID NO: 66360 - protein, 350 aa, Buchnera aphidicola; identical to SEQ ID NO: 27829

SEQ ID NO: 66361 - DNA, 1050 bp, Buchnera aphidicola; identical to SEQ ID NO: 27830
  CDS (1)..(1050): transl_table=11

SEQ ID NO: 66362 - protein, 349 aa, Buchnera aphidicola; identical to SEQ ID NO: 27831

SEQ ID NO: 66363 - DNA, 1020 bp, Helicobacter pylori J99; identical to SEQ ID NO: 27832
  CDS (1)..(1020): transl_table=11

SEQ ID NO: 66364 - protein, 339 aa, Helicobacter pylori J99; identical to SEQ ID NO: 27833

SEQ ID NO: 66365 - DNA, 1020 bp, Helicobacter pylori; identical to SEQ ID NO: 27834
  CDS (1)..(1020): transl_table=11

SEQ ID NO: 66366 - protein, 339 aa, Helicobacter pylori; identical to SEQ ID NO: 27835

SEQ ID NO: 66367 - DNA, 1281 bp, Listeria innocua; identical to SEQ ID NO: 27836
  CDS (1)..(1281): transl_table=11

SEQ ID NO: 66368 - protein, 426 aa, Listeria innocua; identical to SEQ ID NO: 27837

SEQ ID NO: 66369 - DNA, 1281 bp, Listeria monocytogenes; identical to SEQ ID NO: 27838
  CDS (1)..(1281): transl_table=11

SEQ ID NO: 66370 - protein, 426 aa, Listeria monocytogenes; identical to SEQ ID NO: 27839

SEQ ID NO: 66371 - DNA, 1281 bp, Listeria monocytogenes; identical to SEQ ID NO: 27840
  CDS (1)..(1281): transl_table=11

SEQ ID NO: 66372 - protein, 426 aa, Listeria monocytogenes; identical to SEQ ID NO: 27841

SEQ ID NO: 66373 - DNA, 1035 bp, Neisseria meningitidis; identical to SEQ ID NO: 27842
  CDS (1)..(1035): transl_table=11

SEQ ID NO: 66374 - protein, 344 aa, Neisseria meningitidis; identical to SEQ ID NO: 27843

SEQ ID NO: 66375 - DNA, 1047 bp, Pseudomonas aeruginosa; identical to SEQ ID NO: 27844
  CDS (1)..(1047): transl_table=11

SEQ ID NO: 66376 - protein, 348 aa, Pseudomonas aeruginosa; identical to SEQ ID NO: 27845

SEQ ID NO: 66377 - DNA, 1047 bp, Pseudomonas putida; identical to SEQ ID NO: 27846
  CDS (1)..(1047): transl_table=11

SEQ ID NO: 66378 - protein, 348 aa, Pseudomonas putida; identical to SEQ ID NO: 27847

SEQ ID NO: 66379 - DNA, 1035 bp, Ralstonia solanacearum; identical to SEQ ID NO: 27848
  CDS (1)..(1035): transl_table=11

SEQ ID NO: 66380 - protein, 344 aa, Ralstonia solanacearum; identical to SEQ ID NO: 27849

SEQ ID NO: 66381 - DNA, 1044 bp, Rhizobium meliloti; identical to SEQ ID NO: 27850
  CDS (1)..(1044): transl_table=11

SEQ ID NO: 66382 - protein, 347 aa, Rhizobium meliloti; identical to SEQ ID NO: 27851

SEQ ID NO: 66383 - DNA, 1047 bp, Salmonella typhimurium; identical to SEQ ID NO: 27648
  CDS (1)..(1047)

SEQ ID NO: 66384 - protein, 348 aa, Salmonella typhimurium; identical to SEQ ID NO: 27649

SEQ ID NO: 66385 - DNA, 1014 bp, Schizosaccharomyces pombe; identical to SEQ ID NO: 27854
  CDS (1)..(1014)

SEQ ID NO: 66386 - protein, 337 aa, Schizosaccharomyces pombe; identical to SEQ ID NO: 27855

SEQ ID NO: 66387 - DNA, 1278 bp, Staphylococcus epidermidis; identical to SEQ ID NO: 27856
  CDS (1)..(1278): transl_table=11

SEQ ID NO: 66388 - protein, 425 aa, Staphylococcus epidermidis; identical to SEQ ID NO: 27857

SEQ ID NO: 66389 - DNA, 1278 bp, Staphylococcus epidermidis; identical to SEQ ID NO: 27858
  CDS (1)..(1278): transl_table=11

SEQ ID NO: 66390 - protein, 425 aa, Staphylococcus epidermidis; identical to SEQ ID NO: 27859

SEQ ID NO: 66391 - DNA, 1029 bp, Synechocystis sp; identical to SEQ ID NO: 27860
  CDS (1)..(1029): transl_table=11

SEQ ID NO: 66392 - protein, 342 aa, Synechocystis sp; identical to SEQ ID NO: 27861

SEQ ID NO: 66393 - DNA, 1176 bp, Ustilago maydis; identical to SEQ ID NO: 27862
  CDS (1)..(1176)

SEQ ID NO: 66394 - protein, 391 aa, Ustilago maydis; identical to SEQ ID NO: 27863

SEQ ID NO: 66395 - DNA, 1029 bp, Vibrio cholerae; identical to SEQ ID NO: 27864
  CDS (1)..(1029)

SEQ ID NO: 66396 - protein, 342 aa, Vibrio cholerae; identical to SEQ ID NO: 27865

SEQ ID NO: 66397 - DNA, 1029 bp, Vibrio parahaemolyticus; identical to SEQ ID NO: 27866
  CDS (1)..(1029): transl_table=11

SEQ ID NO: 66398 - protein, 342 aa, Vibrio parahaemolyticus; identical to SEQ ID NO: 27867

SEQ ID NO: 66399 - DNA, 1029 bp, Vibrio vulnificus; identical to SEQ ID NO: 27868
  CDS (1)..(1029)

SEQ ID NO: 66400 - protein, 342 aa, Vibrio vulnificus; identical to SEQ ID NO: 27869

SEQ ID NO: 66401 - DNA, 1029 bp, Vibrio vulnificus; identical to SEQ ID NO: 27870
  CDS (1)..(1029)

SEQ ID NO: 66402 - protein, 342 aa, Vibrio vulnificus; identical to SEQ ID NO: 27871

SEQ ID NO: 66403 - DNA, 1095 bp, Saccharomyces cerevisiae; identical to SEQ ID NO: 27872
  CDS (1)..(1095)

SEQ ID NO: 66404 - protein, 364 aa, Saccharomyces cerevisiae; identical to SEQ ID NO: 27873

SEQ ID NO: 66405 - DNA, 1047 bp, Yersinia pestis; identical to SEQ ID NO: 27874
  CDS (1)..(1047): transl_table=11

SEQ ID NO: 66406 - protein, 348 aa, Yersinia pestis; identical to SEQ ID NO: 27875

SEQ ID NO: 66407 - DNA, 23 bp, Artificial sequence
  (1)..(23): primer
atgactgcaccatcccaggtatt

SEQ ID NO: 66408 - DNA, 24 bp, Artificial sequence
  (1)..(24): primer
ttattgtttaacggaccagcgtac

SEQ ID NO: 66409 - protein, 478 aa, Artificial sequence; identical to SEQ ID NO: 27878
  Variant (2)..(2): xaa in position 2 is any amino acid
  Variant (4)..(5): xaa in position 4 to 5 is any amino acid
  Variant (7)..(7): xaa in position 7 is any amino acid
  Variant (9)..(9): xaa in position 9 is any amino acid
  Variant (15)..(16): xaa in position 15 to 16 is any or no amino acid
  Variant (19)..(20): xaa in position 19 to 20 is any amino acid
  Variant (22)..(33): xaa in position 22 to 33 is any amino acid
  Variant (34)..(41): xaa in position 34 to 41 is any or no amino acid
  Variant (49)..(49): xaa in position 49 is any or no amino acid
  Variant (51)..(51): xaa in position 51 is any or no amino acid
  Variant (54)..(58): xaa in position 54 to 58 is any amino acid
  Variant (59)..(61): xaa in position 59 to 61 is any or no amino acid
  Variant (64)..(64): xaa in position 64 is any amino acid
  Variant (65)..(65): xaa in position 65 is any or no amino acid
  Variant (67)..(84): xaa in position 67 to 84 is any or no amino acid
  Variant (88)..(89): xaa in position 88 to 89 is any or no amino acid
  Variant (92)..(92): xaa in position 92 is any amino acid
  Variant (93)..(98): xaa in position 93 to 98 is any or no amino acid
  Variant (101)..(102): xaa in position 101 to 102 is any amino acid
  Variant (104)..(106): xaa in position 104 to 106 is any amino acid
  Variant (107)..(108): xaa in position 107 to 108 is any or no amino acid
  Variant (110)..(110): xaa in position 110 is any amino acid
  Variant (112)..(112): xaa in position 112 is any amino acid
  Variant (118)..(119): xaa in position 118 to 119 is any amino acid
  Variant (124)..(125): xaa in position 124 to 125 is any amino acid
  Variant (128)..(139): xaa in position 128 to 139 is any amino acid
  Variant (140)..(145): xaa in position 140 to 145 is any or no amino acid
  Variant (147)..(150): xaa in position 147 to 150 is any amino acid
  Variant (152)..(152): xaa in position 152 is any amino acid
  Variant (154)..(154): xaa in position 154 is any amino acid
  Variant (159)..(161): xaa in position 159 to 161 is any amino acid
  Variant (162)..(181): xaa in position 162 to 181 is any or no amino acid
  Variant (183)..(185): xaa in position 183 to 185 is any amino acid
  Variant (187)..(188): xaa in position 187 to 188 is any amino acid
  Variant (191)..(192): xaa in position 191 to 192 is any amino acid
  Variant (193)..(203): xaa in position 193 to 203 is any or no amino acid
  Variant (205)..(206): xaa in position 205 to 206 is any amino acid
  Variant (208)..(211): xaa in position 208 to 211 is any amino acid
  Variant (213)..(213): xaa in position 213 is any amino acid
  Variant (218)..(218): xaa in position 218 is any amino acid
  Variant (224)..(225): xaa in position 224 to 225 is any amino acid
  Variant (227)..(229): xaa in position 227 to 229 is any amino acid
  Variant (231)..(235): xaa in position 231 to 235 is any amino acid
  Variant (236)..(244): xaa in position 236 to 244 is any or no amino acid
  Variant (246)..(246): xaa in position 246 is any or no amino acid
  Variant (251)..(252): xaa in position 251 to 252 is any amino acid
  Variant (255)..(260): xaa in position 255 to 260 is any amino acid
  Variant (262)..(264): xaa in position 262 to 264 is any amino acid
  Variant (265)..(265): xaa in position 265 is any or no amino acid
  Variant (267)..(288): xaa in position 267 to 288 is any or no amino acid
  Variant (290)..(290): xaa in position 290 is any or no amino acid
  Variant (293)..(293): xaa in position 293 is any amino acid
  Variant (296)..(296): xaa in position 296 is any amino acid
  Variant (298)..(303): xaa in position 298 to 303 is any amino acid
  Variant (306)..(310): xaa in position 306 to 310 is any amino acid
  Variant (311)..(311): xaa in position 311 is any or no amino acid
  Variant (314)..(315): xaa in position 314 to 315 is any amino acid
  Variant (317)..(317): xaa in position 317 is any amino acid
  Variant (319)..(319): xaa in position 319 is any amino acid
  Variant (327)..(330): xaa in position 327 to 330 is any amino acid
  Variant (332)..(364): xaa in position 332 to 364 is any or no amino acid
  Variant (367)..(367): xaa in position 367 is any amino acid
  Variant (369)..(369): xaa in position 369 is any amino acid
  Variant (371)..(373): xaa in position 371 to 373 is any amino acid
  Variant (375)..(375): xaa in position 375 is any amino acid
  Variant (376)..(390): xaa in position 376 to 390 is any or no amino acid
  Variant (393)..(395): xaa in position 393 to 395 is any amino acid
  Variant (396)..(396): xaa in position 396 is any or no amino acid
  Variant (398)..(399): xaa in position 398 to 399 is any amino acid
  Variant (401)..(402): xaa in position 401 to 402 is any amino acid
  Variant (404)..(404): xaa in position 404 is any amino acid
  Variant (406)..(407): xaa in position 406 to 407 is any amino acid
  Variant (409)..(410): xaa in position 409 to 410 is any amino acid
  Variant (413)..(413): xaa in position 413 is any amino acid
  Variant (415)..(420): xaa in position 415 to 420 is any amino acid
  Variant (421)..(426): xaa in position 421 to 426 is any or no amino acid
  Variant (428)..(428): xaa in position 428 is any amino acid
  Variant (430)..(430): xaa in position 430 is any amino acid
  Variant (432)..(441): xaa in position 432 to 441 is any amino acid
  Variant (442)..(466): xaa in position 442 to 466 is any or no amino acid
  Variant (468)..(468): xaa in position 468 is any amino acid
  Variant (470)..(472): xaa in position 470 to 472 is any amino acid
  Variant (474)..(475): xaa in position 474 to 475 is any amino acid
  Variant (477)..(477): xaa in position 477 is any amino acid

SEQ ID NO: 66410 - protein, 17 aa, Artificial sequence
  Variant (2)..(3): xaa in position 2 to 3 is any amino acid
  Variant (4)..(5): xaa in position 4 to 5 is any or no amino acid
  Variant (7)..(7): xaa in position 7 is any amino acid
  Variant (8)..(9): xaa in position 8 to 9 is any or no amino acid
  Variant (11)..(11): xaa in position 11 is any amino acid
  Variant (13)..(13): xaa in position 13 is any amino acid
  Variant (15)..(15): xaa in position 15 is Phe, Leu or Val
  Variant (17)..(17): xaa in position 17 is Asp, Glu or Gln
LXXXXPXXXDXHXHXRX

SEQ ID NO: 66411 - protein, 25 aa, Artificial sequence
  Variant (2)..(3): xaa in position 2 to 3 is any amino acid
  Variant (4)..(4): xaa in position 4 is any or no amino acid
  Variant (8)..(10): xaa in position 8 to 10 is any amino acid
  Variant (12)..(12): xaa in position 12 is Ala, Ile, Leu or Val
  Variant (13)..(20): xaa in position 13 to 20 is any amino acid
  Variant (22)..(24): xaa in position 22 to 24 is any amino acid
  Variant (25)..(25): xaa in position 25 is Ile or Leu
AXXXMPNXXXPXXXXXXXXXYXXXX

SEQ ID NO: 66412 - protein, 8 aa, Artificial sequence
  Variant (2)..(2): xaa in position 2 is any or no amino acid
  Variant (4)..(5): xaa in position 4 to 5 is any or no amino acid
LXLXXHGE

SEQ ID NO: 66413 - protein, 41 aa, Artificial sequence; identical to SEQ ID NO: 27882
  Variant (2)..(2): xaa in position 2 is any amino acid
  Variant (4)..(4): xaa in position 4 is Ile, Leu or Val
  Variant (5)..(5): xaa in position 5 is Ala, Leu, Pro or Val
  Variant (7)..(9): xaa in position 7 to 9 is any amino acid
  Variant (10)..(10): xaa in position 10 is Asp or His
  Variant (11)..(12): xaa in position 11 to 12 is any amino acid
  Variant (13)..(13): xaa in position 13 is Ala, Ser, Thr or Val
  Variant (15)..(17): xaa in position 15 to 17 is any amino acid
  Variant (18)..(18): xaa in position 18 is Ala, Ile or Val
  Variant (19)..(19): xaa in position 19 is any amino acid
  Variant (20)..(20): xaa in position 20 is Ala, Asp, Glu, Gly, Asn, Gln, Ser or Thr
  Variant (22)..(24): xaa in position 22 to 24 is any amino acid
  Variant (25)..(26): xaa in position 25 to 26 is any or no amino acid
  Variant (28)..(29): xaa in position 28 to 29 is any or no amino acid
  Variant (31)..(31): xaa in position 31 is Ser or Thr
  Variant (33)..(33): xaa in position 33 is Ser or Thr
  Variant (37)..(40): xaa in position 37 to 40 is any amino acid

SEQ ID NO: 66414 - DNA, 1269 bp, Escherichia coli K12
  CDS (1)..(1269): transl_table=11
atgtttgccctctgtgatgtaaacgcgttttatgccagctgtgagacggtgtttcgccctgatttatggggtaaaccggtggttgtgctatcgaataatgacggttgcgttatcgcccgaaacgctgaggcaaaggcgcttggcgttaaaatgggcgatccctggttcaaacaaaaagatctgtttcgtcgctgtggcgtggtttgctttagcagcaattatgagctttacgcagacatgagcaatcgggtgatgtcgacgctggaagagctatcgccccgcgtcgagatttacagtattgatgaggcattctgcgatctgacaggtgtgcgtaattgtcgcgatctgactgattttggcagagaaattcgcgcaacggtgctacaacgtacccatcttactgttggtgtggggatcgcccagaccaaaacgctggctaagcttgccaatcatgcggcaaaaaaatggcagcggcagacgggtggggtggtggatttatcaaatctggaacgccagcgtaaattaatgtctgctctccccgtggatgacgtctgggggattggacggcggatcagcaaaaaactggacgcgatggggatcaaaaccgttctcgatttggcggatacagatatccggtttatccgtaaacattttaatgtcgtgctcgaaagaacggtgcgtgaactgcgcggcgaaccctgtttgcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcggtttatctccacgtttattaagacgtcaccatttgcgctcaatgaaccttattacggcaatagcgcgtcggtaaaactgctgacgcccactcaggacagcagggatatcattaacgctgctacgcgatctctggatgccatctggcaagcgggccatcgttaccaaaaagcgggcgtgatgctgggggatttcttcagtcagggagtcgcgcagctcaatttattcgatgacaacgcaccgcgccccgggagtgagcaattgatgacggtaatggatacactgaatgctaaagagggcagaggaacactctattttgccgggcaggggatccagcaacaatggcagatgaagcgagccatgctttcaccacgttatacaacgcgaagttctgatttactgagggtcaaataa

SEQ ID NO: 66415 - protein, 422 aa, Escherichia coli K12 [sequence omitted]

SEQ ID NO: 66416 - DNA, 1209 bp, Salmonella typhi
  CDS (1)..(1209): transl_table=11
atggaccccaaacttgccaaatccccgctcatcatcgcgagcaacaacgatgccaccattatcgccatgaacaggctcgccaaaaatacagggctcaaacgcgggatgcctatcttcaaatgccgggatctgattgagcagcatcatattgcggtacggagctccaactttacgttgtacgaagattattccaaccggtttcatgaaacgctggaggggtttgccgaggataccgatcgttacagcgtggatgaaagcttcatgctactgaaaaacatggacaaaatagtagattttgaagagtacggatgcctgatcagacgaacgctgctacacaatctttcgctcacctgcgggattggagtatcgaccacgaaaacgctcgcaaaattatgcacctacgccagtaagcgatgggcagcaactggtggtgtggtcgtccttacagacccattccgaattaaaaaactgctgagtctcatcagtacccgggaaatctggggcattggccgcaaaatcagtgagcggctggctgcgtacgggatcatcacggcctgcgacttttatgacagcgatgtgcggtttttacgaaaggcattcggtgttgaaatggaacgtacctggcgggagctgcatggcgagtcctgtttccggttgcatgaatcccctcctgtcagacaacaaattatcgtctcgcggagctttggccagcgccttaatacattcagcaagatgcatgaggcagtgtcattctttaccggccgtgccgctgaacagcttcgaaacgatggctcctggactcgccaaatcaccgtgtttatccagagcagcccgtttgccagagctgaaacccggtacagcagctgcggtattgagccgcttactgcgacgcaggacacccgcgacctggtcagtgcggcaggcgccatactgacccgaatctacaaacccggcatagattatgcgaaggcgggcgtgatgctttcgtcaatgaccgatggcactgagcagctatccctgttcgatgaacgtcccgccaggcgaggcagtgaagcactgatgaaggtgatggatcggtttaacaaagagcatcgaggctctctgtttctggcttgcgaagggattcatcaggatttccgggggaagcaggccatgctgtccccacggtataccactcgctggaatgagttacttgtcgtcaaagcctga

SEQ ID NO: 66417 - protein, 402 aa, Salmonella typhi
MDPKLAKSPLIIASNNDATIIAMNRLAKNTGLKRGMPIFKCRDLIEQHHIAVRSSNFTLYEDYSNRFHETLEGFAEDTDRYSVDESFMLLKNMDKIVDFEEYGCLIRRTLLHNLSLTCGIGVSTTKTLAKLCTYASKRWAATGGVVVLTDPFRIKKLLSLISTREIWGIGRKISERLAAYGIITACDFYDSDVRFLRKAFGVEMERTWRELHGESCFRLHESPPVRQQIIVSRSFGQRLNTFSKMHEAVSFFTGRAAEQLRNDGSWTRQITVFIQSSPFARAETRYSSCGIEPLTATQDTRDLVSAAGAILTRIYKPGIDYAKAGVMLSSMTDGTEQLSLFDERPARRGSEALMKVMDRFNKEHRGSLFLACEGIHQDFRGKQAMLSPRYTTRWNELLVVKA

SEQ ID NO: 66418 - DNA, 1275 bp, Salmonella enterica subsp. enterica serovar Choleraesuis
  CDS (1)..(1275): transl_table=11
atgttcgctttggctgacgtcaactcgttctatgccagttgcgaaaaggtctttcgccccgatttgcgtgacaggtctgtggtggtcctgagtaacaacgatggttgtgtaattccgcgcagcgctgaagcaaaaaaactgggcataaaaatgggggtgccgtggtttcaactgaggtcggcgaaatttccggagccggttatcgcgttctccagtaattacgccctctacgcatcaatgtcgaacagggtcatggttcaccaggaagagctggcgccacgcgttgagcagtactccattgacgagatgtttctggatattcgcggtatagacagttgcatcgatttcgaggatttcggccgacagctgcgtgagcacgttcgttccggcacagggctgaccatcggcgtcggaatgggaccgaccaaaacgctggctaaaagcgcgcaatgggcatcgaaagaatggtcacagttcggaggcatgcttgccctgacgttacacaatcagaaacgaacggagaaactgctgtcactgcaaccggtggaggaaatctggggtgtgggccgcaggatctcaaagaagctgaacacaatggggatcaccacagcactgcagctggcccgcgcgaatccaacgttcatcaggaaaaactttaatgtggttctggagagaacggtccgggaactcaatggagaaagctgtatttccctggaggaagcaccgccccccaaacagcagatagtctgcagcagaagctttggagaacgagtcacgacttatgaagcgatgcggcaggcagtctgtcagcacgctgaacgtcgcgccgaaaagctgcgtggggaacggcagttctgcaggcatattgccgtgtttgtgaaaacatcgccgttcgccgtaactgagccctactacggtaatctggccagtgaaaaactgctcatccccacgcaggatacacgggacatcattgccgctgccgtcagagctctggacaggatctgggtggatggtcaccgttacgcaaaggcaggctgtatgctgaacgatttcacgccaaccagggtatcgcagcttaatttgtttgatgaagtacagccgcgggaacggagcgagcagctgatgcaagtcctagatgggattaaccatccgggcaaggggaaaatatggttcgccggtcgggggattgcccccgagtggcagatgaaaagggaactactttcgccagcttatacgacacgttgggcagatattcctgcagcgaaattgacttga

SEQ ID NO: 66419 - protein, 424 aa, Salmonella enterica subsp. enterica serovar Choleraesuis
MFALADVNSFYASCEKVFRPDLRDRSVVVLSNNDGCVIPRSAEAKKLGIKMGVPWFQLRSAKFPEPVIAFSSNYALYASMSNRVMVHQEELAPRVEQYSIDEMFLDIRGIDSCIDFEDFGRQLREHVRSGTGLTIGVGMGPTKTLAKSAQWASKEWSQFGGMLALTLHNQKRTEKLLSLQPVEEIWGVGRRISKKLNTMGITTALQLARANPTFIRKNFNVVLERTVRELNGESCISLEEAPPPKQQIVCSRSFGERVTTYEAMRQAVCQHAERRAEKLRGERQFCRHIAVFVKTSPFAVTEPYYGNLASEKLLIPTQDTRDIIAAAVRALDRIWVDGHRYAKAGCMLNDFTPTRVSQLNLFDEVQPRERSEQLMQVLDGINHPGKGKIWFAGRGIAPEWQMKRELLSPAYTTRWADIPAAKLT

SEQ ID NO: 66420 - DNA, 1269 bp, Escherichia coli O157:H7 EDL933
  CDS (1)..(1269): n means a or g or c or t/u, s means g or c
atgtttgccctctgtgatgtaaacgcgttttatgccagctgtgagacggtgtttcgccctgagttatggggtaaaccggtggttgtgctatcgaataatgacggttgcgttatcgcccgaaacgctgaggcaaaggcgcttggcgttaaaatgggcgatccctggttcaaacaaaaagatctgtttcgtcgctgtggcgtggtttgctttagcagcaattatgagctttacgcagacatgagcaatcgggtgatgtcgacgctggaagaactatcgccccgcgtcgagatttacagtattgatgaggcattctgcgatctgacaggtgtgcgtaattgtcgcgatctgactgactttggcagagaaattcgcgcaacggtgctacaacgtacccatcttactgttggtgtggggatcgcccagaccaaaacgctggctaagcttgccaatcatgcggcaaaaaaatggcagcggcagacgggtggggtggtggatttatcaaatctggawygccagcgtaaattaatgtctgctctccccgtggatgacgtctgggggattggacggcggatcagcaaaaaactggacgcgatggggatcaaaaccgttctcgatttggcggatacagatatccggtttatccgtaaacattttaatgtcgtgctcgaaagaacggtgcgtgaactgcgcggtgaaccctgtttgcaactggaagaatttgcaccgacaaagcaggaaattatctgttcccgctcgtttggtgaacgcatcacggattatacgtcgatgcggcaggccatttgtagttacgctgcccgggcggcggaaaaacttcgcagtgagcatcaatattgtcggtttatctccacatttattaagacgtcaccatttgcgctcaatgaaccttattacggcaatagcgcgtcggtaaaactgctgacgcccactcaggacagcagggatatcattaacgccgctacgcgatctctggatgccatctggcaagcgggccatcgctaccaaaaagcgggcgtgatgctgggggatttcttcagtcagggagtcgcgcagctcaatttattcgatgacaacgctccgcgccccgggagtgagcaattgatggcggtaatggatacactgaatgctaaagagggcagaggaacactctattttgccgggcaggggatccagcaacaatggcagatgaagcgagccatgctttcaccacgttatacaacgcgaagttctgatttactgcgggtcaaataa

SEQ ID NO: 66421 - protein, 422 aa, Escherichia coli O157:H7 EDL933
  Xaa in positions 170 and 171 is unknown
MFALCDVNAFYASCETVFRPELWGKPVVVLSNNDGCVIARNAEAKALGVKMGDPWFKQKDLFRRCGVVCFSSNYELYADMSNRVMSTLEELSPRVEIYSIDEAFCDLTGVRNCRDLTDFGREIRATVLQRTHLTVGVGIAQTKTLAKLANHAAKKWQRQTGGVVDLSNLXXQRKLMSALPVDDVWGIGRRISKKLDAMGIKTVLDLADTDIRFIRKHFNVVLERTVRELRGEPCLQLEEFAPTKQEIICSRSFGERITDYTSMRQAICSYAARAAEKLRSEHQYCRFISTFIKTSPFALNEPYYGNSASVKLLTPTQDSRDIINAATRSLDAIWQAGHRYQKAGVMLGDFFSQGVAQLNLFDDNAPRPGSEQLMAVMDTLNAKEGRGTLYFAGQGIQQQWQMKRAMLSPRYTTRSSDLLRVK

SEQ ID NO: 66422 - DNA, 1269 bp, Escherichia coli O157:H7
  CDS (1)..(1269): transl_table=11
atgtttgccctctgtgatgtaaacgcgttttatgccagctgtgagacggtgtttcgccctgagttatggggtaaaccggtggttgtgctatcgaataatgacggttgcgttatcgcccgaaacgctgaggcaaaggcgcttggcgttaaaatgggcgatccctggttcaaacaaaaagatctgtttcgtcgctgtggcgtggtttgctttagcagcaattatgagctttacgcagacatgagcaatcgggtgatgtcgacgctggaagaactatcgccccgcgtcgagatttacagtattgatgaggcattctgcgatctgacaggtgtgcgtaattgtcgcgatctgactgactttggcagagaaattcgcgcaacggtgctacaacgtacccatcttactgttggtgtggggatcgcccagaccaaaacgctggctaagcttgccaatcatgcggcaaaaaaatggcagcggcagacgggtggggtggtggatttatcaaatctggaacgccagcgtaaattaatgtctgctctccccgtggatgacgtctgggggattggacggcggatcagcaaaaaactggacgcgatggggatcaaaaccgttctcgatttggcggatacagatatccggtttatccgtaaacattttaatgtcgtgctcgaaagaacggtgcgtgaactgcgcggtgaaccctgtttgcaactggaagaatttgcaccgacaaagcaggaaattatctgttcccgctcgtttggtgaacgcatcacggattatacgtcgatgcggcaggccatttgtagttacgctgcccgggcggcggaaaaacttcgcagtgagcatcaatattgtcggtttatctccacatttattaagacgtcaccatttgcgctcaatgaaccttattacggcaatagcgcgtcggtaaaactgctgacgcccactcaggacagcagggatatcattaacgccgctacgcgatctctggatgccatctggcaagcgggccatcgctaccaaaaagcgggcgtgatgctgggggatttcttcagtcagggagtcgcgcagctcaatttattcgatgacaacgctccgcgccccgggagtgagcaattgatggcggtaatggatacactgaatgctaaagagggcagaggaacactctattttgccgggcaggggatccagcaacaatggcagatgaagcgagccatgctttcaccacgttatacaacgcgaagttctgatttactgcgggtcaaataa

SEQ ID NO: 66423 - protein, 422 aa, Escherichia coli O157:H7
MFALCDVNAFYASCETVFRPELWGKPVVVLSNNDGCVIARNAEAKALGVKMGDPWFKQKDLFRRCGVVCFSSNYELYADMSNRVMSTLEELSPRVEIYSIDEAFCDLTGVRNCRDLTDFGREIRATVLQRTHLTVGVGIAQTKTLAKLANHAAKKWQRQTGGVVDLSNLERQRKLMSALPVDDVWGIGRRISKKLDAMGIKTVLDLADTDIRFIRKHFNVVLERTVRELRGEPCLQLEEFAPTKQEIICSRSFGERITDYTSMRQAICSYAARAAEKLRSEHQYCRFISTFIKTSPFALNEPYYGNSASVKLLTPTQDSRDIINAATRSLDAIWQAGHRYQKAGVMLGDFFSQGVAQLNLFDDNAPRPGSEQLMAVMDTLNAKEGRGTLYFAGQGIQQQWQMKRAMLSPRYTTRSSDLLRVK

SEQ ID NO: 66424 - DNA, 1275 bp, Salmonella typhimurium LT2
  CDS (1)..(1275): transl_table=11
atgttcgctttggctgacgtcaactcgttctatgccagttgcgaaaaggtctttcgccccgatttgcgtgacaggtctgtggtggtcctgagtaacaacgatggttgtgtaatcgcgcgcagcgctgaagcaaaaaaactgggcataaaaatgggggtgccgtggtttcaactgaggtcggcgaaatttccggagccggttatcgcgttctccagtaattacgccctctacgcatcaatgtcgaacagggtcatggttcacctggaagagctggcgccacgcgttgagcagtactccattgacgagatgtttctggatattcgcggtatagacagttgcatcgatttcgaggatttcggccgacagctgcgtgagcacgttcgttccggcacagggctgaccatcggcgtcggaatgggaccgaccaaaacgctggctaaaagcgcgcaatgggcatcgaaagaatggtcacagttcggaggcgtgcttgccctgacgttacacaatcagaaacgaacggagaaactgctgtcactgcaaccggtggaggaaatctggggtgtgggccgcaggatctcaaagaagctgaacacaatggggatcaccacagcactgcagctggcccgcgcgaatccaacgttcatcaggaaaaactttaatgtggttctggagagaacggtccgggaactcaatggagaaagctgtatttccctggaggaagcaccgccccccaaacagcagatagtctgcagcagaagctttggagaacgagtcacgacttatgaagcgatgcggcaggcagtctgtcagcacgctgaacgtgccgccgaaaagctgcgtggggaacggcagttctgcaggcatattgccgtgtttgtgaaaacatcgccgttcgccgtaactgagccctactacggtaatctggccagtgaaaaactgctcatccccacgcaggatacacgggacatcattgccgctgccgtcagagctctggacaggatctgggtggatggtcaccgttacgcaaaggcaggctgtatgctgaacgatttcacgccaaccggggtatcgcagcttaatttgtttgatgaagtacagccgcgggaacggagcgagcagctgatgcaagtcctggatgggattaaccatccgggcaaggggaaaatatggttcgccggtcgggggattgcccccgagtggcagatgaaaagggaactactttcgccagcttatacgacacgttgggcagatattcctgcagcgaaattgacttga

SEQ ID NO: 66425 - protein, 424 aa, Salmonella typhimurium LT2
MFALADVNSFYASCEKVFRPDLRDRSVVVLSNNDGCVIARSAEAKKLGIKMGVPWFQLRSAKFPEPVIAFSSNYALYASMSNRVMVHLEELAPRVEQYSIDEMFLDIRGIDSCIDFEDFGRQLREHVRSGTGLTIGVGMGPTKTLAKSAQWASKEWSQFGGVLALTLHNQKRTEKLLSLQPVEEIWGVGRRISKKLNTMGITTALQLARANPTFIRKNFNVVLERTVRELNGESCISLEEAPPPKQQIVCSRSFGERVTTYEAMRQAVCQHAERAAEKLRGERQFCRHIAVFVKTSPFAVTEPYYGNLASEKLLIPTQDTRDIIAAAVRALDRIWVDGHRYAKAGCMLNDFTPTGVSQLNLFDEVQPRERSEQLMQVLDGINHPGKGKIWFAGRGIAPEWQMKRELLSPAYTTRWADIPAAKLT

SEQ ID NO: 66426 - DNA, 1209 bp, Pseudomonas putida
  CDS (1)..(1209): transl_table=11
atgtgttctaaagaccctcgaccgatttttgggttggtggatgtcaactcgttctactgcagctgcgaacgcatcttccggcctgagttgaggcaccgccctgtcgtcgttctttcgaattcggatggttgcattgtggcccgtacgaacgaagcaaaagccctcggcttgaagatgggcgacccctacttcaaggtgcggaatttcctggagcaaaacggcgtagcggtgttcagcagcaactacaccttgtacggggaattgagccaccgcgtaggtgtggccatcgcctccctggtccctgagtgggagcagtattccatcgatgaactgttcgtgaacctcgatggcctgcccgaaccgatcatcgatgttggccgtgcgatacaagcccgcgtgctgcagtggacagcgcttccggttggtgtcggcataggtcacacgaaaacattggcaaaggcagcgcagcacgcatcgaaggtatggcgggagaagacaggaggggtggtcgacctccgcaagccggatgcagtcgaatggctgctccggcgaatgccggtcgatgaggtatggggcatcggcagtcgcatgcgtgacaacctggcccgcgacgggatcaccacggcatgggagctgtcgcaagcggatgcgcgggcaatgggccgcaaatacagcgtcgtactggaacgtacgatacgggagctgcagggtgaatcctgcatggacctggagcagacggtagcgccaaagcaaacgatctgctctagcaaaatgttcggccagcgtgttcacacgctccagggcctgcaagaagcattggcgacgtacattcaccgcgcagcggagaagctgcgcctgcagcgctcgctgtgcggtgccatgcgcatcggcattcagacctcgtttcacggggatggtccgaaatacgccaacgccgccacgtgcatacctgcctatccaacagacgacgtacgccagctgaccaaatacgccctgcaggctgcagagcagatctaccggccaggcttcgcgtacagcaaagccgaggtgctgctgttggatctgcgcaagcgcggggagtacacgcaagatttgttcagcccgagccagcctgagcgctccgacgcgctcatggccacgatggacaagatcaaccggcgatgggggcatgactgcctgcgaactgcagcgggtgccactgacccctga

SEQ ID NO: 66427 - protein, 402 aa, Pseudomonas putida
MCSKDPRPIFGLVDVNSFYCSCERIFRPELRHRPVVVLSNSDGCIVARTNEAKALGLKMGDPYFKVRNFLEQNGVAVFSSNYTLYGELSHRVGVAIASLVPEWEQYSIDELFVNLDGLPEPIIDVGRAIQARVLQWTALPVGVGIGHTKTLAKAAQHASKVWREKTGGVVDLRKPDAVEWLLRRMPVDEVWGIGSRMRDNLARDGITTAWELSQADARAMGRKYSVVLERTIRELQGESCMDLEQTVAPKQTICSSKMFGQRVHTLQGLQEALATYIHRAAEKLRLQRSLCGAMRIGIQTSFHGDGPKYANAATCIPAYPTDDVRQLTKYALQAAEQIYRPGFAYSKAEVLLLDLRKRGEYTQDLFSPSQPERSDALMATMDKINRRWGHDCLRTAAGATDP

SEQ ID NO: 66428 - DNA, 1260 bp, Salmonella enterica subsp. enterica serovar Typhi str. CT18
  CDS (1)..(1260): transl_table=11
atgtacatgcacgttgatatcaatggagcctacgcggcatttgaatgcgccatggaccccaaacttgccaaatccccgctcatcatcgcgagcaacaacgatgccaccattatcgccatgaacaggctcgccaaaaatacagggctcaaacgcgggatgcctatcttcaaatgccgggatctgattgagcagcatcatattgcggtacggagctccaactttacgttgtacgaagattattccaaccggtttcatgaaacgctggaggggtttgccgaggataccgatcgttacagcgtggatgaaagcttcatgctactgaaaaacatggacaaaatagtagattttgaagagtacggatgcctgatcagacgaacgctgctacacaatctttcgctcacctgcgggattggagtatcgaccacgaaaacgctcgcaaaattatgcacctacgccagtaagcgatgggcagcaactggtggtgtggtcgtccttacagacccattccgaattaaaaaactgctgagtctcatcagtacccgggaaatctggggcattggccgcaaaatcagtgagcggctgactgcgtacgggatcatcacggcctgcgacttttatgacagcgatgtgcggtttttacgaaaggcattcggtgttgaaatggaacgtacctggcgggagctgcatggcgagtcctgtttccggttgcatgaatcccctcctgtcagacaacaaattatcgtctcgcggagctttggccagcgccttaatacattcagcaagatgcatgaggcagtgtcattctttaccggccgtgccgctgaacagcttcgaaacgatggctcctggactcgccaaatcaccgtgtttatccagagcagcccgtttgccagagctgaagcccggtacagcagctgcggtattgagccgcttactgcgacgcaggacacccgcgacctggtcagtgcggcaggcgccatactgacccgaatctacaaacccggcatagattatgcgaaggcgggcgtgatgctttcgtcaatgaccgatggcactgagcagctatccctgttcgatgaacgtcccgccaggcgaggcagtgaagcactgatgaaggtgatggatcggtttaacaaagagcatcgaggctctctgtttctggcttgcgaagggattcatcaggatttccgggggaagcaggccatgctgtccccacggtataccactcgctggaatgagttacttgtcgtcaaagcctga

SEQ ID NO: 66429 - protein, 419 aa, Salmonella enterica subsp. enterica serovar Typhi str. CT18
MYMHVDINGAYAAFECAMDPKLAKSPLIIASNNDATIIAMNRLAKNTGLKRGMPIFKCRDLIEQHHIAVRSSNFTLYEDYSNRFHETLEGFAEDTDRYSVDESFMLLKNMDKIVDFEEYGCLIRRTLLHNLSLTCGIGVSTTKTLAKLCTYASKRWAATGGVVVLTDPFRIKKLLSLISTREIWGIGRKISERLTAYGIITACDFYDSDVRFLRKAFGVEMERTWRELHGESCFRLHESPPVRQQIIVSRSFGQRLNTFSKMHEAVSFFTGRAAEQLRNDGSWTRQITVFIQSSPFARAEARYSSCGIEPLTATQDTRDLVSAAGAILTRIYKPGIDYAKAGVMLSSMTDGTEQLSLFDERPARRGSEALMKVMDRFNKEHRGSLFLACEGIHQDFRGKQAMLSPRYTTRWNELLVVKA

SEQ ID NO: 66430 - DNA, 1287 bp, Xanthomonas campestris pv. campestris str. ATCC 33913
  CDS (1)..(1287): transl_table=11
atgttcgcgctgatcgacggcaataacttctacgctagctgcgagcgcgtgttccagcccgagctgcgtggcaggccgttggtcgtgctcagcaacaacgatggctgcgctattgctcgatcggacgaggccaaagccctaggtgtcacgatgggccagccgatccacaaggtgccaccgcagatccgtcgccggctagcgctgcgctccgcaaatttcggtctctacggcgacatcgcttctcgcattggcgtcatcctgcgtcaggccgcgccacgcgtggaggtgtattcgatcgacgagtcgttcctcgacctggccggcatccgcgattgccggcagctggcggtcgacctgcgcgagcgagttcaccaatggacgggcatccccaactgcattggcatcgcgccgaccaagaccttggccaagctggccaaccgggtcgccaaggatgcagcgcgtaagccgggcagctacccagctagtctggccggcgtctgtgacctggctgcgctcagcgccagtgagctcgatgcggtgctgcgagccacggcggttggcgacctctggggcgttggcaggcgctggggcgcgaggctgcaggcacgcggcgtctttacggcagccgatctgcgagacgccgctgcagacgacttgctagcggagttcggtgtggtcatggcgcgcacgcaacgggagttgcagggccatgcatgcctgcagctggaggaagtcgagcccgaccgtcagcagatcatggtcagccggtcgttcgggacctgggtgaccgatccacaagatatggcggaggcgctggcaacttttgccatgcgcgccaccgagaagctgcgcgcacgcgggctgaccacatgcgccattggcatctttgccgagacggattcgttcaagcccggtgtgccgcagcacaacccatcacgcaccgcgccacttgcctcggctacatccgacagccgcgtggtgctcacggttgtgcgccggctgctccagggcttcatgcgcgatggcttcacctacaagaaggccggcgtgtgcctaatggatctcgccgcgcccgaggatctgcagggcgacctcttcaccccggcacgcataggcgacgacaagctgatgagcaccctggatgccatcaaccggcggttcggtcgcggcacggccgggctgggtgcaagcggctggcagaagtcccccgaatgggcatcgcggcaagatctgctatcgggccgcttcaccacatcgctagctgacctccctcgcgcctcctgctag

SEQ ID NO: 66431 - protein, 428 aa, Xanthomonas campestris pv. campestris str. ATCC 33913
MFALIDGNNFYASCERVFQPELRGRPLVVLSNNDGCAIARSDEAKALGVTMGQPIHKVPPQIRRRLALRSANFGLYGDIASRIGVILRQAAPRVEVYSIDESFLDLAGIRDCRQLAVDLRERVHQWTGIPNCIGIAPTKTLAKLANRVAKDAARKPGSYPASLAGVCDLAALSASELDAVLRATAVGDLWGVGRRWGARLQARGVFTAADLRDAAADDLLAEFGVVMARTQRELQGHACLQLEEVEPDRQQIMVSRSFGTWVTDPQDMAEALATFAMRATEKLRARGLTTCAIGIFAETDSFKPGVPQHNPSRTAPLASATSDSRVVLTVVRRLLQGFMRDGFTYKKAGVCLMDLAAPEDLQGDLFTPARIGDDKLMSTLDAINRRFGRGTAGLGASGWQKSPEWASRQDLLSGRFTTSLADLPRASC

SEQ ID NO: 66432 - DNA, 1269 bp, Proteus vulgaris
  CDS (1)..(1269): transl_table=11
gtgatgctgtgtctcgcagatattaattcgttctactgttcgtgtgaggcggcatttaacccacggcttgcaggtttacctatcgttgtgttggcaaataatgatcacattgtcatatcgcgctcaaaagaagcaaaagccctgggcatcaaaatgggggcgctgtactttgagaatatcaacttctttaaatatcataatgttcaggtgtttagttcaaattattcgctttatcaaaacgtgtctgaccgtgttatgtctgtattagctggcttctcaatcggtatggaagtgtattcaattgacgaggcctttctaactgtgccggatagaatacctaactcaagccttgaagattttggtcgcgcgatacagcaagacatattacagatcactcacgtcccggtaggcgtaggctttggccccacaaaaacgctcgcaaaactggctaatcacgcggctaagtcctggtcaaaaacgggcggggtggtggatttgagccaaaaaacgcgacaaagaaaattgatggcgttattaccggtgggtgatgtgtggggagttggaaggcgcatcgccgcgaagttaaaggtcatgggtattcataccattttagacttggccgacgctgatattgcgatgatcagaaaaacctttggggttgttgttgaaaggaccgtgcgggagcttaacggggacgcttgtatcgaattggaggaagtccggaaagttaaggagcagatcatctcgtctaaatcgttcggtaagaaagttgagcggtatgatgatatgcaccaggcggtatgcagctacgctgagcgagctagcatgaagttaagagaagaagaccagctgtgcagtgtggtctccgtgtttgtgagtaccagccactattctcccggctcaatgtacagcaatcgtgccatcgagcgcttggtgtatcccagcgccgatacgcgggatattatcaatgccgcagtcagggcgttgaatgcaatttggcgagacggccaccagtatcacaaagccggaattatgttgtcggacttcaccgattccaagataactcagttcgatttatttaatgaagtacagccattcaaaagaagtgaagagctcatgcgaatgctggatgacatgaaccggtcgggaaaattcaacattggctttgcaggaaagggttgcgatcctacctggcaaatgaggcggggaatgttgtctcctgaatacacaacaaacgtcaacgagatccctattgctaaggtgcgttga

SEQ ID NO: 66433 - protein, 422 aa, Proteus vulgaris
MMLCLADINSFYCSCEAAFNPRLAGLPIVVLANNDHIVISRSKEAKALGIKMGALYFENINFFKYHNVQVFSSNYSLYQNVSDRVMSVLAGFSIGMEVYSIDEAFLTVPDRIPNSSLEDFGRAIQQDILQITHVPVGVGFGPTKTLAKLANHAAKSWSKTGGVVDLSQKTRQRKLMALLPVGDVWGVGRRIAAKLKVMGIHTILDLADADIAMIRKTFGVVVERTVRELNGDACIELEEVRKVKEQIISSKSFGKKVERYDDMHQAVCSYAERASMKLREEDQLCSVVSVFVSTSHYSPGSMYSNRAIERLVYPSADTRDIINAAVRALNAIWRDGHQYHKAGIMLSDFTDSKITQFDLFNEVQPFKRSEELMRMLDDMNRSGKFNIGFAGKGCDPTWQMRRGMLSPEYTTNVNEIPIAKVR

SEQ ID NO: 66434 - DNA, 1269 bp, Shigella flexneri 2a str. 301
  CDS (1)..(1269): transl_table=11
atgtttgccctctgtgatgtaaacgcgttttatgccagctgtgagacggtgtttcgccctgatttatggggtaaaccggtggttgtgctatcgaataatgacggttgcgttatcgcccgaaacgctgaggcaaaggcgctgggcgttaaaatgggcgatccctggttcaaacaaaaagatctgtttcgtcgctgtggtgtggtttgctttagcagcaattatgagctttacgcagacatgagcaatcgggtgatgtcgacgctggaagaactatcgccccgcgtcgagatttacagtattgatgaagcattctgcgatctgacaggtgtgcgtaattgtcgcgatctgactgattttggcagagaaattcgcgcaacggtgctacaacgtacccatcttactgttggtgtggggatcgcccagaccaaaacgttggctaagcttgccaatcatgcggcaaaaaaatggcagcggcagacgggtggggtggtggatttatcaaatctggaacgccagcgtaaattaatgtctgctctccccgtggatgacgtctgggggattggacggcggatcagcaaaaaactggacgcgatggggatcaaaaccgttctcgatttggcggatacagatatccggtttatccgtaaacattttaatgtcatgctcgaaagaacggtgcgtgaactgcgcggcgaaccctgtttgcaactggaagagtttgcaccgacgaagcaggaaattatctgttcccgctcgtttggtgaacgcatcacggattatacgtcgatgcggcaggccatttgtagttacgctgcccgggcggcggaaaaacttcgcagtgagcatcaatattgtcggtttatctccacatttattaagacgtcaccatttgcgctcaatgaaccttattacggcaatagcgcgtcggtaaaactgctgacgcccactcaggacagcagggatatcattaacgctgctacgcgatctctggatgccatctggcaagcgggccatcgctaccaaaaagcgggcgtgatgctgggggatttcttcagtcagggagtcgcgcagctcaatttattcgatgacaacgcaccgcgccccgggagtgagcaattgatggcggtaatggatactctgaatgctaaagagggcagaggaacactctattttgccgggcaggggatccaacaacaatggcagatgaagcgagctatgctttcaccacgttatacaacgcgaagttctgatttactgcgggtcaaataa

SEQ ID NO: 66435 - protein, 422 aa, Shigella flexneri 2a str. 301
MFALCDVNAFYASCETVFRPDLWGKPVVVLSNNDGCVIARNAEAKALGVKMGDPWFKQKDLFRRCGVVCFSSNYELYADMSNRVMSTLEELSPRVEIYSIDEAFCDLTGVRNCRDLTDFGREIRATVLQRTHLTVGVGIAQTKTLAKLANHAAKKWQRQTGGVVDLSNLERQRKLMSALPVDDVWGIGRRISKKLDAMGIKTVLDLADTDIRFIRKHFNVMLERTVRELRGEPCLQLEEFAPTKQEIICSRSFGERITDYTSMRQAICSYAARAAEKLRSEHQYCRFISTFIKTSPFALNEPYYGNSASVKLLTPTQDSRDIINAATRSLDAIWQAGHRYQKAGVMLGDFFSQGVAQLNLFDDNAPRPGSEQLMAVMDTLNAKEGRGTLYFAGQGIQQQWQMKRAMLSPRYTTRSSDLLRVK

SEQ ID NO: 66436 - DNA, 1257 bp, Shewanella oneidensis MR-1
  CDS (1)..(1257): transl_table=11
atgtttgcccttgttgatgccaatagtttttactgcagttgcgagcaggtgtttcggcccgattggcgtggtaaaccggtggtggtgctcagtaataacgatggaatggtcgtcgctgccaatcgccaagcgaaagaagcgggcatccctaaatttgtgccctactttcaaatacgcgatctttgccagaaaaaaggcgtgattgcgctatcgtccaattacgaattgtatgcggatttgtcggccaaaatgatgcaaatcatcgggcgctttgcgcccgaacaatacgtatattcgattgacgaatcctttctctcttttacccgctgctatcccgctatcacgtgtttaaaaacgcaggcacaggcgatccgccgtgctgtgtggaaagaggctcgcttaccggtgtgtgttggcattgggagcaccttaacgctcgccaaaatcgctaaccatgccgctaaaaaaatatctggttatgccggtgtttgcgtgattgagtcagagccgcaacgcctagcgatattgcaacaaatgccagtgggtgaagtgtggggcattgggcggcgcttgtctgccaaattaaccctaatgggcattactacggcggcgcaattggcggctatgccgccagggctggcacgtaaacaatttagtattgaaatcgagcgcactgtgcgcgagttaaacggccaagtgtgcaaacaatgggatgaagcgcgggccgataaacagcaaatattttcaacccgtagcgttggcgagcgaattatcgatattgatgcgctgcagcaagcactgtgtaagcacgctgggatcgctgccgcaaaagctcggcaacaaggctcaagctgtaaaagcatgttggtatttgccagtaattcgccacatgatgagcggcctgtgagttataaagctgtggtgcagtttccttgccctacttcatccactgccgagatcacggctgcagtatcacgagtgttaccacaagttttccgctctggtgtgcgttattacaaaattggcgtggggttaattgaattaatgcctaccaagcatattcagtatgatttgttccatgcccccaccgaaaaccccgcattgatgcaaacttttgataagttaaatcaacgctatggcagtgattgtatatttatggcggctcaaggtattgagcataaatgggccatgcgcagggataaattaaccccgcaatacactactaagtggcttaatttgcccaaagtgcagtgttag

SEQ ID NO: 66437 - protein, 418 aa, Shewanella oneidensis MR-1
MFALVDANSFYCSCEQVFRPDWRGKPVVVLSNNDGMVVAANRQAKEAGIPKFVPYFQIRDLCQKKGVIALSSNYELYADLSAKMMQIIGRFAPEQYVYSIDESFLSFTRCYPAITCLKTQAQAIRRAVWKEARLPVCVGIGSTLTLAKIANHAAKKISGYAGVCVIESEPQRLAILQQMPVGEVWGIGRRLSAKLTLMGITTAAQLAAMPPGLARKQFSIEIERTVRELNGQVCKQWDEARADKQQIFSTRSVGERIIDIDALQQALCKHAGIAAAKARQQGSSCKSMLVFASNSPHDERPVSYKAVVQFPCPTSSTAEITAAVSRVLPQVFRSGVRYYKIGVGLIELMPTKHIQYDLFHAPTENPALMQTFDKLNQRYGSDCIFMAAQGIEHKWAMRRDKLTPQYTTKWLNLPKVQC

SEQ ID NO: 66438 - DNA, 1269 bp, Escherichia coli CFT073
  CDS (1)..(1269): transl_table=11
atgtttgccctctgtgatgtaaacgcgttttatgccagctgtgagacggtgtttcgccctgatttatggggtaaaccggtggttgtgctatcgaataatgacggttgcgttatcgcccgaaacgctgaggcaaaggcgctgggcgttaaaatgggcgatccctggttcaaacaaaaagatctgtttcgtcgctgtggcgtggtttgctttagcagcaattatgagctttacgcagacatgagtaatcgggtgatgtcgacgctggaagaactatcgccccgcgtcgagatttacagtattgatgaggcattctgcgatctgacaggtgtgcataattgtcgcgatctgactgattttggcagagaaattcgcgcaacggtgctacaacgtacccatcttactgttggtgtggggatcgcccagaccaaaacgctggctaagcttgccaattatgcggcaaaaaaatggcagcggcagacgggcggggtggtggatttatcaaatctggaacgccagcgtaaattaatgtctgctctccccgtggatgaagtctgggggattggacggcggatcagcaaaaaactggacgcgatggggatcaaaaccgttctcgatttggcggattcagatatccggtttatccgtaaacattttaatgtcgtgctcgaaagaacggtgcgtggactgcgcggtgaaccctgtttgcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcggtttatctccacgtttattaagacgtcaccatttgcgttcaatgaaccttattacggcaatagcgcatcggtaaaactgctgacgcccactcaggacagcagggatatcattaacgccgctacgcgatctctggatgccatctggcaagcgggccatcgctaccaaaaagcgggcgtgatgctgggggatttcttcagtcagggagtcgcgcagctcaatttattcgatgacaacgcaccgcgccccgggagtgagcaattgatggcggtaatggatacgctgaatgctaaagagggcagaggaacactctattttgccgggcaggggatccagcaacaatggcagatgaagcgtgccatgctttcaccatgttatacaacgcgaagttctgatttactgcgggtcaaataa

SEQ ID NO: 66439 - protein, 422 aa, Escherichia coli CFT073
MFALCDVNAFYASCETVFRPDLWGKPVVVLSNNDGCVIARNAEAKALGVKMGDPWFKQKDLFRRCGVVCFSSNYELYADMSNRVMSTLEELSPRVEIYSIDEAFCDLTGVHNCRDLTDFGREIRATVLQRTHLTVGVGIAQTKTLAKLANYAAKKWQRQTGGVVDLSNLERQRKLMSALPVDEVWGIGRRISKKLDAMGIKTVLDLADSDIRFIRKHFNVVLERTVRGLRGEPCLQLEEFAPTKQEIICSRSFGERITDYPSMRQAICSYAARAAEKLRSEHQYCRFISTFIKTSPFAFNEPYYGNSASVKLLTPTQDSRDIINAATRSLDAIWQAGHRYQKAGVMLGDFFSQGVAQLNLFDDNAPRPGSEQLMAVMDTLNAKEGRGTLYFAGQGIQQQWQMKRAMLSPCYTTRSSDLLRVK

SEQ ID NO: 66440 - DNA, 1257 bp, Vibrio vulnificus CMCP6
  CDS (1)..(1257): transl_table=11
atgtttgccctagttgatgctaattccttttattgtagtgctgagcaaatttttagacccgagtggagaggtaagcccgtaatcgttctgtcgaataatgatggctgtgtcgttgcagctaatcgtcaagctaaagaagcaggtatagcaaagtttaaaccttactttgaagtcaaagcgttgtgtgagttgaaaggtgtaattgctctatcatctaattatgaactttacgcagatttgtcgtccaaaatgatggatgttatcgggcggtttgcgcctgagcaatatatatactccattgatgaatcatttctttcctttcatcgctgctttcctgccattaaagacttacgagaacatggctctttaatccgacgagccgtttggaaagagtgtcgattaccagtatgtataggtatgggaacaacgctaaccctcgccaaaattgccaatcatgcagctaaaaaaattcaaggctgtaagggcgtttgcgttatcgacaatgaacatcagcgtacctctatattaaagcagctagaagttggtgatgtatggggggtgggcaaaaaaatatcaacacgattaaaacatatggggattaactcggcttatgatttgtctcagtatgccccagaacaagcacgtcgagaattttcagtcgaagttgaaagaaccgttcgtgaattaaatggtgtcgcttgcaagggctgggacacagctagagctgataaaaagcagatttactcaactcgtagtgttggaacaagaatcaccgaccttgaactactgaagcaagcactaagtaaacacgccgctatagcagcacataaagcacgaaatcaaaagtcgctgtgtaaagctatgctctgctttgcttccaattcaccattcgatgataaacctcagagcttccgtatagttcatcattttgcttatccaactgctgactcaatgcagttggtcaaaattgctacacaggcagcaacacaattgttcaaacctggtgtacgttattacaaaattggcatcggcttgatcgatctagttaatgggcagcacgaacaattagatctgttaaatcaaactccgagtaatgataagttaatgaaagtgtttgatagtcttaataatcggtatggcactgatacgctttttgttggttcccaaggcatagagcagaaatggagcatgcggagagaaatgcttactccgcaatatacaaccaactggctagatatacctaaagtaaggtgttaa

SEQ ID NO: 66441 - protein, 418 aa, Vibrio vulnificus CMCP6
MFALVDANSFYCSAEQIFRPEWRGKPVIVLSNNDGCVVAANRQAKEAGIAKFKPYFEVKALCELKGVIALSSNYELYADLSSKMMDVIGRFAPEQYIYSIDESFLSFHRCFPAIKDLREHGSLIRRAVWKECRLPVCIGMGTTLTLAKIANHAAKKIQGCKGVCVIDNEHQRTSILKQLEVGDVWGVGKKISTRLKHMGINSAYDLSQYAPEQARREFSVEVERTVRELNGVACKGWDTARADKKQIYSTRSVGTRITDLELLKQALSKHAAIAAHKARNQKSLCKAMLCFASNSPFDDKPQSFRIVHHFAYPTADSMQLVKIATQAATQLFKPGVRYYKIGIGLIDLVNGQHEQLDLLNQTPSNDKLMKVFDSLNNRYGTDTLFVGSQGIEQKWSMRREMLTPQYTTNWLDIPKVRC

SEQ ID NO: 66442 - DNA, 1305 bp, Citrobacter freundii
  CDS (1)..(1305): transl_table=11
atggggtgtggttacgttcactgttatgagtcaccgcccgtgtacgccttaatcgacgtcaattcgatgtactgcagctgcgaagaggcgttccgccctgatttgcgggggcgccctgtggtcgtcctcagcaacaacgacggggcgcttgttgcggtcaatcgcgcggcgaaagcgctgggagtgcgccgcggggaaccctatttccgctgccgtcgcctgctggaacagcataacgtcgccgtattcagttccaactacaccctttacgcctcattctccgccagatttgcaaccgtagtggaaagtctggcgccgcggacgtttgtttactcaattgatgagctctttgcggatgcgtctcacatggagggcgtgatgtcgccgcaggcgtttggccagcttttgcgggctgaagtgctgcgccagacaacgctcacctgtggagtgggcgtcgcgccaacgaagacgctggccaagctgtgcaaccacgccgcaaagacgtggcctgccaccgggggggttgtggcgctcagtgatcctgtgagactgaaaaggctgatgagcctggtgtcggccggcgatgtgtggggggttggccatcgtaccgaaaaagggctggcgacaatggggatcaaaacggcgctggcgctcgcagagatggatatccgacttgcacgccggctgtacggtgtgacgctggaacggaccatccgtgagctgcgtggcgaggcctgctttgccctggaagaaggtaccggcgcgaaacagcagcttgttgtatcccgctcgtttggatcgcgggtcacgcaactggcgcagatgcagcaggcggtgactaaatatgccacacgggcaggggaaaagttgcgccaggaaaaccgtctggcgaaggtggtaacggtctttatccgcagcagtgcttatgacgccggcggtgtgccctacagtaaccaggctacggaagtgctttccgtgccaagccaggatacccgcgacatcatcgccgcggcgcagctggggctgtcgcgtatctggcgtgagggtgtgcggtatgcaaaagccggcgtgatgctcagcgatctgcagggacatgaaacccagctggatctgtttgcgccggctgcagtgcggccgggcagcgaaaaactgatggccaccatcgacaaaataaacagggaaggaaggtcaagggtcttcttcgccggggaaggtattgatccggaatatgccatgcgccgtgaaatgttgtctccggcctacaccacgcagtggaaggatattcccgcggcgtttatgcgataa

SEQ ID NO: 66443 - protein, 434 aa, Citrobacter freundii
MGCGYVHCYESPPVYALIDVNSMYCSCEEAFRPDLRGRPVVVLSNNDGALVAVNRAAKALGVRRGEPYFRCRRLLEQHNVAVFSSNYTLYASFSARFATVVESLAPRTFVYSIDELFADASHMEGVMSPQAFGQLLRAEVLRQTTLTCGVGVAPTKTLAKLCNHAAKTWPATGGVVALSDPVRLKRLMSLVSAGDVWGVGHRTEKGLATMGIKTALALAEMDIRLARRLYGVTLERTIRELRGEACFALEEGTGAKQQLVVSRSFGSRVTQLAQMQQAVTKYATRAGEKLRQENRLAKVVTVFIRSSAYDAGGVPYSNQATEVLSVPSQDTRDIIAAAQLGLSRIWREGVRYAKAGVMLSDLQGHETQLDLFAPAAVRPGSEKLMATIDKINREGRSRVFFAGEGIDPEYAMRREMLSPAYTTQWKDIPAAFMR

SEQ ID NO: 66444 - DNA, 1269 bp, Salmonella enterica subsp. enterica serovar Typhi Ty2
  CDS (1)..(1269): transl_table=11
atgttcgcgctctgcgatgttaatagcttttacgcctcctgcgaaacggtctttcgtcctgatttatgtggccgaccggtggtggtgttatcaaacaatgatggctgcgttatcgcgtgtagcgccgaggcgaaacaactcggtatcgcagcaggtgagccatacttcaaacagaaagaacgcttccggcgatccggtgttgtttgcttcagcagtaattacgagctttacgctgatatgtcgaaccaggtaatgaccacactagaggagatggtgccgcgggtagaaatttacagcattgatgaggctttttgtgatctgacgggggtacgaaactgccgggatctgacagatttcgggcacgagataagagcgacggtcctgaagcgcacgcacctgactgtcggtgtaggcattgcccagacgaaaacccttgccaagctggctaaccatgctgcgaaaaagtggcagcgccagaccgacggggtggttgacctgtcgaacatcgatcgccagcgtcggctgctggccctgatacccgtagaggatgtctggggtgtcggcagacgcatcagtaagaagctcaatgccctgggcatcaagactgctctcgatctctctgaacaaagtacctggatcatcaggaaacacttcaatgtcgtgctggagcgtaccgtgagagagcttcgcggagagccatgtctggagcttgaagagtttgcgccggcaaagcaggaaatcgtttgtagccgctctttcggcgagcgggtcacagactatgaggaaatgcgccaggctgtttacagctacgctgcgcgcgcggcagaaaaactccgcggcgagcaccagtactgctgtttcatttcaacattcgtcaaaacatcaccctttgccctgaacgagccctactacggtaacagcgccgcggtgacgcttctcacccccacgcaggattcacgtgacattatcaatgcggctgtgaaatgtctggataaaatctggcgcgacggccatcgctaccagaaagcgggggtgatgctgggtggcttcttcagccagggcgtagcgcaactcaaccttttcgacgataacgcgccgcgcgccggtagtgcgaagttgatggaagtactggaccatcttaacgcaaaagacgggaaggggacgctgtacttcgccgggcaggggatgtcgcaacagtgggctatgaagcgagaaatgctttcgcctcggtacaccacaagatactctgatctactgcgtgttaagtaa

SEQ ID NO: 66445 - protein, 422 aa, Salmonella enterica subsp. enterica serovar Typhi Ty2
MFALCDVNSFYASCETVFRPDLCGRPVVVLSNNDGCVIACSAEAKQLGIAAGEPYFKQKERFRRSGVVCFSSNYELYADMSNQVMTTLEEMVPRVEIYSIDEAFCDLTGVRNCRDLTDFGHEIRATVLKRTHLTVGVGIAQTKTLAKLANHAAKKWQRQTDGVVDLSNIDRQRRLLALIPVEDVWGVGRRISKKLNALGIKTALDLSEQSTWIIRKHFNVVLERTVRELRGEPCLELEEFAPAKQEIVCSRSFGERVTDYEEMRQAVYSYAARAAEKLRGEHQYCCFISTFVKTSPFALNEPYYGNSAAVTLLTPTQDSRDIINAAVKCLDKIWRDGHRYQKAGVMLGGFFSQGVAQLNLFDDNAPRAGSAKLMEVLDHLNAKDGKGTLYFAGQGMSQQWAMKREMLSPRYTTRYSDLLRVK

SEQ ID NO: 66446 - DNA, 1275 bp, Salmonella enterica subsp. enterica serovar Typhi Ty2
  CDS (1)..(1275): transl_table=11
atgttcgccctggctgacgtcaacagcttctacgcgagctgtgaaaaagtatttcgtcccgatttacgtaatacacctgttgtggtgctcagtaacaacgatggatgtgttatcgcgcgttcaaaagaagcgaagcaactgggcattaaaatgggggttccgtggtttcaactgaaaacaaccgaatttcctgtacctgtcgttgcgttctcgagtaactacgaactctacgcgtcgatgtcgaaccgtgttatggcgcatctcgaagaactggcacctcgcgttgagcagtattctatcgacgaaatgtttcttgatgtgcgcaatattgacagttgtatcgattttgaagacttcggccggcagttgcgcgagcatgtacattcaggaaccggactgaccatcggagttgggatgggaccgaccaagacactggcaaaaagcgcacaatgggcgtctaaggaatggcggcagtttgagggcgtgcttgctctgacttcaggcaatccaaagcgaacggagaaactattgtcactgcagccagtagacgaaatctggggggttggtcgccggatctcgaagaaactgcacacaatggggataacaactgcactgcagctggcgcgcgcgaacccaacatttatcaggaaaaatttcagtgttgttctcgagagaactgtccgtgaactgaacggggaaagctgtatttcactggaggaggctccgccacccaagcagcagattgtctgcagccgatcctttggggagcgcgtcacaacatatgaagccatgcgccaggcagtctgtcagtatgctgagcgtgcagctgaaaagctgcgcggcgagcggcaattctgcagacatgttgctgtatttgtgaagacgtcaccgttcgctgtgaacgaaccgtattacgggaatgtggccagtgagaaactgacgactcccacgcaggataccagggacatcatagccgcagcggtgaaagcactggatcggatctgggtgaaagggcatagatatgcaaaagcgggttgcatgctcaatgatttcacaccaaccgggatttctcagttaaatctttttgatgaagtgcagccgcacgaacgaagtgagcagttgatgaaagttctcgacagtatcaaccattcaggtatgggaaaagtgtggtttgccggaagagggatagcccctgagtggcagatgaaaagagagctactctctccagcttataccactcgctgggctgaattacctgttgcacgattgcgctga

SEQ ID NO: 66447 - protein, 424 aa, Salmonella enterica subsp. enterica serovar Typhi Ty2
MFALADVNSFYASCEKVFRPDLRNTPVVVLSNNDGCVIARSKEAKQLGIKMGVPWFQLKTTEFPVPVVAFSSNYELYASMSNRVMAHLEELAPRVEQYSIDEMFLDVRNIDSCIDFEDFGRQLREHVHSGTGLTIGVGMGPTKTLAKSAQWASKEWRQFEGVLALTSGNPKRTEKLLSLQPVDEIWGVGRRISKKLHTMGITTALQLARANPTFIRKNFSVVLERTVRELNGESCISLEEAPPPKQQIVCSRSFGERVTTYEAMRQAVCQYAERAAEKLRGERQFCRHVAVFVKTSPFAVNEPYYGNVASEKLTTPTQDTRDIIAAAVKALDRIWVKGHRYAKAGCMLNDFTPTGISQLNLFDEVQPHERSEQLMKVLDSINHSGMGKVWFAGRGIAPEWQMKRELLSPAYTTRWAELPVARLR

SEQ ID NO: 66448 - DNA, 1272 bp, Prochlorococcus marinus subsp. marinus str. CCMP1375
  CDS (1)..(1272): transl_table=11
atgtctatagctctaattgatagtaataatttttatgcttcatgcgaagagagcatggatccttccataaggaatcatcctttaatagtgctttctaataacgatggttgcgttatagctcgtaacgcagaagccaaggcccttgggatcgctatgggacaaccctatttcaaggtacgtcgcaagctaaaagatcttggagtaaaaatacgaagttcaaactacgcactttatgctgacatgagtcggcgcttaatgagtctcatagaagcaaactgtgaagagctggaaatttattctattgacgaagcattcgtaaaaatcaaccgtcctcatgactacgatctcaatccctgggcatatcgactacgcacaacaatatatcaaagtctaagcttaccaattgctattggaattggaactaccaaaagccaatcaaagcttgctaaccacttagcaaaaacaacagcaagccatgcagggatctttgatttcgaagcctccgatgatcaagaccattggcttaagcaagttgcaatagaaaacgtttggggcattggaagaaaattagcctactggtgtcgaatgcacggaattaataatgctcgacaattacgagacactcccagtaatgaactaaggcaaaaattcggtgttacaggcatacgtttacaacatgaattaagaggggaaaaatgtctcaacctcttaataaaatctattcccaaaaaagaaacatgcgtcagcagaagctttagccgtcctgtaagtaacatagaagagctgcgacaagcaatagcaaatcatgcagtacgtgcaagtgaaaaattacgcaaacagcatcaacatgctactgcagttacagtatttactcgtactagtttatatacgtcacctttttatagccaatcagcgacacagcgtctaagtttacctagtaataatactagagttattctttcaacaactctctctttaacagaaaaaatattctgctccaattgtttattaataaaagcaggtgtaattatgcaaggacttgtaaacgaagactatcttcaactatctttattttcactaactaatcccaaggaaatatccagacacaaaagcttaatgaaatcaattgactacctaaatacgcgatatggtaaggacacaatacaatgggctgtttgtggcatcaatcaacaagaatgggaaatgtgccgaagaaacttaagtccttcagcaacaacacttttcaaagaaatccctattgtaaaagcctaa

SEQ ID NO: 66449 - protein, 423 aa, Prochlorococcus marinus subsp. marinus str. CCMP1375
MSIALIDSNNFYASCEESMDPSIRNHPLIVLSNNDGCVIARNAEAKALGIAMGQPYFKVRRKLKDLGVKIRSSNYALYADMSRRLMSLIEANCEELEIYSIDEAFVKINRPHDYDLNPWAYRLRTTIYQSLSLPIAIGIGTTKSQSKLANHLAKTTASHAGIFDFEASDDQDHWLKQVAIENVWGIGRKLAYWCRMHGINNARQLRDTPSNELRQKFGVTGIRLQHELRGEKCLNLLIKSIPKKETCVSRSFSRPVSNIEELRQAIANHAVRASEKLRKQHQHATAVTVFTRTSLYTSPFYSQSATQRLSLPSNNTRVILSTTLSLTEKIFCSNCLLIKAGVIMQGLVNEDYLQLSLFSLTNPKEISRHKSLMKSIDYLNTRYGKDTIQWAVCGINQQEWEMCRRNLSPSATTLFKEIPIVKA

SEQ ID NO: 66450 - DNA, 1293 bp, Prochlorococcus marinus subsp. pastoris str. CCMP1986
  CDS (1)..(1293): transl_table=11
atgaaaagtaaaagctcaaatactgaagcaatagctcttatagatgccaataatttctacgcatcgtgcgaacaaagtatcaaccccaatttaaggaataaaccagtagtaatattatctaataacgacggatgcattatcgcaagaagccctgaagctcgtgctttgaaaataaaaatgggaattccttattttaaagtcaaagaaagtttgaataacttaggagttgcagtcctaagttccaattattcgctctatggtgatatgagcaagagattaatgaatttattaaaggactattctgaagagatagagatttattctattgatgaagcctttatctcaattcttagacctaaagataagaatttaaatccttgggcaagaaaagtaaggtgcttaatatatcaaaatctaggaataacattaacaataggaatagcagaaaacaaagtaagagcaaaaattgctaataatctagctaagaatatagattcttccgcaggaatatttgatttagctaggatctataatgataatgattacttaagaaaaattagtgtagaaaaaatatggggtattggtaaacaaacatctaattggttacaaagcaaagggattaaaaatgcaaaagaattcagagatatggatgaagatgaaataattaagaaattagggatcatagggaaaagattacaaatggaattaaaaggtaataaatgtcttccgatagaaataattaagaagccaaaaaaagagattcaagtaagtagaagctttggaaaaccaatcacaaaattagaagatttaactcaagcattagcaatttatgcaataaaagcgtccgagaaaatgagaagtcaaagcttaaaatcatctgccattactatatttgtaagaactagtcattattcaaatcatccttatcacaaaagtgcttataaaaaacttataaatgcaacagataatacaagtactattttaaaaacagtacttgcattatctaaagaaatttatactccggaatataaattatcaaaagctggggttttgatgcaggatttaactaattgcaaatatttacagcaatcaattatcaattacgaatctcaagaggaatcaaaaaaatcaatccgtcttatgaaaacaattgactccttgaataaaaaatttaataatgaagtaattacatgggcaattacaaaaaaaccacaagaatgggcaatgaatagaaattcattaagttctggatctacaacagatattagaaaaattccaaatataatgatataa

SEQ ID NO: 66451 - protein, 430 aa, Prochlorococcus marinus subsp. pastoris str. CCMP1986
MKSKSSNTEAIALIDANNFYASCEQSINPNLRNKPVVILSNNDGCIIARSPEARALKIKMGIPYFKVKESLNNLGVAVLSSNYSLYGDMSKRLMNLLKDYSEEIEIYSIDEAFISILRPKDKNLNPWARKVRCLIYQNLGITLTIGIAENKVRAKIANNLAKNIDSSAGIFDLARIYNDNDYLRKISVEKIWGIGKQTSNWLQSKGIKNAKEFRDMDEDEIIKKLGIIGKRLQMELKGNKCLPIEIIKKPKKEIQVSRSFGKPITKLEDLTQALAIYAIKASEKMRSQSLKSSAITIFVRTSHYSNHPYHKSAYKKLINATDNTSTILKTVLALSKEIYTPEYKLSKAGVLMQDLTNCKYLQQSIINYESQEESKKSIRLMKTIDSLNKKFNNEVITWAITKKPQEWAMNRNSLSSGSTTDIRKIPNIMI

SEQ ID NO: 66452 - DNA, 1275 bp, Prochlorococcus marinus str. MIT 9313
  CDS (1)..(1275): transl_table=11
atgtctcgggtcacagccctgatcgacggcaacaatttctatgcctcctgtgagcaaagccttgacgcctcgctgatcggtcgtcctctggtcgtgctctccaacaacgatggctgcattgttgctcgcagctccgaagcgcgtgctctcggaatcagcatgggcacgccctatttcaaggtccgtcacaaattggaccgacttggcgttgtcgtgcgcagctccaactacgccctctacggcgatatgagccaacgactgatgagcttgctggaagcccattgtgaggagctggagatttactcgattgatgaagcctttgcttacatcaatggtccctctgatgacaacctaaagccctgggcccgtcaactacgggccctggtgcatcgcaacctgggcctaccgatagcaatcggacttggcgccagtaaaggtcaggccaaactcgccaaccacctggccaaggccataccggctcacgctggagtgttcaacctactcaccgctagtgatccagatacatggcttgagagcgtcgctatcgaaaatgtatgggggatcggtcgcaagttggcccattggtgccgacttagaggcgtaaccaatgcccggcaattgcgcgatatgccacgtagccaacttcatgcccgctgcggcgttgtaggcatacgcctacaacgagaattacaaggttatgcctgccttcctctagccctagccccaacatcaaaacaggaaacctgcgttagccgcagttttagccgaccaatcgccaacctagaggaattacgccaggcaatcgcaacctacgtggtgcgcgccagtgaaaaactgcgacgacaacagcaacgggccgggatcctcaccgtattcacacgtaccagcccatttgcaccatcgttttacagccaagccgctaccattcaactggatttgccaagcaacgacactgcaatcttgctagcagcagccttgccactagtcgagcgaatctaccggccccatcgccgcttaaacaaagccggggtgctgatgcaaaacctacagagcgcagaccatctgcaacaacacctgttggtagcagttcatgccgatgagcagcatcgtagcgatcgactaatgaacaccgtcgaccgacttaatcaccgttacggcagcggaaccgtgagttgggctgtttgtggcatgcagccaggatggagcatgcgtcgtcatcaactcagccgcgcggccacaactcgcctcaatgacgtgccgttggtgctggcctga

SEQ ID NO: 66453 - protein, 424 aa, Prochlorococcus marinus str. MIT 9313
MSRVTALIDGNNFYASCEQSLDASLIGRPLVVLSNNDGCIVARSSEARALGISMGTPYFKVRHKLDRLGVVVRSSNYALYGDMSQRLMSLLEAHCEELEIYSIDEAFAYINGPSDDNLKPWARQLRALVHRNLGLPIAIGLGASKGQAKLANHLAKAIPAHAGVFNLLTASDPDTWLESVAIENVWGIGRKLAHWCRLRGVTNARQLRDMPRSQLHARCGVVGIRLQRELQGYACLPLALAPTSKQETCVSRSFSRPIANLEELRQAIATYVVRASEKLRRQQQRAGILTVFTRTSPFAPSFYSQAATIQLDLPSNDTAILLAAALPLVERIYRPHRRLNKAGVLMQNLQSADHLQQHLLVAVHADEQHRSDRLMNTVDRLNHRYGSGTVSWAVCGMQPGWSMRRHQLSRAATTRLNDVPLVLA

SEQ ID NO: 66454 - DNA, 1281 bp, Synechococcus sp. WH 8102
  CDS (1)..(1281): transl_table=11
atgggccttgccaccgccctgatcgacggcaacaacttctacgcatcctgcgaacagagccttgaccccagcctgatcggcaaacccgtcgtcgtgctctccaacaacgacggctgcatcgtggcccgcagtgcagaagcccgggccctcggcattgcgatgggaaccccctatttcaaggcgcgtcaggagttggaacgccagaacgtggtggtgcgcagctcgaactacgccctgtacgccgacatgagccagcggatgatgagcctgctggaaattcactgcgaagagctcgagatctattccatcgacgaagccttcgggcgcgtccgtcgtccgaaggatggtgacttgcagagctgggggcgatccctgcgagcccgggtgcgccaggacctggggctgccgatcgccatcggcctgggggccagcaaaagccaggcaaaactggccaatcgcctggccaagcaagtccccgcccatgccggcatcttcgatctgggccactgcacggatcccgacgcctggctcgagaccatcgcaatcgaggacgtctggggcatcggccgcaaactggcgcgctggtgccggctgcggggggtgaacaacgcccgcctgctgcgggacatgcccagcggtgaacttcgggcgaagtgcggtgtggtggggttgcggctgcagcgggaactgcgcggccatgcctgcttgccactggcgttggcaccgtcccccaaacaggaaacctgcgtgagccgcagcttcagcaggccgatcacgaccctggaggaactgcggcaggccgtcgccacctatgtggtgcgcgccgcggaaaaactgcgcaagcagcaccaacgggctgccgccctcacggtgtacacccgcaccagccccttcatccccgcgttttacagccaggccgccagcacccgactggatctgcccagcaacgacaccaccgttctgctggaggcagcgctccccctggtggaccgcatcttccggccacaccgacagctggcgaaggcgggggtgctgatgcagcacctgcagggaaccgagctgctccagtcccatcttctggtgccactgagtgaggcacagcaacaacgacgagaggagctgatgcgcaccattgatcggctcaatcgccgctatggccgaggcacggtccagtgggcagcctgcgggttgcatccgagctggatgatgcgacgggagcggctgggacggaccgccaccacccggctgagtgatgttccagtggtgcacgccgatcgctga

SEQ ID NO: 66455 - protein, 426 aa, Synechococcus sp. WH 8102
MGLATALIDGNNFYASCEQSLDPSLIGKPVVVLSNNDGCIVARSAEARALGIAMGTPYFKARQELERQNVVVRSSNYALYADMSQRMMSLLEIHCEELEIYSIDEAFGRVRRPKDGDLQSWGRSLRARVRQDLGLPIAIGLGASKSQAKLANRLAKQVPAHAGIFDLGHCTDPDAWLETIAIEDVWGIGRKLARWCRLRGVNNARLLRDMPSGELRAKCGVVGLRLQRELRGHACLPLALAPSPKQETCVSRSFSRPITTLEELRQAVATYVVRAAEKLRKQHQRAAALTVYTRTSPFIPAFYSQAASTRLDLPSNDTTVLLEAALPLVDRIFRPHRQLAKAGVLMQHLQGTELLQSHLLVPLSEAQQQRREELMRTIDRLNRRYGRGTVQWAACGLHPSWMMRRERLGRTATTRLSDVPVVHADR

SEQ ID NO: 66456 - DNA, 1299 bp, Porphyromonas gingivalis W83
  CDS (1)..(1299): transl_table=11
atgtatgccctcttagactgcaacaacttcttcgtcagttgcgaaagggtgttcgacccctcgctccgaaacaggccggtcgttgtcctctccaataacgatggttgtatcatcgctcgcagcaatgaagccaaagcattggggatagggatgggacaacctttcttcaaggtgcaggacttgattcgccggcacaatgtggcattcttcagctcgaacttcattctctacggcgatatgtcccgacgaatcatgtcgcttgtatcggaacttgtacctcggatgtcgatctattcgatagacgagtgtttcatggatttgagaggagtgaaagattatatgtcgctatgccacatgatagtcgatagagtccgccaatgtacgggtataccggtgagtataggtgtagccgatacgatgaccctgtccaaagtggcagacaaatatgccaagaggtatgcgggttacaagggcgtatgcgccatagactccgaagaaaagaggagaaaggctctgcaaacgttcgatgtaagcgatgtatggggaatagggcgcagactatctcgcaagctatactattatggtatcaatacggcagccgactttgcttcgatgagagaaggtcgggtatatcgtttggccggcacttcgggcgtcaggacatggcaggagcttaggggcgaagcctgcaaagagatgaaattgccacagcctcgccaaagtgtctgcaccacgcgctctttcggccatccatgccgagattttgactcccttctcaggcatttggctgttttcgccgatagttgctgtacgaagatacgtgaagaaaagagcagggcacgccgtttgagtatctttataagctgtagccgatttgatcaggagaacgactattccggccggaatgagatgctccttcccgtagctacttctgacccttcagaactgatcccaaagattcgcaccctgctacaagagatttatcgaccaaatctgccctacaaacaggcaggggtgatcttgtccgacttggtagcggaggcctatcagctcaatcttttcgacccgatcgatcgcatgcggcaggagcgtttcttatcctctgtggatgcgatccgccagcgtttcggaagagatagtctgaccgttgctacccaagaaacagaagctatagcatctgtctcttcgatcaagcatcgttcgcgcagatatacgaccgatatgaacgaggtcatagatgtcgttctgcccgatcagcgaaaaagcggagaaaaaaaatcgacgatcaacagccggtag

SEQ ID NO: 66457 - protein, 432 aa, Porphyromonas gingivalis W83
MYALLDCNNFFVSCERVFDPSLRNRPVVVLSNNDGCIIARSNEAKALGIGMGQPFFKVQDLIRRHNVAFFSSNFILYGDMSRRIMSLVSELVPRMSIYSIDECFMDLRGVKDYMSLCHMIVDRVRQCTGIPVSIGVADTMTLSKVADKYAKRYAGYKGVCAIDSEEKRRKALQTFDVSDVWGIGRRLSRKLYYYGINTAADFASMREGRVYRLAGTSGVRTWQELRGEACKEMKLPQPRQSVCTTRSFGHPCRDFDSLLRHLAVFADSCCTKIREEKSRARRLSIFISCSRFDQENDYSGRNEMLLPVATSDPSELIPKIRTLLQEIYRPNLPYKQAGVILSDLVAEAYQLNLFDPIDRMRQERFLSSVDAIRQRFGRDSLTVATQETEAIASVSSIKHRSRRYTTDMNEVIDVVLPDQRKSGEKKSTINSR

SEQ ID NO: 66458 - DNA, 1299 bp, Pseudomonas syringae pv. syringae
  CDS (1)..(1299): transl_table=11
atggcgtcacaagctttgagtaacaagccagcgccggtctttgcgctggtcgattgcaattcgttctacgccagctgtgagcgcgttttccgacctgacttggccaaggagcctattgtggtgctcagcaataacgatggctgcgttattgcccgcagctacgatgcaaaaccttacgtgaaaatgggcgcgccttattttcagatcaaagatattttgcgccggcacggaatccaggtgttcagcagtaatttttcgctctatggcgatttaagccagcgcgtgatggccatcattgaatccatggtccctgctgttgaggtttatagcatcgatgaggcgtttgcagacctgaccggcttgcctggcaatctgaccgagttgggaaggtcaattcgatccaaagtctaccgctgcaccggcattcccgtgggtgtggggattgcaccgactaagacactggccaagctggccaaccacacggcaaagcgtcttcaggcgcacaccggcggggtcgttgacatctgtgaccctgtaaaacgcgattgggtgctgcgcaatacttctgtcggagaggtctggggcataggtcgaaagatgaaagcgcacctggaaggcatgcagatccggtcggccaaggacttggccatggccgatccttggatgctgcgcaaaacattcagtgttgtgatcgagaaaacggcacgcgagctggcgggcaccgcgtgcctggagctggacgaagtcgaaccaccacgtcaggagatctgctgcagcagaatgtttggtaagcggttgaccgagctggggccgatcaaagaggcggtggccacctacgtgatgcgtgcctctgaaaaattacgcgcccagggatcggtgtgtaaaaagatccgggtgagcattcgcaccggcatgttcaatcctgacgaagccaagtatgcaaacggcgctctggtccagctgccctaccccaccaacgatgtgagggtgatgacccagttcgcgaccgaggcggtttcgcggatttttcgaccaggcttcaggtacagcaaagcagaagtcttgctgatggatatctgccagccaggcgaattcaccgacgatctgttcaccatcgatcagccggcgagtgcagatcgactgatggctactttggacataatcaacggcaagtggggacgcgggacgctgcgtacaggatcagtaccagtcgttccggattgggggatgcgccgtgagctgatgagccagagctacacgacgcgacttgatcagctgtgggttgtaaaggctaactga

SEQ ID NO: 66459 - protein, 432 aa, Pseudomonas syringae pv. syringae
MASQALSNKPAPVFALVDCNSFYASCERVFRPDLAKEPIVVLSNNDGCVIARSYDAKPYVKMGAPYFQIKDILRRHGIQVFSSNFSLYGDLSQRVMAIIESMVPAVEVYSIDEAFADLTGLPGNLTELGRSIRSKVYRCTGIPVGVGIAPTKTLAKLANHTAKRLQAHTGGVVDICDPVKRDWVLRNTSVGEVWGIGRKMKAHLEGMQIRSAKDLAMADPWMLRKTFSVVIEKTARELAGTACLELDEVEPPRQEICCSRMFGKRLTELGPIKEAVATYVMRASEKLRAQGSVCKKIRVSIRTGMFNPDEAKYANGALVQLPYPTNDVRVMTQFATEAVSRIFRPGFRYSKAEVLLMDICQPGEFTDDLFTIDQPASADRLMATLDIINGKWGRGTLRTGSVPVVPDWGMRRELMSQSYTTRLDQLWVVKAN

SEQ ID NO: 66460 - DNA, 1254 bp, Serratia marcescens
  CDS (1)..(1254): transl_table=11
atgcacgttgatattaacggagcctatgcggcatttgagtgtgcgatggatcccaagctgtcaaaaaagccgctcatcatagccagcaataacgattcgtccgtcattgcaatgaataaactggctaaaagcgttggtattaagcgtgggaccccaatttttaagtgcagggatttgattcagcaacaccggatcgaagtccggagctctaactttactttgtatgaagactactcaaatcgcttccatgaaacgctggaaagcttcgcgcctcaatcgagtcgatatagcatagatgaaaatttcatgttattgaaaaacatgaacaagataatagattatgaagattacggccggttgatcagaagtacacttcttcataatctgtcccttacctgtggtgtgggttgttcaagcaccaaaaccctcgctaaattatgcacctatgcgagcaaacgatgggcagctacaggcggggttgtagttttgactgatcaggccaggatcaggaagctcctgagcctgatcagtaccagagaaatatggggtattggtcgaaagattagtgaacgcctgtcggctttcgggatcatcactgccggtgatttttataatagcgacgttcgctttttacgtaaaagctttggcgttgaaatcgagcgtacctggcgggaactgcatggcgaaccatgtttccggctgcacgagtctcctcctgtcaggcaacagattatcgtttccagaagttttggtcagcgccttaatgagataggcaagctacatgaggcagtttcattttttaccgcccgggcggcagagcagctgcgcaaggatggctcgtggacccgtcaaatcacagtcttcattcagagtagcaattatgcgcaaggtgaaaaccgctacagcaattgtggtatcgagccgcttaccgctacacaggacacccgcgatctggttgatgcagccatgaccatcctgaaccgcatttacagacccgggatagcgtatgcgaaagcaggggtaatgctctccgctatgactgacggcacagagcaactcagcctgtttgatactcgcccggccaggcctggcagtcaggcactgatgaaagttatggaccggttcaataaagaaaagcgcggagctctgtttttactgggggaaggcattcaacaggattttcgtatgaagcaggccatgctatcaccgagatatacgacccgctgggatgaattactcgttgtaaaagcgtag

SEQ ID NO: 66461 - protein, 417 aa, Serratia marcescens
MHVDINGAYAAFECAMDPKLSKKPLIIASNNDSSVIAMNKLAKSVGIKRGTPIFKCRDLIQQHRIEVRSSNFTLYEDYSNRFHETLESFAPQSSRYSIDENFMLLKNMNKIIDYEDYGRLIRSTLLHNLSLTCGVGCSSTKTLAKLCTYASKRWAATGGVVVLTDQARIRKLLSLISTREIWGIGRKISERLSAFGIITAGDFYNSDVRFLRKSFGVEIERTWRELHGEPCFRLHESPPVRQQIIVSRSFGQRLNEIGKLHEAVSFFTARAAEQLRKDGSWTRQITVFIQSSNYAQGENRYSNCGIEPLTATQDTRDLVDAAMTILNRIYRPGIAYAKAGVMLSAMTDGTEQLSLFDTRPARPGSQALMKVMDRFNKEKRGALFLLGEGIQQDFRMKQAMLSPRYTTRWDELLVVKA

SEQ ID NO: 66462 - DNA, 1263 bp, Synechocystis sp. PCC 6803
  CDS (1)..(1263): transl_table=11
atgaacagtattgccctggtggattgcaataatttctatgtgtcctgtgagcgggtctttcaacccctattaaacggcaagccggtggtggtactttccaataatgatggttgtgtggtggcgagatcgtcagaagccaaggctttaggaatcaagatgggggtgccgctgttcaaaattcgagatttggttgagcgacataatattcaggttttttcttccaattactgtttgtacggcgacttatcccacaggataatgaccagcctgcaattatttagccctgtcgtggaaatttattccattgatgaagcgtttctggaactgactccaaatcaaagtaatacaaattatggggaagaaattcggcgttgccttaaacaatgggtaggcattcccgtttctattggcattgcccccactaaggtactcgctaaagtggcaactgatgtggcaaaacaatccggggctggaacattttgtttagacaaagcagaagcggctgatactattttggcaacgatgccgatcgccgatatttggggcattggacgacggttagagaagtggtttaccactaggggcgtctcaacagccttgcaattcaaacaagccaatcctgaacttatccgcaaaaaaatgggggtcgtggggcaacggctattactagaactccagggtatttcctgtttacccctagaactaattcctaacccaaagcaagaaacctgcgtttcccgttcctttgctcaagcggtaacgacattggatgaattacaaacggcgatcgccttttttgtcagtcgggcggcggagaaactgcggcgacaacagcaaaccccagcagtgatgattatttttgcccgcaccagcttcttcattgagcaaccaatttccatctcccagacgattgccctgccgactccaacccattacaccccagaattacttaaattggctcaaaccagcctcaaacaaatctttcgaccccatcatccctacaaaaaagctggcgtgataatgaccgggttacagtcggaacgcattgtgcaaggcgatctttttgaacaaccacgggatacggaacggcaacagcggcttatgttgacggtggaccagcttaatcaaaagtttggcagggaaactttgggttttggtattttcgggcaacaacaggattggcggatgaagtccgacctacgctctccccgatttacaacggcttgggatgatttgccagaggtaaaggcaggattttattag

SEQ ID NO: 66463 - protein, 420 aa, Synechocystis sp. PCC 6803
MNSIALVDCNNFYVSCERVFQPLLNGKPVVVLSNNDGCVVARSSEAKALGIKMGVPLFKIRDLVERHNIQVFSSNYCLYGDLSHRIMTSLQLFSPVVEIYSIDEAFLELTPNQSNTNYGEEIRRCLKQWVGIPVSIGIAPTKVLAKVATDVAKQSGAGTFCLDKAEAADTILATMPIADIWGIGRRLEKWFTTRGVSTALQFKQANPELIRKKMGVVGQRLLLELQGISCLPLELIPNPKQETCVSRSFAQAVTTLDELQTAIAFFVSRAAEKLRRQQQTPAVMIIFARTSFFIEQPISISQTIALPTPTHYTPELLKLAQTSLKQIFRPHHPYKKAGVIMTGLQSERIVQGDLFEQPRDTERQQRLMLTVDQLNQKFGRETLGFGIFGQQQDWRMKSDLRSPRFTTAWDDLPEVKAGFY

SEQ ID NO: 66464 - DNA, 1305 bp, Erwinia amylovora
  CDS (1)..(1305): transl_table=11
atggggtgtggttacgttcactgtcatgagacaccgcccgtgtacgccttaatcgacgtcaattcgatgtactgcagctgcgaagaggcgttccgccctgatttacgaggtcgccctgtggtcgttctcagcaacaacgacggggcgcttgttgcggtcaatcgcgcggcgaaagcgctgggcgtgcgccgcggggagccttatttccgctgccgccgcctgctggaacagcataacgttgccgtattcagttccaactacaccctttacgcctcattctccgccagatttgcaaccgtggtggaaagtctggcgccgcggacatttgtttactcaattgatgagctctttgcggatgcctctcatatggagggagtgatgacgccgcaggcgtttggccagcttttgcgggctgaagtgctgcgccagacaacgctcacctgtggagtcggcgtcgcgccaacgaagacgctggccaagctgtgcaaccacgccgcaaagacgtggcctgccaccgggggggttgtggcgctcagtgatgctgtaagactgaaaaagctgatgagcctggtgtcggccggcgatgtgtggggcgttggccatcgtaccgaaaaagggctggcggcaatggggatcaaaacggcgctggcgctcgcagagatggatatccgtcttgcacgccggctgtacggtgtgacgctggaacggaccattcgtgagctgcgtggcgaggcctgctttgccctggaggaaggtaccggcgcgaaacagcagcttgttgtatcccgttcgtttggagcacgggtcacgcaactggcgcagatgcagcaggcggtgactaaatatgccacacgggcaggggaaaagttgcgccaggaaaaccgcctggcgaaggtggtaacggtctttatccgcagcagtgcttatgacgccggcggtgtgccctacagtaaccaggctacggaagtgcttcccgtgccaagccaggatacccgcgacatcatcgccgcggcgcagctggggctgtcgcgtatctggcgtgagggcgtgcggtatgcaaaagccggcgtgatgctcagcgatctgcagggatatgaaacccagctggatctgttttcgccggctgcagtgcggccgggcagcgaaaaactgatggccaccatcgacaaaataaacagggaaggaaggtcaaggatcttcttcgccggagaaggtattgatccggaatatgccatgcgccgtgaaatgttgtccccggcctacaccacgcagtggaaggatattcccgcggcgtttatgcgataa

SEQ ID NO: 66465 - protein, 434 aa, Erwinia amylovora
MGCGYVHCHETPPVYALIDVNSMYCSCEEAFRPDLRGRPVVVLSNNDGALVAVNRAAKALGVRRGEPYFRCRRLLEQHNVAVFSSNYTLYASFSARFATVVESLAPRTFVYSIDELFADASHMEGVMTPQAFGQLLRAEVLRQTTLTCGVGVAPTKTLAKLCNHAAKTWPATGGVVALSDAVRLKKLMSLVSAGDVWGVGHRTEKGLAAMGIKTALALAEMDIRLARRLYGVTLERTIRELRGEACFALEEGTGAKQQLVVSRSFGARVTQLAQMQQAVTKYATRAGEKLRQENRLAKVVTVFIRSSAYDAGGVPYSNQATEVLPVPSQDTRDIIAAAQLGLSRIWREGVRYAKAGVMLSDLQGYETQLDLFSPAAVRPGSEKLMATIDKINREGRSRIFFAGEGIDPEYAMRREMLSPAYTTQWKDIPAAFMR

SEQ ID NO: 66466 - DNA, 1182 bp, Parachlamydia sp. UWE25
  CDS (1)..(1182): transl_table=11
gtggttgttttatccaataatgatggatgcgtaatttcccgttctcaagaagccaagcttttgggcgttaaaatgggggaaccttactttcaaattaaagcgctttgtgaatttagaaatattcaagtgttttcttcaaattacgcgctctacggagatatttcagagcgtatcatgaacctcttattcgaacatgcccccgacctagacatttattcaattgatgaagcttttttaaaatatccttctagtgttgccccttctgatttagtttctctttgtcacgaattacaaaagaaggttaaaaaatgggtgggaatgcctatttctttaggccttgctaacacaaagacacttgcaaaaatggccaatgatctcgccaaaaaaattcaaaatttctatgtgtttgatttaaattcatcggttcgtcaaaaggtcttacaaaattatttgattggggatgtttgggggattggacgaaatttaaaagaaaaattaaatggaatgaatattcacacggcctgggaatatgcacaaatggatccttccattattcgcaaacgactgggtgtgattggagagcgaatactatgggaattaagaggagttagctgcttagaatcagatgaaaaagtctctaaaaaaagtttgctttattctaggtctttcggacatgttctttcagagataacccctttgtccgaggctttatctacctacgtttatacagtggctgaaaagttaagagcacagggaagcctagcaaaagcgttgtatatatttttagaatatcaaattcagcccggaaagaagatgcgctgttatgatagtattactgaaatatttccagctccaactaaagacacaggagagatgattaaggccgcgaaacgagggttaaataaaattttccgtcgtgaagaaagatataagaaatgtggggtcattttattagatcttttacctgaatcatcttcaaattctgatttgtttttaaatcctgtagatcccaagcgaacacaattaatgaataccatggatgcattaaatgctcgttttggtaaaaaaaaattattctttggagcaatgggaacagacgtaagctggaagtctcgaaaagactgcagctcaaagcacaatccttctaattggcagcagctacccattgttttagctaagtaa

SEQ ID NO: 66467 - protein, 393 aa, Parachlamydia sp. UWE25
MVVLSNNDGCVISRSQEAKLLGVKMGEPYFQIKALCEFRNIQVFSSNYALYGDISERIMNLLFEHAPDLDIYSIDEAFLKYPSSVAPSDLVSLCHELQKKVKKWVGMPISLGLANTKTLAKMANDLAKKIQNFYVFDLNSSVRQKVLQNYLIGDVWGIGRNLKEKLNGMNIHTAWEYAQMDPSIIRKRLGVIGERILWELRGVSCLESDEKVSKKSLLYSRSFGHVLSEITPLSEALSTYVYTVAEKLRAQGSLAKALYIFLEYQIQPGKKMRCYDSITEIFPAPTKDTGEMIKAAKRGLNKIFRREERYKKCGVILLDLLPESSSNSDLFLNPVDPKRTQLMNTMDALNARFGKKKLFFGAMGTDVSWKSRKDCSSKHNPSNWQQLPIVLAK

SEQ ID NO: 66468 - DNA, 1404 bp, Desulfovibrio vulgaris subsp. vulgaris str. Hildenborough
  CDS (1)..(1404): transl_table=11
gtgcatgggccgcctgaatcacaagagccatgcggaaccttcgggccagacgagaccacaggggcaacctcgacggccgcatcacgcggggaggcccgacgcctgccgcgggggggcgtcctgtgggcgctggtggactgcaacaacttctacgcctcgtgcgaacggcttttcaggcccgacctcaaggggcgtccggtcgtggtgctttccaacaacgacggctgtgtcatcgcgcgttccgccgaagccaaggcactcggcgtgcccatgggggcaccggagttcaaggtgcgcgacatgctgcgtgcccacgacgtggctgtgttctcgtccaattacgccctgtacggcgacctctcgcaacgggtcatgcgcacactggcgacggtggtgccccgggtcgaggtctattccatcgacgaggcgttcatcccgttgcctgcggcacttgccgccgaccccgtagctgtggggcgcaccctgcggcagcgcgtggcgcaatgggtgggcattcccgtgtcggtgggcgtcggccccacgcggaccctcgccaagcttgccaacaggctttccaagcaggactccgcgtatgggaatgtcttcgacctgaccccggagacggtggacatggacagggtactcgccagcgtggatgtgggcgatgtgtggggcgtggggcgccggagtgcggagatgctgcgggggcgtggcattctcaccgcgcgggcgctgcgcgacgcagaccccctgtgggtgcggcagcgcatgaccgtcacgggctggcgcacgcagcaggagttgcggggaatgccgtgcctcacggatgacgacctgcccgtgccgcgtcgttccatccgctcatcccgttcgttcggtcagatggtgcgcaccttggagcccctgcgggaggcggtcgccacgttcaccgcacgggcggtggccaaggcgcgcgccgaagggcttgtggcgtcgtgcatcgaggtgcatatccgcacgccgcggcacaccgaacgaccacgttacgacgagacgacgaccatcaccctgccttgccccacggcggacacgggcctgtgcatacgacacgccctcacggggctggagcgcatcttccgtgagggctatctctacgccaaggcgggggtcacgctgttcggactcgaaccggctgcggggcggcaggggagccttctcgacctcctcgacggttcgcacgagcacaaggcgcgacgcgaacgactcatggccgcgctggatgccgtcaacctacggcacgggcgcgggagtatccgccacggtgcggaaggcgaccccggtgccgcgtggcatatgagccagaagtaccgttcgccgcgctacaccacggcatgggaggaactgcccgaagtgctctgccgttga

SEQ ID NO: 66469 - protein, 467 aa, Desulfovibrio vulgaris subsp. vulgaris str. Hildenborough
MHGPPESQEPCGTFGPDETTGATSTAASRGEARRLPRGGVLWALVDCNNFYASCERLFRPDLKGRPVVVLSNNDGCVIARSAEAKALGVPMGAPEFKVRDMLRAHDVAVFSSNYALYGDLSQRVMRTLATVVPRVEVYSIDEAFIPLPAALAADPVAVGRTLRQRVAQWVGIPVSVGVGPTRTLAKLANRLSKQDSAYGNVFDLTPETVDMDRVLASVDVGDVWGVGRRSAEMLRGRGILTARALRDADPLWVRQRMTVTGWRTQQELRGMPCLTDDDLPVPRRSIRSSRSFGQMVRTLEPLREAVATFTARAVAKARAEGLVASCIEVHIRTPRHTERPRYDETTTITLPCPTADTGLCIRHALTGLERIFREGYLYAKAGVTLFGLEPAAGRQGSLLDLLDGSHEHKARRERLMAALDAVNLRHGRGSIRHGAEGDPGAAWHMSQKYRSPRYTTAWEELPEVLCR

SEQ ID NO: 66470 - DNA, 1278 bp, Legionella pneumophila subsp. pneumophila str. Philadelphia 1
  CDS (1)..(1278): transl_table=11
atgagcttgcctgagatgtttgcccttatcgattgcaacaatttttacgccagttgtgagcgtttgtttcgtcctgatttaaaggacgtccccatcgtggtgctatccaataacgatggctgttgtatcgcacgctcgaatgaagccaaagcattgggcattgccatgggcgagccgtacttcaaaattaaacatttgtgcaaacagcatggagtgaaagctttttcctcaaattatacgctgtatggcaacatgagtcatcgtgtgatgtgcactattgaagaagcctggccccatatagaagtttactcgattgatgaagcgtttcttgatttaaggagtttaccggttgatagctatgattcgttttgcgagcagttacaaaagaaaatcttgaagcacacaggaatacccacttccatcggtattggacctactaaaacactagctaaagccgccaatcatttatgcaaaaaagtttataaaattcctgtgtttaatatcacctcgaatcgtgggcggttattgcaacagatttccgttggggacatttggggagtagggcggcaatgggccaataaattaatttcgcgaggcattcatacggcttatgatttggcaatgaccaatcctcaccttctgaagaaatgttttaacgccgtgttgatgcgaactgctatggagcttcaaggaattgcttgtggcggtttagaggtaatagagcctaagcaaagtattatgtcatccaaaagttttggtcagatgcaaactcaaattgcttcgattgaggaatcaatcagtagccattgtgctcgtgcggtggagaaaatgcgtcgccaacaattggtggcgacgcgtctggttgtatttgtgcatacgaaccgatttcgggaagatttggctcagcactttcagtccatcgaatttaagctgattaatcctacagatgatttgcgcttaattaccaaaatagccaaaagatgtctgcaacgcatttttaaaccagggtattactataaaaaggcaggggtatgtcttgaagacttaattcctaaaaaaccacgacagctggatatgtttcatcaaccaagtgatgagcatctaaaacacaccgaacaattgatgggtgtctttgaccaaatcaatcaaaagtatggaagaagcacgattcggttagccgccgaaggctattcaaaaccctgggagatgcgtgctgagctgaaatcacctgcttataccacgcgatggtctcaagttcccaaagttcatttgtattaa

SEQ ID NO: 66471 - protein, 425 aa, Legionella pneumophila subsp. pneumophila str. Philadelphia 1
MSLPEMFALIDCNNFYASCERLFRPDLKDVPIVVLSNNDGCCIARSNEAKALGIAMGEPYFKIKHLCKQHGVKAFSSNYTLYGNMSHRVMCTIEEAWPHIEVYSIDEAFLDLRSLPVDSYDSFCEQLQKKILKHTGIPTSIGIGPTKTLAKAANHLCKKVYKIPVFNITSNRGRLLQQISVGDIWGVGRQWANKLISRGIHTAYDLAMTNPHLLKKCFNAVLMRTAMELQGIACGGLEVIEPKQSIMSSKSFGQMQTQIASIEESISSHCARAVEKMRRQQLVATRLVVFVHTNRFREDLAQHFQSIEFKLINPTDDLRLITKIAKRCLQRIFKPGYYYKKAGVCLEDLIPKKPRQLDMFHQPSDEHLKHTEQLMGVFDQINQKYGRSTIRLAAEGYSKPWEMRAELKSPAYTTRWSQVPKVHLY

SEQ ID NO: 66472 - DNA, 1296 bp, Legionella pneumophila subsp. pneumophila str. Philadelphia 1
  CDS (1)..(1296): transl_table=11
ttggggagtcgtcactcatgttattcatacggtattgtgatgtttgcgctggtcgattgtaataatttttatgtctcgtgtgagcgtttatttaaaccagccttagcgaataaacccattttggtcttgtctaataatgatggttgtgtgattgcgcgatctaatgaagtaaaagctttgggtgttcaaatgggagtgccttattttgcagtcaaagcattatgtaagcagcataaagtgcatgtgttttcatccaattacacattgtatgctgatatgtcacgccgggttatgtcagttcttgaagacaattggccagcaatagagatttactccattgatgaagcttttcttgatttgaatactttgccccaatctgaacatgatgagttttgccgcaagttacaaaaaattgttttgcgccataccggtattcccgtatccataggcataggggcaaccaaaaccctggctaaactcgcaaaccatattgcgaaaaaggaattaagaacccctgtatttaacattgaaaatcaatatcattggctagctaaaatagttgttggcgaggtatgggggataggacggcaatggggtaaaaagttagtacaacaggggatttatacagctcatgacttggctggtatggatttgcaattaattaaaaaattatttagtgttgtattgcaacgaacagtgcttgagttgcgtggggtttcatgtggcagtttacaggattttgagtcaagaaaaagcataatatcttccaaatcctttggttctatgcaaacagagtattctgctcttgctcaggccatcagcagccattgtgccagagcttgggaaaagttacgtcatcaaaaattgatggcatgccatctttccatatttatcaaaaccaatcaatttcgtttggatttgccacaatatcagcaaactatagggtttaagctgattaatccaactgatgatctgcgacatttgattcgttgtgccaaattgtgcctgcgtaaaatatttcgctctggattccattaccaaaaggtaggcgtttatttaggagatttaattgaaaaaaactgtttgcagttagatttgtttaaccaggtttcagagaaagaattgaatcagacagagcgattgatgtcggtattagatgaaatcaacacgaaatatggccgccataccttgcgtttggcagcagaagggcatgtgaagccatgggctatgcgggcgcagtcccgttctcctcgctatacaacttcctggtctgaattgcctgtggtaattatttaa

SEQ ID NO: 66473 - protein, 431 aa, Legionella pneumophila subsp. pneumophila str. Philadelphia 1
MGSRHSCYSYGIVMFALVDCNNFYVSCERLFKPALANKPILVLSNNDGCVIARSNEVKALGVQMGVPYFAVKALCKQHKVHVFSSNYTLYADMSRRVMSVLEDNWPAIEIYSIDEAFLDLNTLPQSEHDEFCRKLQKIVLRHTGIPVSIGIGATKTLAKLANHIAKKELRTPVFNIENQYHWLAKIVVGEVWGIGRQWGKKLVQQGIYTAHDLAGMDLQLIKKLFSVVLQRTVLELRGVSCGSLQDFESRKSIISSKSFGSMQTEYSALAQAISSHCARAWEKLRHQKLMACHLSIFIKTNQFRLDLPQYQQTIGFKLINPTDDLRHLIRCAKLCLRKIFRSGFHYQKVGVYLGDLIEKNCLQLDLFNQVSEKELNQTERLMSVLDEINTKYGRHTLRLAAEGHVKPWAMRAQSRSPRYTTSWSELPVVII

SEQ ID NO: 66474 - DNA, 1284 bp, Bacteroides fragilis YCH46
  CDS (1)..(1284): transl_table=11
atgtttggactaatggactgcaataacttctacgcaagttgcgagagagtgttcaatccggctttgaacggtaagccgatcgttgttttaagtaataacgacggatgtgttattgccagaagtaacgaagcgaaaacattggggattaaaatgggagttccggcttatcagatcaaagatgatattcagaaatatggtatatctgtcttttcatcgaactatacgctatacggcgacatgtccggacgcgtgatgtccatactggcagaacaagtgccggaaatggaagtatacagtatagacgaagcatttcttaacctggaagggattcgggatattcagtcactcggaacagacatcataaacaaagtaatccgcggaaccggcatacctgttagtttgggtatcgccccaaccaaaacactcgcaaaggtcgccaataaatttgcaaagaaatatcctgcttacaatcgtttatgtatcatcgatacagaagaaaagcgcaccaaggccctgcaacttactgaaattggagacatctgggggatcggtcaccggcaagttgccaagttagaaaagcagggagtcaaaacagcctatgattttaccgagttgcccgaatcttgggtgcgtaagaacatgactgtagtcggagaaaggacctggaaagaacttcaaggcatttcctgtattgatatggaaaccacaccaccggccaaaaagcagatatgtacaagtcggtcattcggcaagatggtggaggacatcgatacaatgtcggaagcaatcgccactcacgcttctacatgcgcaaagaaactccgacaacagaaaggctatgcaatgtcactaatggtattcatccatacgaataacttccgtaaagattcgccacaatattggaggaatacagttgtacatcttccgataccgaccaatgacacattagaaattgtacattatgcactggccgggctaaaaacgattttcatgcaaggctatcaatataagaaagccggagttattatcaccgaaataaccgatagcacccaattgggactgtttgattcagtagatcgcgagaaacgtgaacgtcttcaacaaacaatagataagataaacggtaaacacagccgactcgtcaaattagcgattcaaggtacagggaggaattggaagcttaaacaaaaacagctatcagggcattataccactgacatcaatcagattataagcattaattgtacttacccaactgcatgtcaacgaaaacaatatagctga

SEQ ID NO: 66475 - protein, 427 aa, Bacteroides fragilis YCH46
MFGLMDCNNFYASCERVFNPALNGKPIVVLSNNDGCVIARSNEAKTLGIKMGVPAYQIKDDIQKYGISVFSSNYTLYGDMSGRVMSILAEQVPEMEVYSIDEAFLNLEGIRDIQSLGTDIINKVIRGTGIPVSLGIAPTKTLAKVANKFAKKYPAYNRLCIIDTEEKRTKALQLTEIGDIWGIGHRQVAKLEKQGVKTAYDFTELPESWVRKNMTVVGERTWKELQGISCIDMETTPPAKKQICTSRSFGKMVEDIDTMSEAIATHASTCAKKLRQQKGYAMSLMVFIHTNNFRKDSPQYWRNTVVHLPIPTNDTLEIVHYALAGLKTIFMQGYQYKKAGVIITEITDSTQLGLFDSVDREKRERLQQTIDKINGKHSRLVKLAIQGTGRNWKLKQKQLSGHYTTDINQIISINCTYPTACQRKQYS

SEQ ID NO: 66476 - DNA, 1278 bp, Legionella pneumophila str. Lens
  CDS (1)..(1278): transl_table=11
atgagcttgcctgagatgtttgcccttatcgattgcaacaatttttacgccagttgtgagcgtttgtttcgtcctgatttaaaggatgtccccatcgtggtgctatccaataacgatggctgttgtatcgcacgctcgaatgaagccaaagcattgggcattgccatgggcgagccatacttcaaaattaaacatttgtgcaaacagcatggtgtgaaagctttttcctcaaattatacgttgtacggtaacatgagtcatcgcgtgatgtgcactattgaagaagcctggcctcatatcgaaatttactcgattgatgaagcgtttcttgatttaaggagtttaccggttaactcgcataatttgttttgcgagcagttacaaaagaaaatcttgaagtacacgggaatacccacttccatcggcattgggccgaccaaaacactagccaaagccgccaatcatttatgcaaaaaagtttataaaatccctgtgtttaatatcacctcgagtcgtgagcggttattacaacagatttccgttggagacatttggggagtaggacggcaatgggccaataaattaatttcgcgaggtattcatacggcttatgatttggcaatgaccaatcctcaccttctgaagaaatgttttaacgtcgtgttgatgcgtaccgccatggagcttcaaggaattgcttgtggcggtttagaggcaatagagcctaagcaaagtattatgtcatctaaaagttttggtcagatgcaaacccaacttgcttcgattgaggaatcaatcagtagccattgtgcccgtgcggtggagaaaatgcgtcgccagcaattggtggcgaagcgcatggttgtatttgttaatacgaaccgatttcgggaagatttggcacagcactttcagtccatcgaatttaagctgattaatcccacagatgatttgcgcttaattactaaaatagccaaacgatgtctgcagcgtatttttaaaccagggtattactataaaaaggcaggagtatggcttgaagatttaattcctaaaagcccacgacagctggatatgtttcatcaaccaagtgatgagcatctaaaacacaccgaacaattgatgggggtctttgaccaaatcaatcaaaaatacggacgaagtacaattcgcctcgcagcagagggttattcaaaaccttgggcgatgcgtgctgaactgaaatcgcctgcctatactacacgatggtctgaggttccgcaggttcgtttgttttga

SEQ ID NO: 66477 - protein, 425 aa, Legionella pneumophila str. Lens
MSLPEMFALIDCNNFYASCERLFRPDLKDVPIVVLSNNDGCCIARSNEAKALGIAMGEPYFKIKHLCKQHGVKAFSSNYTLYGNMSHRVMCTIEEAWPHIEIYSIDEAFLDLRSLPVNSHNLFCEQLQKKILKYTGIPTSIGIGPTKTLAKAANHLCKKVYKIPVFNITSSRERLLQQISVGDIWGVGRQWANKLISRGIHTAYDLAMTNPHLLKKCFNVVLMRTAMELQGIACGGLEAIEPKQSIMSSKSFGQMQTQLASIEESISSHCARAVEKMRRQQLVAKRMVVFVNTNRFREDLAQHFQSIEFKLINPTDDLRLITKIAKRCLQRIFKPGYYYKKAGVWLEDLIPKSPRQLDMFHQPSDEHLKHTEQLMGVFDQINQKYGRSTIRLAAEGYSKPWAMRAELKSPAYTTRWSEVPQVRLF

SEQ ID NO: 66478 - DNA, 1278 bp, Legionella pneumophila str. Paris
  CDS (1)..(1278): transl_table=11
atgagcttgcctgagatgtttgcccttatcgattgcaacaatttttacgccagttgtgagcgtttgtttcgtcctgatttaaaggacgtccccatcgtggtgctatccaataatgatggctgttgtatcgcacgctcgaatgaagccaaagcattgggcattgccatgggcgagccgtacttcaaaattaaacatttgtgcaaacagcatggagtgaaagctttttcctcaaattatacgctgtatggcaacatgagtcatcgtgtgatgtgcactattgaagaagcctggccccatatagaagtttactcgattgatgaagcgtttcttgatttaaggagtttaccggttgatagccatgattcgttttgcgagcagttacaaaagaaaatcttgaagcacacaggaatacccacttccatcggtattggacctactaaaacactagctaaagccgccaatcatttatgcaaaaaagtttataaaatccctgtgtttaatatcacctcgaatcgtgggcggttattgcaacagatttccgttggggacatttggggagtagggcggcaatgggccaataaattaatttcgcgaggcattcatacggcttatgatttggcaatgaccaatcctcaccttctgaagaaatgttttaacgtcgtgttgatgcgtaccgccatggagcttcaaggaattgcttgtggcggtttagaggcaatagagcctaagcaaagtattatgtcatctaaaagttttggtcagatgcaaactcaacttgcttcgattgaggaatcaatcagtagccattgtgcccgtgcggtggagaaaatgcgtcgccagcaattggtggcgaagcgcctggttgtatttgtgcatacgaaccgatttcgcgaagatttggcacagcactttcagtccatcgaatttaagctgattaatcctacagatgatttgcgcttaattaccaaaatggccaagcgatgtctgcaacgcatttttaaaccagggtattactataaaaaggcaggagtatgtcttgaggacttaattcccaaaaacccacgacagctggatatgttttatcaaccaagtgacgagcatctaaaccacacggaacaattgatggcggtctttgaccaaatcaatcaaaaatacggacgaagtacaatccgcctcgcggcagagggttattcaaaaccttgggcgatgcgtgctgaactgaaatcgcctgcctataccacacgatggtctgatttacctcgtgcaatcattaggtaa

SEQ ID NO: 66479 - protein, 425 aa, Legionella pneumophila str. Paris
MSLPEMFALIDCNNFYASCERLFRPDLKDVPIVVLSNNDGCCIARSNEAKALGIAMGEPYFKIKHLCKQHGVKAFSSNYTLYGNMSHRVMCTIEEAWPHIEVYSIDEAFLDLRSLPVDSHDSFCEQLQKKILKHTGIPTSIGIGPTKTLAKAANHLCKKVYKIPVFNITSNRGRLLQQISVGDIWGVGRQWANKLISRGIHTAYDLAMTNPHLLKKCFNVVLMRTAMELQGIACGGLEAIEPKQSIMSSKSFGQMQTQLASIEESISSHCARAVEKMRRQQLVAKRLVVFVHTNRFREDLAQHFQSIEFKLINPTDDLRLITKMAKRCLQRIFKPGYYYKKAGVCLEDLIPKNPRQLDMFYQPSDEHLNHTEQLMAVFDQINQKYGRSTIRLAAEGYSKPWAMRAELKSPAYTTRWSDLPRAIIR

SEQ ID NO: 66480 - DNA, 1257 bp, Legionella pneumophila str. Paris
  CDS (1)..(1257): transl_table=11
atgtttgcgctggtcgattgtaataatttttatgtctcgtgtgagcgtttatttaaaccagccttagcgaataaaccaattttggtcttgtctaataatgatggttgtgtgattgcgcgatctaatgaagtaaaagctttgggtgttcaaatgggagtgccttattttgcagttaaagcattatgtaagcagcataaagtacatgtgttctcatccaattacacattgtatgctgatatgtcacgccgggttatgtcagttcttgaaaacaattggccagcaatagagatttactccattgatgaagcttttcttgatttgaatactttgccccaatctgaacatgatgagttttgccgcaagttacagaaaattgttttgcgctataccggtattcccgtatccataggcataggggcaaccaaaaccctggctaaactcgcaaaccatattgcgaaaaaggaattaagaattcctgtgtttaacattgaaaatcaatatcattggttagctaaaatagttgttggcgaggtatggggagtaggacggcaatggggtaaaaagttagtacaacaggggatttatacagctcatgacttggctggtatggatttgcaattaattaaaaaattatttagtgttgtattgcaacgaacagtgcttgagttgcgtggggtttcatgtggcagtttacaggattttgagtcaagaaaaagcataatatcttccaaatcctttggttctatgcaaacagagtattctgctcttgctcaggccatcagcagccattgtgccagagcttgggaaaagttacgtcatcaaaaattgatggcatgccatctttccatatttatcaaaaccaatcgattccgtttcgatttgccacaatatcagcaaactatagggtttaagttgattaatccaactgatgatttgcgacatttgattcgttgtgccaaattgtgcctgcgtaaaatatttcgtcccggattccattaccaaaaggtaggcgtatatttgggagatttaattgaaaaaaactgtttgcagttagatttgtttaatcaggtttcagagaaagaattgaatcagacagagcgattgatgtcggtattagatgaaatcaatacgaaatatggccgtcataccttacgtttggcagcagaagggcatgtgaagccatgggctatgcgggcacagtcacgttctccctgttataccacttcctggtctgaattgcctgtggtaattatttaa

SEQ ID NO: 66481 - protein, 418 aa, Legionella pneumophila str. Paris
MFALVDCNNFYVSCERLFKPALANKPILVLSNNDGCVIARSNEVKALGVQMGVPYFAVKALCKQHKVHVFSSNYTLYADMSRRVMSVLENNWPAIEIYSIDEAFLDLNTLPQSEHDEFCRKLQKIVLRYTGIPVSIGIGATKTLAKLANHIAKKELRIPVFNIENQYHWLAKIVVGEVWGVGRQWGKKLVQQGIYTAHDLAGMDLQLIKKLFSVVLQRTVLELRGVSCGSLQDFESRKSIISSKSFGSMQTEYSALAQAISSHCARAWEKLRHQKLMACHLSIFIKTNRFRFDLPQYQQTIGFKLINPTDDLRHLIRCAKLCLRKIFRPGFHYQKVGVYLGDLIEKNCLQLDLFNQVSEKELNQTERLMSVLDEINTKYGRHTLRLAAEGHVKPWAMRAQSRSPCYTTSWSELPVVII

SEQ ID NO: 66482 - DNA, 1278 bp, Legionella pneumophila str. Lens
  CDS (1)..(1278): transl_table=11
atgagcttgcctgagatgtttgcccttatcgactgcaacaatttttacgccagttgtgagcgtttgtttcgtcctgatttaaaggatgtccccatcgtggtgctatccaataacgacggctgttgtatcgcacgctcgaatgaagccaaagcattgggcattgccatgggcgagccatacttcaaaattaaacatttgtgcaaacagcatggcgtgaaagctttttcctcaaattatacgttgtatggtaacatgagtcatcgcgtgatgtgcactattgaagaagcctggcctcatatcgaaatttactcgattgatgaagcgtttcttgatttaaggagtttaccggttaactcgcatgatttgttttgcgagcagttacaaaagaaaatcttgaagtacacgggaatacccacttccatcggcattgggccgaccaaaacactagccaaagccgccaatcatttatgcaaaaaagtttataaaatccctgtgtttaatatcacttcgagtcgtgagcggttattacaacagatttccgttggggacatttggggagtagggcggcaatgggccaataaattaatttcgcgaggtattcagacggcttatgatttggcaatgaccaatcctcaccttctgaagaaatgttttaacgtcgtgttgatgcgtaccgccatggagcttcaaggaattgcttgtggcggtttagaggcaatagagcctaagcaaagtattatgtcatctaaaagttttggtcagatgcaaactcaacttgcttcgattgaggaatcaatcagtagccattgtgcccgtgcggtggagaaaatgcgtcgccagcaattggtggcgaagcgcctggttgtatttgtgcatacgaaccgatttcgcgaagatttggcacagcactttcagtccatcgaatttaagctgattaatcctacagatgatttgcgcttaattaccaaaatggccaagcgatgtctgcaacgcatttttaaaccatggtattactataaaaaggcaggagtatgtcttgaggacttaattcccaaaaacccacgacagctggatatgtttcatcaaccaagtgacgagcatctaaaccacacggaacaattgatggcggtctttgaccaaatcaatcaaaaatacggacgaagtacaatccgcctcgcggcagagggttattcaaaaccttgggcgatgcgtgctgaactgaaatcgcctgcctataccacacgatggtctgatttacctcgtgcaatcattaggtaa

SEQ ID NO: 66483 - protein, 425 aa, Legionella pneumophila str. Lens
MSLPEMFALIDCNNFYASCERLFRPDLKDVPIVVLSNNDGCCIARSNEAKALGIAMGEPYFKIKHLCKQHGVKAFSSNYTLYGNMSHRVMCTIEEAWPHIEIYSIDEAFLDLRSLPVNSHDLFCEQLQKKILKYTGIPTSIGIGPTKTLAKAANHLCKKVYKIPVFNITSSRERLLQQISVGDIWGVGRQWANKLISRGIQTAYDLAMTNPHLLKKCFNVVLMRTAMELQGIACGGLEAIEPKQSIMSSKSFGQMQTQLASIEESISSHCARAVEKMRRQQLVAKRLVVFVHTNRFREDLAQHFQSIEFKLINPTDDLRLITKMAKRCLQRIFKPWYYYKKAGVCLEDLIPKNPRQLDMFHQPSDEHLNHTEQLMAVFDQINQKYGRSTIRLAAEGYSKPWAMRAELKSPAYTTRWSDLPRAIIR

SEQ ID NO: 66484 - DNA, 1257 bp, Legionella pneumophila str. Lens
  CDS (1)..(1257): transl_table=11
atgtttgcgctggtcgattgtaataatttttatgtctcgtgtgagcgtttatttaaaccagccttagcgaataaaccaattttggtcttgtctaataatgatggttgtgtgattgcgcgatctaatgaagtaaaagctttgggtgttcaaatgggagtaccttattttgcagtcaaagcattatgcaagcagcataaagtgcatgtgttttcatccaattacacattgtatgctgatatgtcacgtcgggttatgtcagttcttgaagacaattggccagcaatagagatttactccattgatgaagcttttcttgatttgaatactttgccccaatctgaacataatgagttttgtcgcaagttacagaaaattgttttgcgctataccggtattcccgtatccataggcataggggcaaccaaaaccctggctaaactcgcaaaccatattgcgaaaaaggaattaagaactcctgtgtttaacattgaaaatcaatatcattggttagctaaaatagttgttggcgaggtatgggggatagggcggcaatggggtaaaaagttagtacaacagggaatttatacagctcatgacttggctggtatggatttgcaattaattaaaaaattatttagtgttgtattgcaacgaacagtgcttgagttgcgtggggtttcatgtggcagtttacaggattttgaatcaagaaaaagcataatatcttccaaatcctttggttctatgcaaacagagtattctgctcttgctcaggccatcagcagccattgtgccagagcttgggaaaagttacgtcatcaaaaattgatggcatgccatctttccatatttatcaaaaccaatcgattccgtttggatttgccacaatatcagcaaactatagggtttaagttgattaatccaactgatgatctgcgacatttaattcgttgtgccaaattgtgcctgcgtaaaatatttcgtcctggattccattaccaaaaggtaggcatatatttgggagatttaattgaaaaaaactgtttgcaactggatctgtttaaccaagtttcagagaaagagttaaatcaggcagagcgattgatgtcggtattaggtgcaatcaatacgaaatatggccgtcataccttacgtttggcagcagaaggatatgtgaagccttgggctatgcgggcacagttacgttctcccagctataccacttcctggtctgaattgcctgtggtcattatttaa

SEQ ID NO: 66485 - protein, 418 aa, Legionella pneumophila str. Lens
MFALVDCNNFYVSCERLFKPALANKPILVLSNNDGCVIARSNEVKALGVQMGVPYFAVKALCKQHKVHVFSSNYTLYADMSRRVMSVLEDNWPAIEIYSIDEAFLDLNTLPQSEHNEFCRKLQKIVLRYTGIPVSIGIGATKTLAKLANHIAKKELRTPVFNIENQYHWLAKIVVGEVWGIGRQWGKKLVQQGIYTAHDLAGMDLQLIKKLFSVVLQRTVLELRGVSCGSLQDFESRKSIISSKSFGSMQTEYSALAQAISSHCARAWEKLRHQKLMACHLSIFIKTNRFRLDLPQYQQTIGFKLINPTDDLRHLIRCAKLCLRKIFRPGFHYQKVGIYLGDLIEKNCLQLDLFNQVSEKELNQAERLMSVLGAINTKYGRHTLRLAAEGYVKPWAMRAQLRSPSYTTSWSELPVVII

SEQ ID NO: 66486 - DNA, 1305 bp, Photobacterium profundum SS9
  CDS (1)..(1305): transl_table=11
atgacaggtcaccttagtgggtataaaaatcaggtatgggcactggtcgatgtaaagagtttttattgttcttgtgagcaactgtttgatccctcattagtcaatcaacccgtggtggtattgtcgaataacgatgggtgttgtgttgccgtttcagagcaagcgaaagcattaggcatacagcgaggagcaccttggttcaaaattgagcgagaagcacggcagctaggtgtacaagttcgcagttctaactacgccttgtatgctgatatgagccgacgatttatagaagaactacaccgtttttcccctcatgtagagcaatattcaattgatgaagcctttgtgcgtttagacggttttcggcttgatactcttgaacaatatggttcaacaatacgagatgccattcgcgatcatattggtttgcctgtacgtgtaggtattggtgcaacgccaaccttggccaaattaggcaatcaggcagcgaagcaatttgaatgtcgagttgaaggtgtcattaaaattgattcagatgtacgccgtcagtggattcttgagcgaacagatatacaagatatatgggggatcggtgctaaaacggcgtcgcgtttacgtacaacaggcattgataatgcgctacagctagcgaacaagaccccagcagatatgcgcagactatggaatgtcggtttagcgcgtacagtcatggaactgcaaggcattgcttgtattgagcctggagacattgatgaaacgcgtaaacaaatattatcaagccgaagctttggctcaggtatttccaattttgatgaattaaaagcagcgttagcgtttcattgccagcgtgcgggagaaaaactgcgtaagcaaggtagccaagccaatgttgttggtgtgtttttacgtacgaataggcataagaacctgccacaacataatagaagtagtgctatgccactaagctgccccagccaagatagttacaagtttcttgatcttgctttgttgcagttaaagcaactctaccgaccgggctatgagtaccaaacaattggtgtaattcttaatgaattaacagaggcgaagaatgatagctttcaattggatatgtttaatagtagtgcgcttgatgaacataaacggcgagatttaatggcaatcaccgatcaagtgaatgctcgatttaaaaacggtattaaaccagcatctgttattggctcaacaaactggcatatgcggcaagcttttcgctctaaccgctggacaacgaggcttgacgaattgcctatcgcgaagtgctag

SEQ ID NO: 66487 - protein, 434 aa, Photobacterium profundum SS9
MTGHLSGYKNQVWALVDVKSFYCSCEQLFDPSLVNQPVVVLSNNDGCCVAVSEQAKALGIQRGAPWFKIEREARQLGVQVRSSNYALYADMSRRFIEELHRFSPHVEQYSIDEAFVRLDGFRLDTLEQYGSTIRDAIRDHIGLPVRVGIGATPTLAKLGNQAAKQFECRVEGVIKIDSDVRRQWILERTDIQDIWGIGAKTASRLRTTGIDNALQLANKTPADMRRLWNVGLARTVMELQGIACIEPGDIDETRKQILSSRSFGSGISNFDELKAALAFHCQRAGEKLRKQGSQANVVGVFLRTNRHKNLPQHNRSSAMPLSCPSQDSYKFLDLALLQLKQLYRPGYEYQTIGVILNELTEAKNDSFQLDMFNSSALDEHKRRDLMAITDQVNARFKNGIKPASVIGSTNWHMRQAFRSNRWTTRLDELPIAKC

SEQ ID NO: 66488 - DNA, 1269 bp, Salmonella enterica subsp. enterica serovar Paratyphi A str. ATCC
  CDS (1)..(1269): transl_table=11
atgttcgcgctctgcgatgttaatagcttttacgcctcctgcgaaacggtctttcgtcctgatttatgtggccgaccggtggtggtgttatcaaacaatgatggctgcgttatcgcgtgtagcgccgaggcgaaacaactcggtatcgcagcaggtgagccatacttcaaacagaaagaacgcttccggcgatccggtgttgtttgcttcagcagtaattacgagctttacgctgatatgtcgaaccgggtaatgaccacactagaggagatggtgccgcgggtagaaatttacagcattgatgaggctttttgtgatctgacgggggtacgaaactgccgggatctgacagatttcgggcacgagataagagcgacggtcctgaagcgcacgcacctgactgtcggtgtaggcattgcccagacgaaaacccttgccaagctggctaaccatgctgcgaaaaagtggcagcgccagaccgacggggtggttgacctgtcgaacatcgatcgccagcgtcggctgctggccctgatacccgtagaggatgtctggggtgtcggcagacgcatcagtaagaagctcaatgccctgggcatcaagactgctctcgatctctctgaacaaagtacctggatcatcaggaaacacttcaatgtcgtgctggagcgcaccgtgagagagcttcgcggagagccatgtctggagcttgaagagtttgcgccggcaaagcaggaaatcgtttgtagccgctctttcggcgagcgggtcacagactatgaggaaatgcgccaggctgtttacagctacgctgcgcgcgcggcagaaaaactccgcggcgagcaccagtactgctgtttcatttcaacattcgtcaaaacatcaccctttgccctgaacgagccctactacggtaacagcgccgcggtgacgcttctcacccccacgcaggattcacgtgacattatcaatgcggctgtgaaatgtctggataaaatctggcgcgacggccatcgctaccagaaagcgggggtgatgctgggtgacttcttcagccagggcgtagcgcaactcaaccttttcgacgataacgcgccgcgcgccggtagtgcgaagttgatggaagtactggaccatcttaacgcaaaagacgggaaggggacgctgtacttcgccgggcaggggatgtcgcaacagtgggctatgaagcgagaaatgctttcgcctcggtacaccacaagatactctgatctactgcgtgttaagtaa

SEQ ID NO: 66489 - protein, 422 aa, Salmonella enterica subsp. enterica serovar Paratyphi A str. ATCC
MFALCDVNSFYASCETVFRPDLCGRPVVVLSNNDGCVIACSAEAKQLGIAAGEPYFKQKERFRRSGVVCFSSNYELYADMSNRVMTTLEEMVPRVEIYSIDEAFCDLTGVRNCRDLTDFGHEIRATVLKRTHLTVGVGIAQTKTLAKLANHAAKKWQRQTDGVVDLSNIDRQRRLLALIPVEDVWGVGRRISKKLNALGIKTALDLSEQSTWIIRKHFNVVLERTVRELRGEPCLELEEFAPAKQEIVCSRSFGERVTDYEEMRQAVYSYAARAAEKLRGEHQYCCFISTFVKTSPFALNEPYYGNSAAVTLLTPTQDSRDIINAAVKCLDKIWRDGHRYQKAGVMLGDFFSQGVAQLNLFDDNAPRAGSAKLMEVLDHLNAKDGKGTLYFAGQGMSQQWAMKREMLSPRYTTRYSDLLRVK

SEQ ID NO: 66490 - DNA, 1257 bp, Synechococcus elongatus PCC 6301
  CDS (1)..(1257): transl_table=11
atgttcgccctgattgactgcaacaacttctacgtctcttgtgaacgagtatttgatcccaagctgcaggggcagcctgtcgttgtcctctccaataacgacggctgcgtgattgctcgttctgcagaagcaaaagctctagggattcccatggggatccccttcttcaaagtcaaagacctgatatcacaacatcagattcaggtcttctccagcaactacgccctctacggcgacatgagccagcgagtgatgcaaaccctggcaacactctgtcctgatctagaggtctattccattgatgaagccttcttagacttctcaggatttcaagcccagcccctgcagcaaggtcaattgattcgtcaaaccgtcgggcagtggacaggcatccccgtctcgatcggcattgctgccaccaaggtactcgccaaagtagccaacaaactcgccaagcaaaatggtggtgtctttgtcctgtcgccatcaaaagtgcaagccgtcctcatgactctgcccgttgaagaagtttggggcatttccagtcgttggggtcagcggcttcgggctttgaacatcagtaccgccgccgaactccaggccactaaccttaatctgatgcgtcagcagttcaacatagttctcgagcggattgtgcgagagctacggggggaatcctgcttacccctcgaatccattgtcaatccgcagcaaagcttggtagtctctcgttccttcgggcagccaattacaacgctgccagagcttaaacaagccgtagcgacctacgtcagtcgagccgccgaggaactacggagccggcaactaacgaccagctatctaaccgtctttgtaagaacaaatcggtttcaagagaactatgaagcgcccaatgctagtcagggcttactcacgcccaccaatcacacggggaaattactggaaattgccctgcgttgcacagaatcgctctatcaaccaggacgagcctacaagaaagctggagtcctgtttcaagggttagggtcagcgcagtcaatccagcagagcctgtttgaggagtccgacagcgagaaaggagcagcgctgatggtgacgatggaccggcttaaccggcggtatggtcggcagtccctgcactatggagccacaggaactcgacaaccttgggccatgcgctccgaccagcgatcgccgcaatacacaactcgatggcaagacttacccgaagtccatgcaagagctcgagagatttga

SEQ ID NO: 66491 - protein, 418 aa, Synechococcus elongatus PCC 6301
MFALIDCNNFYVSCERVFDPKLQGQPVVVLSNNDGCVIARSAEAKALGIPMGIPFFKVKDLISQHQIQVFSSNYALYGDMSQRVMQTLATLCPDLEVYSIDEAFLDFSGFQAQPLQQGQLIRQTVGQWTGIPVSIGIAATKVLAKVANKLAKQNGGVFVLSPSKVQAVLMTLPVEEVWGISSRWGQRLRALNISTAAELQATNLNLMRQQFNIVLERIVRELRGESCLPLESIVNPQQSLVVSRSFGQPITTLPELKQAVATYVSRAAEELRSRQLTTSYLTVFVRTNRFQENYEAPNASQGLLTPTNHTGKLLEIALRCTESLYQPGRAYKKAGVLFQGLGSAQSIQQSLFEESDSEKGAALMVTMDRLNRRYGRQSLHYGATGTRQPWAMRSDQRSPQYTTRWQDLPEVHARAREI

SEQ ID NO: 66492 - DNA, 1272 bp, Escherichia coli
  CDS (1)..(1272): transl_table=11
atgtttgcactagctgatatcaacagtttctacgcctcatgtgaaaaagttttccgcccggaccttcgcaacgaaccggtcatcgtactcagcaataacgatggctgtgtgatcgcgcgcagcccggaggcaaaagcccttggcatcagaatggggcagccctggtttcaggtgagacaaatgcgcctggagaagaaaatacatgtattttccagcaattatgcgctgtaccacagcatgagccaacgggttatggctgttctggagtcgctttctcccgcagttgagccctactcaattgatgaaatgttcattgatttgcgggggataaatcattgcatctctccggagttttttggtcatcagctcagggaacaggtaaaaagctggacaggactcaccatgggggtgggcattgcgcctacaaaaacgctggctaaaagtgcacagtgggcaacaaagcaatggccacagttttccggtgtggtcgcgctgacggcagaaaaccgtaatcggatcttgaagctactggggctgcagccagttggtgaggtctggggagtaggacgcagactgacggaaaagctgaatgcgctgggtattaacacagcactgcagctggcgcaggctaacacggcattcatccggaaaaacttcagcgtcattcttgagcgtacggtacgcgaactcaacggcgagtcctgcatatccctggaagaagcaccaccggcaaaacagcagattgtctgtagtcgcagttttggtgaacgaatcacagacaaagatgccatgcaccaggctgttgttcagtatgcagagcgggccgcagagaaactacgtggggagcgtcagtattgccggcaggtgacgacatttgtacggacatccccctttgcagtaaaagaaccctgttacagcaatgccgctgtggaaaagcttccattgcccacacaggacagccgggacattattgccgcagcatgcagagcgttaaaccatgtctggcgtgaagggtaccgctatatgaaggcaggtgtcatgctggctgatttcacaccatcgggtatagcgcagccgggattatttgatgaaatccagccccgtaaaaacagtgaaaagttaatgaaaacactcgatgaactgaaccagtcgggaaaagggaaagtgtggtttgcggggcgaggaaccgcccctgaatggcaaatgaaacgggaaatgctctcgccttcgtatacaacacaatggactgagatccccattgcttcattatga

SEQ ID NO: 66493 - protein, 423 aa, Escherichia coli
MFALADINSFYASCEKVFRPDLRNEPVIVLSNNDGCVIARSPEAKALGIRMGQPWFQVRQMRLEKKIHVFSSNYALYHSMSQRVMAVLESLSPAVEPYSIDEMFIDLRGINHCISPEFFGHQLREQVKSWTGLTMGVGIAPTKTLAKSAQWATKQWPQFSGVVALTAENRNRILKLLGLQPVGEVWGVGRRLTEKLNALGINTALQLAQANTAFIRKNFSVILERTVRELNGESCISLEEAPPAKQQIVCSRSFGERITDKDAMHQAVVQYAERAAEKLRGERQYCRQVTTFVRTSPFAVKEPCYSNAAVEKLPLPTQDSRDIIAAACRALNHVWREGYRYMKAGVMLADFTPSGIAQPGLFDEIQPRKNSEKLMKTLDELNQSGKGKVWFAGRGTAPEWQMKREMLSPSYTTQWTEIPIASL

SEQ ID NO: 66494 - DNA, 1263 bp, Gluconobacter oxydans 621H
  CDS (1)..(1263): transl_table=11
gtgatgcgtgttttcggcctgatcgacggcaattccttctattgctcctgccagcgcgctttcgagccgcgcctgaagcgcaggccggtcgtggtcctgagcaacaatgatggctgcgcgattgcccgcacccgagaagccaaggcactcggcatcaagatgggggatgcctggcacttggcccggaaacggcccgagagccgtccggtcgtctggtactcctcgaactatgccctctatgccgatatgtcgcgacggatgtatcaggtcctggcggagcgcgtgccgggcgtggagccctactcgatcgacgagatgttcctcgatctgagcaatcttccaggggatctgcatgaccgctgtcggcagctgcgccaggacgtgcttgatcatgcgaagatcccgacctgcgtgggctggggcccgaccaagacaatcgccaagctggccaacggtctggcgaaagatcatgcggaactggatggtttgtgtgacctcacagatcctgccatgcgccaagactggtaccgccgcacggacattgatgaagtctggggtatcggccgacagacgacgcagaagctgaaggccatgggcatcgagacaatcgccgatttcgtggcgcttgacgcaaagacagtccgtcagatgctgaccgtcgtgggcgcacgcgtacaggcggagctgcgcggtcaatcctgccttcccctgtccgacattgccgccacgcggaaaagcatcgcctcgacccggacgttcggccgtctgctactgaaatgggacgagattcgtgaggctatcgcgcactatgcgaaccgggctgcggagaaactgcgagaggataagcttgaagctgcgcacctttctgtcttgatgcagaccaatccgcacaatggcgacccctggtatgcgaagcacgcagccatcaccatcgagccaacgtccgatgccagggacctgatccggcatgcgacagaactcggccgagccatctggcttccaggatatcgctatttcaaagctggagtgatcttggcggatctgcgtcctgccgacagtcaaggactcatgttcgcatcgcgagatccggttcagtctgcgaccgtcatggctgcactggacgcagtgaatgcacgctttggaatggggactctccgcccgggatcgactgggctaaagcacagctggtcaccccggcagtctttgttgtcggcgcgatatacaacacagctggatgagattgtgacagcgaaaggttggtga

SEQ ID NO: 66495 - protein, 420 aa, Gluconobacter oxydans 621H
MMRVFGLIDGNSFYCSCQRAFEPRLKRRPVVVLSNNDGCAIARTREAKALGIKMGDAWHLARKRPESRPVVWYSSNYALYADMSRRMYQVLAERVPGVEPYSIDEMFLDLSNLPGDLHDRCRQLRQDVLDHAKIPTCVGWGPTKTIAKLANGLAKDHAELDGLCDLTDPAMRQDWYRRTDIDEVWGIGRQTTQKLKAMGIETIADFVALDAKTVRQMLTVVGARVQAELRGQSCLPLSDIAATRKSIASTRTFGRLLLKWDEIREAIAHYANRAAEKLREDKLEAAHLSVLMQTNPHNGDPWYAKHAAITIEPTSDARDLIRHATELGRAIWLPGYRYFKAGVILADLRPADSQGLMFASRDPVQSATVMAALDAVNARFGMGTLRPGSTGLKHSWSPRQSLLSARYTTQLDEIVTAKGW

SEQ ID NO: 66496 - DNA, 1293 bp, Azoarcus sp. EbN1
  CDS (1)..(1293): transl_table=11
atgagttcaccgcccccggttttcgcgctggtcgactgcaacaacttctacgccagctgcgaaaaactcttcgaccctcggctcgccggccgggcggtcgtggtgctgtcgaacaacgacggctgcgtggtcgcccgctcggccgaggcgaaggtcctcggagtcccgatgggcgcgccctggttcaaactcgccgggctcgcccagcggcacggaatcatcgccctgtcctcgaactacgcgctgtacgcggacatgagcaaccgtgtgatcgaggttctggccagcttcacgccgcggctcgaggtctacagcatcgacgagtgctttctcgatttagcggggtttgctcagctcgacctcgtggagtacagctaccggatccgcgaccgcgtcagccaatggctcgggctgccggtatgcatcgggatcgccccgacgaaaaccctcgccaagctcgccaatcatcttgccaagaagcgcctgcagtacgctggcgtctgcgacctgcgcacaatccagccagcgcaacgggcggccctattcgctgaaatcggtgtcggcgaggtgtggggcgtcggtggccggctgcaggaccgcttggccacgatggcgatccgcaccgttgaagacctgcgtcgggccaaccccgaattaatccggcgccgcttctcggtcgccctcgaacgcacggtgcgcgagctcaatgacatgtcctgcctcgaactcgaagaggtcgccccgcccaggcagcagatcattgccagccgctcgttcggcaacgccgtcttcctcttggaagagctgcgggaagcggtcgcaagccacatcagccgggcagcggagaagctgcgcgcgcgaggatccgaggtaggggcgctgacggtgatgatctgcaccaatccgttcaagccccaagatccgcaataccagcgcgcggtcacggttccgctgagcgacccgaccagcgacacccgcaagctgatcgcaatcgcgctgcgggtgctcgacggtctctaccggtcaggcttcgcataccacaaagctggaatcatgctcgccgagctcatgccggccggaaaacggcaacagagcctgttcgacgagctggcgagcgatacgcgcgcacaagccgtcatggtggcaatggatgcgatcaaccaccgatggggccgcagcacgctgaaatcctccgtcatcggcacccggcaaggctggaagatgcgccaggaacggcggacaccggactatacgacgtcctggagcgatttaccggtggtggtggcacgctga

SEQ ID NO: 66497 - protein, 430 aa, Azoarcus sp. EbN1
MSSPPPVFALVDCNNFYASCEKLFDPRLAGRAVVVLSNNDGCVVARSAEAKVLGVPMGAPWFKLAGLAQRHGIIALSSNYALYADMSNRVIEVLASFTPRLEVYSIDECFLDLAGFAQLDLVEYSYRIRDRVSQWLGLPVCIGIAPTKTLAKLANHLAKKRLQYAGVCDLRTIQPAQRAALFAEIGVGEVWGVGGRLQDRLATMAIRTVEDLRRANPELIRRRFSVALERTVRELNDMSCLELEEVAPPRQQIIASRSFGNAVFLLEELREAVASHISRAAEKLRARGSEVGALTVMICTNPFKPQDPQYQRAVTVPLSDPTSDTRKLIAIALRVLDGLYRSGFAYHKAGIMLAELMPAGKRQQSLFDELASDTRAQAVMVAMDAINHRWGRSTLKSSVIGTRQGWKMRQERRTPDYTTSWSDLPVVVAR

SEQ ID NO: 66498 - DNA, 1275 bp, Salmonella enterica subsp. enterica serovar Choleraesuis str
  CDS (1)..(1275): transl_table=11
atgttcgctttggctgacgtcaactcgttctatgccagttgcgaaaaggtctttcgccccgatttgcgtgacaggtctgtggtggtcctgagtaacaacgatggttgtgtaatcgcgcgcagcgctgaagcaaaaaaactgggcataaaaatgggggtgccgtggtttcaactgaggtcggcgaaatttccggagccggttatcgcgttctccagtaattacgccctctacgcatcaatgtcgaacagggtcatggttcaccaggaagagctggcgccacgcgttgagcagtactccattgacgagatgtttctggatattcgcggtatagacagttgcatcgatttcgaggatttcggccgacagctgcgtgagcacgttcgttccggcacagggctgaccatcggcgtcggaatgggaccgaccaaaacgctggctaaaagcgcgcaatgggcatcgaaagaatggtcacagttcggaggcatgcttgccctgacgttacacaatcagaaacgaacggagaaactgctgtcactgcaaccggtggaggaaatctggggtgtgggccgcaggatctcaaagaagctgaacacaatggggatcaccacagcactgcagctggcccgcgcgaatccaacgttcatcaggaaaaactttaatgtggttctggagagaacggtccgggaactcaatggagaaagctgtatttccctggaggaagcaccgccccccaaacagcagatagtctgcagcagaagctttggagaacgagtcacgacttatgaagcgatgcggcaggcagtctgtcagcacgctgaacgtgccgccgaaaagctgcgtggggaacggcagttctgcaggcatattgccgtgtttgtgaaaacatcgccgttcgccgtaactgagccctactacggtaatctggccagtgaaaaactgctcatccccacgcaggatacacgggacatcattgccgctgccgtcagagctctggacaggatctgggtggatggtcaccgttacgcaaaggcaggctgtatgctgaacgatttcacgccaaccagggtatcgcagcttaatttgtttgatgaagtacagccgcgggaacggagcgagcagctgatgcaagtcctagatgggattaaccatccgggcaaggggaaaatatggttcgccggtcgggggattgcccccgagtggcagatgaaaagggaactactttcgccagcttatacgacacgttgggcagatattcctgcagcgaaattgacttga

SEQ ID NO: 66499 - protein, 424 aa, Salmonella enterica subsp. enterica serovar Choleraesuis str
MFALADVNSFYASCEKVFRPDLRDRSVVVLSNNDGCVIARSAEAKKLGIKMGVPWFQLRSAKFPEPVIAFSSNYALYASMSNRVMVHQEELAPRVEQYSIDEMFLDIRGIDSCIDFEDFGRQLREHVRSGTGLTIGVGMGPTKTLAKSAQWASKEWSQFGGMLALTLHNQKRTEKLLSLQPVEEIWGVGRRISKKLNTMGITTALQLARANPTFIRKNFNVVLERTVRELNGESCISLEEAPPPKQQIVCSRSFGERVTTYEAMRQAVCQHAERAAEKLRGERQFCRHIAVFVKTSPFAVTEPYYGNLASEKLLIPTQDTRDIIAAAVRALDRIWVDGHRYAKAGCMLNDFTPTRVSQLNLFDEVQPRERSEQLMQVLDGINHPGKGKIWFAGRGIAPEWQMKRELLSPAYTTRWADIPAAKLT

SEQ ID NO: 66500 - DNA, 1284 bp, Bacteroides fragilis NCTC 9343
  CDS (1)..(1284): transl_table=11
atgtttggactaatggactgcaataacttctacgcaagttgcgagagagtgttcaatccggctttgaacggtaagccgatcgttgttttaagtaataacgacggatgtgttattgccagaagtaacgaagcgaaagcattggggattaaaatgggagttccggcttatcagatcaaagatgatattcagaaatatggtatatctgtcttttcatcgaactatacgctatacggcggcatgtccggacgcgtgatgtccatactggcagaacaagtgccggaaatggaagtatacagtatagacgaagcatttcttaacctggaagggattcgggatattcagtcactcggaacagacatcataaacaaagtaatccgcggaaccggcatacctgttagtttgggtatcgccccaaccaaaacactcgcaaaggtcgccaataaatttgcaaagaaatatcctgcttacaatcgtttatgtatcatcgatacagaagaaaagcgcaccaaggctctgcagcttactgaaattggagacatctgggggatcggtcaccggcaagttgccaagttagaaaagcagggagtcaaaacagcctatgactttaccgagttgcccgaatcttgggtgcgtaagaacatgactgtagtcggagaaaggacctggaaagaacttcaaggcatttcctgtattgatatggaaaccacaccaccggccaaaaagcagatatgtacaagtcggtcattcggcaagatggtggaggacatcgatacaatgtcggaagcaatcgccactcacgcttctacatgcgcaaagaaactccgacaacagaaaggctatgcaatgtcactaatggtattcatccatacaaataacttccgtaaagattcaccacaatattggaggaatacagttgtacatcttccagtaccgaccaatgacacattagaaattgtacattatgcactggccgggctaaaaacgattttcatgcaaggctatcaatataagaaagccggagttattatcaccgaaataaccgatagcacccaattgggactgtttgattcagtagatcgcgagaaacgtaaacgtcttcaacaaacaatagataagataaacggtaaacacagccgactcgtcaaattagcgattcaaggtacagggaggaattggaagcttaaacaaaaacagctatcagggcattataccactgacatcaatcagattataagcattaattgtacttacccaactgcatgtcaacgaaaacaatatagctga

SEQ ID NO: 66501 - protein, 427 aa, Bacteroides fragilis NCTC 9343
MFGLMDCNNFYASCERVFNPALNGKPIVVLSNNDGCVIARSNEAKALGIKMGVPAYQIKDDIQKYGISVFSSNYTLYGGMSGRVMSILAEQVPEMEVYSIDEAFLNLEGIRDIQSLGTDIINKVIRGTGIPVSLGIAPTKTLAKVANKFAKKYPAYNRLCIIDTEEKRTKALQLTEIGDIWGIGHRQVAKLEKQGVKTAYDFTELPESWVRKNMTVVGERTWKELQGISCIDMETTPPAKKQICTSRSFGKMVEDIDTMSEAIATHASTCAKKLRQQKGYAMSLMVFIHTNNFRKDSPQYWRNTVVHLPVPTNDTLEIVHYALAGLKTIFMQGYQYKKAGVIITEITDSTQLGLFDSVDREKRKRLQQTIDKINGKHSRLVKLAIQGTGRNWKLKQKQLSGHYTTDINQIISINCTYPTACQRKQYS

SEQ ID NO: 66502 - DNA, 1269 bp, Salmonella enterica subsp. enterica serovar Choleraesuis str
  CDS (1)..(1269): transl_table=11
atgttcgcgctctgcgatgttaatagcttttacgcctcctgcgaaacggtctttcgtcctgatttatgtggccgaccagtggtggtgttatcaaacaatgatggctgcgttatcgcgtgtagcgccgaggcgaaacagctcggtatcgcaccaggtgagccatacttcaaacagaaagaacgcttccggcgatccggcgttgtttgcttcagcagtaattacgagctttacgctgatatgtcgaaccgggtaatgaccacactcgaggagatggtgccgcgggtagaaatttacagcattgatgaggctttttgtgatctgacgggggtacgaaactgcctggatctgacagatttcgggcgcgagataagagcgacggtcctgaagcgcacgcacctgactgtcggtgtaggcattgcccagacgaaaacccttgccaagctggctaaccatgctgcgaaaaagtggcagcgccagaccgacggggtggttgacttgtcgaacatcgatcgccagcgtcggctgctggccctgatacccgtagaggatgtctggggtgtcggcaggcgcatcagtaagaagctaaatgccctgggcatcaagactgctctcgatctctctgaacaaagtacctggatcatcaggaaacacttcaatgtcgtgctggagcgtaccgtgagagagctttgcggagagccatgtctggagcttgaagagtttgcgccggcaaagcaggaaatcgtttgtagccgctctttcggcgagcgggtcacagactatgaggaaatgcgccaggctgtttacagctacgctgcgcgcgcggcagaaaaactccgcggcgagcaccagtactgccgtttcatctcaacattcgtcaaaacatccccctttgccctgaacgagccctactacggtaacagcgccgcagtgacgcttctcacccccacgcaggattcacgcgacattatcaatgcggctgtgaaatgcctggataaaatctggcgcgacggccatcgctaccagaaagcgggggtgatgctgggtgacttcttcagtcagggcgtagcgcaactcaaccttttcgacgataacgcgccgcgcgccggtagtgcgaagttgatggaagtactggaccatcttaacgcaaaagacgggaaggggacgctgtacttcgccgggcaggggatgtcgcaacagtgggctatgaagcgagaaatgctttcgcctcggtacaccacaagatactctgatctactgcgtgttaagtaa

SEQ ID NO: 66503 - protein, 422 aa, Salmonella enterica subsp. enterica serovar Choleraesuis str
MFALCDVNSFYASCETVFRPDLCGRPVVVLSNNDGCVIACSAEAKQLGIAPGEPYFKQKERFRRSGVVCFSSNYELYADMSNRVMTTLEEMVPRVEIYSIDEAFCDLTGVRNCLDLTDFGREIRATVLKRTHLTVGVGIAQTKTLAKLANHAAKKWQRQTDGVVDLSNIDRQRRLLALIPVEDVWGVGRRISKKLNALGIKTALDLSEQSTWIIRKHFNVVLERTVRELCGEPCLELEEFAPAKQEIVCSRSFGERVTDYEEMRQAVYSYAARAAEKLRGEHQYCRFISTFVKTSPFALNEPYYGNSAAVTLLTPTQDSRDIINAAVKCLDKIWRDGHRYQKAGVMLGDFFSQGVAQLNLFDDNAPRAGSAKLMEVLDHLNAKDGKGTLYFAGQGMSQQWAMKREMLSPRYTTRYSDLLRVK

SEQ ID NO: 66504 - DNA, 1281 bp, Pseudomonas syringae pv. syringae B728a
  CDS (1)..(1281): transl_table=11
atggaaaagcgtgaggctgtcttcgcgctaatcgactgcaattgcttctatgccagctgcgagcgtgtttttcgtccagatctggagaaaacgcccatcgtggtactcagcaataacgacggttgcgtcatcgcccgtagctacgacgccaagccatttgtgaaaatgggcgctccctattttcagatcagagaggtgttgcgccgcaacggcatcaaggtgttcagcagcaactatgcactctatggcgacatgagcgagcgtgtcatgtcgatcatcgagtcgatggtgccagcctccgaggtctacagcatcgatgaggcgttcgcagacctcaccggcgtgcctggcgatctcacagcgttcggtcgacgcatccgggcgaacattcttaaatgcactggcattcctgtgggtgtgggtatcggtcctacgaaaacgctcgccaagctggcaaaccacactgctaagcgactgctatcccatacaggcggtgttgtagacatttgcgacctgcataaccgcaactgggtactgcgtaatacggcggtctcagaggtctggggggtagggaagaagatgaatgcccacctggaggctatgaacatccgcaccgcaatggaccttgcaaccgccgacccgcgtactctgcgcgaacggttcagcgtggtcattgaaaagaccgcacgtgagctggcaggtacttcgtgcctggagctgggcgaagctgcaccacccaagcaggagatctgttgcagccgaatgttcggcaaacggctaaccaccattcagcctatcaaagaggcggtggccacctacactcagcgtgcggccgagaagctccgttctcaaaactcgctgtgcaagaagatccgcgtcagcatccgtaccggcatgttcaatccggaagaagccaagtacgccaacggcgctttggttgaattgccataccccaccaacgacgtgcgcttgatgaccagggcggcgactgaggcagtgaatcgtttgtttcgaccggggttcaagtacagcaaagctgaggttctgttgctggatctgagacagcctggcgaatttacggatgacatgttcgctgcttcgcagccggcatcttcagagaaggtgatgggagtcctggatgagatcaatacacgctggggcagagggactttacgagctgggagtgttccttccaatccggagtgggctatgcgtcgcgagctgatgagtcaaagttatacgaccaggctcgatcagttgtgggaggtgaaaagtgtgtaa

SEQ ID NO: 66505 - protein, 426 aa, Pseudomonas syringae pv. syringae B728a
MEKREAVFALIDCNCFYASCERVFRPDLEKTPIVVLSNNDGCVIARSYDAKPFVKMGAPYFQIREVLRRNGIKVFSSNYALYGDMSERVMSIIESMVPASEVYSIDEAFADLTGVPGDLTAFGRRIRANILKCTGIPVGVGIGPTKTLAKLANHTAKRLLSHTGGVVDICDLHNRNWVLRNTAVSEVWGVGKKMNAHLEAMNIRTAMDLATADPRTLRERFSVVIEKTARELAGTSCLELGEAAPPKQEICCSRMFGKRLTTIQPIKEAVATYTQRAAEKLRSQNSLCKKIRVSIRTGMFNPEEAKYANGALVELPYPTNDVRLMTRAATEAVNRLFRPGFKYSKAEVLLLDLRQPGEFTDDMFAASQPASSEKVMGVLDEINTRWGRGTLRAGSVPSNPEWAMRRELMSQSYTTRLDQLWEVKSV

SEQ ID NO: 66506 - DNA, 1281 bp, Pseudomonas syringae pv. syringae B728a
  CDS (1)..(1281): transl_table=11
atggccggtcatgagaatgtcttcgcgctgatcgactgcaactgtttttatgcgagctgcgagcgagctttccgtcccgacctggcaaagactcccatcgtagtgctcagtaacaacgacggatgtgttatcgcccggagctatgacgcaaaaccatttgtgaaaatgggtgcaccgtactttcagatcaaggacgttttgcgtcagaacggcgtgattgccttcagcagcaattacgccctgtatggcgacatgagtgagcgggttatgacgatcatcgagtcgatggtgcccgcctcggaggtttatagcatcgatgaagcgtttgccgatctgacgggcataccgggcgacatgacagaatttggccggcgcatccggtcgaaaatcctcaaatgcaccggtataccagttggcgttggcattgggcctaccaagacgcttgccaagctggcgaaccacaccgctaagagactgctggcccaaacaggtggagtcgttgacatctgcgacctgcacaagcgcaactgggtgctgcgcaatacgtgtgtgtcagaggtgtggggagtgggaaagaagatgaaagcgcatctagaggccatgaacatccgaagcgcaatggatttggccaatgctgacgcgcgcaccctacgcaccaagttcagtgtcgtcattgaaaagactgcgcgagagctggccggcacgtcgtgtttggaaatgagcgaagctgatccgcccaaacaggaaatctgcagcagtcgaatgtttgggcagcgcctgaccactatcgagccgatcaaggaagcggtggccacctacacgcagcgcgccgctgaaaaactgcgtgcccagaattcactgtgcaagaagatgcgcgtcagtatccgcacaggtatgttcaacccggatgaacctaaatatgcgaatggtgcgctggtcgagctgccgtatcccaccaatgacgtgcgcttgctgacgaagggtgcaactgaggcggtcaaccgacttttccgcccagggtacaagtacagcaaggccgaagtgctgctgctggatcttcgccaacctggcgagtttacggatgacctgtttgcggagtcgcagccagcggcggtagaaaaggtgatgggcgtgctcgacgaaatcaatgcactctgggggagggggacattgagggccgggagcgtaccgtccgatccagactgggcaatgcgcagggacatgatgagccagagctacacgactcgattggatcaactgtgggtagtcagggcgtactga

SEQ ID NO: 66507 - protein, 426 aa, Pseudomonas syringae pv. syringae B728a
MAGHENVFALIDCNCFYASCERAFRPDLAKTPIVVLSNNDGCVIARSYDAKPFVKMGAPYFQIKDVLRQNGVIAFSSNYALYGDMSERVMTIIESMVPASEVYSIDEAFADLTGIPGDMTEFGRRIRSKILKCTGIPVGVGIGPTKTLAKLANHTAKRLLAQTGGVVDICDLHKRNWVLRNTCVSEVWGVGKKMKAHLEAMNIRSAMDLANADARTLRTKFSVVIEKTARELAGTSCLEMSEADPPKQEICSSRMFGQRLTTIEPIKEAVATYTQRAAEKLRAQNSLCKKMRVSIRTGMFNPDEPKYANGALVELPYPTNDVRLLTKGATEAVNRLFRPGYKYSKAEVLLLDLRQPGEFTDDLFAESQPAAVEKVMGVLDEINALWGRGTLRAGSVPSDPDWAMRRDMMSQSYTTRLDQLWVVRAY

SEQ ID NO: 66508 - DNA, 1281 bp, Pseudomonas fluorescens Pf-5
  CDS (1)..(1281): transl_table=11
atgtctaaacacaatgagccggtgtttgccctgatcgactgcaatagcttctatgccagttgcgagcgagtgtttcgccctgatctggcaaaggtgccgattgttgtgctgagcaataacgacggttgtgtcattgcgcgcagctatgacgcaaagtccttcgtcaaaatgggagagccgtattttcagatcaagcacaagctgaggcagcacggcattgtggcgttctcttcgaactatgccctctacggcgacatgagcgagcgggtgatatcgctgatcgaatcgatggtaccggcagtcgaggtgtacagcatcgatgaagccttcgcagatctcacgggaatcaatagccttgagcagttcggccgccagatccgggcccaggtgctgcgctgtacaggcattccggttggtgtagggatcgcacctacaaagacgctcgccaagttggccaaccacactgccaagcgtctacaagcgcacactgggggcgttgtagatattaccgatcaggtgaagcgagattgggtgttgcgaaacactgatgtcgccgaggtgtggggtatcggccggcggatgaaggcgcatctggacgggatgggaatcaagtctgctatggacctggccaaggctgatccgtggacgttgcgcaaaaatttcagtgtcgtgatcgagaagacggcccgggagttggcgggcacgccgtgcctggaactggacgagccagatccgccgaaacaggagatctgctgtagtcggatgtttgggaagcgactaaccgagttggcccctatcaaggaggcggttgctacttacatgatgagagcctcggaaaaactacgggctcagaactcattgtgtaagaaaatccgcgtcagcattcgcacgggcatgtttaaccccgaggaagccaagtatgcaaacggtgtcctggtagaactgccgtatccaaccaatgacgtcagactaatgacgaaaatggctgtggaagcgctggaccgcgttttcaggccgggtttcaaatacagtaaggccgaggtcctgttgttgaatctgtgccaaccaagcgagtacaccggcgatctcttcgccttagcgcaaccatctgaaaccgacaaggtgatgaaggttctggaccagatcaacagtcgctgggggaggggcacactccgtgctgccagcgtccctaccaatcccgattggggtatgcggcgggagatgatgagccagagttacacgacgaagcttgatcagctttggaaggtgtcctgcaactga

SEQ ID NO: 66509 - protein, 426 aa, Pseudomonas fluorescens Pf-5
MSKHNEPVFALIDCNSFYASCERVFRPDLAKVPIVVLSNNDGCVIARSYDAKSFVKMGEPYFQIKHKLRQHGIVAFSSNYALYGDMSERVISLIESMVPAVEVYSIDEAFADLTGINSLEQFGRQIRAQVLRCTGIPVGVGIAPTKTLAKLANHTAKRLQAHTGGVVDITDQVKRDWVLRNTDVAEVWGIGRRMKAHLDGMGIKSAMDLAKADPWTLRKNFSVVIEKTARELAGTPCLELDEPDPPKQEICCSRMFGKRLTELAPIKEAVATYMMRASEKLRAQNSLCKKIRVSIRTGMFNPEEAKYANGVLVELPYPTNDVRLMTKMAVEALDRVFRPGFKYSKAEVLLLNLCQPSEYTGDLFALAQPSETDKVMKVLDQINSRWGRGTLRAASVPTNPDWGMRREMMSQSYTTKLDQLWKVSCN

SEQ ID NO: 66510 - DNA, 1272 bp, Pseudomonas fluorescens Pf-5
  CDS (1)..(1272): transl_table=11
atgtctgactcggtatttgcacttatcgattgcaacagcttctacgcaagctgtgagcgggtattcaggccggacctggctcgggtgccgatcgtggtcctgagcaataacgacggctgcgttattgcacgcagttatgatgctaaaccgcatgtaaagatgggcgagccgtactttcaaattaagcgcaagctccagcagttgggcatagtcgcattttcgtcgaattacgcgctctatggcgatatgagccagcgcgtcatgagcgtcatcgagtccatggttccggctgtggaggtatattcgatcgatgaagctttcgccgatctgagtgggatctgcgggccggaagccctgggccggcaaatccgcgcgcaggttatgcgcgataccgggatacccgtcggagttgggatcgccaggactaaaaccctggctaagctggcaaaccacaccgccaaacgcctgcagacacacaccggaggcgtcgtcgatctatgcgacacgttcaagcgagactgggtgcttcgtaacaccgacgtcgcagaagtctggggtgttggccgccggatgacagcgcacctggaatcaattgggatcaggacagctatggatctggccaatgcggatcctcgaacactgcgcatgaaattcagcgtagtcattgagaaaactgcacgggaactagccggtaccgcgtgcctggagctggacgaccccgctccaccgaagcaggaaatctgctgcagtcggatgttcggccaacgcctgcaggaactgccagcgctcaaagaggcggtggccacctacatgatgcgtgcctcagaaaagctccgagcccagggctcactgtgcaagaaaattcgtgtcagcatccgcactggcatgttcaatccggaggaggcgaagtatgcaaacggtgttgtggtgcatctgccctaccccaccgacgacgtgcgtttactgacacgggaagcggtggatgccttggaccgaatattcaggccaggcttcaagtacagcaaagcagaagttatgttgctcgacctatgccagccaggcgactacacggacgacctttttgcggtgtcgcaacctgctgacgcaactcgggtaatgaaggttcttgatcagattaacgatcgatggggtcgaggaactcttcgatcagccagcgtgccagcagaacccgcctggggcatgcgcagagagatgatgagccgcagctacaccacacgtctagagcaactctggacggttcactgtcattga

SEQ ID NO: 66511 - protein, 423 aa, Pseudomonas fluorescens Pf-5
MSDSVFALIDCNSFYASCERVFRPDLARVPIVVLSNNDGCVIARSYDAKPHVKMGEPYFQIKRKLQQLGIVAFSSNYALYGDMSQRVMSVIESMVPAVEVYSIDEAFADLSGICGPEALGRQIRAQVMRDTGIPVGVGIARTKTLAKLANHTAKRLQTHTGGVVDLCDTFKRDWVLRNTDVAEVWGVGRRMTAHLESIGIRTAMDLANADPRTLRMKFSVVIEKTARELAGTACLELDDPAPPKQEICCSRMFGQRLQELPALKEAVATYMMRASEKLRAQGSLCKKIRVSIRTGMFNPEEAKYANGVVVHLPYPTDDVRLLTREAVDALDRIFRPGFKYSKAEVMLLDLCQPGDYTDDLFAVSQPADATRVMKVLDQINDRWGRGTLRSASVPAEPAWGMRREMMSRSYTTRLEQLWTVHCH

SEQ ID NO: 66512 - DNA, 1281 bp, Candidatus Pelagibacter ubique HTCC1062
  CDS (1)..(1281): transl_table=11
atgtcatccattcaacgtactaagaaaatagcattagtagattgtaattcattttatgtttcctgtgaaagattattcaatcctaagattagaaataagccagttgtcgtattgtcgaataatgatggctgcattattgcaagatcgaatgaagcaaagtttcttggtattaaaatgggtgagccttactttaaagctaaagaaataatacttaaaaataaagtttatgtattttcttcaaattattctttgtatggagatttatctagaagagtgatgagaactttaaaaagatttaatcctgaattagaaatatattcagtagatgaggcctttttagatttgagtaattatccagatgatgaagtagaagatgtgggaaaagaaattagaagcattattttacaatggacaggaattccaactagcattggtattgctaaaacaaaaacactaagcaaaattgcaaatcatatagcaaagaaaaaacaatctggtgttacaaacttgataggaattgaaaatattgatccactattagaaaaaatagatatcaacgatgtgtggggagttggtaaacagatgacaaaattttatcatcaaaatggaatttataatgccaaacaattaaaaaatatgtcaaatacttggattaaaaaaagttctaatgttttaagttctagaactgccttagaacttagaggtattccttgtatcccactagaaactaaaacttccaaaagaaaaagttgtgtagtgtcaagatcatttggtacaagagttgaaaagtttcaagagttagaagaggcagttgcaagctattgtttaaatgcttcagaaaaaattagatcagaatctttaatagcaaaatcaataactgtgtctgttagaacaagcccttttcaaaatagaggggtgtattattcaaatgctaaaactatagattttccaatagctaccaataatagtattgaaatagttaaaactgctttgattgcattaaatgaaatctttattaatggatacagatatcaaaaagcaggcataacattgactggtttagttagttcaagtggcagtaaaaatctattttccactgaaaaagatgagaaaattaaaggcttaatgagatctattgatagtacaaattataagtatggacgatcaacattaagtttagctagcgctggagtaaataaaaaatggaatatgagaagagaccactcttcaaagatagatacagctaattttcattcgctaccaataataaaagctatttaa

SEQ ID NO: 66513 - protein, 426 aa, Candidatus Pelagibacter ubique HTCC1062
MSSIQRTKKIALVDCNSFYVSCERLFNPKIRNKPVVVLSNNDGCIIARSNEAKFLGIKMGEPYFKAKEIILKNKVYVFSSNYSLYGDLSRRVMRTLKRFNPELEIYSVDEAFLDLSNYPDDEVEDVGKEIRSIILQWTGIPTSIGIAKTKTLSKIANHIAKKKQSGVTNLIGIENIDPLLEKIDINDVWGVGKQMTKFYHQNGIYNAKQLKNMSNTWIKKSSNVLSSRTALELRGIPCIPLETKTSKRKSCVVSRSFGTRVEKFQELEEAVASYCLNASEKIRSESLIAKSITVSVRTSPFQNRGVYYSNAKTIDFPIATNNSIEIVKTALIALNEIFINGYRYQKAGITLTGLVSSSGSKNLFSTEKDEKIKGLMRSIDSTNYKYGRSTLSLASAGVNKKWNMRRDHSSKIDTANFHSLPIIKAI

SEQ ID NO: 66514 - DNA, 1254 bp, Colwellia psychrerythraea 34H
  CDS (1)..(1254): transl_table=11
atgtttgggttagttgatgctgtttctttctatgcacgtgcagagaaggtttttgacccaagcattaggcataaacctgttgtcgttttaacgaataacgacggctgtatttgtgctgtctgtcctattgcgaggcagctaggtgtacctaaatttgtcccctattttaaggttaagtcttttctagcaaagcacggtgtcgttgttcgttcttcaaactatgaactgtatgcagacctaagtgaaagaatgatgaatgttattgcgcgttactcagataaccattatgtctattctattgatgaatcattcttacatttcaaaaactttagctgtgttgataactggcacgaatacggccatgtaatacgtaaggcggtgtggcgagaaacacgtttacccgttggtgttggtttcggtgcaaccttaacattagccaaagcagcgaatcatgcctctaaaaagctgtcaggttttgatggtgtcgctgtgatagatgataaagcctctcgtaaagaaatcctctctagaatgtcgctcactgaggtttggggtattggctccaagttgggtaaacggctaagtatattagggcttaaaaatggctgggatttagctaatcaatcacctaaagcaatgcgaggtcagttcggtgtggtcgttgaacgtacagtgaatgaactgaacggcatgccgtgcttacaatgggatgaaatagggcaagacaaacaagagatattttctacacgtagttttgggcaacgagtaaccgacggtcatgcactcaaagctgcactatcaagtcacgccagtattgtaggggcaaaagttagacgacaaggctctttgattaaacgcttagttatttttgcatcaagttcgccacatgatgacagttactataaaaaatcggtcatttatgagtttcccattgcgactgacaatatcttaaagctagtcggtgctatttcttacgtatttgataatatttatagacaaggtgttagcttttatcgctgtggagtaggtggcgttgaattagagaatagtcaatttcagcaacaagatatgtttagtcttagtgtgaataacccgcctttaatgaaatgctatgaccaaataaatcatcgttatggtcgtggggctgttgaagtggctatcgctgaaaaaaatgaaaagtgggccatgaggcgaaacttcttatcacctcgctctacgagtaactggtcagaaatacctaagataaactgttga

SEQ ID NO: 66515 - protein, 417 aa, Colwellia psychrerythraea 34H
MFGLVDAVSFYARAEKVFDPSIRHKPVVVLTNNDGCICAVCPIARQLGVPKFVPYFKVKSFLAKHGVVVRSSNYELYADLSERMMNVIARYSDNHYVYSIDESFLHFKNFSCVDNWHEYGHVIRKAVWRETRLPVGVGFGATLTLAKAANHASKKLSGFDGVAVIDDKASRKEILSRMSLTEVWGIGSKLGKRLSILGLKNGWDLANQSPKAMRGQFGVVVERTVNELNGMPCLQWDEIGQDKQEIFSTRSFGQRVTDGHALKAALSSHASIVGAKVRRQGSLIKRLVIFASSSPHDDSYYKKSVIYEFPIATDNILKLVGAISYVFDNIYRQGVSFYRCGVGGVELENSQFQQQDMFSLSVNNPPLMKCYDQINHRYGRGAVEVAIAEKNEKWAMRRNFLSPRSTSNWSEIPKINC

SEQ ID NO: 66516 - DNA, 1257 bp, Colwellia psychrerythraea 34H
  CDS (1)..(1257): transl_table=11
atgtatgctttagttgatgcagtatcattctacgcaagtgctgaaaaagtttttgaccccagcatacgtaataaacccgttgttgttttaactaataatgatggttgtatctgcgctgtctgtccgattgcaagacgccttggtattccaaaatttataccgtactttcaagttaaatcattgcttgaaaagcatggcgtggttgttcgttcttcaaattatgagttgtatgcggatttgagcgaacgaatgatgaatgtcatcggccgcttttgtgataaccagtatatatacagcattgatgagtcatttttatattttgatcattatgaaagctgcataaatgattggcacgaatatggacataaaataagaaaagccatttggaaagaaacgagacttcccgtcggtgttggttttggtgaaacagcaacactgtcaaaagcggcaaaccatgcagccaaaaaactctctggttttaatggtgtagccgttattaatagcgcagtaagcagagacaaaatactcaagcgcatggcggtagatgaggtatggggcatcgggcgaaaaatatcgaaacgattagggcttgagggtattaacaacgccgcgcagttagcagagcaagatcctaaacatatacgaaaacaatttagcgtagtaactgaaagaaccgtgaatgaattaaacggcatcagttgtttgtcttgggatgaggtgaaatcacccaaaaaagagattttctcaacacgaagttttggacagcgcattaccacaaaaaatgaattacgctctgcgttggtaacacatgcagccattgtaggaaggaaagtgagaagacaaaattcactcattaaaaagttaatgatatttgcctctaactcgccgcatgatgacttgtattacaagcaatccatggtttttccatttatcatagcgactgaaaatacctgtgaaatggcgcgcgcggtaaaccaagttattgattctatatacaaagcaggaataaaattttaccgttgtggtgtaggtgcaatcgaattaaatagtaaaacgtttatacaaccagacttatttatgcccgatcacactaatagtaacgtaatgaaatgcttagataatgtgaaccacagatacggagatagcaccttaaagctggccgctgaagggcatcatgaaaaatggcaaatgcgacgagcgtttttaagccctcaatacaccagtcagtggcgagacattcctaaaatacagtgctag

SEQ ID NO: 66517 - protein, 418 aa, Colwellia psychrerythraea 34H
MYALVDAVSFYASAEKVFDPSIRNKPVVVLTNNDGCICAVCPIARRLGIPKFIPYFQVKSLLEKHGVVVRSSNYELYADLSERMMNVIGRFCDNQYIYSIDESFLYFDHYESCINDWHEYGHKIRKAIWKETRLPVGVGFGETATLSKAANHAAKKLSGFNGVAVINSAVSRDKILKRMAVDEVWGIGRKISKRLGLEGINNAAQLAEQDPKHIRKQFSVVTERTVNELNGISCLSWDEVKSPKKEIFSTRSFGQRITTKNELRSALVTHAAIVGRKVRRQNSLIKKLMIFASNSPHDDLYYKQSMVFPFIIATENTCEMARAVNQVIDSIYKAGIKFYRCGVGAIELNSKTFIQPDLFMPDHTNSNVMKCLDNVNHRYGDSTLKLAAEGHHEKWQMRRAFLSPQYTSQWRDIPKIQC

SEQ ID NO: 66518 - DNA, 1275 bp, Salmonella enterica
  CDS (1)..(1275): transl_table=11
atgttcgctttggctgacgtcaactcgttctatgccagttgcgaaaaggtctttcgccccgatttgcgtgacaggtctgtggtggtcctgagtaacaacgatggttgtgtaatcgtacgcagcgctgaagcaaaaaaactgggcataaaaatgggggtgccgtggtttcaactgaggtcggcgaaatttccggagccggttatcgcgttctccagtaattacgccctctacgcatcaatgtcgaacagggtcatggttcacctggaagagctggcgccacgcgttgagcagtactccattgacgagatgtttctggatattcgcggtatagacagttgcatcgatttcgaggatttcggccgacagctgcgtgagcacgttcgttccggcacagggctgaccatcggcgtcggaatgggaccgaccaaaacgctggctaaaagcgcgcaatgggcatcgaaagaatggtcacagttcggaggcgtgcttgccctgacgttacacaatcagaaacgaacggagaaactgctgtcactgcaaccggtggaggaaatctggggtgtgggccgcaggatctcaaagaagctgaacacaatggggatcaccacagcactgcagctggcccgcgcgaatccaacgttcatcaggaaaaactttaatgtggttctggagagaacggtccgggaactcaatggagaaagctgtatttccctggaggaagcaccgccccccaaacagcagatagtctgcagcagaagctttggagaacgagtcacgacttatgaagcgatgcggcaggcagtctgtcagcacgctgaacgtgccgccgaaaagctgcgtggggaacggcagttctgcaggcatattgccgtgtttgtgaaaacatcgccgttcgccgtaactgagccctactacggtaatctggccagtgaaaaactgctcatccccacgcaggatacacgggacatcattgccgctgccgtcagagctctggacaggatctgggtggatggtcaccgttacgcaaaggcaggctgtatgctgaacgatttcacgccaaccggggtatcgcagcttaatttgtttgatgaagtacagccgcgggaacggagcgagcagctgatgcaagtcctggatgggattaaccatccgggcaaggggaaaatatggttcgccggtcgggggattgcccccgagtggcagatgaaaagggaactactttcgccagcttatacgacacgttgggcagatattcctgcagcgaaattgacttga

SEQ ID NO: 66519 - protein, 424 aa, Salmonella enterica
MFALADVNSFYASCEKVFRPDLRDRSVVVLSNNDGCVIVRSAEAKKLGIKMGVPWFQLRSAKFPEPVIAFSSNYALYASMSNRVMVHLEELAPRVEQYSIDEMFLDIRGIDSCIDFEDFGRQLREHVRSGTGLTIGVGMGPTKTLAKSAQWASKEWSQFGGVLALTLHNQKRTEKLLSLQPVEEIWGVGRRISKKLNTMGITTALQLARANPTFIRKNFNVVLERTVRELNGESCISLEEAPPPKQQIVCSRSFGERVTTYEAMRQAVCQHAERAAEKLRGERQFCRHIAVFVKTSPFAVTEPYYGNLASEKLLIPTQDTRDIIAAAVRALDRIWVDGHRYAKAGCMLNDFTPTGVSQLNLFDEVQPRERSEQLMQVLDGINHPGKGKIWFAGRGIAPEWQMKRELLSPAYTTRWADIPAAKLT

SEQ ID NO: 66520 - DNA, 1284 bp, Pseudomonas syringae pv. phaseolicola 1448A
  CDS (1)..(1284): transl_table=11
ttgaataagaagcccgcgccggtgtttggcctggtcgattgcaactcgttttacgcgagctgtgagcgcgtatttcgacctgacttggccaaggtccctatcgttgttctcagcaacaacgatggctgtgttattgcccgcagctacgatgcaaaaccgtacgtgaaaatgggcgcgccttatttccagatcaaagatgttttgcgccggcacggcatccagtcgttcagtagtaattttgcgttgtatggcgacttaagccagcgcgtgatggccatcatagaatccatggtcccagccgttgaggtttacagcattgatgaagcgttcgcagacctctccggcatgcctggcaatttgaccgagctgggaagatcgattcgatcaaaagtctaccgctgcaccggtatccccgtgggtgtgggcattgcaccgaccaagacgctggccaagctggccaaccacaccgcaaagcgtctccaagcgcacaccggcggggtcgtggacatctgcgaccctgtaaaacgtgattgggtgctgcgcaatacctctgtcggagaggtatggggcatcggtcgaaaaatgaaagcgcacctggagggtatgcagatcctgtcggccaaggacttggcaatggccgatccctggatgctgcgcaaaacgttcagcgttgtgatcgagaaaacggctcgcgagctcgcgggcactgcgtgcctggagttagacgaagtcgaaccgccacgccaggagatttgttgcagcagaatgttcggcaagcgattaactgaactggggccgatcaaagaggcggtggccacctacatgatgcgcgcctccgagaagctgagagcccagggttccgtgtgcaaaaagatcagggtcagcatccgcacagggatgttcaaccctgatgaggccaagtatgcgaacggcgcgttggtgcagctcccctaccccaccaacgatgtgcggctgatgactcagtacgcgaccgaggcggtttcgcggatatttcgaccaggcttcaggtacagcaaagcagaggtgctgctgatggatatttgccagccaggcgaatttaccgatgacctgttcgcggtcaatcagccggtgagttcagatcggctgatggctgctttggattcaatcaacggcaagtggggacgtgggacgctgcgtacaggctcagtaccagtcaccccagattggggcatgcgccgtgagcagatgagccagagctacacgacacggcttgatcagttgtgggtcgtaaaagctaagtga

SEQ ID NO: 66521 - protein, 427 aa, Pseudomonas syringae pv. phaseolicola 1448A
MNKKPAPVFGLVDCNSFYASCERVFRPDLAKVPIVVLSNNDGCVIARSYDAKPYVKMGAPYFQIKDVLRRHGIQSFSSNFALYGDLSQRVMAIIESMVPAVEVYSIDEAFADLSGMPGNLTELGRSIRSKVYRCTGIPVGVGIAPTKTLAKLANHTAKRLQAHTGGVVDICDPVKRDWVLRNTSVGEVWGIGRKMKAHLEGMQILSAKDLAMADPWMLRKTFSVVIEKTARELAGTACLELDEVEPPRQEICCSRMFGKRLTELGPIKEAVATYMMRASEKLRAQGSVCKKIRVSIRTGMFNPDEAKYANGALVQLPYPTNDVRLMTQYATEAVSRIFRPGFRYSKAEVLLMDICQPGEFTDDLFAVNQPVSSDRLMAALDSINGKWGRGTLRTGSVPVTPDWGMRREQMSQSYTTRLDQLWVVKAK

SEQ ID NO: 66522 - DNA, 1122 bp, Pseudomonas syringae pv. phaseolicola 1448A
  CDS (1)..(1122): transl_table=11
gtgaaaatgggggctccgtatttccagatcaaagaggtgctgcgccgcaatgggatcaaggtgttcagcagcaactacgcgctttatggcgacatgagcgagcgcgtgatgtcgatcatcgagtccatggtgcccgccactgaggtttacagtattgacgaagcgttcgcggacttgactggcatccctggggatctcacagcattcggtcgtcgcatacgggcttccgtcctcaagtgcacgggcatacctgtcggggtcggcatcgctcctacaaaaaccctggccaagcttgcgaatcataccgccaagcgcttattggctcagacaggtggtgtcgtcgatatctgcgatctgcataaacgcaactgggtgctgcgtaacacagcagtttccgaggtctggggcgtgggcaggaagatgaaagcacacctggaggcgatgaacatccgcaccgcaatggacctggccaacgccgatccgcgcaccttgcgcgaccgtttcagtgttgtcattgaaaagacagctcatgagttggccggcactccatgcctggagctgggcgaggccgcgccccccaagcaggagatctgctgcagccgaatgtttggtcagcggctgactacgattgagccaatcaaagaagcggtggccacctatacgcaacgtgctgccgagaagcttcgctctcagagttccctgtgcaagaagatccgagtcagcatccgcaccggcatgttcaaccctgaagaagccaagtacgccaatggggcgctggttgaactgccgtatcccaccaacgacgttcgcttgatgacgaaagccgcgaccgaggcggtcaaccgtctgttccggccgggcttcaagtacagcaaagcggaggtgttgctactggaccttcgtcagccaggtgaatttacggatgatcttttcgcggcctcgcagccggtcgccgccgagaaggtgatgggcgtactggacgagatcaatacgcgctggggcagagggacccttaggacgggaagtgtgcctacgaatcctgagtgggccatgcggcgcgacatgatgagccagagttacaccacaaggcttgatcagctttggactgtccgaagtgagtga

SEQ ID NO: 66523 - protein, 373 aa, Pseudomonas syringae pv. phaseolicola 1448A
MKMGAPYFQIKEVLRRNGIKVFSSNYALYGDMSERVMSIIESMVPATEVYSIDEAFADLTGIPGDLTAFGRRIRASVLKCTGIPVGVGIAPTKTLAKLANHTAKRLLAQTGGVVDICDLHKRNWVLRNTAVSEVWGVGRKMKAHLEAMNIRTAMDLANADPRTLRDRFSVVIEKTAHELAGTPCLELGEAAPPKQEICCSRMFGQRLTTIEPIKEAVATYTQRAAEKLRSQSSLCKKIRVSIRTGMFNPEEAKYANGALVELPYPTNDVRLMTKAATEAVNRLFRPGFKYSKAEVLLLDLRQPGEFTDDLFAASQPVAAEKVMGVLDEINTRWGRGTLRTGSVPTNPEWAMRRDMMSQSYTTRLDQLWTVRSE

SEQ ID NO: 66524 - DNA, 1278 bp, Prochlorococcus marinus str. NATL2A
  CDS (1)..(1278): transl_table=11
atgtccaaagtaatacttcaaattgatgggaataatttctatgcttcgtgtgaacaaatgatcgatccttccataaaaggaaagggattagtagtactttcgaataatgatggatgcataatagctcgcagttcagaggccagaagaatgggaattcctatgggacagccttatttcaagttaaagaataaactaaatcaattaaatataaatgtgagaagttcaaattacgaactgtacggtgatataagtaatcgattaatgcaactactaagaaaaaattgcgaagaactggaaatttactctatagatgaagcgtttggaactataaaacgtccaaaagaaaagtgcttatacaaatggggaaaagatttaagggctttggtttatcaaaacataggaataccaatatctattggtattggtgagacaaaagttctatcaaaaatttctaatcatctagcaaaaaagatacaaacgaattcaggtatatttgatataggtcgtgttgaaaataaagatcattatcttgatctaattaatgtagataaagtttggggtatcggcaaaaggatgtctaaatggctaaaagacagaggcatcactaatgcgagagaacttagagatatgtcaagcgaccaaatcaaaggaaagtatggtgtagttggtctacgcattcaaaatgaattaaaaggaaacctctgtatccctataaaagagaactcatcagatcgaaaagaaatctgcgtaagcaggagttttgcacatcccatagatagcttagatgatttgagccaagcaattattaaatacgttttaatcgcaagtgctaagttgcgaaaatacaatcaattatcttcagctattacggtttttacgaatacaaatactcattcaaaagatttctttaggagtgaagcaacagaaaaaataagcgttccaacttctaactcaaagatcatgattgaaaaaagcctatcactaacaaaagaaatttttaaaccatataaaaattttataaaagcaggtgtaatattacataaacttcaaagcaatcaatacaaacaaaacctaatatttgatgcacagaatattaaagaagaattatatctacagagactagataatgtaatagataatattaattcgaaaaatggtatagatacaataaattggggatcatcaatgatggatacagaatggagcccccgaagaaaaaatctatctagtataaaaacaacaaatatagaaaatattccgactatatatgctaattag

SEQ ID NO: 66525 - protein, 425 aa, Prochlorococcus marinus str. NATL2A
MSKVILQIDGNNFYASCEQMIDPSIKGKGLVVLSNNDGCIIARSSEARRMGIPMGQPYFKLKNKLNQLNINVRSSNYELYGDISNRLMQLLRKNCEELEIYSIDEAFGTIKRPKEKCLYKWGKDLRALVYQNIGIPISIGIGETKVLSKISNHLAKKIQTNSGIFDIGRVENKDHYLDLINVDKVWGIGKRMSKWLKDRGITNARELRDMSSDQIKGKYGVVGLRIQNELKGNLCIPIKENSSDRKEICVSRSFAHPIDSLDDLSQAIIKYVLIASAKLRKYNQLSSAITVFTNTNTHSKDFFRSEATEKISVPTSNSKIMIEKSLSLTKEIFKPYKNFIKAGVILHKLQSNQYKQNLIFDAQNIKEELYLQRLDNVIDNINSKNGIDTINWGSSMMDTEWSPRRKNLSSIKTTNIENIPTIYAN

SEQ ID NO: 66526 - DNA, 1239 bp, Pseudoalteromonas haloplanktis TAC125
  CDS (1)..(1239): transl_table=11
gtggccttttatgccagtgctgaaaaagtattcgatccggctattcgctcaaaacctgtggtggtgcttaccaataacgacggttgcatatgcgcggtttgccccattgctcggcgtttaaatattcctaaatttgcgccttactttaaagttaagcagttacttgcgcaaaataatgtagtaattcgttctagtaattacgagctatacgcagatttaagcgacaaaatgatgaacgttattggccgtttttgcgacgtgcaacacgtatacagtatcgacgaatcatttttacactttaacggttacacccctgttattaatgactggtttgcatacgggcacactattaggcgcaccgtatggcgcgaaactaagctccccgttggtgttggctttggctctacggctactttagcaaaagcggcaaaccatgccgctaaaaaattatccggatttaatggcgttgctgttattaactgcgaagcaagccgtaaagctattttacaaagaatgagttgccaagatatatggggtattggtaagcgtttagccaaaaaattaaaagtaatgaacatacacactgcatggcaattagcgcagcaaaaccctaacagtatgcgccgtgcatttagtgtggtggtagagcgcactgtaaatgagcttaatggcataccttgcttaaattgggacgaagtacgccaagataagcgcgagatattttcgacccgaagctttggtgagcgtatatacgagccaacggcacttaaaaccgcgttaattaatcacgttactgtggttgctagtaaattaagaaagcaaaaatcgcttaccaaacaactttatatttttgcggcgagctcgtctcacgaaaacgttttttataaaaagtcgtatatgtatacatttgccagccccactaacgacacctgcgtaatggctagtgctgtatctcaagtgtttgagcaaatataccagccgggtattcgctattataaatgtggtgtaggtgctttagagcttattgcgcagcaatttcaacaagacgatttatttaatgaacgcaccgacaatccaccattaatgaattgtcttgatgcaataaataaacgctatggtaaaggaatgctaagtttagcaagcagtaaattaaatgaaggttggcatatgaacaggaattttttatctccgcagtacaccacgcgctggcgtgatatacccaaaatatattgtgagtaa

SEQ ID NO: 66527 - protein, 412 aa, Pseudoalteromonas haloplanktis TAC125
MAFYASAEKVFDPAIRSKPVVVLTNNDGCICAVCPIARRLNIPKFAPYFKVKQLLAQNNVVIRSSNYELYADLSDKMMNVIGRFCDVQHVYSIDESFLHFNGYTPVINDWFAYGHTIRRTVWRETKLPVGVGFGSTATLAKAANHAAKKLSGFNGVAVINCEASRKAILQRMSCQDIWGIGKRLAKKLKVMNIHTAWQLAQQNPNSMRRAFSVVVERTVNELNGIPCLNWDEVRQDKREIFSTRSFGERIYEPTALKTALINHVTVVASKLRKQKSLTKQLYIFAASSSHENVFYKKSYMYTFASPTNDTCVMASAVSQVFEQIYQPGIRYYKCGVGALELIAQQFQQDDLFNERTDNPPLMNCLDAINKRYGKGMLSLASSKLNEGWHMNRNFLSPQYTTRWRDIPKIYCE

SEQ ID NO: 66528 - DNA, 1299 bp, Pelodictyon luteolum DSM 273
  CDS (1)..(1299): transl_table=11
atgttcgcccttgccgactgcaacaacttctatgtgtcctgcgagcgggtcttcaaccccatgctttgtgggcggccggtggtggtgctttccaacaatgacggctgcgtcatcgcccgctccgaggagtcgaaagcgcttggcatagcgatgggtactccgctgttccggtgccgggatgtgattggccgccacggcgtcgcagtcttttcttccaactaccccctctacggtgacatgtcttcacgggtgatgaacaccctcggggccatggctccggagcaggagcgctattctatcgacgaggcttttttcgacctctccgggttccggcgtttcggcctcagggagcatgcggccctcatgcgacgcaccgtgctcaaacacaccggtatccccgtcagcatcggcatcgcccataccaagaccctcgccaaacttgcagcgaaggcggccaagaaagacccctcgtgcggcggcgtgctcatgcttgagggggcggaccgggtgcgccgtgcccttgcatccacccatctggaggatgtctggggtatcggtcggcagtggagcctgaaactcgctttgcagggtattcaaaccgcagccgactttgccggtatgcctcccgcgcttgtgcgccggctgctcggggtcaccggcgcaaaggtacaggctgagctccaggggcaccgatgtctcccgctggagcttgtccggcccatgaaacagaccatctgcacctcccgttcgttcggccggaacgttttctcggttgaggaactgcaagaggctgttgcaagcttcgcttcccgggccgcttcgaagcttcgccgtgagggctcgacggcctcgcttctcaccgtcttcatctccacgagcccgtttgccgcttccgctctccggcgcgaggcctcacgcaccgtctctcttccccgtgcggccgacgatgccatgacgctcgtcacggccgcctcccgggtgctcgaggcgatctaccagggcggccacccgtaccggaaagccggtgtgcttctcggagccattgctccgaagaaccctccgggagagtcattcctgctcttcggcgacgagggtgaggggagagctgaagcgctccagcaggtcatggaacaggtcaacctccgctacggaaacggcagcatccgccttgccgcggaggactcccgggcctgggagccgctttgccggcacatctccccacgctacaccacttcctgggaggagatcctccgggttccctccgcaccgcaggccccacccgctcccgctcacaggtga

SEQ ID NO: 66529 - protein, 432 aa, Pelodictyon luteolum DSM 273
MFALADCNNFYVSCERVFNPMLCGRPVVVLSNNDGCVIARSEESKALGIAMGTPLFRCRDVIGRHGVAVFSSNYPLYGDMSSRVMNTLGAMAPEQERYSIDEAFFDLSGFRRFGLREHAALMRRTVLKHTGIPVSIGIAHTKTLAKLAAKAAKKDPSCGGVLMLEGADRVRRALASTHLEDVWGIGRQWSLKLALQGIQTAADFAGMPPALVRRLLGVTGAKVQAELQGHRCLPLELVRPMKQTICTSRSFGRNVFSVEELQEAVASFASRAASKLRREGSTASLLTVFISTSPFAASALRREASRTVSLPRAADDAMTLVTAASRVLEAIYQGGHPYRKAGVLLGAIAPKNPPGESFLLFGDEGEGRAEALQQVMEQVNLRYGNGSIRLAAEDSRAWEPLCRHISPRYTTSWEEILRVPSAPQAPPAPAHR

SEQ ID NO: 66530 - DNA, 1275 bp, Synechococcus sp. CC9902
  CDS (1)..(1275): transl_table=11
atggctcaggtcaccgccctcattgacgggaacaatttctatgcctcctgcgaacagagcctggacccagccctgattggtcggccggtggtggtgctttccaataacgacggttgcatcgtggctcgaagtgccgaagcgcgggaacttggcatcgccatggggaccccatatttcaaagccaggcgcgagctagcccgccaaaacgttgtggtgcggagctcgaactatgcgctctacgccgatatgagccaacggatgatgagcctgctggaagcccattgcgacgacgttgagatctattccatcgatgaagcctttggacgcctaaggcggcccaacaatggagagctcattccctgggcgcgccagcttcgcgcacgggtacgccaaaacctgggactccccattgcgatcggattgggcgcgagcaaaagtcaagccaaactggccaaccgcctggcaaaagcggtccccaatcatgcgggggtcttcgatttcgggacttgccacaacccagatcaatggctggaaacgattgcgatcgaagacgtttgggggatcggccggcaattggcggcgtggtgccagcggagaggaatcagcaacgcacgccaactgagggatatgccccaaggagagctcaaagcgaaatgtggcgtggtgggattacgactgcaatgggaactgcggggatatgcctgcctgcccatggatttggcacccgcagccaaacaagaaacatgcgtgagccgtagcttcagccaaccggtgaccacccgcgaagagctgcgccagtcgatcgcgacgtatgtggtgcgcgcagccgaaaaattgcgtaagcaacagcaacgcacatcggccctcacgatctacacccgcacaagtcccttcaagcccaacttttacagccgtgctgccagtcgccaattggatgtacccagcaacgacaccgccgttctgctccaagcggcgctgcccctggtcgaccacatctttcgtccgcaccgtcccctcgccaaagcgggggtgttgatgcaacacctccagggcatcgacacccttcaatcccacttgttggtaccgatgagtgccgagcaacaagacaaacgggagagcctgatgcaaaccatcgaccaactcaaccgacgctatgggcgaggctccgtgcactgggccgcctgtgggctggaacctggatgggccatgcgtcgcgaccaattgagtcgtgccgcgacaacccgtttgagggatattcctgtggtccgggcttaa

SEQ ID NO: 66531 - protein, 424 aa, Synechococcus sp. CC9902
MAQVTALIDGNNFYASCEQSLDPALIGRPVVVLSNNDGCIVARSAEARELGIAMGTPYFKARRELARQNVVVRSSNYALYADMSQRMMSLLEAHCDDVEIYSIDEAFGRLRRPNNGELIPWARQLRARVRQNLGLPIAIGLGASKSQAKLANRLAKAVPNHAGVFDFGTCHNPDQWLETIAIEDVWGIGRQLAAWCQRRGISNARQLRDMPQGELKAKCGVVGLRLQWELRGYACLPMDLAPAAKQETCVSRSFSQPVTTREELRQSIATYVVRAAEKLRKQQQRTSALTIYTRTSPFKPNFYSRAASRQLDVPSNDTAVLLQAALPLVDHIFRPHRPLAKAGVLMQHLQGIDTLQSHLLVPMSAEQQDKRESLMQTIDQLNRRYGRGSVHWAACGLEPGWAMRRDQLSRAATTRLRDIPVVRA

SEQ ID NO: 66532 - DNA, 1275 bp, Synechococcus sp. CC9605
  CDS (1)..(1275): transl_table=11
atgcctcaggccacggccctgatcgatggaaacaacttctacgcctcctgcgaacagagcctggatccggctctgatcggtcagcccgtggtggtgctgtccaacaacgacggctgcatcgttgcgcgcagtgccgaagcccgtgccctcggcatccgcatgggaacgccgtacttcaaggcgcgcagggagcttgaacggcacaacgtggtggtgcgcagttcgaactacgccctctatgccgacatgagccagcggatgatgagcctgctggaggcccactgtgaagagctggaggtgtattcgattgacgaggccttcgggaggattcgtcgtccccgcaatggcgacctgcagggttgggcacgccagctgagggcacgggcacggcagaacctcggccttccgatcgccatcggcctaggggccagcaaggcgcaggccaagctggccaatcgcctggccaaacaggccccggaccatgccggaatgttcgacctcggacagtgcgacaaccccgatcgctggctggaaaccattgcgattgaagatgtctggggaatcggtcgccaattggcccattggtgccgcctgcggggcatcagcaacgcacgacatctccgggacatgccgagtggtgaactgcgcgccaaatgcggcgtggtgggtctgcggctgcaacgggagctgcgaggccatgcctgcctgccgctggagctggcaccagcaccgaagcaggaaacctgcgtgagccgcagtttcagccgccccatcaccagccaggaggagctgcaccaggccatcgccacctatgtggtgcgcgccgccgagaaattgcgcaagcaacggcaacgggcagcggccctcaccatctacacccgcaccagcccgtttgctcctgggttttacagccaagcggccagcacgcagctagacctaccgagcaatgacacagctgtgctgctgcaagcggcacgccccttggtggcacggatcttccggccccaccgtcaattggccaaggccggcgtgctgacgcagcacctgcagagccacaacatcctgcagacccatctgatggtgccgatgagtgaggagcagcagcagaaacgggagtgcctgatgcagaccatcgaccggatcaatcggcgttacgggcgtggaaccctgcaatgggccggttgcggactgcagcccagctggctgatgcggcgtgagcaactcagccgcgccgccaccacccgtctgcaggatctaccggtggtgaaggcctga

SEQ ID NO: 66533 - protein, 424 aa, Synechococcus sp. CC9605
MPQATALIDGNNFYASCEQSLDPALIGQPVVVLSNNDGCIVARSAEARALGIRMGTPYFKARRELERHNVVVRSSNYALYADMSQRMMSLLEAHCEELEVYSIDEAFGRIRRPRNGDLQGWARQLRARARQNLGLPIAIGLGASKAQAKLANRLAKQAPDHAGMFDLGQCDNPDRWLETIAIEDVWGIGRQLAHWCRLRGISNARHLRDMPSGELRAKCGVVGLRLQRELRGHACLPLELAPAPKQETCVSRSFSRPITSQEELHQAIATYVVRAAEKLRKQRQRAAALTIYTRTSPFAPGFYSQAASTQLDLPSNDTAVLLQAARPLVARIFRPHRQLAKAGVLTQHLQSHNILQTHLMVPMSEEQQQKRECLMQTIDRINRRYGRGTLQWAGCGLQPSWLMRREQLSRAATTRLQDLPVVKA

SEQ ID NO: 66534 - DNA, 1479 bp, Desulfovibrio desulfuricans G20
  CDS (1)..(1479): transl_table=11
gtgtgcttacacttgcggcagtaccggcatgcagcgcctgtgcgtgaaggagggatggctgtggatgtgaccgtactgggcagagctgcctgttcccgcgtgcggcatgacgggggaacaccgtccgcacccgcggcacagcggcaggggcgtccgttgtatgcgcttgtggactgcaacagtttttatgtttcctgcgagcgggttttcaggcccgaccttgtccgccgccccgtggttgtgctgtccaacaacgacggctgcatcattgcacgctcggcagaggctaaagctctgggtattcccatgggggccccgtggttcaaggtgcgcagacatgctgagtccgcgggggtgaccgtgttttcgtccaattatgccttgtacggtgatatgtcgtcacgcgtcatgcgggtgctggagcgtttctgtccggatgtgcatgtgtattccattgatgaggcttttatgcggctggacagcctgatcatgccgccgggtatgtcgccggagcggtatgcggcgtgtctgcggcgcgaggtgtaccggcgtacaggcattcccgtgtcggtggggctgggctgcaccaagactcttgccaagctggcaaacaggctgagcaaacagcagaatgccggagcgcgggccatggtgccggcggctttccggtatgccggagtattcaactttggagcagtgacagatcctgacgttatggatgcgttgctggaaacgctggacgtgacggatgtgtggggtgtgggggcgcgccatgcggggcgtctgcggacatggggcatacgcaccgcgcgggcgctgcgtgatgcaccggatgacagggtgcgcagatacatgagcgtgaccggtctgcacaccgtgctggaactgcgcggcatttcgtgtctgcctctggatgatgcgccgccgtcgcgcaggtcggttgtctcttcgcggtcattcggcacactggtgacgcacaaggagcatatgctcgaagctgtcacggcctatatgacacgggccgccgaaaaactgcggcgcgaacagcttgaagcgcactgcgtgggggttatgatcagcaccccgcgccacggcgacgggccgcgctatgccgacagcgcacaggtgcagcttgcggtgcccaccagccatacgccgcagctgatagtccgcgcccgcgccctgctggagagtatatggcgcgacggctaccggtaccagaaggccggcgtgatgctttcggggcttgaatctgcggtatcccgtcaggtttccatgctgcctgccctgcaggggacagggcggggactggaacggggaaggcggctcatggcggcggccgatgcggtgaatgcacgtttcggaaggggaacgctggaatacgcggcggccggtctgggaaggccgtggagcatgaaacaggaacacctgtcgccccgctacacttcggactggaaaaaactgccgcttgtgcgctga

SEQ ID NO: 66535 - protein, 492 aa, Desulfovibrio desulfuricans G20
MCLHLRQYRHAAPVREGGMAVDVTVLGRAACSRVRHDGGTPSAPAAQRQGRPLYALVDCNSFYVSCERVFRPDLVRRPVVVLSNNDGCIIARSAEAKALGIPMGAPWFKVRRHAESAGVTVFSSNYALYGDMSSRVMRVLERFCPDVHVYSIDEAFMRLDSLIMPPGMSPERYAACLRREVYRRTGIPVSVGLGCTKTLAKLANRLSKQQNAGARAMVPAAFRYAGVFNFGAVTDPDVMDALLETLDVTDVWGVGARHAGRLRTWGIRTARALRDAPDDRVRRYMSVTGLHTVLELRGISCLPLDDAPPSRRSVVSSRSFGTLVTHKEHMLEAVTAYMTRAAEKLRREQLEAHCVGVMISTPRHGDGPRYADSAQVQLAVPTSHTPQLIVRARALLESIWRDGYRYQKAGVMLSGLESAVSRQVSMLPALQGTGRGLERGRRLMAAADAVNARFGRGTLEYAAAGLGRPWSMKQEHLSPRYTSDWKKLPLVR

SEQ ID NO: 66536 - DNA, 1353 bp, Thiomicrospira crunogena XCL-2
  CDS (1)..(1353): transl_table=11
atggcggtttttgcactggtggatggcaacagtttttatgtatcttgccaaatagcgtttgaacccgcattaaagaaccgacccgcagtggtcttgtcgaataatgatggctgtgtggtggccgcgaatgccaaggcgaaagccattgatgcctttttgaggcagcagaaaacgcatttcggaccgggcggctacaaagcggcacggcccgaaagtattatgtttcaaccgtactttaaggtgaagcggtatttagaccagattaatgcagtggtgtttagttcgaactatgaattgtatgccgatatgagtagtcgaatgcattcggttttatccggctttgctgtgcaacaggagatttattccatcgatgaaagtttcttggatttatcgggcatgtcgttatccgatttcacggcgtatggcgaagagatgaagcgtacggtgatgcaatggttagggttgccggtggcggttgggtttgggtcgtctcgaaccttggcaaagctggcgaaccatttggccaaaaagcaacctgatcatcaggacgtgctcgatttgacggtgttatcagaagccagtttgaatgccttgcttaaaaaagttgcgattcgagatgtgtggggcgtcggcaaaggattgtccgccaaactggaaatgcagggcattctttcagcgtatgatttaaaagtcagtgatcttaagttcatccgaaaacgctattccattacgttggagcgtatcgtaagagaattgagaggtgagtcctgtttgtctttgggcgctttagccacctcggatcgacaaattatttcttctcgctcttttggtcaacctgtgacggagtatgctgaaatggaacaagcggtggcgagttacattgtacgagcggccgagaaaatgcgtgctcagcacaaagtgtgtcagtttgtgacggtatccattcgaaccagtccttttcagaatcggtcatgtttttaccaaaattcacagaccttgcctttgatttacccctcagacagttctgtgttgctgatcaaactggccaaacgtgctttaagatcgatttggcagtcaggatatgcttaccagaaagctggtgtgattttatcgggggtgacggaaaaaggtgcggttcagattgactgctttgcgccgaatccgcaatattccgcaaatccaaaatcagatcgtttaatgcaggtgatggattttttaaatcacagcatgggaaaaggaacggttcaattagccgcagaaggacgtaaaaatgaccaggcctggcaaatgaagcgttccaaaatgtcaaagcgttataccacgcgctgggacgagttactgacggtacgatga

SEQ ID NO: 66537 - protein, 450 aa, Thiomicrospira crunogena XCL-2
MAVFALVDGNSFYVSCQIAFEPALKNRPAVVLSNNDGCVVAANAKAKAIDAFLRQQKTHFGPGGYKAARPESIMFQPYFKVKRYLDQINAVVFSSNYELYADMSSRMHSVLSGFAVQQEIYSIDESFLDLSGMSLSDFTAYGEEMKRTVMQWLGLPVAVGFGSSRTLAKLANHLAKKQPDHQDVLDLTVLSEASLNALLKKVAIRDVWGVGKGLSAKLEMQGILSAYDLKVSDLKFIRKRYSITLERIVRELRGESCLSLGALATSDRQIISSRSFGQPVTEYAEMEQAVASYIVRAAEKMRAQHKVCQFVTVSIRTSPFQNRSCFYQNSQTLPLIYPSDSSVLLIKLAKRALRSIWQSGYAYQKAGVILSGVTEKGAVQIDCFAPNPQYSANPKSDRLMQVMDFLNHSMGKGTVQLAAEGRKNDQAWQMKRSKMSKRYTTRWDELLTVR

SEQ ID NO: 66538 - DNA, 1287 bp, Prochlorococcus marinus str. MIT 9312
  CDS (1)..(1287): transl_table=11
atgagaatttcaagcattgatgctatagctcttatagatgctaataatttttatgcgtcatgtgaacaaactattaatcctcatttgagaaataaaccagtagtaattttatctaataatgacggatgtatcattgcgagaagtcccgaagcgcgagctttgaaaattaaaatgggaactccttattttaaggtcaaagaaaaattaaataaattagatgtagcagtcttaagctcaaactactcgctttacggcgatatgagcagaagacttatgaatttactaaaaaaatactgtgaacaaatagaaatttattctattgacgaagcatttgtctcaatttctagacctaatgataaaaatctatatccttgggcaagaaacataagatcattaatatatcagaatctaggcatcacactaacagtaggtataggagaaaataaagtaagagcaaaaattgctaataaattagctaaaaatattgattattcagctggaatatttgatttatctagaactagaaatgagaataattatttaaaaagaattagtgtagataacatatggggagtcgggaaacaaacctctaattggttgaaaagtaaaggtattaaaaatgcgagagaattaagagatatggaagaaaatgaaattattaagaaactaggcatagtagggaaaagattacaattagaactgaaaggctataaatgcctgcctctagaaaaaagcaagaaatcaaaaaaagaaattcaggtaagcaggagtttcggtacccctatcacaaaattagaagacttaactcaagcactggcgactcatgcaataaaagcatctgaaaaaatgagaagtcagaatttacaatcatccgacattagagtatttgccagaaccagtaaatattcaagtcaaaattatcaaagaagtgctcatagaaaacttacaaatgcgacagacgacacaaacagcattttaaaaatagtagttgaattatctaaagaaatttataatcccgaatataaattttcaaaagctggtgttttaatgcaggatttaactaatagcgaatatttacagcaatcagttatcaattacaaatctcagaaagacctaaaaaaatcagcaactctcatgagaactattgatttattaaataaaagatttaataacaatgcaattacatgggctattacaaaaacgcaaaaaagttggaagatgaataagaatttcttaagtcgctcatctacaactgatatagaacaaatcccaactatagtaaagtaa

SEQ ID NO: 66539 - protein, 428 aa, Prochlorococcus marinus str. MIT 9312
MRISSIDAIALIDANNFYASCEQTINPHLRNKPVVILSNNDGCIIARSPEARALKIKMGTPYFKVKEKLNKLDVAVLSSNYSLYGDMSRRLMNLLKKYCEQIEIYSIDEAFVSISRPNDKNLYPWARNIRSLIYQNLGITLTVGIGENKVRAKIANKLAKNIDYSAGIFDLSRTRNENNYLKRISVDNIWGVGKQTSNWLKSKGIKNARELRDMEENEIIKKLGIVGKRLQLELKGYKCLPLEKSKKSKKEIQVSRSFGTPITKLEDLTQALATHAIKASEKMRSQNLQSSDIRVFARTSKYSSQNYQRSAHRKLTNATDDTNSILKIVVELSKEIYNPEYKFSKAGVLMQDLTNSEYLQQSVINYKSQKDLKKSATLMRTIDLLNKRFNNNAITWAITKTQKSWKMNKNFLSRSSTTDIEQIPTIVK

SEQ ID NO: 66540 - DNA, 1257 bp, Synechococcus elongatus PCC 7942
  CDS (1)..(1257): transl_table=11
atgttcgccctgattgactgcaacaacttctacgtctcttgtgaacgagtatttgatcccaagctgcaggggcagcctgtcgttgtcctctccaataacgacggctgcgtgattgctcgttctgcagaagcaaaagctctagggattcccatggggatccccttcttcaaagtcaaagacctgatatcacaacatcagattcaggtcttctccagcaactacgccctctacggcgacatgagccagcgagtgatgcaaaccctggcaacactctgtcctgatctagaggtctattccattgatgaagccttcttagacttctcaggatttcaagcccagcccctgcagcaaggtcaattgattcgtcaaaccgtcgggcagtggacaggcatccccgtctcgatcggcattgctgccaccaaggtactcgccaaagtagccaacaaactcgccaagcaaaatggtggtgtctttgtcctgtcgccatcaaaagtgcaagccgtcctcatgactctgcccgttgaagaagtttggggcatttccagtcgttggggtcagcggcttcgggctttgaacatcagtaccgccgccgaactccaggccactaaccttaatctgatgcgtcagcagttcaacatagttctcgagcggattgtgcgagagctacggggggaatcctgcttacccctcgaatccattgtcaatccgcagcaaagcttggtagtctctcgttccttcgggcagccaattacaacgctgccagagcttaaacaagccgtagcgacctacgtcagtcgagccgccgagaaactacggagccggcaactaacgaccagctatctaaccgtctttgtaagaacaaatcggtttcaagagaactatgaagcgcccaatgctagtcagggcttactcacgcccaccaatcacacggggaaattactggaaattgccctgcgttgcacagaatcgctctatcaaccaggacgagcctacaagaaagctggagtcctgtttcaagggttagggtcagcgcagtcaatccagcagagcctgtttgaggagtccgacagcgagaaaggagcagcgctgatggtgacgatggaccggcttaaccggcggtatggtcggcagtccctgcactatggagccacaggaactcgacaaccttgggccatgcgctccgaccagcgatcgccgcaatacacaactcgatggcaagacttacccgaagtccatgcaagagctcgagagatttga

SEQ ID NO: 66541 - protein, 418 aa, Synechococcus elongatus PCC 7942
MFALIDCNNFYVSCERVFDPKLQGQPVVVLSNNDGCVIARSAEAKALGIPMGIPFFKVKDLISQHQIQVFSSNYALYGDMSQRVMQTLATLCPDLEVYSIDEAFLDFSGFQAQPLQQGQLIRQTVGQWTGIPVSIGIAATKVLAKVANKLAKQNGGVFVLSPSKVQAVLMTLPVEEVWGISSRWGQRLRALNISTAAELQATNLNLMRQQFNIVLERIVRELRGESCLPLESIVNPQQSLVVSRSFGQPITTLPELKQAVATYVSRAAEKLRSRQLTTSYLTVFVRTNRFQENYEAPNASQGLLTPTNHTGKLLEIALRCTESLYQPGRAYKKAGVLFQGLGSAQSIQQSLFEESDSEKGAALMVTMDRLNRRYGRQSLHYGATGTRQPWAMRSDQRSPQYTTRWQDLPEVHARAREI

SEQ ID NO: 66542 - DNA, 1116 bp, Pseudomonas syringae pv. syringae B728a
  CDS (1)..(1116)
atgggtgcaccgtactttcagatcaaggacgttttgcgtcagaacggcgtgattgccttcagcagcaattacgccctgtatggcgacatgagtgagcgggttatgacgatcatcgagtcgatggtgcccgcctcggaggtttatagcatcgatgaagcgtttgccgatctgacgggcataccgggcgacatgacagaatttggccggcgcatccggtcgaaaatcctcaaatgcaccggtataccagttggcgttggcattgggcctaccaagacgcttgccaagctggcgaaccacaccgctaagagactgctggcccaaacaggtggagtcgttgacatctgcgacctgcacaagcgcaactgggtgctgcgcaatacgtgtgtgtcagaggtgtggggagtgggaaagaagatgaaagcgcatctagaggccatgaacatccgaagcgcaatggatttggccaatgctgacgcgcgcaccctacgcaccaagttcagtgtcgtcattgaaaagactgcgcgagagctggccggcacgtcgtgtttggaaatgagcgaagctgatccgcccaaacaggaaatctgcagcagtcgaatgtttgggcagcgcctgaccactatcgagccgatcaaggaagcggtggccacctacacgcagcgcgccgctgaaaaactgcgtgcccagaattcactgtgcaagaagatgcgcgtcagtatccgcacaggtatgttcaacccggatgaacctaaatatgcgaatggtgcgctggtcgagctgccgtatcccaccaatgacgtgcgcttgctgacgaagggtgcaactgaggcggtcaaccgacttttccgcccagggtacaagtacagcaaggccgaagtgctgctgctggatcttcgccaacctggcgagtttacggatgacctgtttgcggagtcgcagccagcggcggtagaaaaggtgatgggcgtgctcgacgaaatcaatgcactctgggggagggggacattgagggccgggagcgtaccgtccgatccagactgggcaatgcgcagggacatgatgagccagagctacacgactcgattggatcaactgtgggtagtcagggcgtactga

SEQ ID NO: 66543 - protein, 371 aa, Pseudomonas syringae pv. syringae B728a
MGAPYFQIKDVLRQNGVIAFSSNYALYGDMSERVMTIIESMVPASEVYSIDEAFADLTGIPGDMTEFGRRIRSKILKCTGIPVGVGIGPTKTLAKLANHTAKRLLAQTGGVVDICDLHKRNWVLRNTCVSEVWGVGKKMKAHLEAMNIRSAMDLANADARTLRTKFSVVIEKTARELAGTSCLEMSEADPPKQEICSSRMFGQRLTTIEPIKEAVATYTQRAAEKLRAQNSLCKKMRVSIRTGMFNPDEPKYANGALVELPYPTNDVRLLTKGATEAVNRLFRPGYKYSKAEVLLLDLRQPGEFTDDLFAESQPAAVEKVMGVLDEINALWGRGTLRAGSVPSDPDWAMRRDMMSQSYTTRLDQLWVVRAY

SEQ ID NO: 66544 - DNA, 1425 bp, Desulfovibrio desulfuricans G20
  CDS (1)..(1425)
atggctgtggatgtgaccgtactgggcagagctgcctgttcccgcgtgcggcatgacgggggaacaccgtccgcacccgcggcacagcggcaggggcgtccgttgtatgcgcttgtggactgcaacagtttttatgtttcctgcgagcgggttttcaggcccgaccttgtccgccgccccgtggttgtgctgtccaacaacgacggctgcatcattgcacgctcggcagaggctaaagctctgggtattcccatgggggccccgtggttcaaggtgcgcagacatgctgagtccgcgggggtgaccgtgttttcgtccaattatgccttgtacggtgatatgtcgtcacgcgtcatgcgggtgctggagcgtttctgtccggatgtgcatgtgtattccattgatgaggcttttatgcggctggacagcctgatcatgccgccgggtatgtcgccggagcggtatgcggcgtgtctgcggcgcgaggtgtaccggcgtacaggcattcccgtgtcggtggggctgggctgcaccaagactcttgccaagctggcaaacaggctgagcaaacagcagaatgccggagcgcgggccatggtgccggcggctttccggtatgccggagtattcaactttggagcagtgacagatcctgacgttatggatgcgttgctggaaacgctggacgtgacggatgtgtggggtgtgggggcgcgccatgcggggcgtctgcggacatggggcatacgcaccgcgcgggcgctgcgtgatgcaccggatgacagggtgcgcagatacatgagcgtgaccggtctgcacaccgtgctggaactgcgcggcatttcgtgtctgcctctggatgatgcgccgccgtcgcgcaggtcggttgtctcttcgcggtcattcggcacactggtgacgcacaaggagcatatgctcgaagctgtcacggcctatatgacacgggccgccgaaaaactgcggcgcgaacagcttgaagcgcactgcgtgggggttatgatcagcaccccgcgccacggcgacgggccgcgctatgccgacagcgcacaggtgcagcttgcggtgcccaccagccatacgccgcagctgatagtccgcgcccgcgccctgctggagagtatatggcgcgacggctaccggtaccagaaggccggcgtgatgctttcggggcttgaatctgcggtatcccgtcaggtttccatgctgcctgccctgcaggggacagggcggggactggaacggggaaggcggctcatggcggcggccgatgcggtgaatgcacgtttcggaaggggaacgctggaatacgcggcggccggtctgggaaggccgtggagcatgaaacaggaacacctgtcgccccgctacacttcggactggaaaaaactgccgcttgtgcgctga

SEQ ID NO: 66545 - protein, 474 aa, Desulfovibrio desulfuricans G20
MAVDVTVLGRAACSRVRHDGGTPSAPAAQRQGRPLYALVDCNSFYVSCERVFRPDLVRRPVVVLSNNDGCIIARSAEAKALGIPMGAPWFKVRRHAESAGVTVFSSNYALYGDMSSRVMRVLERFCPDVHVYSIDEAFMRLDSLIMPPGMSPERYAACLRREVYRRTGIPVSVGLGCTKTLAKLANRLSKQQNAGARAMVPAAFRYAGVFNFGAVTDPDVMDALLETLDVTDVWGVGARHAGRLRTWGIRTARALRDAPDDRVRRYMSVTGLHTVLELRGISCLPLDDAPPSRRSVVSSRSFGTLVTHKEHMLEAVTAYMTRAAEKLRREQLEAHCVGVMISTPRHGDGPRYADSAQVQLAVPTSHTPQLIVRARALLESIWRDGYRYQKAGVMLSGLESAVSRQVSMLPALQGTGRGLERGRRLMAAADAVNARFGRGTLEYAAAGLGRPWSMKQEHLSPRYTSDWKKLPLVR

SEQ ID NO: 66546 - DNA, 1323 bp, Rubrivivax gelatinosus PM1
  CDS (1)..(1323)
atgtacgccctcgtcgacggcaacaacttctactgctcggtcgagcgcgttttccggccgtcgctgacgggccggcccgtggtggtcatgggctcgaacgacggctgtgtcattgcccggtccaacgaggcgaaggcgctgggcgtgaagatgggggagccctggtttcaatgtcgacacctcgagaaggaccagggcctcgtggcgctgtcggccaacttcaccctctacggcgacatgtccgagaggatgatgaccgtggccggttccttcgcgccacgccaagaggtttacagcatcgacgagtgcttcctggacttcgccggcatgccgggcggaccaggttccctcgtcgaaactggccgcgcgctgcgtgagaaggttcttcggtggaccggcattcccacctgcgtcggcttcggcccgaccaagacgctcgcgaagctggcgaaccacatcgccaagtcggccgagcgcaagccggggtcctaccctgagcagcttgctcaggtctgcaatctgggcgagctggcagatgaagtccggcgggagctcctggtcaagacggaggtcaaggaagtctggggcgtagggccgcgcatcggcgcccagctcaacgcggctggagtctcgaccgtgctcgacctagtccggctggaccccgcggctgtccggcgacgcttctcggtggtgctcgagaagaccgtgctcgaactgcgcggcatcagctgcctgacgctcgaagacgcgccggcgagccggcagcagatcatgtgttcgcgctccttcgggcggccggtgctcgagatggagggactggtcgaggcgttgagcgacttcgcggcgcgcgcggccgagaagctgcgcaagcaggagaacctcgccggcgccgtgcacgtcttcatcaccacgagccccttccgcaaggaggaccggcagtacagccgttcggtcaccgtgccgctggtccgaccgacaggagacacgcgggtgctggtcagcgccgccatcctcgctctgcgggcggtgttcaagcctggctaccgctacgcgaaagcgggggtcatgctcatggaactgcagcccgagtcggtgcaccaggccgagctcgacctgggagagcccgagcccggcactgtcccgcgcgaccgcagcaagctgatgtccgcggtcgacgctgtgaaccggcgccacggccgcggctcactaatggtggcgagcgccggtctcgcaactgcgcgacgcgagttcgtgccgaaacaggagcggcgaacgccccactacacaacgtcttgggacgacatgccggtggcgcgcgcctga

SEQ ID NO: 66547 - protein, 440 aa, Rubrivivax gelatinosus PM1
MYALVDGNNFYCSVERVFRPSLTGRPVVVMGSNDGCVIARSNEAKALGVKMGEPWFQCRHLEKDQGLVALSANFTLYGDMSERMMTVAGSFAPRQEVYSIDECFLDFAGMPGGPGSLVETGRALREKVLRWTGIPTCVGFGPTKTLAKLANHIAKSAERKPGSYPEQLAQVCNLGELADEVRRELLVKTEVKEVWGVGPRIGAQLNAAGVSTVLDLVRLDPAAVRRRFSVVLEKTVLELRGISCLTLEDAPASRQQIMCSRSFGRPVLEMEGLVEALSDFAARAAEKLRKQENLAGAVHVFITTSPFRKEDRQYSRSVTVPLVRPTGDTRVLVSAAILALRAVFKPGYRYAKAGVMLMELQPESVHQAELDLGEPEPGTVPRDRSKLMSAVDAVNRRHGRGSLMVASAGLATARREFVPKQERRTPHYTTSWDDMPVARA

SEQ ID NO: 66548 - DNA, 1263 bp, Cytophaga hutchinsonii
  CDS (1)..(1263)
atgtatgcattaattgactgcaataatttctacgcaagctgtgaaagagtattcaatccttcactgaacggaaagcccatagtcgtattaagtaataacgatggctgtgtgattgcaagaagcaacgaagcaaaggctctgggcattgacatgggaggagcgtattttatgattgaagaagcattaaaaaaacataatgtatttgtgttctcttctaattatactttgtacggtgatatgtcacaacgggtaatgaatacattggctgaatttacacccgagattgaagtatacagtatcgacgaatcttttctaaactttgaaggctttgaattgcttggggatttaaagatttatggtacaacaatccgtaatacagtttttcgcaatacaggtattccggtatcaataggcattgcccctacaaaagctcttgccaaattatccaataggatcgcaaagaagaataaggaatataatcatgtttgtgtgcttgattcacaggagaaaataatggcagccttaaagattacaactgtagataatatctggggaataggtcgtgcatatcataattttcttttgaatcatggaatacaaactacttatgattttgttcagcagcccgaagagtgggttagaaaaaatatgtcagtggtcggattaagacttcacaaggaattgaagggtgaaaaatgcctagagctagagttagtagctatggcaaaacagaatatttgtacttccagaagctttggcagatacttaacggatattgacccaataaaagaagcaatgagcaattttgcatcacgctgcgctttaaagcttagaaaagataagtctgtatgcacgttggtacaaatcctattacataccaataagcataagcctgatcagccacaatattttgttaataaagtaatcacattgcctgtgccaactaatagcaccatcgaacttatacaggcatcattgcgcgcattggatttggtttataaaccaggatacagatatatgaaatgcggagtgatcgtgtcaggtattgttccggaagatcgtgttcaacaaaatcttttcgatacagtagatagaagcaagcacaacaaggttactacgatcatggacaagttaaataagtccttaggtgcagattttgtaaaagtaggatcgttaggtgttacaaagcaatggcatcttaaggctgaaaaattgagtcaatgctacagcacaaggtgggatgagataattgtaattaagtaa

SEQ ID NO: 66549 - protein, 420 aa, Cytophaga hutchinsonii
MYALIDCNNFYASCERVFNPSLNGKPIVVLSNNDGCVIARSNEAKALGIDMGGAYFMIEEALKKHNVFVFSSNYTLYGDMSQRVMNTLAEFTPEIEVYSIDESFLNFEGFELLGDLKIYGTTIRNTVFRNTGIPVSIGIAPTKALAKLSNRIAKKNKEYNHVCVLDSQEKIMAALKITTVDNIWGIGRAYHNFLLNHGIQTTYDFVQQPEEWVRKNMSVVGLRLHKELKGEKCLELELVAMAKQNICTSRSFGRYLTDIDPIKEAMSNFASRCALKLRKDKSVCTLVQILLHTNKHKPDQPQYFVNKVITLPVPTNSTIELIQASLRALDLVYKPGYRYMKCGVIVSGIVPEDRVQQNLFDTVDRSKHNKVTTIMDKLNKSLGADFVKVGSLGVTKQWHLKAEKLSQCYSTRWDEIIVIK

SEQ ID NO: 66550 - DNA, 1260 bp, Cytophaga hutchinsonii
  CDS (1)..(1260)
atgtacgcattaatcgactgcaactgtttctacgtttcctgtgaacgtgtcttccgtcccgacctgcggcagcagccggttgttgtgctttctaacaacgacggctgtgtgatctcgcgttccgatgaagctaaagcaatcggtgttaaaatgggtgaaccattttttaaaatgaaagagctggtgcgtaatggtaaggtgactgctttctcttcaaactatacgctgtatggggatctgtctgatcgtgtaatgaaaacgcttgcttccattgtgccggatatagaagtctattccattgatgaagcatttttgcatctgaatgagagccatacggatttagaaacacttggccataccattcgcaatacagttaaacagcataccggaatcccggtaggcgtgggcattgcgccaaccaagacactcgccaagctggcgaaccgtctttcaaaaaaaacaggcggcgtacatattatttatccggataatattcaggaaaagctgaatgcgtgcgcactgcaggatgtatggggcatcggcaggcggaatgcgaaacggctgcaggcaaattatgttgataccattgagcagtttgtgaatcagcgcgaagaatgggtacgccagcatttttcagtgatcgggctgcgtacatataaggaattaaaaggaattccgtgcattgatatggaagatgaattgacggaaaaaaaatccatctgtacttcacgttcattcggtgaactgcagaatacatttgcctctatccaggaagctatagccacacacgctgccagctgtgccgagaaattacgcaaacaaaaatgtgccgcagccggtatgtatgtgtccttatcaaaaagccgctttaccgaccaggaaggcgataaatattttggcacctacattaaattaccacaggcaaccaacaatacagccacgttgattcaatatgcttcaaaagggttagagctcttgtttaagaaagatgtctattataaaaaatgtggcgtaaccgttattgatattgttcccgaagaaaagatccagttaaatttattcgaaccccaaaagaatgcgcggttgcatgcattggaagacacgattgataaactgaatcagaaactgggaaagaatgtccttcggcaagccatacaaggtaatgataacaatacctggaagctgcgctgtgaaaacatgtcgcccaactatacgaccaggataggggagatactggtcgtgcatgtaggtaataagtaa

SEQ ID NO: 66551 - protein, 419 aa, Cytophaga hutchinsonii
MYALIDCNCFYVSCERVFRPDLRQQPVVVLSNNDGCVISRSDEAKAIGVKMGEPFFKMKELVRNGKVTAFSSNYTLYGDLSDRVMKTLASIVPDIEVYSIDEAFLHLNESHTDLETLGHTIRNTVKQHTGIPVGVGIAPTKTLAKLANRLSKKTGGVHIIYPDNIQEKLNACALQDVWGIGRRNAKRLQANYVDTIEQFVNQREEWVRQHFSVIGLRTYKELKGIPCIDMEDELTEKKSICTSRSFGELQNTFASIQEAIATHAASCAEKLRKQKCAAAGMYVSLSKSRFTDQEGDKYFGTYIKLPQATNNTATLIQYASKGLELLFKKDVYYKKCGVTVIDIVPEEKIQLNLFEPQKNARLHALEDTIDKLNQKLGKNVLRQAIQGNDNNTWKLRCENMSPNYTTRIGEILVVHVGNK

SEQ ID NO: 66552 - DNA, 1314 bp, Arthrobacter sp. FB24
  CDS (1)..(1314): transl_table=11
atgtctgagtcgcgggcgcctgagaagcgggcgcaggacacggtccggcagattgccttggtggacgtcaactgcttctatgcctcagccgagcgggcattcgatccctcgctggaaggccgccccctcgtggtcctctcgaataacgatggctgcgcggtcacccggtcccccgaagccaaggcgctgggcatccccgtcggcgagccgtggttcaagatcgcgccccgggccaaggaatgggggctggtggccaagtccagcaactatgagctgtacggggatatcagcgcccgcgtgatggagcttctagggcgctactcggcctggctggaggtttacagcatcgatgaagccttcctgggagtcaaagggaccccggatgagctcctgcgtctgggacaaaccatcaagacggctgtccgccgcaacgtcggggtgccggtctgcgtgggaattgccaataccaagactctcgcgaagctggccaacaagtgggcgaagaacaaccccggcctcaacggcgtgtgccactgggactccatgccgcccccggcccgcgaagcgctgatgggccgggtatccgtcatcgaactctggggcgtggctggccggctgacaaaacgcctgaacaacatgggcatccattccatcctggaccttgcccgcgccgatcccgtccggatccgtgaccgcttctcggtggtgctgatgcgcacggtcctggaactgcagggcaccgcgtgcatccccatggaagcagagcgcattgggcgtgaccagctcatcttcagccgctcgttttccacgcccatcaccaccgccgcggacctgcgacaggtcatgagcgtctacggccagcaagccagcgcccgcctggccaagcacagcctgcaggccaaggtcctcacggccttcgccggcacctcccactacaacccgctggacacgtcctacccctcggtctgcgtcaccctgcccatgcccaccgcggatccggtgctgttgaccagggccgcgcatgccctgctcccccggatccaggaagggaccaaatacgtccgcgcgggcatcatggtcaccgacctgcgcccctcgggccagcagtcacccctgccggtgtttgccaacccgcacgaagaacgcggcatcggccccctgctggaggacatcacccgccgctacggacgcggatccgtgggcctcggccatgccggaatccggggcgggccggactggtccatgcagcgcaccatgctctcgcccaggtacaccacgcactggaacgagcttcccgtggtcaaggcagcctga

SEQ ID NO: 66553 - protein, 437 aa, Arthrobacter sp. FB24
MSESRAPEKRAQDTVRQIALVDVNCFYASAERAFDPSLEGRPLVVLSNNDGCAVTRSPEAKALGIPVGEPWFKIAPRAKEWGLVAKSSNYELYGDISARVMELLGRYSAWLEVYSIDEAFLGVKGTPDELLRLGQTIKTAVRRNVGVPVCVGIANTKTLAKLANKWAKNNPGLNGVCHWDSMPPPAREALMGRVSVIELWGVAGRLTKRLNNMGIHSILDLARADPVRIRDRFSVVLMRTVLELQGTACIPMEAERIGRDQLIFSRSFSTPITTAADLRQVMSVYGQQASARLAKHSLQAKVLTAFAGTSHYNPLDTSYPSVCVTLPMPTADPVLLTRAAHALLPRIQEGTKYVRAGIMVTDLRPSGQQSPLPVFANPHEERGIGPLLEDITRRYGRGSVGLGHAGIRGGPDWSMQRTMLSPRYTTHWNELPVVKAA

SEQ ID NO: 66554 - DNA, 1308 bp, Chromohalobacter salexigens DSM 3043
  CDS (1)..(1308): transl_table=11
atgtcattcacgcactgcccgccgagggcgaggaataggcgctcgttcatgttcgcgctgatcgactgcaacaacttctatgccgcctgcgagcgcctgttcgagccgcgcctggaaggcgttcccctgggtgtgctgtccaacaacgacggctgcgtcatcgcgcgctccgaggagttcaaggcgctcgacatcccgatgggcatcccgacccacaagatcgccccgcatctgcgccggcgcatcgtgctgaaatcctccaactacacgctctatggcgacctctcggcacgcgtgcagcaggtgctggcacagcaggttcccacgctggagccctactccatcgacgaatgcttcctggatctgcgcggcatgcgcgaggactggcacgccctcggcgcgaccctggtgcgcagcgtgcaacgccaggtcggcctgccggtgtccatcggcatcgcgccgacgcgcaccctggccaagctcgccaatcgccaggccaagacacagccgacacgccctcaggtatgcgtgtggcaaagcgccgacgcgcccgaactggcagcccacctggcccggctgtcgccccgcgaggtctggggcgtgggcgagcgcctcaacgcacgcctggccggcatgggcatcgtgaccgccgccgccctgcgcgagacgccggacagcgtattgcggcggcgcttcagcgtggtactggcgcgcaccgccgccgaactcaacggccaggcctgcctgtcgatgggcgacctggaaacgccacgccgcagcatcctctgttcgcgctcgttcggtcagccactgcgcgaccgcgcctccctggccggcgccttgcgccatcattgccagcgcgccggcgaaaagctgcggcgcgatgccatgcaagcctcggccatcggcgtatacatgcgtaccaacccgcatcatgccgacagtttccaccaggcctgcgaatgggcggcgctgcccttccccagcgccgacacccagcaactcaaccgcgcggcacaacgcctgctcgcacggctctggcagcctgcggcctatcaaaaactgggggtgatgctcaccgagctgacgccccgtcgacagagccagacaacgctcttcgacggcgccgagccggcacggcaggaggcgctgatgcatgcctgggataccattcgcgcccgctacggccgccaggcgctgaccctgggtccgcagcccgccgacgccccctggcagatgaacagcgcctaccgttcggcctgctataccacgcgctgggacgagctgcctcgggcacgcgccaggtga

SEQ ID NO: 66555 - protein, 435 aa, Chromohalobacter salexigens DSM 3043
MSFTHCPPRARNRRSFMFALIDCNNFYAACERLFEPRLEGVPLGVLSNNDGCVIARSEEFKALDIPMGIPTHKIAPHLRRRIVLKSSNYTLYGDLSARVQQVLAQQVPTLEPYSIDECFLDLRGMREDWHALGATLVRSVQRQVGLPVSIGIAPTRTLAKLANRQAKTQPTRPQVCVWQSADAPELAAHLARLSPREVWGVGERLNARLAGMGIVTAAALRETPDSVLRRRFSVVLARTAAELNGQACLSMGDLETPRRSILCSRSFGQPLRDRASLAGALRHHCQRAGEKLRRDAMQASAIGVYMRTNPHHADSFHQACEWAALPFPSADTQQLNRAAQRLLARLWQPAAYQKLGVMLTELTPRRQSQTTLFDGAEPARQEALMHAWDTIRARYGRQALTLGPQPADAPWQMNSAYRSACYTTRWDELPRARAR

SEQ ID NO: 66556 - DNA, 1320 bp, Chromohalobacter salexigens DSM 3043
  CDS (1)..(1320): transl_table=11
atggggggtggtgcgctcggtcatccacgagttcgtcgtatgattgggctcgtggactgcaacaacttctacgtcagctgcgagcgcgtcttccaaccacggctagagggcgtaccggtgggggtgatgtcgaacaacgacggctgtgtgatcgcccgctccaacgaactcaaggctctgggcgtcgagatgggcaccccagccttcgagctgcaggagtgggtaaaccaaggccgcatccatctgctctcgtccaactacgagctctatggcgacatgagcgcccgggtgcgtgaagtcctcgaggagttctccgccggcgtcgagccctactccatcgacgagatgttcgtgcgcttcgacggcttcgacgccgccaccacccaggccttggcccgcacgctctaccgcaacgtgcgccaattcaccggcatccccgtctgcgtgggcgttgcacccacccgtaccctggccaagctagccaaccgcgccgccaaaaagctgccggagtacggcggtacctgcgtcatgcatgccaacggtgatgacactcgccgtctactcgagcacaccgccctgggggacatctggggcgtgggccagcggcttgttgaacggctcgctctccagggcatcaagaccgcctgggatctccgacaggccgatcccaaagccatccgccaacgcttctccgtcacactcgagcgcaccgtgcgcgagcttcagggcacgccctgcattgagctccacgacgccgatcggccccgtgatcgcatcatgacctcgcgatccttcggccgcctcactggcgacctgggcgacctgcaggacgccatccgtcagcacgcccaacgcggcgccgagaaactgcgccggcaggacagccacgctcgcgccgtgctcgtcttcctcaagactaaccgtcaccggcccgacctgccccagtactcgcccagcatcgtcatagagctgcccgagcccaccgacgacagccggccgatcctcgccgccgcccgccaagggctcgagacgatctatcgccgtgggtaccgattcatgaagggcggcgtgatgctgctcgacctggtggacgccaaccgcgagcagctctcactactcgatacccccgagcgggaagcccagcgcgaacgcgaccacaagctaatggccgccttggacgcgctcaacgggaagatgggcaagggcactgtgcgcctgggcgtgccacgccagaacgccgcctggcacctacgctgcgcgcaccgcacgccacggtggacaacgcagtggcgagaattgcctcgcattgcgacccgttag

SEQ ID NO: 66557 - protein, 439 aa, Chromohalobacter salexigens DSM 3043
MGGGALGHPRVRRMIGLVDCNNFYVSCERVFQPRLEGVPVGVMSNNDGCVIARSNELKALGVEMGTPAFELQEWVNQGRIHLLSSNYELYGDMSARVREVLEEFSAGVEPYSIDEMFVRFDGFDAATTQALARTLYRNVRQFTGIPVCVGVAPTRTLAKLANRAAKKLPEYGGTCVMHANGDDTRRLLEHTALGDIWGVGQRLVERLALQGIKTAWDLRQADPKAIRQRFSVTLERTVRELQGTPCIELHDADRPRDRIMTSRSFGRLTGDLGDLQDAIRQHAQRGAEKLRRQDSHARAVLVFLKTNRHRPDLPQYSPSIVIELPEPTDDSRPILAAARQGLETIYRRGYRFMKGGVMLLDLVDANREQLSLLDTPEREAQRERDHKLMAALDALNGKMGKGTVRLGVPRQNAAWHLRCAHRTPRWTTQWRELPRIATR

SEQ ID NO: 66558 - DNA, 1299 bp, Polaromonas sp. JS666
  CDS (1)..(1299): transl_table=11
gtgtatgcattggtggatgggaacaacttctacgtgagctgtgagcgcgtattccagcccaggctggagggcgtgccagtcgtcgtcttgagcaacaacgacggatgtgcggtggccagaagcaacgaagccaaggccttgggcatcgccatgggagctccctggttcaagatcaagcactttgccgatgaagcggggctggtcgcccattcggcaaatttcgcgctctacggagacatgtcagatcgcatgatgcgtctggccgccggcatggggccccggcaggagatttactccatcgatgagtcctttatcgaactcggcggcgtccagggtgacctggtggaacgaggccacaaaattcgtgaccgcatcctccagggcataggcataccgtgcggtattggcattggtgccaccaagacacttgcaaagctcgcaaatcacgtcgccaagaccgcggagcgcaagccgggcagctacccggatcacttggcccaggtgtgcaaccttgaggcgttaagcaagggtgagcttgaggcggtcatggccagaacggacgtgggggaggtttggggagtgggtcgtcagatcggcaagcagctggtcgccggcggcatcaagagcgtgctggatctggtgcgcatggattcagggacggttcggcgcagatggtccgtggtactggaacgcacagtgctggagctgcagggggtctcatgcatcgaactggaaaatgccccggccccaaaacaggaaatcgcgtgcacgcgctcgtttgggcatccggtcaccagtcagcatcaccttgccgaggcggtaaccgactttgcgtccagagcggccgaaaagctgcgcaagcagcacagcctggctggccaagtgctggtcttcatccgtacgagcccgttccggcagtgcacgcagtacagccgatcggtgaccgtacccatgcgccgccccagctgcgacagcgccgtgatcgtgaatgcagccttgctgggcctgcaggccatttaccgcgaggggttcaactatgccaaagccgggatcatgctgctggacctgcaagggaacacaaaccggcaaggtgagctggacttggagggcgacgaagcacaagaccgctccacattgatgctggccatggatgaactcaataagcgctttggcaagggaacggtgcttctgggttgcgcggggctgggcggcaaccggcgcgcatggtcaatgaaacaggaacgccgcacgccggggtacaccacttgttgggaagacatacccgttgcgaaaagctga

SEQ ID NO: 66559 - protein, 432 aa, Polaromonas sp. JS666
MYALVDGNNFYVSCERVFQPRLEGVPVVVLSNNDGCAVARSNEAKALGIAMGAPWFKIKHFADEAGLVAHSANFALYGDMSDRMMRLAAGMGPRQEIYSIDESFIELGGVQGDLVERGHKIRDRILQGIGIPCGIGIGATKTLAKLANHVAKTAERKPGSYPDHLAQVCNLEALSKGELEAVMARTDVGEVWGVGRQIGKQLVAGGIKSVLDLVRMDSGTVRRRWSVVLERTVLELQGVSCIELENAPAPKQEIACTRSFGHPVTSQHHLAEAVTDFASRAAEKLRKQHSLAGQVLVFIRTSPFRQCTQYSRSVTVPMRRPSCDSAVIVNAALLGLQAIYREGFNYAKAGIMLLDLQGNTNRQGELDLEGDEAQDRSTLMLAMDELNKRFGKGTVLLGCAGLGGNRRAWSMKQERRTPGYTTCWEDIPVAKS

SEQ ID NO: 66560 - DNA, 1272 bp, Chlorobium limicola DSM 245
  CDS (1)..(1272): transl_table=11
atgttcgccctgatcgactgcaataacttctacgtttcctgcgaaagggttttcaacccggcgctgacaggaaagcccgtggtagtgctctcgaataacgacggctgttttatcgcacgttcgaacgaagcgaaagctcttggcctgccgatgggcggcccggcgttcaaattccgggacatcctcaaaaaacatcatgtcagggtcttttcggcgaacttcccgctctacggcgacatgtcctcacgggtgatggtcacgcttgccgaccttgctcctgaaatagagatctactccatcgacgaagcctttgtcgacctcggcggcttcagccggttcggcgcctccggatacgcggcacaaatcaggaaaaccctcaccagacacaccggaatcccggtcagcatcggcattggctcaacgaaaaccctggccaaggcggccaaccggatggcgaaaaaaaaacccgggtacgatggaatctgcatactctctgcaccggaagagattcatgaggcccttgccgcattaaaagttgaagatatctggggaataggtcggcaatggagcaaactgctcgaagcgggaaacatccggactgcgctcgactactcccgagctccggcgccgtggatccggaaacacctgcacctccccggcatccgcattcaggaggaactgaacggccattcgtgcctgcctctggaacaggtccgcccaccgaagcagagcatctgcacctcccgttcattcggccgcacgattaccgcattggatgaactgcagcaggctgtggcaacctttgccggaaaatgcgccgaaaaactcagaaaggaaaactccgcaacgtcgatgatcactgtcttcatctgcagcagcccgttcaatgaaccgcaactgaaatactggggaacccgaaccatggccatgtccagaccgtctcaggacagcatcgccgtcatccgggctgctgatcttgctctcgcatcgatcttccggcagggatacaactacaaaaaggcgggtgtgatcgtcagcggcctcattccggcacaatcagccgagaaagaactgctcctgttccccgacgatacatcgaccgggaataatcggcaaaagcgcctcatggaagcaatggaccgcatcaaccaccagtacggcccaggagcgatccggatcgccgccgaaaatgccgagacctggaagccgaatcaggcaaacctctccgaacactataccacctcctggagcggcattatcactgtcggttaa

SEQ ID NO: 66561 - protein, 423 aa, Chlorobium limicola DSM 245
MFALIDCNNFYVSCERVFNPALTGKPVVVLSNNDGCFIARSNEAKALGLPMGGPAFKFRDILKKHHVRVFSANFPLYGDMSSRVMVTLADLAPEIEIYSIDEAFVDLGGFSRFGASGYAAQIRKTLTRHTGIPVSIGIGSTKTLAKAANRMAKKKPGYDGICILSAPEEIHEALAALKVEDIWGIGRQWSKLLEAGNIRTALDYSRAPAPWIRKHLHLPGIRIQEELNGHSCLPLEQVRPPKQSICTSRSFGRTITALDELQQAVATFAGKCAEKLRKENSATSMITVFICSSPFNEPQLKYWGTRTMAMSRPSQDSIAVIRAADLALASIFRQGYNYKKAGVIVSGLIPAQSAEKELLLFPDDTSTGNNRQKRLMEAMDRINHQYGPGAIRIAAENAETWKPNQANLSEHYTTSWSGIITVG

SEQ ID NO: 66562 - DNA, 1281 bp, Chlorobium phaeobacteroides DSM 266
  CDS (1)..(1281): transl_table=11
atgtttgctctggtggactgcaataacttctatgtctcatgcgagcgggtctttaatcccggattgcaaaaccgcccggttgtggtactctccaacaacgacggctgttttattgcccgttcggaagaggcaaaggcaataggccttgcaatgggagaccctgcatataaaaaccgtgaactgctcaggcagcacaacgtagctgtctattccgccaacttcccgctttatggcgacatgtcggcaagagtcatgaaaaccctcgaaacgcttgcgcctgatcttgagatctactccattgatgaatgttttcttgatctcggcggcttcggaaagttcaaccttgccgactacgcagcagcaacaagaaaaacagtacaccgaaacaccggcattccggtcagcataggcatcggagcaacaaaaaccattgccaaggcggcaaaccgcatggcaaaaaaaaacctctccctcggaggcgtctgcattctttccaccgcagcggcaacaagggaggctctcggcgccatggcggttgaacacatctggggcatcggcagccagtacgccgcactgctgcacaagcagcacatccatactgctctcgactttgccgacgcaccgacgcactgggtacagaaacacctccacatcaccggcgcaagagtgcagcaggagctgaacggacactcctgtttgcctcttgagctggttcggtcgagaaagcagagcatctgcacctcccgttctttcggctcactggtaagctcatacgaagaaatcggctatgccatagctcactttacctcaacatgcgcattcaagctccgtcgagaaggttcccgggcatcgctgctcactgtttttctgtataccagcccatttatcgaaaaagaaaaccgctaccggggaacaagaacctttgcgctccccttcccttcaaacaacacccttgagctccagaaagctgctcaactgctgcttgcctcgatctaccgatccggatacggctacaaaaaagccggcgtgctggtttccggtattaccgatgaaaaaggagccgcaatgacaacactctccctgtttgacaacgatccgttaccccggaaccagaagcgggacatgaaacttatggaaacgcttgacgcgataaactcacgatttggtcagggcacactccgcacagcatccgacaccaactccggctggaaacaacgacaggaaaagctttcaccgcactataccacacgatggaacgacattatcgaaatacacgcatga

SEQ ID NO: 66563 - protein, 426 aa, Chlorobium phaeobacteroides DSM 266
MFALVDCNNFYVSCERVFNPGLQNRPVVVLSNNDGCFIARSEEAKAIGLAMGDPAYKNRELLRQHNVAVYSANFPLYGDMSARVMKTLETLAPDLEIYSIDECFLDLGGFGKFNLADYAAATRKTVHRNTGIPVSIGIGATKTIAKAANRMAKKNLSLGGVCILSTAAATREALGAMAVEHIWGIGSQYAALLHKQHIHTALDFADAPTHWVQKHLHITGARVQQELNGHSCLPLELVRSRKQSICTSRSFGSLVSSYEEIGYAIAHFTSTCAFKLRREGSRASLLTVFLYTSPFIEKENRYRGTRTFALPFPSNNTLELQKAAQLLLASIYRSGYGYKKAGVLVSGITDEKGAAMTTLSLFDNDPLPRNQKRDMKLMETLDAINSRFGQGTLRTASDTNSGWKQRQEKLSPHYTTRWNDIIEIHA

SEQ ID NO: 66564 - DNA, 1272 bp, Chlorobium phaeobacteroides BS1
  CDS (1)..(1272): transl_table=11
atgtttgctcttatggactgcaacaacttctatgtctcctgtgaacgggtgttcaatccggcactttacggccgtccggttgttgtgctgtccaacaatgatggatgctttatttcacgttcccgggaagccaaggctctcggcttgccgatgggggcaccggttttcaaatacagggagctgattaaaaagcatgatgtggcgatgttttccccgaacttcccgctctatggggacatgtcgtcacgggtgatgcacacccttggcgaactgctgccggatatcgagatatattccattgatgaagcctttgccgatctgcaggaattcggtcgatacgatcttgagcaattggcgcaaaaggtctgtttgacgatcagaaggaataccggtattccggtcagtgtcggggtaggcccgaccaagacccttgccaaggctgccaactatcttgccaagaaagacacgcggtatcacggggtgtgcgtgcttgagaacggtatctctgttcgcgaggctctcggcaacgttcctgttgaggatgtctgggggatcggcagagcctacggtcgctttttgcgtacccattcgctcactactgcccttgatttctccagggctcgacctgcatgggtgcggcgtcatatgcatagtacaggagcgagggttcagcaagaactgaacggcgaatcctgccttgctctggaacaggtacgtccttccaaacagagcatctgtacatcccgttctttcgggacaatggtgaggacgcgtgaagatctggagcatgcggtaggcagtttcgcgtcgaaatgtgctctgaagttgcgcagggagggggtttatgccggtcttgttacggtgtttctctgcactgacgcatgtgaccggcgttcagatcactacagagagagccgtacagcggcaatgccttttgcaacgcagagtaccttacgaatagttcgttatgcgctggatatcctgaaggtgatattccgggatggttatgcctacaagaaggcgggagtgattctggacgggttttcgcctgcgttcccatcatcagttacaccgtcgctttttgacggtgatggaacctcagcagctgattcacaggctcttatgcaggcgatcgacacgataaatttccgctatggttcaggaacgttgaggctggcagttgaatcacagtcgggatggaagcagcgtcaggaaaaactctcacagcgttacacgacatgctgggaggaaattatccaggtgagagcgtag

SEQ ID NO: 66565 - protein, 423 aa, Chlorobium phaeobacteroides BS1
MFALMDCNNFYVSCERVFNPALYGRPVVVLSNNDGCFISRSREAKALGLPMGAPVFKYRELIKKHDVAMFSPNFPLYGDMSSRVMHTLGELLPDIEIYSIDEAFADLQEFGRYDLEQLAQKVCLTIRRNTGIPVSVGVGPTKTLAKAANYLAKKDTRYHGVCVLENGISVREALGNVPVEDVWGIGRAYGRFLRTHSLTTALDFSRARPAWVRRHMHSTGARVQQELNGESCLALEQVRPSKQSICTSRSFGTMVRTREDLEHAVGSFASKCALKLRREGVYAGLVTVFLCTDACDRRSDHYRESRTAAMPFATQSTLRIVRYALDILKVIFRDGYAYKKAGVILDGFSPAFPSSVTPSLFDGDGTSAADSQALMQAIDTINFRYGSGTLRLAVESQSGWKQRQEKLSQRYTTCWEEIIQVRA

SEQ ID NO: 66566 - DNA, 1266 bp, Desulfuromonas acetoxidans DSM 684
  CDS (1)..(1266): transl_table=11
atgacaagctacgctctggtcgactgcaataatttttatgtcagttgtgagaggctgttctgcccacaactcaagcggcgtcctgttgttatcctgtccaacaatgacggctgtgttgtgtcacgcagtcaggaagccaaagcactcaaaatccccatggcaacgccgctgttcaaggttcattctttgctcaaacggcatcaggtggccatcttttcatcgaattacaccctctatgccgacatctcctcccgggttatgcaaacccttgaattgttttcccccgaggtggaggaatactccatagatgaagcttttctcaacctgaccgggttggttaaaagcgaagatcgtctggactatggtcaaaaaattcgtcagaccgtgcatcaacatgtcggcatcccggtttgcgttggcctggccccgaccaaaaccctggctaaattagccaactatgcggcaaaaaactacccggcaaccaacggcgttgtcgatctgcactcacctcagcgtcgccaacgcttgctccatctcaccccggttggtgaaatctggggcattggtcggcgcacggccttacgtctgcaacagatgggcattcataccggctggcaactgacccagatgccgctgaagcaggctcggcaccgcttttccatcgtcatggagcgattgattcgggaactgcatggggaaaactgcctggaggtcgaccatcaaccggcgcctcagcaacaggtgatctgttcgcgctcctttggagaaaaaattgtttctttcgatgagttacgtgagacggtttgtgaattttccgcgcgagccgccgaaaagttacgtcacaatcaacaggcagctcggctgattaatgtctcgattcgcaccagtgcgtattgtgctgcggaaccgtgctatgccaattccgccagtggcatgttgcaacaacataccagtgattcacgtcagattgtcgccaaagccactcagcttcttgaggggttgtggaaagagggttatcgttatgccaaagctggagttatgctgagtgatctgtgcctggaaaacaacattcagcccggactgtttgatgatgtaaaccagaagaataaaagcaaagccctcatgcaagcaatggatcacatcaatgaacagtgtggttccatctggttgggcgggcaacggccgcaacgcgattggttcatgaaccagaattatctgtcccccgcctataccacacgctgggactgcctgccggtagtctcctga

SEQ ID NO: 66567 - protein, 421 aa, Desulfuromonas acetoxidans DSM 684
MTSYALVDCNNFYVSCERLFCPQLKRRPVVILSNNDGCVVSRSQEAKALKIPMATPLFKVHSLLKRHQVAIFSSNYTLYADISSRVMQTLELFSPEVEEYSIDEAFLNLTGLVKSEDRLDYGQKIRQTVHQHVGIPVCVGLAPTKTLAKLANYAAKNYPATNGVVDLHSPQRRQRLLHLTPVGEIWGIGRRTALRLQQMGIHTGWQLTQMPLKQARHRFSIVMERLIRELHGENCLEVDHQPAPQQQVICSRSFGEKIVSFDELRETVCEFSARAAEKLRHNQQAARLINVSIRTSAYCAAEPCYANSASGMLQQHTSDSRQIVAKATQLLEGLWKEGYRYAKAGVMLSDLCLENNIQPGLFDDVNQKNKSKALMQAMDHINEQCGSIWLGGQRPQRDWFMNQNYLSPAYTTRWDCLPVVS

SEQ ID NO: 66568 - DNA, 1257 bp, Shewanella baltica OS155
  CDS (1)..(1257): transl_table=11
atgtttgcgctagtcgatgccaatagcttctactgtagcgcggaacaggtgttccggcctgattggcgtggtaagcctgttgttgtactcagtaataacgatgggatgattgttgctgctaatagacaggctaaagaagcgggtattcagaagtttgtgccttactttcaagtcaaagcactctgtgcagagcgtggtgttattgcctgttcgtctaacaatgaactgtatgctgatttgtctagcaagatgatggatatcattggccgatttgcgcctgagcaacatgtctacagtatcgatgaaaccttcctgtcgtttaagaactgctaccctgccataaagtgcctacatacccaagggcaattgataagacgcgctgtatggaaagaagcccgtttacctgtttgtgtggggattgctaaaaccctgacgctggcgaaactagctaaccatgctgctaagaagatagagggctataaaggtgtctgtgttatcgacaatgaccaagaccgaatcgctattttaaaacagcttgcagtgggtgatgtttgggggattggacgcaggcttagtacgaagctcgaactgatgaatatccgtactgcgtttgacctcgctaacatgccagcaggattagcccgtaaacagttcagcattgaagtcgagcgcacagtacgcgagcttaacggccaagtatgcaaggtgtgggatgaagcgagggctgataagaagcagatattctcgacaagaagcatgggtgagcgcatcacagattttgagtcattattgcaagcattgagtaagcacgtggggattgcggcggctaaagcgcgtaagcaaggctcagtctgcaagactatgctgttatttgccactaactctccccatgatgagcgccctgtaaactataaaacagtggtgcactttctttgtccaactaactgtacggtcgagctgactaaggccatatgtgaagccgcacctaagctatttcgtgaagatgtacgctattacaagataggcgtaggtttgattgacttagcgagcgagaaacatagccaactagacctgttcaatccaccgacagcaaaaccagcgctaatgcttacactcgatcacattaaccaacgatatggtagtgatactctgtttattgctgctcaaggcatagagcataaatgggcaatgcggagggacttattgactcctcaatatacgactaagtggcgaagtgtaccgcgtatcaagtgctaa

SEQ ID NO: 66569 - protein, 418 aa, Shewanella baltica OS155
MFALVDANSFYCSAEQVFRPDWRGKPVVVLSNNDGMIVAANRQAKEAGIQKFVPYFQVKALCAERGVIACSSNNELYADLSSKMMDIIGRFAPEQHVYSIDETFLSFKNCYPAIKCLHTQGQLIRRAVWKEARLPVCVGIAKTLTLAKLANHAAKKIEGYKGVCVIDNDQDRIAILKQLAVGDVWGIGRRLSTKLELMNIRTAFDLANMPAGLARKQFSIEVERTVRELNGQVCKVWDEARADKKQIFSTRSMGERITDFESLLQALSKHVGIAAAKARKQGSVCKTMLLFATNSPHDERPVNYKTVVHFLCPTNCTVELTKAICEAAPKLFREDVRYYKIGVGLIDLASEKHSQLDLFNPPTAKPALMLTLDHINQRYGSDTLFIAAQGIEHKWAMRRDLLTPQYTTKWRSVPRIKC

SEQ ID NO: 66570 - DNA, 1275 bp, Shewanella baltica OS155
  CDS (1)..(1275): transl_table=11
atgacgccctcactattcgcactcgtcgattgcaataatttttatgcctcctgtgagcggatgtttaggccagatttagctggcaggccgattgtagtgttatccaataacgatggctgcgtcgtcgcccgctcggcagaggcaaaacaacttggcatcaagatggcggtgcctgtgtatcaaatcgcaaaccaactccgccagcatcacgtcgcggtattctcctccaactatgcactctatgccgacatatcaaatagagtcatgaccaccttagaacaaatggtgccgaaagtagaagtgtatagtattgatgaagcgtttttagacctttctcgtctcgataaatgcattgatattcatcagcttgcacttgatatttatcaacgaataccacagtggattgggatcagtgtttgcgtcggcattggaccgacaaaaaccctcgctaaactggcaaaccatgccgcgaaacgttatcccgcgacgcagggcgtggttgacttgcgcgaccgtgaacgccaacgacggctgatggcgcttatccctgtcgacgaagtctggggaataggccgtaggcttacaaaacgcttgaacatcatgggcataaataccgcgttgcaattggcggatgcgcatccaaagcttatccgcgacaccttttctgtcaccgttgagcgcacggtacgcgaacttaacggcattgcctgtgatgacatacaagaggtcgccgccactaagcaacaaattattagctcccgctcctttggcagtcgtattgataatttagaagcgatgcaacaggcaatcaatgaatacacttttagggcctgtgaaaaactgcgctccgagcgccagtacgctaaagcgatgtcagtatttgtgcgtactagcccttttagcgatacaactccccagtacagcaaatcactgtcgggcagtttagttcgccccagcaatgatacgcgtgattttgtcacccttggccaaagcctactgcaacgcatttggcgtgaaggtcatgcctatgcaaaggccggtgtcatgttaggggatttttttggtgcaggcgtgtttcagctcggattattcgatgacgtcacgcctaggcctaaaagcaaggagttgatgcaattactcgataaagtgaaccacagcggtcatggaaaaatttggtttgcaggacaaggtattgacccgacttggggaatgaagcgagagcagctttcccctcgctacaccacccaatgggcacaattgcccatagtgaaataa

SEQ ID NO: 66571 - protein, 424 aa, Shewanella baltica OS155
MTPSLFALVDCNNFYASCERMFRPDLAGRPIVVLSNNDGCVVARSAEAKQLGIKMAVPVYQIANQLRQHHVAVFSSNYALYADISNRVMTTLEQMVPKVEVYSIDEAFLDLSRLDKCIDIHQLALDIYQRIPQWIGISVCVGIGPTKTLAKLANHAAKRYPATQGVVDLRDRERQRRLMALIPVDEVWGIGRRLTKRLNIMGINTALQLADAHPKLIRDTFSVTVERTVRELNGIACDDIQEVAATKQQIISSRSFGSRIDNLEAMQQAINEYTFRACEKLRSERQYAKAMSVFVRTSPFSDTTPQYSKSLSGSLVRPSNDTRDFVTLGQSLLQRIWREGHAYAKAGVMLGDFFGAGVFQLGLFDDVTPRPKSKELMQLLDKVNHSGHGKIWFAGQGIDPTWGMKREQLSPRYTTQWAQLPIVK

SEQ ID NO: 66572 - DNA, 1281 bp, Pelodictyon phaeoclathratiforme BU-1
  CDS (1)..(1281): transl_table=11
atgtttgcactggtcgattgcaacaacttctacgtctcatgcgagagagtctttaatcccgccctgcgaggccgccctgtagtagtgctctccaacaatgacggctgcttcattgcccgctccgaagaggcgaaagccattggtcttgctatgggcgccccggcattcaaaaacagggagctgctgaaaaggcataaggttgtcgtttactctgcaaacttccccttgtatggagacatgtcatcaagggtcatgacaacccttgccgatcttgctcctgatcttgagatctattcgatcgatgaagcctttcttgacatgagcggcttccagcgatacgatctcgaccactatgcccgtttcatccgcaaaaccgtcacgcagcataccggtattccggtttgtatcggcattgctcccacaaaaacccttgccaaggttgccaatcgtcttgccaaaaagaatccctgctatgcgggggtctgtctgctcaacaccgacaaggaacagcgcgcagcgctcgccataacccaggttgaagatatctgggggataggtcgccagtggagtaaatttctccatacccaaaacatccacaccgctcttgaccttgccgaggcatcgctaggcttgattcgcaaacatctgcatatcaccggagcccgtgttcaggcagagctgaacggaaaatcatgcctctcactcgaaatggtgaggccagcaaaacagagcatatgcacctcacgttcatttggccgcagtgtcaccacttttgatgaactgcatcaggcagtctcaacctttaccggaaaatgcgccatcaaactgcgcaaagagggatcagcagcatcccttctgacactctttatctgcacaagcccattcaatgctcctgaaaaaaaatactggggcaccagaaccgtcaccatgcctcaccacacccaggactccatcgtcctgattcgaacggcaggagcgcttcttgaatcactctttcgggcaggctacgaatacaaaaaagcaggagttattgtcagcagactgataccggcagcatcttccacggcaacacttccactctttccgcaggagttcccggttccggacgaccgccaaaaaaagctcatgacagtaatggacagcatcaaccagcgctatggcagcggttctatccaaatcgctgccgaaaactccgcaggatggaaaccccaccagaaactgctctctccgcgctacacgaccgcctggaaagaacttatcgaggtgagaaccttgcagtaa

SEQ ID NO: 66573 - protein, 426 aa, Pelodictyon phaeoclathratiforme BU-1
MFALVDCNNFYVSCERVFNPALRGRPVVVLSNNDGCFIARSEEAKAIGLAMGAPAFKNRELLKRHKVVVYSANFPLYGDMSSRVMTTLADLAPDLEIYSIDEAFLDMSGFQRYDLDHYARFIRKTVTQHTGIPVCIGIAPTKTLAKVANRLAKKNPCYAGVCLLNTDKEQRAALAITQVEDIWGIGRQWSKFLHTQNIHTALDLAEASLGLIRKHLHITGARVQAELNGKSCLSLEMVRPAKQSICTSRSFGRSVTTFDELHQAVSTFTGKCAIKLRKEGSAASLLTLFICTSPFNAPEKKYWGTRTVTMPHHTQDSIVLIRTAGALLESLFRAGYEYKKAGVIVSRLIPAASSTATLPLFPQEFPVPDDRQKKLMTVMDSINQRYGSGSIQIAAENSAGWKPHQKLLSPRYTTAWKELIEVRTLQ

SEQ ID NO: 66574 - DNA, 1275 bp, Prosthecochloris aestuarii DSM 271
  CDS (1)..(1275): transl_table=11
atgttcgctctggttgactgcaataatttttacgcttcgtgcgagcgggtgttcaatccggcgcttgtcgggcggccggtcgttgtgctgtcgaacaacgacgggtgcgttattgcccgttcagaggaggcgaaggtcctggggatcgggatgggcgccccggagttcaagtgccgcgaactgctgctgcgccacggggttgctgtcttttcatccaactatccgctctatggcgatatgtcttcgcgggtgatgacgacgctggcaggttttgcgccgtcgatcgaggtgtattcgatcgacgaatcttttctcgatctcagcggtttcgggcgctttgaccttgagcgctacgggagcgagatccgaaggacagtacggaggcataccggtattcctgtgggggtcgggattgccgcaaccaaaacgcttgccaagattgccaaccggattgccaagaagcacctggagtatgatggggtatgcgtgcttgagcgcgatgcggagattcagcgtgcgctgaagctgatcgcggttggtgatatctggggcgtcggacggcagtgggcgagtttcctgcagacgaacggtattggtacggcagctgattttgccgctgcatcgcccgcctggatcaggcagcatatgcatgtgaccggggcacgggttcaggctgagctgaacgggcactcatgtctggctctggaagcggtgaggccggtgaagaaaagcatctgcacctcccgctcgttcgggcggacggtgagatcgaaagaggatctgcgacaggcggtggcgacctttgccggacggtgcgctctcaagctgcgccgtgaaggtctccgaacttcgcttgttacggtctttgccgcaacgagccgtttcaatcacgagagcgagcgctactgggggacgagaactcttgctctgcaggagccgtcgcaggattccattgtcctgctcaacgccgcggagcagctgctcgatgcactctatcagcccggctatgagtaccggaaagcgggcgttctcctcgccggtctgaaccctgcagacgctcccggagcagcgctgtcactgtttcctgaagctccttgcactcgtgacgggcagcaccgtaaactcatgcagattatggacgccgtcaaccggcgttacggccacggcaccatccatctcgcagcagaagagaccgaagcatggaaacccctgcagaaacggctttcgccacgttacaccacccggtggtcggagattctggaggttcatagctga

SEQ ID NO: 66575 - protein, 424 aa, Prosthecochloris aestuarii DSM 271
MFALVDCNNFYASCERVFNPALVGRPVVVLSNNDGCVIARSEEAKVLGIGMGAPEFKCRELLLRHGVAVFSSNYPLYGDMSSRVMTTLAGFAPSIEVYSIDESFLDLSGFGRFDLERYGSEIRRTVRRHTGIPVGVGIAATKTLAKIANRIAKKHLEYDGVCVLERDAEIQRALKLIAVGDIWGVGRQWASFLQTNGIGTAADFAAASPAWIRQHMHVTGARVQAELNGHSCLALEAVRPVKKSICTSRSFGRTVRSKEDLRQAVATFAGRCALKLRREGLRTSLVTVFAATSRFNHESERYWGTRTLALQEPSQDSIVLLNAAEQLLDALYQPGYEYRKAGVLLAGLNPADAPGAALSLFPEAPCTRDGQHRKLMQIMDAVNRRYGHGTIHLAAEETEAWKPLQKRLSPRYTTRWSEILEVHS

SEQ ID NO: 66576 - DNA, 1278 bp, Prosthecochloris aestuarii DSM 271
  CDS (1)..(1278): transl_table=11
atgtttgccctggttgactgcaacaatttctacgtttcctgtgaacgggtgttcaatccgtcactgaacggccggccggtcgttgttctgtcgaacaatgacggatgcattatcgcgcgttcgaatgaggccaaagctctcggcatcgcgatgggaacacctgaattcaggtgcaggaagctgctgaagcagaacaacgttgctgtcttctcctccaattatccgctgtacggtgacatgtcttcccgggtgatgttgactttggctgagtttacgccggccatcgaggtctactccatcgatgaatccttcctcgatctcagtggattcaaccgcttcgatctgaaagactattgccaggatatccgcaaaacggcgggtcgttttaccggcatcccggtcagtatcggcatcggtccgaccaagaccctcgccaagattgccaaccgttttgccaagaagtacagtgggtttgaaggcgtgtgcatacttcagaaaaaggaggacatccgcaaagcgctggaacagacagctgtcggggatatctggggtatcgggagacagtggagccggctgctgcaggtgggaaggatcctttccgctgaacagtttgcatcgacatcgccggtatgggtccgtcgtcatcttcacgtgaccggtgccaggatccaggcggaactgaacgggcattcctgcctgcctctcgaggaggtcaggccggcaaaacagagtatctgtacatcccgttcatttggcagaagtgttaacagtgagcccgaactggaacaggctgtcgccacattctccggaagatgcgcccggaagcttcgtaaggaagggttgtgtgcgtccctcatcactgtgtttgcgggcacaagtccgtttgatccggctgctcagcggtactgggggtcccgaactgcagccctgactgtgccatcgcaggattcaataacgctgggaaaggcagcaagggctgtattggcgtcagtttatcagcctgattacggatacagaaaagcaggtgtgatggtaagcggtatggtgccggcagatcaggcgggaggaaaagagctgtccctttttgatgagcaggacactctgcaggatgataagacccggaagctaatgaaggctatggatgctctcaatgagcagtatggccagggaacggtgtatcttgcatcggaaaatgccgatgcctggaaaccgcatcaggagtggctgtcgccttgttatactacccgatggtcggatatcatagaggtgaatgcgtaa

SEQ ID NO: 66577 - protein, 425 aa, Prosthecochloris aestuarii DSM 271
MFALVDCNNFYVSCERVFNPSLNGRPVVVLSNNDGCIIARSNEAKALGIAMGTPEFRCRKLLKQNNVAVFSSNYPLYGDMSSRVMLTLAEFTPAIEVYSIDESFLDLSGFNRFDLKDYCQDIRKTAGRFTGIPVSIGIGPTKTLAKIANRFAKKYSGFEGVCILQKKEDIRKALEQTAVGDIWGIGRQWSRLLQVGRILSAEQFASTSPVWVRRHLHVTGARIQAELNGHSCLPLEEVRPAKQSICTSRSFGRSVNSEPELEQAVATFSGRCARKLRKEGLCASLITVFAGTSPFDPAAQRYWGSRTAALTVPSQDSITLGKAARAVLASVYQPDYGYRKAGVMVSGMVPADQAGGKELSLFDEQDTLQDDKTRKLMKAMDALNEQYGQGTVYLASENADAWKPHQEWLSPCYTTRWSDIIEVNA

SEQ ID NO: 66578 - DNA, 1266 bp, Magnetococcus sp. MC-1
  CDS (1)..(1266): transl_table=11
atgagctatgcgctggtggattgcaacaatttttatgcctcctgcgagcgcctttttcaaccgcacctggagggcaagccggtcgttgtgctctccaataacgatggctgcgccatcgcccgctccaacgaagccaaacagctgggcattgccatgggggcccccctgcatcagatccaggcactcatcaagcagcaccaagtggcgctcttctcctccaactatcccctctatggggatctctccgcccgcgtcatgcgcaccctggaacagttggcaccgcgcgttgaaatctactccattgacgaagcctttttagatctccaaggcatgcctgcgccccaacgccaaatcctcggcagaacgatccatcaacaggttaaacgctggacgggtatccctgtttcggtgggcattggccccaccaaaaccctggctaaagtggccaaccgtttcgccaaaaaatcgcccaagaccgagggtgtactggaccttagcgacccccaatggtgccgcaaggcgctacaccagctccccgttggcgaggtgtggggggtggggccgcgctgggccaaacggcttaaccaagcaggtattgataccgccctacagcttagccgcatgcccccacccttggcacgccaacagtttaatgtggtgctggaacgcaccgtgcgagagctgcgtggtgaatcggttatcccctttgcggcgctgcctgccgcccgtcaatccatcgccaccacccgcacctttggtcaaaaaatccatacgcatgacgaaattaaagaggcgatctccagctttaccgtacgcgccgctgaaaaattgcggaagcaggggttgctggccgccgccctgcacctgtttatcaccaccaaccgttttagcgagcaggacctccagtataaaaacagcctcacctggagcttccaacaaccccaggatgacaccctaaccctgctgaccggggcacacgccgcgctggatgccatctaccggcccggctaccgctaccaaaaggccggggtgatcctgttggggctggtttcggcccagcattttcaaccttccctgtttgcgcccccacccaggctgcccaacagtcgcgccctgatgcgcaccctcgacggccttaaccaaaagatggggcgcggtaccgtgcgttttggtgccgaaggcccccccaagccctcctggggcatgcgccagttgcagagatctcccgcctacaccacccgctggagcgatctaccccaagtttag

SEQ ID NO: 66579 - protein, 421 aa, Magnetococcus sp. MC-1
MSYALVDCNNFYASCERLFQPHLEGKPVVVLSNNDGCAIARSNEAKQLGIAMGAPLHQIQALIKQHQVALFSSNYPLYGDLSARVMRTLEQLAPRVEIYSIDEAFLDLQGMPAPQRQILGRTIHQQVKRWTGIPVSVGIGPTKTLAKVANRFAKKSPKTEGVLDLSDPQWCRKALHQLPVGEVWGVGPRWAKRLNQAGIDTALQLSRMPPPLARQQFNVVLERTVRELRGESVIPFAALPAARQSIATTRTFGQKIHTHDEIKEAISSFTVRAAEKLRKQGLLAAALHLFITTNRFSEQDLQYKNSLTWSFQQPQDDTLTLLTGAHAALDAIYRPGYRYQKAGVILLGLVSAQHFQPSLFAPPPRLPNSRALMRTLDGLNQKMGRGTVRFGAEGPPKPSWGMRQLQRSPAYTTRWSDLPQV

SEQ ID NO: 66580 - DNA, 1257 bp, Shewanella denitrificans OS-217
  CDS (1)..(1257): transl_table=11
atgtttgcccttgttgatgctaactcattctactgcagcgcggagcaagtgttccgccctgactggcgtggtaagcccattatcgtgttaagtaataatgatggctgtattgtggctgctaatcgtcaggccaaggcacttggtatccctaaattttcaccttactttaaagttaaaaacctctgcattaagcaaggcgtgatcgcttgctctagtaactatgagctctatgccgacttatcgagcaagatgatgagtattattggccgctttgctcctgaacaacatgtgtattccatagatgaaagcttcttatcttttgcccattgctatcccgctattaaatgcctgcagacacaaggccagttaattcgccgcgcggtctggaaagaggtacgccttccagtctgtgttggtatagcagcgacgctcacactggctaaaattgctaaccacgcggcaaagaagattgagggttatcaaggtgtatgtgtaatcaataccgaccatgagcgagtagctattctaaaacaactttcgacagaggacgtgtgggggattggtcgcagaataagcaaaaagcttgagttaatgaacatcaaaactgcgttcgaccttgctaatatgccggcaggcttagccagaaaacaattcagcatagagatagagcgtaccgttcgtgagttaaatggccaggcatgtaaggtttgggatgaagcaagagctgataagaagcagatattcagcactcgaagcgttggcgaacggatcaccgattataactcactgcttcaagctttaagtaagcatgtgggtatcgcagccgccaaggctcgttctcaaggttcaagttgtaagactatgatgttatttgctagtaactcgccctttgatgagcagtctagaagcttcaaagccatagttcattttgcaagcccaaccaactgcagcgctgaaataactaaagccatgacacaggccgccacacagctgttccgtgaaggcgttcgttactacaaaattggggttgggttaatcgacttagcaagtgataaacacaggcaacttgatttattcagttcatccagagccaacccctcattgatgttggttttagataatctgaatcaacgctatggccgtgataccttatttcttgtggctcaaggcatagaacaaaagtggagcatgcgccgtgaactactcaccccccaatacaccacagactgggtaagcttacctcggataaagtgctag

SEQ ID NO: 66581 - protein, 418 aa, Shewanella denitrificans OS-217
MFALVDANSFYCSAEQVFRPDWRGKPIIVLSNNDGCIVAANRQAKALGIPKFSPYFKVKNLCIKQGVIACSSNYELYADLSSKMMSIIGRFAPEQHVYSIDESFLSFAHCYPAIKCLQTQGQLIRRAVWKEVRLPVCVGIAATLTLAKIANHAAKKIEGYQGVCVINTDHERVAILKQLSTEDVWGIGRRISKKLELMNIKTAFDLANMPAGLARKQFSIEIERTVRELNGQACKVWDEARADKKQIFSTRSVGERITDYNSLLQALSKHVGIAAAKARSQGSSCKTMMLFASNSPFDEQSRSFKAIVHFASPTNCSAEITKAMTQAATQLFREGVRYYKIGVGLIDLASDKHRQLDLFSSSRANPSLMLVLDNLNQRYGRDTLFLVAQGIEQKWSMRRELLTPQYTTDWVSLPRIKC

SEQ ID NO: 66582 - DNA, 1257 bp, Shewanella frigidimarina NCIMB 400
  CDS (1)..(1257): transl_table=11
atgtttgctctagttgacgcgaatagcttctattgcagtgcagaacaagtctttcgccctgattggcgtggtaagcctgttattgtgttgagtaacaacgatgggatgattgttgctgctaatcgtcaagctaaagaggctggaattgggaagtttctaccttactttcaagttaaagccttatgcgccaaacgtggtgttattgtctgttcctcaaactatgaactttatgctgacttatctagcaaaatgatggatatcattggccgctttgcccctgagcaacatgtctactctattgatgaaagcttcctctcttttaaaaactgctatcccgctatcaaatgcctccttacgcaaggccagttaatccgccgtgctgtgtggaaagaagcgcggctagcagtctgtgtgggtattggtgaaacgcttactctttctaaaatagccaaccatgcagctaagaagattgagggctacaaaggagtttgtttcattagtaatgagcaagagcgtatagctattttaaagcagcttgctgtaggggatgtatgggggataggccgccgaataagtaagaagcttgaattaatgaatatccgtactgcgtttcaacttgcgtctatgccgccgacactggcaagaaagcaatttagtattgaaatagaacgtaccgttcgtgagcttaacggccaagcctgtaaaatatgggatgagtcgagggcagataaaaagcagatattttcgactagaagcgtaggtgagcgcatcacagattattcgtcgttattacaagcattgagtaagcatgttgctatcgcagcgagtaaagcacgtaagcaaggttcaaactgcaagaccttgctgatttttgccagtaattcaccccatgatgaacggcctgtaagctataaagctattgtacattttccatgtccaaccaactgcactgttgagctaaccaaagctatgagtgaggccgcaccaaagctatttcgtgagttcgtacattattacaaaatcggtatagggcttatcgatttagctagcgaaaaacataaccaattcgatttatttaacccttcaaaggctaatcccgctttgatgaatacgctagatgacattaaccaacgctatggcagtgatacgatgtttctagcagctcaaggcatagagcacaagtggtcaatgcgccgtgatttgctaacgccacaatacacaaccaaatggttcagtgtacccagcattaagtgctaa

SEQ ID NO: 66583 - protein, 418 aa, Shewanella frigidimarina NCIMB 400
MFALVDANSFYCSAEQVFRPDWRGKPVIVLSNNDGMIVAANRQAKEAGIGKFLPYFQVKALCAKRGVIVCSSNYELYADLSSKMMDIIGRFAPEQHVYSIDESFLSFKNCYPAIKCLLTQGQLIRRAVWKEARLAVCVGIGETLTLSKIANHAAKKIEGYKGVCFISNEQERIAILKQLAVGDVWGIGRRISKKLELMNIRTAFQLASMPPTLARKQFSIEIERTVRELNGQACKIWDESRADKKQIFSTRSVGERITDYSSLLQALSKHVAIAASKARKQGSNCKTLLIFASNSPHDERPVSYKAIVHFPCPTNCTVELTKAMSEAAPKLFREFVHYYKIGIGLIDLASEKHNQFDLFNPSKANPALMNTLDDINQRYGSDTMFLAAQGIEHKWSMRRDLLTPQYTTKWFSVPSIKC

SEQ ID NO: 66584 - DNA, 1257 bp, Shewanella frigidimarina NCIMB 400
  CDS (1)..(1257): transl_table=11
atgtttgccttagtcgatgccaatgctttttattgcagtgcagaacaggtttttcgccctgactggcgcggcagacctattattgtgctgagcaataacgatggctgtattgttgctgctaatcggcaagcaaaagaggcgggtattgagaagtttttgccttactttcaagctaaagcattatgcgttcagcgcaatgtcattgtgtgctcatctaattatgaattgtatgccgatttatcggcaaagatgatggcaataataggtcgttttgcgccagaacaacatgtgtactccatcgatgaaagctttctgtcttttaaacattgttatcctgctatcaaatgcctgtatacccagggtcagttaattcgtcgcgcagtttggaaagaagcccgcctggcggtttgtgtgggcatggggcaaacgttaaccttagctaaaatagccaatcacgccgctaaaaaaatcccgggataccaaggagtgtgcgttatcgacactgcgcaactacgtaatgacattttacgccaacttgccgtaaaagaggtgtgggggattggcaggcgcatcagtaaaaagcttgaattgatgaatattcgcagcgcatacgatctcgcctctatgccacccagtttggccagaaaacaatttagtattgaaattgaacgcacggtacgcgaacttaacggcgaagtgtgtaaacaatgggatgaggctagggcagataaaaaacaaattttctccacccgcagtgtgggcgaacgtatttgtgattttgaatcgctattacaggcattgagtaaacatgttggcatcgcagcaagtaaagctcgtcaacaaggctcacattgtaaaaccatgttgttatttgccagtaattcgccccatgacgaacggcctgtgagttataaagttatcgtccattttccatgtccaaccaattgcaccattgaactcaccaaagccatgaccgacgccgccccgagattatttagcaatggtgttcgttattacaaaattggtgtaggcctagttgatttaaccagcgagaaacattttcaatttgatttatttaataccgcgaaggttaattatgccttaatggacacgcttgacggcatcaaccaacgatacggccgcgatacagtgtttttggctgcacaagggatacaacaaaaatgggccatgcgccgtgatttactcacacctcaatattcaacccaatggaaatgcttacctagcattaaatgctaa

SEQ ID NO: 66585 - protein, 418 aa, Shewanella frigidimarina NCIMB 400
MFALVDANAFYCSAEQVFRPDWRGRPIIVLSNNDGCIVAANRQAKEAGIEKFLPYFQAKALCVQRNVIVCSSNYELYADLSAKMMAIIGRFAPEQHVYSIDESFLSFKHCYPAIKCLYTQGQLIRRAVWKEARLAVCVGMGQTLTLAKIANHAAKKIPGYQGVCVIDTAQLRNDILRQLAVKEVWGIGRRISKKLELMNIRSAYDLASMPPSLARKQFSIEIERTVRELNGEVCKQWDEARADKKQIFSTRSVGERICDFESLLQALSKHVGIAASKARQQGSHCKTMLLFASNSPHDERPVSYKVIVHFPCPTNCTIELTKAMTDAAPRLFSNGVRYYKIGVGLVDLTSEKHFQFDLFNTAKVNYALMDTLDGINQRYGRDTVFLAAQGIQQKWAMRRDLLTPQYSTQWKCLPSIKC

SEQ ID NO: 66586 - DNA, 1296 bp, Nitrosomonas eutropha C71
  CDS (1)..(1296): transl_table=11
atgaagttatttgccttgatcgatggcaacaatttttattgtagttgtgaacgtgtgtttcaaccacaattacagaataagccacttatcgtattgtcaaataacgatggctgtgcaatcgcccgcagcgaacaagcaaaagcgctgggggttaaaatgggacatccatggttccaggttaaacacctggagaaatctgccggattgatttcactttccgccaatttcgcactgtacggcgatatgagcaatcgcatgatgagcctggcatccgagctgggcgattcccaggaaatctattccattgacgagtgtttccttggcttgcaaggcattccagatgtgactcaacgtgccaaagatacgcgcgccaagattctgcaatggatcggtattcctacatgcattggaataggcgcgagtaaaaccctggccaagcttgccaatcatattgccaaggatgcagaacgaaagcccggcagctaccctccccgtttggcgcaggtttgcaacctggttgaactcactgaacgccagagaatgtatctttttggtatcactgatattggtgaaatctggggaataggtaggcggatcggccagcagctcaaggacgctggtattaagacagtaaaagatttcgtagagcttgatcctggaacagttagaaaacgattcagtgtaacgctggaacgtacctggcgcgagttacacggccaaagctgcatcgatctggaagaaatcccggcaccaaagaaagaaattgcttacacccgtacttttggccagcctgtacgagatctcgtatcacttaccgaagcggttacagaattcacctcacgcgcggcagaaaagctgcgtagacaacaaagttttgcttcggcaattctggtattcatacataccagcaaacatcgcgccggcccgcaatatgctcgttcaatcactgtgccattggtacgccctgcatctgatactaatagcctgttatcggcggctatacgcggtctaagaacgatttacaagcctgggtatgattttataaaggctggtgtgattcttatggatctatccactacaacggttcagcagatcgagctggatttcggctcctcgatgtcaaacaaagccgatcagttaatgcaggcaattgaccagattaatagccagtttggaagagggacaatcatttacggcagcacaggtactggcaagaaaacatggtctatgagccagcagcgtaaaacgccttcctatactgcgaaaatcagagatatcccgattgctgtgggataa

SEQ ID NO: 66587 - protein, 431 aa, Nitrosomonas eutropha C71
MKLFALIDGNNFYCSCERVFQPQLQNKPLIVLSNNDGCAIARSEQAKALGVKMGHPWFQVKHLEKSAGLISLSANFALYGDMSNRMMSLASELGDSQEIYSIDECFLGLQGIPDVTQRAKDTRAKILQWIGIPTCIGIGASKTLAKLANHIAKDAERKPGSYPPRLAQVCNLVELTERQRMYLFGITDIGEIWGIGRRIGQQLKDAGIKTVKDFVELDPGTVRKRFSVTLERTWRELHGQSCIDLEEIPAPKKEIAYTRTFGQPVRDLVSLTEAVTEFTSRAAEKLRRQQSFASAILVFIHTSKHRAGPQYARSITVPLVRPASDTNSLLSAAIRGLRTIYKPGYDFIKAGVILMDLSTTTVQQIELDFGSSMSNKADQLMQAIDQINSQFGRGTIIYGSTGTGKKTWSMSQQRKTPSYTAKIRDIPIAVG

SEQ ID NO: 66588 - DNA, 1296 bp, Nitrosomonas eutropha C71
  CDS (1)..(1296): transl_table=11
atgtttgcgctgatcgacggcaataacttttactgctcgtgtgaacgaatttttcagcctcgtctgcaaaaagtacctttggttgtactgtctaataacgatggatgcgctattgcccgcagtgaagaagccaaggcgctgggtatcaaaatggggcaaccgtggtttcagatcaagcatctggagcaatcagccgggctggtttctctttcacccaattttccactctacggagacatgagcctgcgcatgatgcgcctggcttctgaactgggtgacaaacaggaaatttactcgattgacgagtgttttatcgggttacaggggatctccaatgtgacacacagggcaagtgagattcgcgccaaaattttgcagtggactggaataccaacctgtattggtatcggccacaccaaaacattggccaaactcgccaatcatattgccaaggatgcagacagaaagccaggcagctaccctacccggctggcacaagtttgcaatctggctgaattaaatgaacgtcaacgccagttccttttcgagatgacagatgtgggggaagtatggggcatcggcagacgcatcagtcagcagctcaaggaagcaggtattaaaacagtaaaagatttcgtagaacttgaccctggaaccgttagaaaacgtttcagcgttgtcctggaacgtacctggcgagaattgcgcggacaaagctgcattgaattggaggaagtaccgacaccaaagaaagaaattgcttatacccgcacatttggccagccagtgcacaatcttgcttccttgatagaagccgttacggagttcacttcacgggcagccgagaagctgcgcaagcaacaaagcaagacttcaaccattctggtatttattcataccagcaaacaccgttcaagaccgcaatatgcccgatcaatcaccgtgccgttggttcgtccagtatccgataccaaaaatttgataaatgctgctttacatggcctcaagaagatctataaaccaggattcgatctcaccaaagcgggcattgttttaatggatctgaccaacgctcaaaccagacaggcagagctggattttggtgagacagtacttgatagcgacgagcggttaatgcacgctattgatgagatcaatgaccgcttcggcagaggaacaatcatttatggcagtgctggagtgggcagcgaaaaaaaggtatggacgatgaaccagcagcgacgtaccccttcttatacaacgactcttggagaaattccaaccgccttaacctga

SEQ ID NO: 66589 - protein, 431 aa, Nitrosomonas eutropha C71
MFALIDGNNFYCSCERIFQPRLQKVPLVVLSNNDGCAIARSEEAKALGIKMGQPWFQIKHLEQSAGLVSLSPNFPLYGDMSLRMMRLASELGDKQEIYSIDECFIGLQGISNVTHRASEIRAKILQWTGIPTCIGIGHTKTLAKLANHIAKDADRKPGSYPTRLAQVCNLAELNERQRQFLFEMTDVGEVWGIGRRISQQLKEAGIKTVKDFVELDPGTVRKRFSVVLERTWRELRGQSCIELEEVPTPKKEIAYTRTFGQPVHNLASLIEAVTEFTSRAAEKLRKQQSKTSTILVFIHTSKHRSRPQYARSITVPLVRPVSDTKNLINAALHGLKKIYKPGFDLTKAGIVLMDLTNAQTRQAELDFGETVLDSDERLMHAIDEINDRFGRGTIIYGSAGVGSEKKVWTMNQQRRTPSYTTTLGEIPTALT

SEQ ID NO: 66590 - DNA, 525 bp, Rhodoferax ferrireducens DSM 15236
  CDS (1)..(525): transl_table=11
gtgtacgccctcgttgattgcaataatttttatgccagctgtgaacgcgtgtttcgccccagtttgcggggcatacctgtggtcgtgctcagcaacaacgatggcgcgtgcgtagcgcgcagcgatgaggctaaaaaccttggaatcaagatgggcgagccttggttcaaggtccgtcacctggcggagtcccatggattggtcgcgttgtccgccaactttgcactctacggcgacatcagcgatcgcgtgatgagtctggcggccgggctcggagtcaaaactgaaatctattccatcgacgaatgcttcgtcaccgtggatgggattccccggcgacctggtcgcgcgagcccacaaaattcgcgcacggatactccagtgggtcggaattccctgtgggataggcatcggaccgaccaaaaacgcttgcgaagctggccaatcatgtcgccaagagtgccgaaaggaagccaggcagctaccccgtgcacctggcccaggtgtgcgacctttctggactga

SEQ ID NO: 66591 - protein, 174 aa, Rhodoferax ferrireducens DSM 15236
MYALVDCNNFYASCERVFRPSLRGIPVVVLSNNDGACVARSDEAKNLGIKMGEPWFKVRHLAESHGLVALSANFALYGDISDRVMSLAAGLGVKTEIYSIDECFVTVDGIPRRPGRASPQNSRTDTPVGRNSLWDRHRTDQKRLRSWPIMSPRVPKGSQAATPCTWPRCATFLD

SEQ ID NO: 66592 - DNA, 1269 bp, Escherichia coli HS
  CDS (1)..(1269)
atgtttgctctctgtgatgtaaacgcgttttatgccagctgtgagacggtgtttcgccctgatttatggggtaaaccggtggttgtgctatcgaataatgacggttgcgttatcgcccgaaacgctgaggcaaaggcgctgggtgttaaaatgggcgatccctggttcaaacaaaaagatctgtttcgtcgctgtggtgtggtttgctttagcagcaattatgagctttacgcagacatgagcaatcgggtgatgtcgacgctggaagagctatcgccccgcgtcgagatttacagtattgatgaggcattctgcgatctgacaggtgtgcgtaattgtcgcgatctgactgattttggcagagaaattcgcgcaacggtgctacaacgtacccatcttactgttggcgtggggatcgcccagaccaaaacgctggctaagcttgccaatcatgcggcaaaaaaatggcagcggcagacgggtggggtggtggatttatcaaatctggaacgccagcgtaaattaatgtctgctctccccgtggatgacgtctgggggattggacggcggatcagcaaaaaactggacgcgatggggatcaaaaccgttctcgatttggcggatacagatatccggtttatccgtaaacattttaatgtcgtgctcgaaagaacggtgcgtgaactgcgcggcgaaccctgttttcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcggtttatctccacgtttattaagacgtcaccatttgcgctcaatgaaccttattacggcaatagcgcgtcggtaaaactgctgacgcccactcaggacagcagggatatcattaacgctgctacgcgatctctggatgccatctggcaagcgggccatcgttaccaaaaagcgggcgtgatgctgggggatttcttcagtcagggagtcgcgcagctcaatttattcgatgacaacgcaccgcgccccgggagtgagcaattgatgacggtaatggatacactgaatgctaaagagggcagaggaacactctattttgccgggcaggggatccagcaacaatggcagatgaagcgagccatgctttcaccacgttatacaacgcgaagttctgatttactgagggtcaaataa

SEQ ID NO: 66593 - protein, 422 aa, Escherichia coli HS
MFALCDVNAFYASCETVFRPDLWGKPVVVLSNNDGCVIARNAEAKALGVKMGDPWFKQKDLFRRCGVVCFSSNYELYADMSNRVMSTLEELSPRVEIYSIDEAFCDLTGVRNCRDLTDFGREIRATVLQRTHLTVGVGIAQTKTLAKLANHAAKKWQRQTGGVVDLSNLERQRKLMSALPVDDVWGIGRRISKKLDAMGIKTVLDLADTDIRFIRKHFNVVLERTVRELRGEPCFQLEEFAPTKQEIICSRSFGERITDYPSMRQAICSYAARAAEKLRSEHQYCRFISTFIKTSPFALNEPYYGNSASVKLLTPTQDSRDIINAATRSLDAIWQAGHRYQKAGVMLGDFFSQGVAQLNLFDDNAPRPGSEQLMTVMDTLNAKEGRGTLYFAGQGIQQQWQMKRAMLSPRYTTRSSDLLRVK

SEQ ID NO: 66594 - DNA, 1041 bp, Escherichia coli B7A
  CDS (1)..(1041)
atgtttgcactggctgatatcaacagtttctacgcctcatgtgaaaaagttttccgcccggaccttcgcaacgaaccggtcatcgtactcagcaataacgatggctgtgtgatcgcgcgcagcccggaggcaaaagctcttggcatcagaatggggcagccctggtttcaggtgagacagatgcgcctggagaagaaaatacatgtattttccagcaattatgcgctgtaccacagcatgagccaacgggtcatggctgttctggagtcgctttctcccgcagttgagccctactcaattgatgaaatgtttattgatttgcgggggataaatcattgcatctctccggagttttttggtcatcagctcagggaacaggtaaagagctggacaggactcaccatgggggtgggcattgcgcctacaaaaacgctggctaaaagtgcacagtgggcaacaaagcaatggccacagttttccggtgtggtcgcgctgacggcagaaaaccgtaatcggatcttgaagctactgggactgcagccagttggtgaggtctggggagtaggacgcagactgacggaaaagctgaatgcgctgggtattaacacagcactgcagctggcgcaggctaacacggcattcatccggaaaaacttcagcgtcattcttgagcgtacggtacgcgaactcaacggcgagtcctgcatatccctggaagaagcaccaccggcaaaacagcagattgtctgtagtcgcagttttggtgaacgaatcacagacaaagatgccatgcaccaggctgttgttcagtatgcagagcgggccgcagagaaactacgtggggagcgtcagtattgccggcaggtgacgacatttgtacggacatccccctttgcagtaaaagaaccctgttacagcaatgccgctgtggaaaagcttccattgcccacacaggacagccgggacattattgccgccgcatgcagagccttaaaccatgtctggcgtgaaggtgtcagcgccaatgatataagacagtaa

SEQ ID NO: 66595 - protein, 346 aa, Escherichia coli B7A
MFALADINSFYASCEKVFRPDLRNEPVIVLSNNDGCVIARSPEAKALGIRMGQPWFQVRQMRLEKKIHVFSSNYALYHSMSQRVMAVLESLSPAVEPYSIDEMFIDLRGINHCISPEFFGHQLREQVKSWTGLTMGVGIAPTKTLAKSAQWATKQWPQFSGVVALTAENRNRILKLLGLQPVGEVWGVGRRLTEKLNALGINTALQLAQANTAFIRKNFSVILERTVRELNGESCISLEEAPPAKQQIVCSRSFGERITDKDAMHQAVVQYAERAAEKLRGERQYCRQVTTFVRTSPFAVKEPCYSNAAVEKLPLPTQDSRDIIAAACRALNHVWREGVSANDIRQ

SEQ ID NO: 66596 - DNA, 1269 bp, Escherichia coli E110019
  CDS (1)..(1269)
atgtttgctctctgtgatgtaaacgcgttttatgccagctgtgagacggtgtttcgccctgatttatggggtaaaccggtggttgtgctatcgaataatgacggttgcgttatcgcccgaaacgctgaggcaaaggcgctgggtgttaaaatgggcgatccctggttcaaacaaaaagatctgtttcgtcgctgtggtgtggtttgctttagcagcaattatgagctttacgcagacatgagcaatcgggtgatgtcgacgctggaagaactatcgccccgcgtcgagatttacagtattgatgaggcattctgcgatctgacaggtgtgcgtaattgtcgcgatctgactgattttggcagagaaattcgcgcaacggtgctacaacgtacccatcttactgttggtgtggggatcgcccagaccaaaacgctggctaagcttgccaatcatgcggcaaaaaaatggcagcggcagacggggggggtggtggatttatcaaatctggaacgccagcgtaaattaatgtctgctctccccgtggatgaagtctgggggattggacggcggatcagcaaaaaactggacgcgatggggatcaaaaccgttcttgatttggcggatacagatatccggtttatccgtaaacattttaatgtcgtgctcgaaagaacggtgcgtgaactgcgcggcgaaccctgtttgcaactggaagagtttgcaccgacgaagcaggaaattatctgttcccgctcgtttggtgaacgcatcacggattatccatcgatgcggcaggccatttgtagttacgctgcccgggcggcggaaaaacttcgcagcgagcatcaatattgtcggtttatctccacatttattaagacgtcaccatttgcgctcaatgaaccttattacggcaatagcgcgtcggtaaaactgctgacgcccactcaggacagcagggatatcattaacgctgctacgcgatctctggatgccatctggcaagcgggccatcgctaccaaaaagcgggcgtgatgctgggggatttcttcagtcagggagtcgcgcagctcaatttattcgatgacaacgcaccgcgccccgggagtgagcaattgatgacggtaatggatacactgaatgctaaagagggcagaggaacactctattttgccgggcaggggatccagcaacaatggcagatgaagcgtgccatgctttcaccacgttatacaacgcgaagttctgatttactgcgggtcaaataa

SEQ ID NO: 66597 - protein, 422 aa, Escherichia coli E110019
MFALCDVNAFYASCETVFRPDLWGKPVVVLSNNDGCVIARNAEAKALGVKMGDPWFKQKDLFRRCGVVCFSSNYELYADMSNRVMSTLEELSPRVEIYSIDEAFCDLTGVRNCRDLTDFGREIRATVLQRTHLTVGVGIAQTKTLAKLANHAAKKWQRQTGGVVDLSNLERQRKLMSALPVDEVWGIGRRISKKLDAMGIKTVLDLADTDIRFIRKHFNVVLERTVRELRGEPCLQLEEFAPTKQEIICSRSFGERITDYPSMRQAICSYAARAAEKLRSEHQYCRFISTFIKTSPFALNEPYYGNSASVKLLTPTQDSRDIINAATRSLDAIWQAGHRYQKAGVMLGDFFSQGVAQLNLFDDNAPRPGSEQLMTVMDTLNAKEGRGTLYFAGQGIQQQWQMKRAMLSPRYTTRSSDLLRVK

SEQ ID NO: 66598 - DNA, 993 bp, Escherichia coli F11
  CDS (1)..(993)
atgtttgcactggctgatatcaacagtttctacgcctcatgtgaaaaagttttccgcccggaccttcgcaacgaaccggtcatcgtactcagcaataacgatggctgtgtgatcgcgcgcagcccggaggcaaaagcccttggcatcagaatggggcagccctggtttcaggtgagacaaatgcgcctggagaagaaaatacatgtattttccagcaattatgcgctgtaccacagcatgagccaacgggttatggctgttctggagtcgctttctcccgcagttgagccctactcaattgatgaaatgttcattgatttgcgggggataaatcattgcatctctccggagttttttggtcatcagctcagggaacaggtaaagagctggacaggactcaccatgggggtgggcattgcgcctacaaaaacgctggctaaaagtgcacagtgggcaacaaagcaatggccacagttttccggtgtggtcgcgctgacggcagaaaaccgtaatcggatcttgaagctactggggctgcagccagttggtgaggtctggggagtaggacgcagactgacggaaaagctgaatgcgctgggtattaacacagcactgcaactggcgcaggctaacacggcattcatccggaaaaacttcagcgtcattcttgagcgtacggtacgcgaactcaacggcgagtccagcatatccctggaagaagtaccaccggcaaaacagcagattgtctgtagtcgcagttttggtgaacgaatcacagacaaagatgccatgcaccaggctgttgttcagtatgcagagcgggccgcagagaaactacgtggggagcgtcagtattgtcggcaggtgacgacatttgtacggacatccccctttgcagtaaaagaaccctgttacagcaatgccgctgtggaaaagctttcattgccacacaggacagccgggacattattgccgccgcatgcagagtcttaa

SEQ ID NO: 66599 - protein, 330 aa, Escherichia coli F11
MFALADINSFYASCEKVFRPDLRNEPVIVLSNNDGCVIARSPEAKALGIRMGQPWFQVRQMRLEKKIHVFSSNYALYHSMSQRVMAVLESLSPAVEPYSIDEMFIDLRGINHCISPEFFGHQLREQVKSWTGLTMGVGIAPTKTLAKSAQWATKQWPQFSGVVALTAENRNRILKLLGLQPVGEVWGVGRRLTEKLNALGINTALQLAQANTAFIRKNFSVILERTVRELNGESSISLEEVPPAKQQIVCSRSFGERITDKDAMHQAVVQYAERAAEKLRGERQYCRQVTTFVRTSPFAVKEPCYSNAAVEKLSLPHRTAGTLLPPHAES

SEQ ID NO: 66600 - DNA, 1269 bp, Escherichia coli F11
  CDS (1)..(1269)
atgtttgccctctgtgatgtaaacgcgttttatgccagctgtgagacggtgtttcgccctgatttatggggtaaaccggtggttgtgctatcgaataatgacggttgcgttatcgcccgaaacgctgaggcaaaggcgctgggcgttaaaatgggcgatctctggttcaaacaaaaagatctgtttcgtcgctgtggcgtggtttgctttagcagcaattatgagctttacgcagacatgagtaatcgggtgatgtcgacgctggaagaactatcgccccgcgtcgagatttacagtattgatgaggcattctgcgatctgacaggtgtgcataattgtcgcgatctgactgattttggcagagaaattcgcgcaatggtgctacaacgtacccatcttactgttggtgtggggatcgcccagaccaaaacgctggctaagcttgccaatcatgcggcaaaaaaatggcagcggcagacgggcggggtggtggatttatcaaatctggaacgccagcgtaaattaatgtctgctctccccgtggatgaagtctgggggattggacggcggatcagcaaaaaactggacgcgatggggatcaaaaccgttctcgatttggcggattcagatatccggtttatccgtaaacattttaatgtcgtgctcgaaagaacggtgcgtgaactgcgcggtgaaccctgtttgcaactggaagagtttgcaccgacgaagcaggaaattatctgttcccgctcgtttggtgaacgcatcacggattatccgtcgatgcggcaggccatttgtagttacgctgcccgggcggcggaaaaacttcgcagcgagcatcaatattgtcggtttatctccacgtttattaagacgtcaccatttgcgttcaatgaaccttattacggcaatagcgcatcggtaaaactgctgacgcccactcaggacagcagggatatcattaacgccgctacgcgatctctggatgccatctggcaagcgggccatcgctaccaaaaagcgggcgtgatgctgggggatttcttcagtcagggagtcgcgcagctcaatttattcgatgacaacgcaccgcgccccgggagtgagcaattgatggcggtaatggatacgctgaatgctaaagagggcagaggaacactctattttgccgggcaggggatccagcaacaatggcagatgaagcgtgccatgctttcaccatgttatacaacgcgaagttctgatttactgcgggtcaaataa

SEQ ID NO: 66601 - protein, 422 aa, Escherichia coli F11
MFALCDVNAFYASCETVFRPDLWGKPVVVLSNNDGCVIARNAEAKALGVKMGDLWFKQKDLFRRCGVVCFSSNYELYADMSNRVMSTLEELSPRVEIYSIDEAFCDLTGVHNCRDLTDFGREIRAMVLQRTHLTVGVGIAQTKTLAKLANHAAKKWQRQTGGVVDLSNLERQRKLMSALPVDEVWGIGRRISKKLDAMGIKTVLDLADSDIRFIRKHFNVVLERTVRELRGEPCLQLEEFAPTKQEIICSRSFGERITDYPSMRQAICSYAARAAEKLRSEHQYCRFISTFIKTSPFAFNEPYYGNSASVKLLTPTQDSRDIINAATRSLDAIWQAGHRYQKAGVMLGDFFSQGVAQLNLFDDNAPRPGSEQLMAVMDTLNAKEGRGTLYFAGQGIQQQWQMKRAMLSPCYTTRSSDLLRVK

SEQ ID NO: 66602 - DNA, 1275 bp, Escherichia coli E22
  CDS (1)..(1275)
atgtttgcactggctgatatcaacagtttctacgcctcatgtgaaaaagttttccgcccggaccttcgcaacgaaccggtcatcgtactcagcaataacgatggctgtgtgatcgcgcgcagcccggaggcaaaagcccttggcatcagaatggggcagccctggtttcaggtgagacagatgcgcctggagaagaaaatacatgtattttccagcaattatgcgctgtaccacagcatgagccaacgggttatggctgttctggagtcgctttctcccgcagttgagccctactcaattgatgaaatgttcattgatttgcgggggataaatcattgcatctctccggagttttttggtcatcagctcagggaacaggtaaagagctggacaggactcaccatgggggtgggcattgcgcctacaaaaacgctggcaaaaagtgcacagtgggcaacaaagcaatggccacagttttccggtgtggtcgcgctgacggcagaaaaccgtaatcggatcttgaagctactggggctgcagccagttggtgaggtctggggagtaggacgcagactgacggaaaagctgaatgcactgggtattaacacagcactgcagctggcgcaggctaacacggcattcatccggaaaaacttcagcgtcattcttgagcgtacggtacgcgaactcaacggcgagtcctgcatatccctggaagaagcaccaccggcaaaacagcagattgtctgtagtcgcagttttggtgaacgaatcacagacaaagatgccatgcaccaggctgttgttcagtatgcagagcgggccgcagagaaactacgtggggagcgtcagtattgccggcaggtgacgacatttgtacggacatcaccctttgcagtaaaagaaccctgttacagcaatgccgctgtggaaaagcttccattgcccacacaggacagccgggacattattgccgccgcatgcagagccttaaaccatgtctggcgtgaagggtaccgctatatgaaggcaggtgtcatgctggctgatttcacaccatcgggtatagcgcagccgggattatttgatgagatccagccccgtaaaaacagcgaaaagttaatgaaaacactcgatgaactgaaccagtctggaaaagggaaagtgtggtttgcggggcgaggaaccgcccctgaatggcaaatgaaacgggaaatgttgagtcagtgttatacaactaaatggcgagatattcccctggccaggctgggttag

SEQ ID NO: 66603 - protein, 424 aa, Escherichia coli E22
MFALADINSFYASCEKVFRPDLRNEPVIVLSNNDGCVIARSPEAKALGIRMGQPWFQVRQMRLEKKIHVFSSNYALYHSMSQRVMAVLESLSPAVEPYSIDEMFIDLRGINHCISPEFFGHQLREQVKSWTGLTMGVGIAPTKTLAKSAQWATKQWPQFSGVVALTAENRNRILKLLGLQPVGEVWGVGRRLTEKLNALGINTALQLAQANTAFIRKNFSVILERTVRELNGESCISLEEAPPAKQQIVCSRSFGERITDKDAMHQAVVQYAERAAEKLRGERQYCRQVTTFVRTSPFAVKEPCYSNAAVEKLPLPTQDSRDIIAAACRALNHVWREGYRYMKAGVMLADFTPSGIAQPGLFDEIQPRKNSEKLMKTLDELNQSGKGKVWFAGRGTAPEWQMKREMLSQCYTTKWRDIPLARLG

SEQ ID NO: 66604 - DNA, 1257 bp, Vibrio cholerae RC385
  CDS (1)..(1257)
atgtttgctttagttgatgctaactcgttttactgtagtgctgaacaagtctttcgtccggattggcgaggaaagcccatcatagtgttatcaaacaatgatggttgcgttgtggccgcgaaccgccaagcaaaggaagcgggtgttgagaagtttaaaccctactttcaggttaaagcgctttgtgagcaaaaaggcgttattgcactttcatcaaactatgagttgtatgccgacttatcgtcaaagatgatgcaggtgatcgggagattcgcgcccgagcaacacatatacagtattgatgagtcgtttttatcttttgagcaagtttatcctgctatctcgtgttttagaaaattaggaatggaactcagacgcacagtatggcgtgagtgccgtcttcctgtaagtgttggctttgggagtacattaacactcgcgaaagtggctaaccatgccgcaaaaaaattggatgcttatcagggtgtttgtgtacttgataatgaaaaagagcgtcaaatagtgttatctcaattacgagcagttgatgtgtggggcatcggccgtaaacttggacagcgcctacagctaatgggcattaaaaccgctttacaactggctaactatcctcccgccctcattaggaaagagtttaacgttgaggttgaacgtaccgttcgtgagctgaatggacaaaaatgcaaaggatgggatgtagctcgagccgataagaaacaaattttttctacgcgtagtgcagggcagcgaatcacagatattgagtcgttgaagcaagccttgtgtaaacatgccaatattgcctcttataaggcccgtcaacaaaaatcactctgccgagtcatgctctgttttgcaaatagctctccgtttgacgagtattcggttgtacgtagagcgattcatagatttgcttatccgacatctgatgtgacgcaattgacccagattgcctctttactggctgagcaattgtttcaggaggatattcggttttataagattggcgtgggtttgcttgaccttgttgatggacaacatgaacaagcagatttattcaatcctaatccgaacaaccctgcgttgatgcatgtctacgataccctaaatgaccggtatgggagtgataccctttttttggcggcgcagggtatcactcagaaatgggcaatgcggcgtgatatgttgaccccgcagtacaccacgcgttggcaagatttacccaaaatcaaatgctga

SEQ ID NO: 66605 - protein, 418 aa, Vibrio cholerae RC385
MFALVDANSFYCSAEQVFRPDWRGKPIIVLSNNDGCVVAANRQAKEAGVEKFKPYFQVKALCEQKGVIALSSNYELYADLSSKMMQVIGRFAPEQHIYSIDESFLSFEQVYPAISCFRKLGMELRRTVWRECRLPVSVGFGSTLTLAKVANHAAKKLDAYQGVCVLDNEKERQIVLSQLRAVDVWGIGRKLGQRLQLMGIKTALQLANYPPALIRKEFNVEVERTVRELNGQKCKGWDVARADKKQIFSTRSAGQRITDIESLKQALCKHANIASYKARQQKSLCRVMLCFANSSPFDEYSVVRRAIHRFAYPTSDVTQLTQIASLLAEQLFQEDIRFYKIGVGLLDLVDGQHEQADLFNPNPNNPALMHVYDTLNDRYGSDTLFLAAQGITQKWAMRRDMLTPQYTTRWQDLPKIKC

SEQ ID NO: 66606 - DNA, 1266 bp, Pseudoalteromonas atlantica T6c
  CDS (1)..(1266): transl_table=11
atgttcgctctatgtgatgccaacagcatgtacgcgagttgcgaaaaagtgtttgatccaagtattcgcaataagccagtggtggtgttgaccaacaacgatggctgtatttgtgcagcgtgtggcattgccaaacgaatgggtgtcgggaagaagttcgtaccttattttcaggtcaaaaaagagctagaagcggcaggtgtcgttattcgctcaagtaattacgagctttatgccgacctgagtcaacgcatgatggatacgtgcgcgcgctttgcccctgacatcaatgtgtactctatcgatgaatgttttttatattatggtaaagacgcaactgcgccccaagatggttggaataaccttgctaacagtattcgaaaaaccgtgtggcgggaagtgaggttgcctatctgtgttggcatagggccgacgcctacattggctaaagtggccaatcacgcggctaaaaatgtgagtggttttatcggcgtggcagtgctggataacgaagatgcgcgtaagcatgtgctgaagcaactggctgtgactgacgtgtggggcataggaaaacgtttaggtgttaaattgaatgcgctggggatccacacagcgtgggagcttgcaaaccgtgacccgtcgcacatcagaaaggcgttttcgattatcgtggaaaacacggtgcgagagctaaatggcgagattcgtcactgctgggaaaccgtaagaggggccaaaaaagaaatatacagtacgcgcagttttggcagtcgcgtgactgattatgatgaattgcgagcggcgcttgctggtcatgctgaaactgtaagtgtgaaactgcgtaaacaaaaaagcgtgaccagtagtatgacgctttttgccactaattctccccatgataatggcgggtatgtgcggcgctctttctttcatcgcttcactgtgcccacaaatgacacgcgtaatatacttcatgtgattgacagtgcaatgtctcagctttttcaaccgggtgtacattattacaaatgtggtgtcgggttgatggacttacatgagcaggatttatatcagtatgatttatttaacccgtcgaatgacaactcaaggttgatggcatgtatggacaatattaactcgcgctacggacgttcaaccgtgcaaatggcggccaaaggctttgagcaacgtttttctatgaagcgggcgtttttgtccccgcagtacacgacgcagtggcgagatataccaaaaattaagtgctag

SEQ ID NO: 66607 - protein, 421 aa, Pseudoalteromonas atlantica T6c
MFALCDANSMYASCEKVFDPSIRNKPVVVLTNNDGCICAACGIAKRMGVGKKFVPYFQVKKELEAAGVVIRSSNYELYADLSQRMMDTCARFAPDINVYSIDECFLYYGKDATAPQDGWNNLANSIRKTVWREVRLPICVGIGPTPTLAKVANHAAKNVSGFIGVAVLDNEDARKHVLKQLAVTDVWGIGKRLGVKLNALGIHTAWELANRDPSHIRKAFSIIVENTVRELNGEIRHCWETVRGAKKEIYSTRSFGSRVTDYDELRAALAGHAETVSVKLRKQKSVTSSMTLFATNSPHDNGGYVRRSFFHRFTVPTNDTRNILHVIDSAMSQLFQPGVHYYKCGVGLMDLHEQDLYQYDLFNPSNDNSRLMACMDNINSRYGRSTVQMAAKGFEQRFSMKRAFLSPQYTTQWRDIPKIKC

SEQ ID NO: 66608 - DNA, 1293 bp, Marinobacter aquaeolei VT8
  CDS (1)..(1293): transl_table=11
atgcgctctgacatgaaacaggtgttcgctctttgtgacatgaacagcttttacgccagctgcgagcagttattcaatccagcgtttcgtggccggccggtcgtggtcgccagtaacaacgatggctgtgccgttgcacgatcaccggaggcgaaagcgctcggtataaagatgggccaacccatttttgagttgcgggagtacgtcgaaaagcacggcctgattgtttgctcatccaactatgcactctacggagatatgtcccatcgattcatgcttgccctggcggaatgcgcaccacgggtcatgccctacagtattgatgaagcctttcttgatctgaccggtatcgattccgttgtgtcgtatctggatttcggccaccacgtcaaagagctggtgcgaatatggacgggcttacctatctgtgtcggaatcgctccaagtccgacattggcaaaattagctaaccacgccgcaaaacactatcccgccacccggggtgtcgtggatctgactgaccgagaccggcaacgacgtcttatgcacctgacaccggtggaagaagtatggggaatcggcaggaaactgagcaaacgactggatgccctgggaataaagactgctctggatctagccgattccgatcctaaatggatacgagatcacttttcagtcgtggtcgagcgcaccgtcagggagctgaacggcataccatgtcattcagaccttctcgaagtagcaccagcaaagcagcagattctctgttcaaagtccttcggggcacccgtcaccgatctgaattccatgcttgccgcgattaccgctcacgcatcccgagcgtcggagaagctgcgtcgcgaaaaccgggattgcgggtatctagccgcgttcatgtcaacgagccggtttcgaaccggtagccactacgccaaccagcaagggattactctgccattcccgacctcagacacccgggaaatcgtacgacatgcggtcagtattgcccggtcgttgtggcgggaggggtaccggtacaacaaagcgggcattgtactgacagacttccgggtgcctggtgcttgccaatccgattttttcagccaggtcgaggacgacgagcgcaaccgaaagctgatgcggaccttagacaagatcaacagcatcgctggcaaaaacacgatccagtttggccggcagattcacaaaaaccaaagctggcaaatgcgaagagaaaatctttcgcctgcttacacgactcgatgggctgacatccccgtggcgatcagttaa

SEQ ID NO: 66609 - protein, 430 aa, Marinobacter aquaeolei VT8
MRSDMKQVFALCDMNSFYASCEQLFNPAFRGRPVVVASNNDGCAVARSPEAKALGIKMGQPIFELREYVEKHGLIVCSSNYALYGDMSHRFMLALAECAPRVMPYSIDEAFLDLTGIDSVVSYLDFGHHVKELVRIWTGLPICVGIAPSPTLAKLANHAAKHYPATRGVVDLTDRDRQRRLMHLTPVEEVWGIGRKLSKRLDALGIKTALDLADSDPKWIRDHFSVVVERTVRELNGIPCHSDLLEVAPAKQQILCSKSFGAPVTDLNSMLAAITAHASRASEKLRRENRDCGYLAAFMSTSRFRTGSHYANQQGITLPFPTSDTREIVRHAVSIARSLWREGYRYNKAGIVLTDFRVPGACQSDFFSQVEDDERNRKLMRTLDKINSIAGKNTIQFGRQIHKNQSWQMRRENLSPAYTTRWADIPVAIS

SEQ ID NO: 66610 - DNA, 1269 bp, Yersinia intermedia ATCC 29909
  CDS (1)..(1269)
atgtttgctctcgttgacgtgaactcattttatgccagttgtgaaacggtattcaggcctgatctgtatggtcgccctgtggtggtgttatccaataacgatggctgcgtgattgcccgtagccgggaggctaaggtcgtgggtattccaatgggggcaccctatttcaagatacagcaagttatccatcagcatcgtgtcgtcgcgtttagcagtaattacgcactctacagtgatatgtctgcacgggtcatgactattcttgaacaactggccccagggattgaaatttactcaatcgatgaagcatttctcaatattactggtgtgcagcattgcattacactggaagagtttggtcagggcgtgcgtgataaaatacgcaaattgactggcctaaatgtcggtgtaggcatcgcaccaagcaagactctcgccaagctggcaaaccatgctgctaagttatggcataaaacgggtggtgtagtcgatttgtccaatcccatacgtcaacgcaaattgctggcgctgatgccagcggcgcaggtatggggcgtgggccagcgtaccgcaaaaaagctggcagtgatggggataaccaccgcccttcaattatcagaggccagccccccgcttattcgcaaaaactttagcgtcgtactggaacggacagtgcgagaattgcgcggagaagcttgtctggcggtggctgaattcgcacctacaaaacaacaaataatctgttcgcgctcatttagtaaacacattacagaatatcaaagtatgcatgaagccgtttgtagctatgccgagaaagcagcagaaaagctacgcaaagagcaccaatactgttgccatgtatcaacttttatcaaaaccagcccttttgccagtaacgaggtctattacagtaacctcgccagcactcgcctcaactttccgaccttggactcaagggatattattgccgcagccctcaaatggctggcagcaatttggcgacccggtcaccattacctgaaagcaggtattatgttgggagatttttcaagtcagggtatcgcgcaattgggtctatttgatgagagcaaaccgcgcattaacagtgaatcattgatggcggctatcgacaaaattaatcaatccggtaaaagtaaaattgcgtttatcgggcaaggagttaatcaacaatggcagatgaaacgtgaaatgttatcacctgcatatactacccgaattcaagattgtcctattgcggttattcggtaa

SEQ ID NO: 66611 - protein, 422 aa, Yersinia intermedia ATCC 29909
MFALVDVNSFYASCETVFRPDLYGRPVVVLSNNDGCVIARSREAKVVGIPMGAPYFKIQQVIHQHRVVAFSSNYALYSDMSARVMTILEQLAPGIEIYSIDEAFLNITGVQHCITLEEFGQGVRDKIRKLTGLNVGVGIAPSKTLAKLANHAAKLWHKTGGVVDLSNPIRQRKLLALMPAAQVWGVGQRTAKKLAVMGITTALQLSEASPPLIRKNFSVVLERTVRELRGEACLAVAEFAPTKQQIICSRSFSKHITEYQSMHEAVCSYAEKAAEKLRKEHQYCCHVSTFIKTSPFASNEVYYSNLASTRLNFPTLDSRDIIAAALKWLAAIWRPGHHYLKAGIMLGDFSSQGIAQLGLFDESKPRINSESLMAAIDKINQSGKSKIAFIGQGVNQQWQMKREMLSPAYTTRIQDCPIAVIR

SEQ ID NO: 66612 - DNA, 1251 bp, Shewanella sp. ANA-3
  CDS (1)..(1251): transl_table=11
atgagcagcataatagcgttatgcgatgggaataagttttacagctcatgcgaacagatttttaacccgcagtatcgtggtaagcctctaattgtggtctcgaacaatgacggcatgacagtgacgttaagccctgaagcggctgcgttggggcttaaaaaattcacgccttactttcaagttgctgagttctgtagggcgaatggcgtggttgtttgctcgagcaattacgccttgtattcagaaatcagctctcagtttatgaaagtcgcatcgagagagtgtttttcgtattttccctattcgatagacgagatttttgctgaatttgggaatgatgacacaccacagaacctctcaatattaggccgcaagctcaggcacgatgtctggcgcgaggtccgattgcctattggtgtcgggctaggggataccttaacgctggcgaaagccgcaaatcatgcagcgaagcgcttaggctatcgcggtgtttgcgtgattaaagcgcacaatcgcgaagccatcttaggggcgatgttgactaccgatgtgtggggagtgggtaaacgaattggtcagcggctaagttcgatggggattcatactgcgctgcagttggcccaaatgaagactaagaccgcgaggaaaatgtttggcgttaacatcgaaagaacaattttcaaattgaatgggacaaaggcgtttaactgggacgatatgcccgttaataagcgacagatattctccacacgctcagttggccagcgaataacgacgatagaggggttaaaagaggcgttgtcattccatgcgtgtgaagcggctcgaaagctaaggggtcaaaaatcggtagcacgttgcttggtattttttgctcaaacatccgcgtatgacaagcatggtgttagtggtttcagtcggacaattcatttaccagcccccaccagtgacagcatgattatcagtcagcaaattacctctgcggttgagtcattttatgccgcagtgccgtactatcgcgttggggtagggctattagatatagaaccaggcttgcagctcgatatgttcaacgacaacctgggaaaaccagcgttgatgtcagtcatggacagattaaacgagcaaatgggcaaaggtgccgtgttcgtcgctgccaatggcattgagaaaaaatggcagatgcggcgagcgttcttgagtccatcttatctaacaaattggaatgaaattccaaccattcactgttag

SEQ ID NO: 66613 - protein, 416 aa, Shewanella sp. ANA-3
MSSIIALCDGNKFYSSCEQIFNPQYRGKPLIVVSNNDGMTVTLSPEAAALGLKKFTPYFQVAEFCRANGVVVCSSNYALYSEISSQFMKVASRECFSYFPYSIDEIFAEFGNDDTPQNLSILGRKLRHDVWREVRLPIGVGLGDTLTLAKAANHAAKRLGYRGVCVIKAHNREAILGAMLTTDVWGVGKRIGQRLSSMGIHTALQLAQMKTKTARKMFGVNIERTIFKLNGTKAFNWDDMPVNKRQIFSTRSVGQRITTIEGLKEALSFHACEAARKLRGQKSVARCLVFFAQTSAYDKHGVSGFSRTIHLPAPTSDSMIISQQITSAVESFYAAVPYYRVGVGLLDIEPGLQLDMFNDNLGKPALMSVMDRLNEQMGKGAVFVAANGIEKKWQMRRAFLSPSYLTNWNEIPTIHC

SEQ ID NO: 66614 - DNA, 1257 bp, Shewanella sp. ANA-3
  CDS (1)..(1257): transl_table=11
atgtacgccttagtcgatgccaactcgttttattgctccgctgagcaagtgttccgccccgattggcgcggcaaaccgattatcgtactaagcaataacgatggctgtatcgtggcagccaaccgtcaggccagagaactcggcatccccaaatttgcgccgtattttcatgtcaaagaacaatgcgccaaactgggggtaatagtgtgttctagcaactacgagctctatgccgatttgtcggcaaaaatgatggaaatcatcggccgcttcgctccagaccaacatatttactccattgatgaatcatttttatccttcaagcactgccacaccagcatcccctgcttaaaaacacacggcctgcgcatccgccaaaccgtttggaaagaagcgcgcatccccgtttgcgttggcataggtgcaacactcacactggctaaaatcgctaatcatgccgctaaaaaattacccggctatcatggtgtttgcctgatagataatgaacctcaacgaattgaaattcttaaacaactcttagtcagtgatgtatggggtattgggcgccgcctcagcaaaaaactggtgagtatgggcattcacaccgcttacgatctggcacaaatgccaacaggtcttgctcgcaagcaattcagcatagagatagagcgaaccgtccgagagcttaatggcacagcctgtaaacaatgggatcacacacgggcagataaacaacagatattttccactcgctccgtgggtgagcgcatcatggattttgaggcgttactacaagcattgagcaaacacgttgggattgcagcggcaaaagccagagcgcagggttcatgctgcaaatcgatgctgatttttgccaataactccccttacgatgaacaacccgttggttttaaatcccttatccatttccccactgcaaccaattgcaccattgagatgacgcaagcagcgtctttagcagcaccaagattatttcgaccaggagttaagtactacaagataggaataggcctgataaatctcgaacaaaataggtatcaacaactcgatttgttcaatttatctaaaactaaacccacactaatgaacgcatttgatggaataaatgcccgttatgggcgagataccttatttttagccgcacaaggcatagaacagaaatgggcaatgcgccgcgcattactcacaccacaatacaccacgctgtggggtggcatacctagagtaaaatgctag

SEQ ID NO: 66615 - protein, 418 aa, Shewanella sp. ANA-3
MYALVDANSFYCSAEQVFRPDWRGKPIIVLSNNDGCIVAANRQARELGIPKFAPYFHVKEQCAKLGVIVCSSNYELYADLSAKMMEIIGRFAPDQHIYSIDESFLSFKHCHTSIPCLKTHGLRIRQTVWKEARIPVCVGIGATLTLAKIANHAAKKLPGYHGVCLIDNEPQRIEILKQLLVSDVWGIGRRLSKKLVSMGIHTAYDLAQMPTGLARKQFSIEIERTVRELNGTACKQWDHTRADKQQIFSTRSVGERIMDFEALLQALSKHVGIAAAKARAQGSCCKSMLIFANNSPYDEQPVGFKSLIHFPTATNCTIEMTQAASLAAPRLFRPGVKYYKIGIGLINLEQNRYQQLDLFNLSKTKPTLMNAFDGINARYGRDTLFLAAQGIEQKWAMRRALLTPQYTTLWGGIPRVKC

SEQ ID NO: 66616 - DNA, 1257 bp, Shewanella sp. MR-7
  CDS (1)..(1257): transl_table=11
atgtacgccttagtcgatgccaactcgttttactgctcggctgagcaagtgttccgccccgattggcgcggtaaaccgattatcgtcctaagcaataacgatggctgtatcgtggcagccaaccgccaggccagagaacttggggtccccaaatttgcgccgtactttcatgtcaaagagcagtgcgccaaactaggggtgatagtgtgctcaagcaactacgagctttatgccgatttgtcagcaaaaatgatggaaatcatcggccgcttcgctcccgagcaacatatttactccattgatgaatcgtttttatccttcaagcactgccactccagcattcccagcttaaaaacgcaaggactgcgtatccgtcaaaccgtttggaaagaagctcgcttacccgtttgtgttggtataggtgcaacactcacattggctaaaatcgccaatcatgctgccaaaaaactacctggttatcatggcgtttgcctgattgataatgacccacaacggattgaaattctcaagcaactctcagtcggtgacgtgtggggaattggacgacggctcagcaaaaagctggcgagtatgggcattcagaccgcttacgaccttgcgcaaatgccagcaggccttgcacgcaagcaattcagcatagagatagagcgaacagtccgagaacttaatggcactgcctgtaaacaatgggaccacacacgggcggataaacaacagatattttccactcgctccgtgggtgagcgcatcatggattttgattcgttactacaggcattgagcaaacacgttggaattgcagcggcaaaagctagggcgcaaggttcgtgctgcaaatcgatgctgatttttgccaataactccccttacgacgaacaacccgtcggttttaaatcccttatccatttccccacggcaaccaattgcacgattgaaatgacgcaggcaatgtctttggctgccccaaaattatttcgaccaggaattaggtactacaagataggtgtaggcttgattaatctcgaacaggatagatatcagcaactcgatttgttcaatcgtcctaaaaccaaacccatactaatgaacgcactggatggaataaattcccgctatggacaagacaccttatttttggcagcacaaggcatagaacaaaaatgggcaatgcggcgggcattactaacgccacaatacaccactctgtggggcggcataccgagagtcaagtgctaa

SEQ ID NO: 66617 - protein, 418 aa, Shewanella sp. MR-7
MYALVDANSFYCSAEQVFRPDWRGKPIIVLSNNDGCIVAANRQARELGVPKFAPYFHVKEQCAKLGVIVCSSNYELYADLSAKMMEIIGRFAPEQHIYSIDESFLSFKHCHSSIPSLKTQGLRIRQTVWKEARLPVCVGIGATLTLAKIANHAAKKLPGYHGVCLIDNDPQRIEILKQLSVGDVWGIGRRLSKKLASMGIQTAYDLAQMPAGLARKQFSIEIERTVRELNGTACKQWDHTRADKQQIFSTRSVGERIMDFDSLLQALSKHVGIAAAKARAQGSCCKSMLIFANNSPYDEQPVGFKSLIHFPTATNCTIEMTQAMSLAAPKLFRPGIRYYKIGVGLINLEQDRYQQLDLFNRPKTKPILMNALDGINSRYGQDTLFLAAQGIEQKWAMRRALLTPQYTTLWGGIPRVKC

SEQ ID NO: 66618 - DNA, 1257 bp, Shewanella sp. MR-4
  CDS (1)..(1257): transl_table=11
atgtttgcgctagtcgatgccaacagcttttactgtagtgcggaacaagtattccggcctgattggcgtggtaagcctgttgttgtgctaagtaataatgatgggatgattgttgccgccaataggcaggctaaagaggcgggtattcagaagtttgtgccttactttcaagtcaaagcacaatgtgctgagcgtggtgtgattgcgtgttcatctaattatgaactgtatgctgacttgtctagcaagatgatggatatcattggccgctttgcgcctgagcagcatgtctatagcatcgatgaaacgttcctctcgtttaagaactgctatccagcaataaaatgcctccacacccaaggtcaattaataagacgcgctgtatggaaagaagctcgcttgccagtttgtgtgggaattgcggaaaccctgacgttggcaaaactggctaaccatgcagctaagaagattgagggttataaaggggtttgtgttattgacaatgaccaagaccgaaccgctattctaaagcagctagcagtaggtgatgtttggggaattgggcgcaggattagtgcaaagcttgaactgatgaatatccgtactgcatttgacctagcgaacatgccagcagggctagcccgtaaacagttcagcattgaagtcgagcggacagtacgagagcttaacggccaagcatgcaaggtgtgggatgaagcgagagctgataagaagcagatattctcgacaagaagcatgggtgagcgtatcactgattttgaatcgttactccaagcactgagcaagcatgtgggaattgcggctgctaaagcacgtaagcaaggctctgtttgcaagacgatgctgctatttgcgagtaactcaccccatgatgagcgccctgttagctataaaactgtggtgcacttcccttgtccgacgaactgtacgatagagctgactaaagcagtatgtgaagccgcacccaagctgtttcgtgaaggagtacgctattacaagataggcgtaggtttgattgatttagcgagcgagaaacacagccaattagacttgttcaatccaccgaccacaaagccgacgctaatgcttacactcgatcacattaaccaacgctacggtagtgatactctgtttgttgcagctcaaggcatagagcaaaaatgggcaatgcggagggaattactgacgccacaatatacgactaagtggcgaagtgtgccgtgtattaagtgctaa

SEQ ID NO: 66619 - protein, 418 aa, Shewanella sp. MR-4
MFALVDANSFYCSAEQVFRPDWRGKPVVVLSNNDGMIVAANRQAKEAGIQKFVPYFQVKAQCAERGVIACSSNYELYADLSSKMMDIIGRFAPEQHVYSIDETFLSFKNCYPAIKCLHTQGQLIRRAVWKEARLPVCVGIAETLTLAKLANHAAKKIEGYKGVCVIDNDQDRTAILKQLAVGDVWGIGRRISAKLELMNIRTAFDLANMPAGLARKQFSIEVERTVRELNGQACKVWDEARADKKQIFSTRSMGERITDFESLLQALSKHVGIAAAKARKQGSVCKTMLLFASNSPHDERPVSYKTVVHFPCPTNCTIELTKAVCEAAPKLFREGVRYYKIGVGLIDLASEKHSQLDLFNPPTTKPTLMLTLDHINQRYGSDTLFVAAQGIEQKWAMRRELLTPQYTTKWRSVPCIKC

SEQ ID NO: 66620 - DNA, 1266 bp, IncL
  CDS (1)..(1266): transl_table=11
gtgtacgccttaatcgatgtcaattcgatgtactgcagctgcgaagaagcgttccgccctgatttacgaggtcgcccagtggtcgttctcagcaacaacgacggggcgcttgttgcggtcaatcgcgcggcgaaagcgcttggcgtgcgccgcggggagccctatttccgctgccgccgcctgctggaacagcataacgttgccgtattcagttccaactacaccctttacgcctcattctccgccagatttgcaaccgtggtggagagtctggcgccgcggacatttgtttactcaattgatgagctctttgcggatgcctctcatatggagggagtgatgacgccgcaggcgtttggccagcttttgcgggctgaagtgctgcgccagacaacgctcacctgtggagtcggcgtcgcgccaacgaagacgctggccaagctgtgcaaccatgccgcaaagacgtggcctgctaccgggggggttgtggcgctcagtgatcctgtaagactgaaaaagctgatgagcctggtggcggccggcgatgtgtggggcgttggccatcgtaccgaaaaagggctggcggcaatggggatcaaaacggcgctggcgctcgcagagatggatatccgtcttgcacgccggctgtacggtgtgacgctggaaaggaccattcgtgagctgcgtggcgaggcctgctttgccctggaggaaggaaccggcgcgaaacagcagcttgttgtatcccgttcgtttggagcacgggtcacgcaactggcgcagatgcagcaggcggtgactaaatatgccacacgggcaggggaaaagttgcgccaggaaaaccgcctggcgaaggtggtaacggtctttatccgcagcagtgcttatgacgccggcggtgtgccctacagtaaccaggctacggaagtgcttcccgtgccaagccaggatacccgcgacatcatcgccgcggcgcagctgggactgtcgcgtatctggcgtgagggcgtgcggtatgcaaaagccggcgtgatgctcagcgatctgcagggatatgaaacccagctggatctgttttcgccggctgctgtgcggccgggcagcgaaaaactgatggccaccatcgacaaaataaacagggaaggaaggtcaaggatcttcttcgccggagaaggtattgatccggaatatgccatgcgccgtgaaatgttgtccccggcctacaccacgcagtggaaggatattcccgcggcgtttatgcgataa

SEQ ID NO: 66621 - protein, 421 aa, IncL
MYALIDVNSMYCSCEEAFRPDLRGRPVVVLSNNDGALVAVNRAAKALGVRRGEPYFRCRRLLEQHNVAVFSSNYTLYASFSARFATVVESLAPRTFVYSIDELFADASHMEGVMTPQAFGQLLRAEVLRQTTLTCGVGVAPTKTLAKLCNHAAKTWPATGGVVALSDPVRLKKLMSLVAAGDVWGVGHRTEKGLAAMGIKTALALAEMDIRLARRLYGVTLERTIRELRGEACFALEEGTGAKQQLVVSRSFGARVTQLAQMQQAVTKYATRAGEKLRQENRLAKVVTVFIRSSAYDAGGVPYSNQATEVLPVPSQDTRDIIAAAQLGLSRIWREGVRYAKAGVMLSDLQGYETQLDLFSPAAVRPGSEKLMATIDKINREGRSRIFFAGEGIDPEYAMRREMLSPAYTTQWKDIPAAFMR

SEQ ID NO: 66622 - DNA, 1266 bp, IncL
  CDS (1)..(1266): transl_table=11
gtgtacgccttaatcgatgtcaattcgatgtactgcagctgcgaagaagcgttccgccctgatttacgagggcgccctgtggtcgttctcagcaacaacgacggggcgcttgttgcggtcaatcgcgcggcgaaagcgctgggcgtgcgccgcggggagccctatttccgctgccgccgcctgctggaacagcataacgtcgccgtattcagttccaactacaccctttacgcctcattctccgcccgatttgcaaccgtagtggaaagtctggcgccgcggacgtttgtttactcaattgatgagctctttgctgatgcgtctcacatggagggcgtgatgtcgccgcaggcgtttggccagcttttgcgggctgaagtgctgcgccagacaacgctcacctgtggagtgggcgtcgcgccaacgaagacgctggccaagctgtgcaaccacgccgcaaagacgtggcctgccaccgggggggttgtggcgctcagtgatcctgtgagactgaaaaggctgatgagcctggtgtcggccggcgatgtgtggggggttggccatcgtaccgaaaaagggctggcgacaatggggatcaaaacggcgctggcgctcgcagagatggatatccgacttgcacgccggctgtacggtgtgacgctggaacggaccatccgtgagctgcgtggcgaggcctgctttgccctggaagaaggtaccggcgcgaaacagcagcttgttgtatcccgctcgtttggatcgcgggtcacgcaactggcgcagatgcagcaggcggtgactaaatatgccacacgggcaggggaaaagttgcgccaggaaaaccgtctggcgaaggtggtaacggtctttatccgcagcagtgcttatgacgccggcggtgtgccctacagtaaccaggctacggaagtgctttccgtgccaagccaggatacacgcgacatcatcgccgcggcgcagctggggctgtcgcgtatctggcgtgagggtgtgcggtatgcaaaagccggcgtgatgctcagcgatctgcagggacatgaaacccagctggatctgtttgcgccggctgcagtgcggccgggcagcgaaaaactgatggccaccatcgacaaaataaacagggaaggaaggtcaagggtcttcttcgccggggaaggtattgatccggaatatgccatgcgccgtgaaatgttgtctccggcctacaccacgcagtggaaggatattcccgcggcgtttatgcgataa

SEQ ID NO: 66623 - protein, 421 aa, IncL
MYALIDVNSMYCSCEEAFRPDLRGRPVVVLSNNDGALVAVNRAAKALGVRRGEPYFRCRRLLEQHNVAVFSSNYTLYASFSARFATVVESLAPRTFVYSIDELFADASHMEGVMSPQAFGQLLRAEVLRQTTLTCGVGVAPTKTLAKLCNHAAKTWPATGGVVALSDPVRLKRLMSLVSAGDVWGVGHRTEKGLATMGIKTALALAEMDIRLARRLYGVTLERTIRELRGEACFALEEGTGAKQQLVVSRSFGSRVTQLAQMQQAVTKYATRAGEKLRQENRLAKVVTVFIRSSAYDAGGVPYSNQATEVLSVPSQDTRDIIAAAQLGLSRIWREGVRYAKAGVMLSDLQGHETQLDLFAPAAVRPGSEKLMATIDKINREGRSRVFFAGEGIDPEYAMRREMLSPAYTTQWKDIPAAFMR

SEQ ID NO: 66624 - DNA, 1269 bp, IncJ plasmid R391
  CDS (1)..(1269): transl_table=11
atgcctgtatttgccttggtggactgcaacaacttttacgccagttgtgagaagctgtttcgtcctgatttaaaagatacaccggttgtggtgctgtccaataacgacggctgcgtggttgcacggtcacgtgaagctaagtcactcggtattaaaatgggcgtacccgtctttcagatcaaagctgaaatgcagcgccatggtattttggcattctcgtccaactatgcgctgtacgcagatttgagcagtcgagtgatgcgcactttggaagagatggcaccacgagtagaggtttactcgattgacgaagcgtttttggacttaaccggtattgagtctgccatatctcttgtcgagttcggacaacaagtgcgagagcgcataggtcactggattgggatcagcgtctgtgtaggcattgcaccgactaaaacactcgccaagctggctaaccatgccgctaagaaatatcccgctactcaaggggttgtagacctgaccaatccagatcggcaacgtcgattgctcgcattagtcccggttgatgatgtttggggcgttggtaggcggctttctaagcgattaaatgcgttgggtatcactacagccttagacctagccaatgcctcacctagagccatcagagaccagttttcggtggttttagagagaaccgtcagagagctcaatggtgagtcgtgcattgaacttgaagagatcccgccaactaagaaacaaattgtctgtagccgttcatttggcgtaaaagtgacgcactttgaattcttacgtgaagccatatgcgaatacgcaacccgcgccacggagaagcttcgcaaagaacagcagcaagccaaagtgatgaccgtgtttatacgtaccagcccctttaaggacaacgagccgcagtacagcaactctgcatcgggtgagttgctgatccccagttgcgatacgcgggactttatcgagctggccaatcacttactcaagcggatttggaaggatggttttcgttatgccaaagcgggcgtcatgctgtctgacttttacgatcctggtatgtttcaaccaggactattcgatgacgtatcgacccgctctaatagccagcagttaatgtctgtattggacaccattaaccaaagcggtgccggaaaggttttctttgctggacaaggtacgaagaaagattggtcgatgaagcgagagcatttatctcccgcttatacaacacgctgggaccaattaccgcgagttaagtag

SEQ ID NO: 66625 - protein, 422 aa, IncJ plasmid R391
MPVFALVDCNNFYASCEKLFRPDLKDTPVVVLSNNDGCVVARSREAKSLGIKMGVPVFQIKAEMQRHGILAFSSNYALYADLSSRVMRTLEEMAPRVEVYSIDEAFLDLTGIESAISLVEFGQQVRERIGHWIGISVCVGIAPTKTLAKLANHAAKKYPATQGVVDLTNPDRQRRLLALVPVDDVWGVGRRLSKRLNALGITTALDLANASPRAIRDQFSVVLERTVRELNGESCIELEEIPPTKKQIVCSRSFGVKVTHFEFLREAICEYATRATEKLRKEQQQAKVMTVFIRTSPFKDNEPQYSNSASGELLIPSCDTRDFIELANHLLKRIWKDGFRYAKAGVMLSDFYDPGMFQPGLFDDVSTRSNSQQLMSVLDTINQSGAGKVFFAGQGTKKDWSMKREHLSPAYTTRWDQLPRVK

SEQ ID NO: 66626 - DNA, 1284 bp, Pseudomonas syringae pv
  CDS (1)..(1284): transl_table=11
atggaaaagcatgaggttgtcttcgcgcttatcgattgcaattgcttctatgccagctgcgagcgtgtttttcgtccagatctggagaaaacgcccatcgtggtactcagcaataacgacggttgcgtcatcgcccgtagctacgacgccaagccatttgtgaaaatgggggctccctattttcagatcaaagaggtgttgcgccgccacggcataaaggtgttcagcagcaactacgcgctctatggcgacatgagcgagcgtgtcatgtcgatcatcgagtcgatggtgccagcctccgaggtctacagcatcgatgaggcgtttgcagacctcaccggggtccctggcgatctcacagcgttcggtcgacgcatccgggcgaacattcttaaatgcactggtattcctgtgggggtgggtatcggtcctacgaaaacgctcgctaagctggcaaaccacactgctaagcgactgctatcccatacaggcggtgttgtagacatttgcgacctgcataaccgcaactgggtactgcgtaatacggcagtatctgaggtctggggggtagggaagaagataaatgcccacctggaggctatgaagatccgcacagcaatggaccttgcaaccgccgacccgcgtactctgcgcgaccggttcagcgtggtcattgaaaagaccgcacgtgagctggcaggtacttcgtgcctggagctgggcgaagctgcaccacccaagcaggagatctgttgcagccgaatgttcggcaaacggctaaccaccattcagccaatcaaagaggcggtggccacctacactcagcgtgcggccgagaagctccgttttcaaaactcgctgtgcaagaagatccgcgtcagcatccgtaccggcatgttcaatccggaagaagccaagtacgccaacggcgctttggttgaattgccataccccaccaacgacgtccgcttgatgaccagggcggcgactgaggcagtgaatcgtttgtttcgaccggggttcaagtacagcaaagctgaggttctgttgctggatctgagacagcctggcgaatttacggatgacatgttcgctgcttcgcagcctgcatcttcggagaaggtgatgggagtcctggacgagatcaatacacgctggggcagagggactttaagagctgggagtgttccttccaatccggaatgggctatgcgtcgcgagctgatgagtcaaagttatacaaccaggctcgatcagttgtgggaggtgaaaagtctcttgtag

SEQ ID NO: 66627 - protein, 427 aa, Pseudomonas syringae pv
MEKHEVVFALIDCNCFYASCERVFRPDLEKTPIVVLSNNDGCVIARSYDAKPFVKMGAPYFQIKEVLRRHGIKVFSSNYALYGDMSERVMSIIESMVPASEVYSIDEAFADLTGVPGDLTAFGRRIRANILKCTGIPVGVGIGPTKTLAKLANHTAKRLLSHTGGVVDICDLHNRNWVLRNTAVSEVWGVGKKINAHLEAMKIRTAMDLATADPRTLRDRFSVVIEKTARELAGTSCLELGEAAPPKQEICCSRMFGKRLTTIQPIKEAVATYTQRAAEKLRFQNSLCKKIRVSIRTGMFNPEEAKYANGALVELPYPTNDVRLMTRAATEAVNRLFRPGFKYSKAEVLLLDLRQPGEFTDDMFAASQPASSEKVMGVLDEINTRWGRGTLRAGSVPSNPEWAMRRELMSQSYTTRLDQLWEVKSLL

SEQ ID NO: 66628 - DNA, 1263 bp, Pseudomonas cichorii
  CDS (1)..(1263): transl_table=11
atgcccgtgttcggtctcgtggactgcaactgtttctacgcaagctgtgagcgtgtgtttcggccggatctggctaagatccccattgttgtgctcagcaataacgatggctgcgttatagctcgaagctacgacgccaaaccgttcgtgaaaatgggcgcgccctattttcagattaaggacgtattgcgccggcacggcatcaaggccttcagcagcaattttgcgctctacggagacatgagccaaagagtcatggccatcatcgaatcgatggtgcctgccgtcgaggtctacagcatcgatgaggcttttgccgagttaaccggcatgccaggcaatctaaccgagttaggtagagcaatccggtcaaaggtctaccgctgcacgggcatccctgtgggtgtagggattgctccgactaaaaccctggcaaagcttgccaattacacagcaaagcgtctccaggcgcacacaggcggcgtagtggatatctgcgaccctttgaagcgtgactgggtgctgcgcaatacctcagtcggtgaagtttggggtatcggtcgaaagctgaaagcacaccttgagggcatgcatatcctttccgcgaaggatcttgcagctgcagacccgtggatgctgcgcaagaaattcagcgtggtcgtggagaagacggcgcgagagctgtcaggcaccgtgtgcctggagctggatgaggtagagccaccaaagcaagagatctgctgcagcagaatgttcggcaagcgactgaccgagcttggaccgatcaaagaggcggtggccacctacatgatgcgtgcttcagagaaactgcgagcccagggatcagtatgcaaaaaaatcagggtcagcatccgtaccggcatgttcagtcctgacgaggccaagtatgcgaacggtgcgcttgtccagctgccctaccctacaaacgacgtgcggctgatgacaaaatatgcgaccgaggcagtgtcgcgcatctatcgtcccgggtccaggtacagcaaagcagaggttatgttgatggacatttgtcagccgggtgagtttaccgacgacctgttctcggccgtgcagccgctgagctctgatcgtctgatgaccgcattggacttgatcaacgaaaagtggggccgcggcacgctgcgtactggatctgtcccagttgtcccggattggggtatgcggcgcgagaatatgagccagagctacacgacgcgacttgatcagctgtgggttgtaaagtaa

SEQ ID NO: 66629 - protein, 420 aa, Pseudomonas cichorii
MPVFGLVDCNCFYASCERVFRPDLAKIPIVVLSNNDGCVIARSYDAKPFVKMGAPYFQIKDVLRRHGIKAFSSNFALYGDMSQRVMAIIESMVPAVEVYSIDEAFAELTGMPGNLTELGRAIRSKVYRCTGIPVGVGIAPTKTLAKLANYTAKRLQAHTGGVVDICDPLKRDWVLRNTSVGEVWGIGRKLKAHLEGMHILSAKDLAAADPWMLRKKFSVVVEKTARELSGTVCLELDEVEPPKQEICCSRMFGKRLTELGPIKEAVATYMMRASEKLRAQGSVCKKIRVSIRTGMFSPDEAKYANGALVQLPYPTNDVRLMTKYATEAVSRIYRPGSRYSKAEVMLMDICQPGEFTDDLFSAVQPLSSDRLMTALDLINEKWGRGTLRTGSVPVVPDWGMRRENMSQSYTTRLDQLWVVK

SEQ ID NO: 66630 - DNA, 1308 bp, Providencia rettgeri
  CDS (1)..(1308): transl_table=11
atgtggtgcgaaacatgcgccgtaagtcgtgacgatcccatgcctgtatttgccttggtggactgcaacaacttttacgccagttgtgagaagctgtttcgtcctgatttaaaagatacaccggttgtggtgctgtccaataacgacggctgcgtggttgcacggtcacgtgaagctaagtcactcggtattaaaatgggcgtacccgtctttcagatcaaagctgaaatgcagcgccatggtattttggcattctcgtccaactatgcgctgtacgcagatttgagcagtcgagtgatgcgcactttggaagagatggcaccacgagtagaggtttactcgattgacgaagcgtttttggacttaaccggtattgagtctgccatatctcttgtcgagttcggacaacaagtgcgagagcgcataggtcactggattgggatcagcgtctgtgtaggcattgcaccgactaaaacactcgccaagctggctaaccatgccgctaagaaatatcccgctactcaaggggttgtagacctgaccaatccagatcggcaacgtcgattgctcgcattagtcccggttgatgatgtttggggcgttggtaggcggctttctaagcgattaaatgcgttgggtatcactacagccttagacctagccaatgcctcacctagagccatcagagaccagttttcggtggttttagagagaaccgtcagagagctcaatggtgagtcgtgcattgaacttgaagagatcccgccaactaagaaacaaattgtctgtagccgttcatttggcgtaaaagtgacgcactttgaattcttacgtgaagccatatgcgaatacgcaacccgcgccacggagaagcttcgcaaagaacagcagcaagccaaagtgatgaccgtgtttatacgtaccagcccctttaaggacaacgagccgcagtacagcaactctgcatcgggtgagttgctgatccccagttgcgatacgcgggactttatcgagctggccaatcacttactcaagcggatttggaaggatggttttcgttatgccaaagcgggcgtcatgctgtctgacttttacgatcctggtatgtttcaaccaggactattcgatgacgtatcgacccgctctaatagccagcagttaatgtctgtattggacaccattaaccaaagcggtgccggaaaggttttctttgctggacaaggtacgaagaaagattggtcgatgaagcgagagcatttatctcccgcttatacaacacgctgggaccaattaccgcgagttaagtag

SEQ ID NO: 66631 - protein, 435 aa, Providencia rettgeri
MWCETCAVSRDDPMPVFALVDCNNFYASCEKLFRPDLKDTPVVVLSNNDGCVVARSREAKSLGIKMGVPVFQIKAEMQRHGILAFSSNYALYADLSSRVMRTLEEMAPRVEVYSIDEAFLDLTGIESAISLVEFGQQVRERIGHWIGISVCVGIAPTKTLAKLANHAAKKYPATQGVVDLTNPDRQRRLLALVPVDDVWGVGRRLSKRLNALGITTALDLANASPRAIRDQFSVVLERTVRELNGESCIELEEIPPTKKQIVCSRSFGVKVTHFEFLREAICEYATRATEKLRKEQQQAKVMTVFIRTSPFKDNEPQYSNSASGELLIPSCDTRDFIELANHLLKRIWKDGFRYAKAGVMLSDFYDPGMFQPGLFDDVSTRSNSQQLMSVLDTINQSGAGKVFFAGQGTKKDWSMKREHLSPAYTTRWDQLPRVK

SEQ ID NO: 66632 - DNA, 1272 bp, Shigella flexneri
  CDS (1)..(1272): transl_table=11
atgtttgcactggctgatatcaacagtttctacgcctcatgtgaaaaagttttccgcccggaccttcgcaacgaaccggtcatcgtactcagcaataacgatggctgtgtgatcgcgcgcagcccggaggcaaaagcccttggcatcagaatggggcagccctggtttcaggtgagacagatgcgcctggagaagaaaatacatgtattttccagcaattatgcgctgtaccacagcatgagccaacgggttatggctgttctggagtcgctttctcccgcagttgagccctactcaattgatgaaatgttcattgatttgcgggggataaatcattgcatctctccggagttttttggtcatcagctcagggaacaggtaaaaagctggacaggactcaccatgggggtgggcattgcgcctacaaaaacgctggctaaaagtgcacagtgggcaacaaagcaatggccacagttttccggtgtggtcgcgctgacggcagaaaaccgtaatcggatcttgaagctactggggctgcagccagttggtgaggtctggggagtaggacgcagactgacggaaaagctgaatgcgctgggtattaacacagcactgcagctggcgcaggctaacacggcattcatccggaaaaacttcagcgtcattcttgagcgtacggtacgcgaactcaacggcgagtcctgcatatccctggaagaagcaccaccggcaaaacagcagattgtctgtagtcgcagttttggtgaacgaatcacagacaaagatgccatgcaccaggctgttgttcagtatgcagagcgggccgcagagaaactacgtggggagcgtcagtattgccggcaggtgacgacatttgtacggacatccccctttgcagtaaaagaaccctgttacagcaatgccgctgtggaaaagcttccattacccacacaggacagccgggacattattgccgcagcatgcagagcgttaaaccatgtctggcgtgaagggtaccgctatatgaaggcaggagtcatgctggctgatttcacaccatcgggtatagcgcagccgggattatttgatgagatccagccccgtaaaaacagcgaaaagttaatgaaaacactcgatgaactgaaccagtctggaaaagggaaagtgtggtttgcggggcgaggaaccgcccctgaatggcaaatgaaacgggaaatgctctcgccttcgtatacaacacaatggactgagatccccattgcttcattctga

SEQ ID NO: 66633 - protein, 423 aa, Shigella flexneri
MFALADINSFYASCEKVFRPDLRNEPVIVLSNNDGCVIARSPEAKALGIRMGQPWFQVRQMRLEKKIHVFSSNYALYHSMSQRVMAVLESLSPAVEPYSIDEMFIDLRGINHCISPEFFGHQLREQVKSWTGLTMGVGIAPTKTLAKSAQWATKQWPQFSGVVALTAENRNRILKLLGLQPVGEVWGVGRRLTEKLNALGINTALQLAQANTAFIRKNFSVILERTVRELNGESCISLEEAPPAKQQIVCSRSFGERITDKDAMHQAVVQYAERAAEKLRGERQYCRQVTTFVRTSPFAVKEPCYSNAAVEKLPLPTQDSRDIIAAACRALNHVWREGYRYMKAGVMLADFTPSGIAQPGLFDEIQPRKNSEKLMKTLDELNQSGKGKVWFAGRGTAPEWQMKREMLSPSYTTQWTEIPIASF

SEQ ID NO: 66634 - DNA, 1275 bp, Salmonella typhimurium
  CDS (1)..(1275): transl_table=11
atgtttgcactggctgatatcaacagtttctacgcctcatgtgaaaaagttttccgcccggaccttcgcaacgaaccggtcatcgtactcagcaataacgatggctgtgtgatcgcgcgcagcccggaggcaaaagcccttggcatcagaatggggcagccctggtttcaggtgagacaaatgcgcctggagaagaaaatacatgtattttccagcaattatgcgctgtaccacagcatgagccaacgggttatggctgttctggagtcgctttctcccgcagttgagccctactcaattgatgaaatgttcattgatttgcgggggataaatcattgcatctctccggagttttttggtcatcagctcagggaacaggtaaagagctggacaggactcaccatgggggtgggcattgcgcctacaaaaacgctggctaaaagtgcacagtgggcaacaaagcaatggccacagttttccggagtggtcgcgctgacggcagaaaaccgtaatcggatcttgaagctactggggctgcagccagttggtgaggtctggggagtaggacacagactgacggaaaagctgaatgcgctgggtattaacacagcactgcagctggcgcaggctaacacggcattcatccggaaaaacttcagcgtcattcttgagcgtacggtacgcgaactcaacggcgagtcctgcatatccctggaagaagcaccaccggcaaaacagcagattgtctgtagtcgcagttttggtgaacgaatcacagacaaagatgccatgcaccaggctgttgttcagtatgcagagcgggccgcagagaaactacgtggggagcgtcagtattgccggcaggtgacgacatttgtacggacatcaccctttgcagtaaaagaaccctgttacagcaatgccgctgtggaaaagcttccattgcccacacaggacagccgggacattattgccgccgcatgcagagccttaaaccatgtctggcgtgaagggtaccgctatatgaaggcaggtgtcatgctggctgatttcacaccatcgggtatagcgcagccgggattatttgatgaaatccagccccgtaaaaacagtgaaaagttaatgaaaacactcgatgaactgaaccagtcgggaaaagggaaagtgtggtttgcggggcgaggaaccgcccctgaatggcaaatgaaacgggaaatgttgagtcagtgttatacaactaaatggcgagatattcccctggccaggctgggttag

SEQ ID NO: 66635 - protein, 424 aa, Salmonella typhimurium
MFALADINSFYASCEKVFRPDLRNEPVIVLSNNDGCVIARSPEAKALGIRMGQPWFQVRQMRLEKKIHVFSSNYALYHSMSQRVMAVLESLSPAVEPYSIDEMFIDLRGINHCISPEFFGHQLREQVKSWTGLTMGVGIAPTKTLAKSAQWATKQWPQFSGVVALTAENRNRILKLLGLQPVGEVWGVGHRLTEKLNALGINTALQLAQANTAFIRKNFSVILERTVRELNGESCISLEEAPPAKQQIVCSRSFGERITDKDAMHQAVVQYAERAAEKLRGERQYCRQVTTFVRTSPFAVKEPCYSNAAVEKLPLPTQDSRDIIAAACRALNHVWREGYRYMKAGVMLADFTPSGIAQPGLFDEIQPRKNSEKLMKTLDELNQSGKGKVWFAGRGTAPEWQMKREMLSQCYTTKWRDIPLARLG

SEQ ID NO: 66636 - DNA, 1263 bp, Escherichia coli
  CDS (1)..(1263): transl_table=11
atgtttgcgctgattgatgtcaatggcatgtacgccagctgtgagcaggcatttaggccagatctggcaaaccgagcagtggccgttttatccaacaatgacggcaacattgtggcccgtaattacctggcgaagaaagcgggcctgaaaatgggcgatccgtacttcaaagtcagacccataatcgagcgtcataacatcgctatttttagctctaattacactctttatgcctccatgtcggcccggttcgcggccgtagttgagtcccttgcaagccacgtcgaacagtattcaatcgacgagctttttgttgactgcaaagggataacggccgccatgagccttgacgctttcgggcgccaactgcgcgaggaagtcaggcgacacacaacgctggtatgcggggtcggtattgcccgtactaagacgctggcgaagctgtgtaaccacgctgcaaaaacatggcccgctactggcggggtggttgctctggacgatggcgccagactgaagaaattaatgagcatcctgccggttgcggaagtctggggcgtcggccatcgtacagagaaagcactcgccacaatggggatcaaaacggtgctggatttagccagggcagatacgcgcctaatccgtaaaacattcggcgttgtgcttgaaagaacggtacgggagttgcgcggcgaggcttgcttcagcctggaagaaaaccctcctgcgaagcagcagattgttgtgtcgcgctcattcggccaacgcgtagaaaccctgacggacatgcagcaggctgtcaccggatttgcagcgcgcgcagctgaaaaactgcgtaatgagaggcaatactgccgcgtcataagcgtctttatccgtaccagtccttattcagtgcgtgatacacagtatgccaatcaggcaaccgaaaaactgacggtggcaacccaggacagccgcacgataattcaggcagcacaagcgctggcgcggatctggcgggaagatattgcgtatgcaaaagcaggggtcatgctggcagattttagcgggaaggaggcccagcttgatttattcgactctgctacgccttcagctggcagcgaggctttaatggctgttcttgatggtataaaccggcgtggaaagaaccagcttttttttgcaggccagggcatcgataactcctttgccatgcgtcgtcagatgttgtcacctgattacacgacagactggcgctcaataccaatagccaccatcaaataa

SEQ ID NO: 66637 - protein, 420 aa, Escherichia coli
MFALIDVNGMYASCEQAFRPDLANRAVAVLSNNDGNIVARNYLAKKAGLKMGDPYFKVRPIIERHNIAIFSSNYTLYASMSARFAAVVESLASHVEQYSIDELFVDCKGITAAMSLDAFGRQLREEVRRHTTLVCGVGIARTKTLAKLCNHAAKTWPATGGVVALDDGARLKKLMSILPVAEVWGVGHRTEKALATMGIKTVLDLARADTRLIRKTFGVVLERTVRELRGEACFSLEENPPAKQQIVVSRSFGQRVETLTDMQQAVTGFAARAAEKLRNERQYCRVISVFIRTSPYSVRDTQYANQATEKLTVATQDSRTIIQAAQALARIWREDIAYAKAGVMLADFSGKEAQLDLFDSATPSAGSEALMAVLDGINRRGKNQLFFAGQGIDNSFAMRRQMLSPDYTTDWRSIPIATIK

SEQ ID NO: 66638 - DNA, 1266 bp, Salmonella typhimurium
  CDS (1)..(1266): transl_table=11
atgtttgcgctgattgatgtcaatggcatgtacgccagctgtgagcaggcatttaggccagatctggcaaaccgagcagtggccgttttatccaacaatgacggcaacattgtggcccgtaattacctggcgaagaaagcgggcctgaaaatgggcgatccgtacttcaaagtcagacccataatcgagcgtcataacatcgctatttttagctctaattacactctttatgcctccatgtcggcccggttcgcggccgtagttgagtcccttgcaagccacgtcgaacagtattcaatcgacgagctttttgttgactgcaaagggataacggccgccatgagccttgacgctttcgggcgccaactgcgcgaggaagtcaggcgacacacaacgctggtatgcggggtcggtattgcccgtactaagacgctggcgaagctgtgtaaccacgctgcaaaaacatggcccgctactggcggggtggttgctctggacgatggcgccagactgaagaaattaatgagcatcctgccggttgcggaagtctggggcgtcggccatcgtacagagaaagcactcgccacaatggggatcaaaacggtgctggatttagccagggcagatacgcgcctaatccgtaaaacattcggcgttgtgcttgaaagaacggtacgggagttgcgcggcgaggcttgcttcagcctggaagaaaaccctcctgcgaagcagcagattgttgtgtcgcgctcattcggccaacgcgtagaaaccctgacggacatgcagcaggctgtcaccggatttgcagcgcgcgcagctgaaaaactgcgtaatgagaggcaatactgccgcgtcataagcgtctttatccgtaccagtccttattcagtgcgtgatacacagtatgccaatcaggcaaccgaaaaactgacggtggcaacccaggacagccgcacgataattcaggcagcacaagccgcgctggcgcggatctggcgggaagatattgcgtatgcaaaagcaggggtcatgctggcagattttagcgggaaggaggcccagcttgatttattcgactctgctacgccttcagctggcagcgaggctttaatggctgttcttgatggtataaaccggcgtggaaagaaccagcttttttttgcaggccagggcatcgataactcctttgccatgcgtcgtcagatgttgtcacctgattacacgacagactggcgctcaataccaatagccaccatcaaataa

SEQ ID NO: 66639 - protein, 421 aa, Salmonella typhimurium
MFALIDVNGMYASCEQAFRPDLANRAVAVLSNNDGNIVARNYLAKKAGLKMGDPYFKVRPIIERHNIAIFSSNYTLYASMSARFAAVVESLASHVEQYSIDELFVDCKGITAAMSLDAFGRQLREEVRRHTTLVCGVGIARTKTLAKLCNHAAKTWPATGGVVALDDGARLKKLMSILPVAEVWGVGHRTEKALATMGIKTVLDLARADTRLIRKTFGVVLERTVRELRGEACFSLEENPPAKQQIVVSRSFGQRVETLTDMQQAVTGFAARAAEKLRNERQYCRVISVFIRTSPYSVRDTQYANQATEKLTVATQDSRTIIQAAQAALARIWREDIAYAKAGVMLADFSGKEAQLDLFDSATPSAGSEALMAVLDGINRRGKNQLFFAGQGIDNSFAMRRQMLSPDYTTDWRSIPIATIK

SEQ ID NO: 66640 - DNA, 1275 bp, Salmonella typhimurium
  CDS (1)..(1275): transl_table=11
atgttcgctttggctgacgtcaactcgttctatgccagttgcgaaaaggtctttcgccccgatttgcgtgacaggtctgtggtggtcctgagtaacaacgatggttgtgtaattccgcgcagcgctgaagcaaaaaaactgggcataaaaatgggggtgccgtggtttcaactgaggtcggcgaaatttccggagccggttatcgcgttctccagtaattacgccctctacgcatcaatgtcgaacagggtcatggttcacctggaagagctggcgccacgcgttgagcagtactccattgacgagatgtttctggatattcgcggtatagacagttgcatcgatttcgaggatttcggccgacagctgcgtgagcacgttcgttccggcacagggctgaccatcggcgtcggaatgggaccgaccaaaacgctggctaaaagcgcgcaatgggcatcgaaagaatggtcacagttcggaggcgtgcttgccctgacgttacacaatcagaaacgaacggagaaactgctgtcactgcaaccggtggaggaaatctggggtgtgggccgcaggatctcaaagaagctgaacacaatggggatcaccacagcactgcagctggcccgcgcgaatccaacgttcatcaggaaaaactttaatgtggttctggagagaacggtccgggaactcaatggagaaagctgtatttccctggaggaagcaccgccccccaaacagcagatagtctgcagcagaagctttggagaacgagtcacgacttatgaagcgatgcggcaggcagtctgtcagcacgctgaacgtgccgccgaaaagctgcgtggggaacggcagttctgcaggcatattgccgtgtttgtgaaaacatcgccgttcgccgtaactgagccctactacggtaatctggccagtgaaaaactgctcatccccacgcaggatacacgggacatcattgccgctgccgtcagagctctggacaggatctgggtggatggtcaccgttacgcaaaggcaggctgtatgctgaacgatttcacgccaaccggggtatcgcagcttaatttgtttgatgaagtacagccgcgggaacggagcgagcagctgatgcaagtcctggatgggattaaccatccgggcaaggggaaaatatggttcgccggtcgggggattgcccccgagtggcagatgaaaagggaactactttcgccagcttatacgacacgttgggcagatattcctgcagcgaaattgacttga

SEQ ID NO: 66641 - protein, 424 aa, Salmonella typhimurium
MFALADVNSFYASCEKVFRPDLRDRSVVVLSNNDGCVIPRSAEAKKLGIKMGVPWFQLRSAKFPEPVIAFSSNYALYASMSNRVMVHLEELAPRVEQYSIDEMFLDIRGIDSCIDFEDFGRQLREHVRSGTGLTIGVGMGPTKTLAKSAQWASKEWSQFGGVLALTLHNQKRTEKLLSLQPVEEIWGVGRRISKKLNTMGITTALQLARANPTFIRKNFNVVLERTVRELNGESCISLEEAPPPKQQIVCSRSFGERVTTYEAMRQAVCQHAERAAEKLRGERQFCRHIAVFVKTSPFAVTEPYYGNLASEKLLIPTQDTRDIIAAAVRALDRIWVDGHRYAKAGCMLNDFTPTGVSQLNLFDEVQPRERSEQLMQVLDGINHPGKGKIWFAGRGIAPEWQMKRELLSPAYTTRWADIPAAKLT

SEQ ID NO: 66642 - DNA, 1269 bp, Escherichia coli; identical to SEQ ID NO: 66414
  CDS (1)..(1269): transl_table=11

SEQ ID NO: 66643 - protein, 422 aa, Escherichia coli [sequence omitted]

SEQ ID NO: 66644 - DNA, 1269 bp, Salmonella typhimurium
  CDS (1)..(1269): transl_table=11
atgttcgcgctctgcgatgttaatagcttttacgcctcctgcgaaacggtctttcgtcctgatttatgtggccgaccggtggtggtgttatcaaacaatgatggctgcgttatcgcgtgtagcgccgaggcgaaacagctcggtatcgcaccaggtgagccatacttcaaacagaaagaacgcttccggcgatccggtgttgtttgcttcagcagtaattacgagctttacgctgatatgtcgaaccgggtaatgaccacactcgaggagatggtgccgcgggtagaaatttacagcattgatgaggccttttgtgatctgacgggggtacgaaactgccgggatctgacagatttcgggcgcgagataagagcgacggtcctgaagcgcacgcacctgactgtcggtgtaggcattgcccagacgaaaacccttgccaagctggctaaccatgctgcgaaaaagtggcagcgccagaccgacggggtggttgacttgtcgaacatcgatcgccagcgtcggctgctggccctgatacccgtggaggatgtctggggtgtcggcaggcgcatcagtaagaagctcaatgccctgggcatcaagactgctctcgatctctctgaacaaagtacctggatcatcaggaaacacttcaatgtcgtgctggagcgtaccgtgagagagcttcgcggagagccatgtctggagctcgaagagtttgcgccggcaaagcaggaaatcgtttgtagtcgctctttcggcgagcgggtcacagactatgaggaaatgcgccaggctgtttacagctacgctgcgcgcgcggcagaaaaactccgcggcgagcaccagtactgccgtttcatttcaacattcgtcaaaacatcaccctttgccctgaacgagccctactacggtaacagcgccgcggtgacgcttctcacccccacgcaggattcacgtgacattatcaatgcggctgtgaaatgcctggataaaatatggcgcgacggccatcgctaccagaaagcgggggtgatgctgggtgacttcttcagtcagggcgtagcgcaactcaaccttttcgacgataacgcgccgcgcgccggtagtgcgaagttgatggaagtactggaccatcttaacgcaaaagacgggaaggggacgctgtacttcgccgggcaggggatgtcgcaacagtgggctatgaagcgagaaatgctttcgcctcggtacaccacaagatactctgatctactgcgtgttaagtaa

SEQ ID NO: 66645 - protein, 422 aa, Salmonella typhimurium
MFALCDVNSFYASCETVFRPDLCGRPVVVLSNNDGCVIACSAEAKQLGIAPGEPYFKQKERFRRSGVVCFSSNYELYADMSNRVMTTLEEMVPRVEIYSIDEAFCDLTGVRNCRDLTDFGREIRATVLKRTHLTVGVGIAQTKTLAKLANHAAKKWQRQTDGVVDLSNIDRQRRLLALIPVEDVWGVGRRISKKLNALGIKTALDLSEQSTWIIRKHFNVVLERTVRELRGEPCLELEEFAPAKQEIVCSRSFGERVTDYEEMRQAVYSYAARAAEKLRGEHQYCRFISTFVKTSPFALNEPYYGNSAAVTLLTPTQDSRDIINAAVKCLDKIWRDGHRYQKAGVMLGDFFSQGVAQLNLFDDNAPRAGSAKLMEVLDHLNAKDGKGTLYFAGQGMSQQWAMKREMLSPRYTTRYSDLLRVK

SEQ ID NO: 66646 - DNA, 24 bp, Artificial sequence
  (1)..(24): primer
atgtttgccctctgtgatgtaaac

SEQ ID NO: 66647 - DNA, 26 bp, Artificial sequence
  (1)..(26): primer
ttatttgaccctcagtaaatcagaac

SEQ ID NO: 66648 - protein, 458 aa, Artificial sequence
  Variant (3)..(3): xaa in position 3 is any amino acid
  Variant (5)..(5): xaa in position 5 is any amino acid
  Variant (7)..(7): xaa in position 7 is any amino acid
  Variant (10)..(10): xaa in position 10 is any amino acid
  Variant (14)..(15): xaa in position 14 to 15 is any amino acid
  Variant (17)..(17): xaa in position 17 is any amino acid
  Variant (19)..(19): xaa in position 19 is any amino acid
  Variant (21)..(23): xaa in position 21 to 23 is any amino acid
  Variant (25)..(26): xaa in position 25 to 26 is any amino acid
  Variant (35)..(36): xaa in position 35 to 36 is any amino acid
  Variant (38)..(41): xaa in position 38 to 41 is any amino acid
  Variant (44)..(44): xaa in position 44 is any amino acid
  Variant (45)..(70): xaa in position 45 to 70 is any or no amino acid
  Variant (72)..(72): xaa in position 72 is any amino acid
  Variant (74)..(74): xaa in position 74 is any amino acid
  Variant (76)..(88): xaa in position 76 to 88 is any amino acid
  Variant (89)..(89): xaa in position 89 is any or no amino acid
  Variant (94)..(94): xaa in position 94 is any amino acid
  Variant (97)..(99): xaa in position 97 to 99 is any amino acid
  Variant (101)..(101): xaa in position 101 is any amino acid
  Variant (103)..(103): xaa in position 103 is any amino acid
  Variant (105)..(111): xaa in position 105 to 111 is any amino acid
  Variant (113)..(116): xaa in position 113 to 116 is any amino acid
  Variant (122)..(122): xaa in position 122 is any amino acid
  Variant (124)..(137): xaa in position 124 to 137 is any amino acid
  Variant (138)..(144): xaa in position 138 to 144 is any or no amino acid
  Variant (146)..(158): xaa in position 146 to 158 is any amino acid
  Variant (160)..(162): xaa in position 160 to 162 is any amino acid
  Variant (169)..(169): xaa in position 169 is any amino acid
  Variant (172)..(174): xaa in position 172 to 174 is any amino acid
  Variant (176)..(185): xaa in position 176 to 185 is any amino acid
  Variant (186)..(218): xaa in position 186 to 218 is any or no amino acid
  Variant (221)..(221): xaa in position 221 is any amino acid
  Variant (223)..(228): xaa in position 223 to 228 is any amino acid
  Variant (230)..(233): xaa in position 230 to 233 is any amino acid
  Variant (235)..(239): xaa in position 235 to 239 is any amino acid
  Variant (241)..(248): xaa in position 241 to 248 is any amino acid
  Variant (250)..(253): xaa in position 250 to 253 is any amino acid
  Variant (255)..(257): xaa in position 255 to 257 is any amino acid
  Variant (259)..(261): xaa in position 259 to 261 is any amino acid
  Variant (264)..(264): xaa in position 264 is any amino acid
  Variant (266)..(267): xaa in position 266 to 267 is any amino acid
  Variant (269)..(279): xaa in position 269 to 279 is any amino acid
  Variant (280)..(281): xaa in position 280 to 281 is any or no amino acid
  Variant (283)..(284): xaa in position 283 to 284 is any amino acid
  Variant (290)..(300): xaa in position 290 to 300 is any amino acid
  Variant (302)..(308): xaa in position 302 to 308 is any amino acid
  Variant (310)..(311): xaa in position 310 to 311 is any amino acid
  Variant (315)..(347): xaa in position 315 to 347 is any amino acid
  Variant (348)..(349): xaa in position 348 to 349 is any or no amino acid
  Variant (351)..(360): xaa in position 351 to 360 is any amino acid
  Variant (362)..(364): xaa in position 362 to 364 is any amino acid
  Variant (365)..(371): xaa in position 365 to 371 is any or no amino acid
  Variant (373)..(374): xaa in position 373 to 374 is any amino acid
  Variant (376)..(376): xaa in position 376 is any amino acid
  Variant (378)..(378): xaa in position 378 is any amino acid
  Variant (381)..(393): xaa in position 381 to 393 is any amino acid
  Variant (394)..(398): xaa in position 394 to 398 is any or no amino acid
  Variant (400)..(407): xaa in position 400 to 407 is any amino acid
  Variant (408)..(414): xaa in position 408 to 414 is any or no amino acid
  Variant (417)..(419): xaa in position 417 to 419 is any amino acid
  Variant (421)..(422): xaa in position 421 to 422 is any amino acid
  Variant (424)..(424): xaa in position 424 is any amino acid
  Variant (425)..(426): xaa in position 425 to 426 is any or no amino acid
  Variant (428)..(440): xaa in position 428 to 440 is any amino acid
  Variant (441)..(444): xaa in position 441 to 444 is any or no amino acid
  Variant (446)..(452): xaa in position 446 to 452 is any amino acid
  Variant (454)..(455): xaa in position 454 to 455 is any amino acid
ALXDXNXFYXSCEXXFXPXLXXXPXXVLSNNDGCXXAXXXXAKXXXXXXXXXXXXXXXXXXXXXXXXXXXGXPXFXXXXXXXXXXXXXXSSNYXLYXXXSXRXMXXXXXXXPXXXXYSIDEXFXXXXXXXXXXXXXXXXXXXXXRXXXXXXXXXXXXXGXXXTKTLAKXANXXXKXXXXXXXXXXXXXXXXXXXXXXXXXXXXXXXXXXXXXXXXXXXWGXGXXXXXXLXXXXIXXXXXLXXXXXXXXRXXXXVXXXRXXXELXGXXCXXXXXXXXXXXXXIXXSRSFGXXXXXXXXXXXAXXXXXXXAXXKLRXXXXXXXXXXXXXXXXXXXXXXXXXXXXXXXXXXXPXXXXXXXXXXAXXXXXXXXXXGXXYXKXGVXXXXXXXXXXXXXXXXXXFXXXXXXXXXXXXXXXLMXXXDXXNXXXGXXXXXXXXXXXXXXXXXWXXXXXXXSXXYTT

SEQ ID NO: 66649 - protein, 42 aa, Artificial sequence
  Variant (3)..(3): xaa in position 3 is any amino acid
  Variant (5)..(5): xaa in position 5 is any amino acid
  Variant (7)..(7): xaa in position 7 is any amino acid
  Variant (8)..(8): xaa in position 8 is Phe or Met
  Variant (10)..(10): xaa in position 10 is Ala, Cys, Ser or Val
  Variant (12)..(12): xaa in position 12 is Ala, Cys or Val
  Variant (14)..(15): xaa in position 14 to 15 is any amino acid
  Variant (16)..(16): xaa in position 16 is Phe, Ile, Leu or Met
  Variant (17)..(17): xaa in position 17 is any amino acid
  Variant (19)..(23): xaa in position 19 to 23 is any amino acid
  Variant (24)..(24): xaa in position 24 is Ala, Pro or Ser
  Variant (25)..(25): xaa in position 25 is Ile, Leu or Val
  Variant (26)..(26): xaa in position 26 is Ala, Ile, Leu or Val
  Variant (27)..(27): xaa in position 27 is Ile or Val
  Variant (28)..(28): xaa in position 28 is any amino acid
  Variant (29)..(29): xaa in position 29 is Gly, Ser or Thr
  Variant (30)..(30): xaa in position 30 is Asn or Ser
  Variant (34)..(38): xaa in position 34 to 38 is any amino acid
  Variant (39)..(39): xaa in position 39 is Cys, Asn or Ser
  Variant (40)..(41): xaa in position 40 to 41 is any amino acid
  Variant (42)..(42): xaa in position 42 is Ala, Ser or Val
ALXDXNXXYXSXEXXXXPXXXXXXXXXXXXNDGXXXXXXXXX

SEQ ID NO: 66650 - protein, 14 aa, Artificial sequence
  Variant (5)..(5): xaa in position 5 is Ala, Glu, Ser or Thr
  Variant (8)..(8): xaa in position 8 is any amino acid
  Variant (9)..(9): xaa in position 9 is Asp, Glu, Gly, Asn or Ser
  Variant (10)..(10): xaa in position 10 is Phe, Ile, Leu, Met or Val
  Variant (12)..(13): xaa in position 12 to 13 is any amino acid
  Variant (14)..(14): xaa in position 14 is Phe, Ile, Leu, Met or Val
SSNYXLYXXXSXXX

SEQ ID NO: 66651 - protein, 7 aa, Artificial sequence
  Variant (6)..(6): xaa in position 6 is any amino acid
YSIDEXF

SEQ ID NO: 66652 - protein, 17 aa, Artificial sequence
  Variant (2)..(2): xaa in position 2 is Ala, Ile, Leu, Pro or Val
  Variant (3)..(3): xaa in position 3 is Ala, Gly, Ser or Thr
  Variant (4)..(4): xaa in position 4 is any amino acid
  Variant (6)..(7): xaa in position 6 to 7 is any or no amino acid
  Variant (11)..(11): xaa in position 11 is any amino acid
  Variant (12)..(12): xaa in position 12 is Ala, Cys, Gly or Ser
  Variant (13)..(13): xaa in position 13 is Ala, Asn, Gln or Thr
  Variant (14)..(15): xaa in position 14 to 15 is any amino acid
  Variant (16)..(16): xaa in position 16 is Ala, Cys, Ser or Thr
GXXXTXXLAKXXXXXXK

SEQ ID NO: 66653 - protein, 54 aa, Artificial sequence
  Variant (2)..(2): xaa in position 2 is any or no amino acid
  Variant (4)..(4): xaa in position 4 is any amino acid
  Variant (6)..(7): xaa in position 6 to 7 is any amino acid
  Variant (9)..(22): xaa in position 9 to 22 is any amino acid
  Variant (23)..(23): xaa in position 23 is any or no amino acid
  Variant (25)..(25): xaa in position 25 is any or no amino acid
  Variant (27)..(27): xaa in position 27 is any amino acid
  Variant (28)..(28): xaa in position 28 is Phe, Met or Val
  Variant (29)..(29): xaa in position 29 is Ala, Gly or Ser
  Variant (30)..(37): xaa in position 30 to 37 is any amino acid
  Variant (38)..(38): xaa in position 38 is Ile, Leu or Met
  Variant (39)..(40): xaa in position 39 to 40 is any amino acid
  Variant (41)..(41): xaa in position 41 is Ala, Ser or Thr
  Variant (42)..(42): xaa in position 42 is Ile, Leu, Met or Val
  Variant (43)..(44): xaa in position 43 to 44 is any amino acid
  Variant (45)..(45): xaa in position 45 is Phe, His or Tyr
  Variant (46)..(49): xaa in position 46 to 49 is any amino acid
  Variant (50)..(50): xaa in position 50 is Ala, Cys, Gly, Ser, Thr or Val
  Variant (51)..(53): xaa in position 51 to 53 is any amino acid
EXLXGXXCXXXXXXXXXXXXXXXSXRXXXXXXXXXXXXXXXXXXXXXXXXXXXR

SEQ ID NO: 66654 - protein, 22 aa, Artificial sequence
  Variant (2)..(14): xaa in position 2 to 14 is any amino acid
  Variant (15)..(15): xaa in position 15 is any or no amino acid
  Variant (17)..(17): xaa in position 17 is any amino acid
  Variant (18)..(19): xaa in position 18 to 19 is any or no amino acid
  Variant (21)..(21): xaa in position 21 is any amino acid
  Variant (22)..(22): xaa in position 22 is Glu or Gly
AXXXXXXXXXXXXXXYXXXKXX

SEQ ID NO: 66655 - DNA, 1392 bp, Escherichia coli K12; identical to SEQ ID NO: 28298
  CDS (1)..(1392): transl_table=11

SEQ ID NO: 66656 - protein, 463 aa, Escherichia coli K12; identical to SEQ ID NO: 28299

SEQ ID NO: 66657 - DNA, 1428 bp, Aquifex aeolicus VF5; identical to SEQ ID NO: 28300
  CDS (1)..(1428): transl_table=11

SEQ ID NO: 66658 - protein, 475 aa, Aquifex aeolicus VF5; identical to SEQ ID NO: 28301

SEQ ID NO: 66659 - DNA, 1212 bp, Pseudomonas aeruginosa PAO1; identical to SEQ ID NO: 28302
  CDS (1)..(1212): transl_table=11

SEQ ID NO: 66660 - protein, 403 aa, Pseudomonas aeruginosa PAO1; identical to SEQ ID NO: 28303

SEQ ID NO: 66661 - DNA, 1407 bp, Pseudomonas aeruginosa PAO1; identical to SEQ ID NO: 28304
  CDS (1)..(1407): transl_table=11

SEQ ID NO: 66662 - protein, 468 aa, Pseudomonas aeruginosa PAO1; identical to SEQ ID NO: 28305

SEQ ID NO: 66663 - DNA, 1296 bp, Pseudomonas aeruginosa PAO1; identical to SEQ ID NO: 28306
  CDS (1)..(1296): transl_table=11

SEQ ID NO: 66664 - protein, 431 aa, Pseudomonas aeruginosa PAO1; identical to SEQ ID NO: 28307

SEQ ID NO: 66665 - DNA, 1554 bp, Mycobacterium leprae TN; identical to SEQ ID NO: 28308
  CDS (1)..(1554): transl_table=11

SEQ ID NO: 66666 - protein, 517 aa, Mycobacterium leprae TN; identical to SEQ ID NO: 28309

SEQ ID NO: 66667 - DNA, 1389 bp, Escherichia coli O157:H7; identical to SEQ ID NO: 28310
  CDS (1)..(1389): transl_table=11

SEQ ID NO: 66668 - protein, 462 aa, Escherichia coli O157:H7; identical to SEQ ID NO: 28311

SEQ ID NO: 66669 - DNA, 1410 bp, Mycobacterium tuberculosis CDC1551; identical to SEQ ID NO: 28312
  CDS (1)..(1410): transl_table=11

SEQ ID NO: 66670 - protein, 469 aa, Mycobacterium tuberculosis CDC1551; identical to SEQ ID NO: 28313

SEQ ID NO: 66671 - DNA, 1392 bp, Mycobacterium tuberculosis CDC1551; identical to SEQ ID NO: 28314
  CDS (1)..(1392): transl_table=11

SEQ ID NO: 66672 - protein, 463 aa, Mycobacterium tuberculosis CDC1551; identical to SEQ ID NO: 28315

SEQ ID NO: 66673 - DNA, 1188 bp, Mycobacterium tuberculosis CDC1551; identical to SEQ ID NO: 28316
  CDS (1)..(1188): transl_table=11

SEQ ID NO: 66674 - protein, 395 aa, Mycobacterium tuberculosis CDC1551; identical to SEQ ID NO: 28317

SEQ ID NO: 66675 - DNA, 1548 bp, Mycobacterium tuberculosis CDC1551; identical to SEQ ID NO: 28318
  CDS (1)..(1548): transl_table=11

SEQ ID NO: 66676 - protein, 515 aa, Mycobacterium tuberculosis CDC1551; identical to SEQ ID NO: 28319

SEQ ID NO: 66677 - DNA, 1170 bp, Staphylococcus aureus subsp. aureus Mu50; identical to SEQ ID NO: 28320
  CDS (1)..(1170): transl_table=11

SEQ ID NO: 66678 - protein, 389 aa, Staphylococcus aureus subsp. aureus Mu50; identical to SEQ ID NO: 28321

SEQ ID NO: 66679 - DNA, 1422 bp, Caulobacter crescentus CB15; identical to SEQ ID NO: 28322
  CDS (1)..(1422): transl_table=11

SEQ ID NO: 66680 - protein, 473 aa, Caulobacter crescentus CB15; identical to SEQ ID NO: 28323

SEQ ID NO: 66681 - DNA, 1275 bp, Sinorhizobium meliloti 1021; identical to SEQ ID NO: 28324
  CDS (1)..(1275): transl_table=11

SEQ ID NO: 66682 - protein, 424 aa, Sinorhizobium meliloti 1021; identical to SEQ ID NO: 28325

SEQ ID NO: 66683 - DNA, 1398 bp, Salmonella typhimurium LT2; identical to SEQ ID NO: 28326
  CDS (1)..(1398): transl_table=11

SEQ ID NO: 66684 - protein, 465 aa, Salmonella typhimurium LT2; identical to SEQ ID NO: 28327

SEQ ID NO: 66685 - DNA, 1314 bp, Ralstonia solanacearum GMI1000; identical to SEQ ID NO: 28328
  CDS (1)..(1314): transl_table=11

SEQ ID NO: 66686 - protein, 437 aa, Ralstonia solanacearum GMI1000; identical to SEQ ID NO: 28329

SEQ ID NO: 66687 - DNA, 1386 bp, Ralstonia solanacearum GMI1000; identical to SEQ ID NO: 28330
  CDS (1)..(1386): transl_table=11

SEQ ID NO: 66688 - protein, 461 aa, Ralstonia solanacearum GMI1000; identical to SEQ ID NO: 28331

SEQ ID NO: 66689 - DNA, 2856 bp, Brucella melitensis 16M; identical to SEQ ID NO: 28332
  CDS (1)..(2856): transl_table=11

SEQ ID NO: 66690 - protein, 951 aa, Brucella melitensis 16M; identical to SEQ ID NO: 28333

SEQ ID NO: 66691 - DNA, 1293 bp, Clostridium perfringens str. 13; identical to SEQ ID NO: 28334
  CDS (1)..(1293): transl_table=11

SEQ ID NO: 66692 - protein, 430 aa, Clostridium perfringens str. 13; identical to SEQ ID NO: 28335

SEQ ID NO: 66693 - DNA, 1338 bp, Corynebacterium glutamicum ATCC 13032; identical to SEQ ID NO: 28336
  CDS (1)..(1338): transl_table=11

SEQ ID NO: 66694 - protein, 445 aa, Corynebacterium glutamicum ATCC 13032; identical to SEQ ID NO: 28337

SEQ ID NO: 66695 - DNA, 1239 bp, Streptomyces coelicolor A3(2); identical to SEQ ID NO: 28338
  CDS (1)..(1239): transl_table=11

SEQ ID NO: 66696 - protein, 412 aa, Streptomyces coelicolor A3(2); identical to SEQ ID NO: 28339

SEQ ID NO: 66697 - DNA, 1359 bp, Streptomyces coelicolor A3(2); identical to SEQ ID NO: 28340
  CDS (1)..(1359): transl_table=11

SEQ ID NO: 66698 - protein, 452 aa, Streptomyces coelicolor A3(2); identical to SEQ ID NO: 28341

SEQ ID NO: 66699 - DNA, 1236 bp, Xanthomonas campestris pv. campestris str. ATCC 33913; identical to SEQ ID NO: 28342
  CDS (1)..(1236): transl_table=11

SEQ ID NO: 66700 - protein, 411 aa, Xanthomonas campestris pv. campestris str. ATCC 33913; identical to SEQ ID NO: 28343

SEQ ID NO: 66701 - DNA, 2688 bp, Brucella suis 1330; identical to SEQ ID NO: 28344
  CDS (1)..(2688): transl_table=11

SEQ ID NO: 66702 - protein, 895 aa, Brucella suis 1330; identical to SEQ ID NO: 28345

SEQ ID NO: 66703 - DNA, 1389 bp, Shigella flexneri 2a str. 301; identical to SEQ ID NO: 28346
  CDS (1)..(1389): transl_table=11

SEQ ID NO: 66704 - protein, 462 aa, Shigella flexneri 2a str. 301; identical to SEQ ID NO: 28347

SEQ ID NO: 66705 - DNA, 1434 bp, Corynebacterium efficiens YS-314; identical to SEQ ID NO: 28348
  CDS (1)..(1434): transl_table=11

SEQ ID NO: 66706 - protein, 477 aa, Corynebacterium efficiens YS-314; identical to SEQ ID NO: 28349

SEQ ID NO: 66707 - DNA, 1302 bp, Corynebacterium efficiens YS-314; identical to SEQ ID NO: 28350
  CDS (1)..(1302): transl_table=11

SEQ ID NO: 66708 - protein, 433 aa, Corynebacterium efficiens YS-314; identical to SEQ ID NO: 28351

SEQ ID NO: 66709 - DNA, 1236 bp, Pseudomonas putida KT2440; identical to SEQ ID NO: 28352
  CDS (1)..(1236): transl_table=11

SEQ ID NO: 66710 - protein, 411 aa, Pseudomonas putida KT2440; identical to SEQ ID NO: 28353

SEQ ID NO: 66711 - DNA, 1164 bp, Staphylococcus epidermidis ATCC 12228; identical to SEQ ID NO: 28354
  CDS (1)..(1164): transl_table=11

SEQ ID NO: 66712 - protein, 387 aa, Staphylococcus epidermidis ATCC 12228; identical to SEQ ID NO: 28355

SEQ ID NO: 66713 - DNA, 1380 bp, Bradyrhizobium japonicum USDA 110; identical to SEQ ID NO: 28356
  CDS (1)..(1380): transl_table=11

SEQ ID NO: 66714 - protein, 459 aa, Bradyrhizobium japonicum USDA 110; identical to SEQ ID NO: 28357

SEQ ID NO: 66715 - DNA, 1191 bp, Lactobacillus plantarum WCFS1; identical to SEQ ID NO: 28358
  CDS (1)..(1191): transl_table=11

SEQ ID NO: 66716 - protein, 396 aa, Lactobacillus plantarum WCFS1; identical to SEQ ID NO: 28359

SEQ ID NO: 66717 - DNA, 1212 bp, Pseudomonas syringae pv. tomato str. DC3000; identical to SEQ ID NO: 28360
  CDS (1)..(1212): transl_table=11

SEQ ID NO: 66718 - protein, 403 aa, Pseudomonas syringae pv. tomato str. DC3000; identical to SEQ ID NO: 28361

SEQ ID NO: 66719 - DNA, 1389 bp, Salmonella enterica subsp. enterica serovar Typhi Ty2; identical to SEQ ID NO: 28362
  CDS (1)..(1389): transl_table=11

SEQ ID NO: 66720 - protein, 462 aa, Salmonella enterica subsp. enterica serovar Typhi Ty2; identical to SEQ ID NO: 28363

SEQ ID NO: 66721 - DNA, 1392 bp, Streptomyces avermitilis MA-4680; identical to SEQ ID NO: 28364
  CDS (1)..(1392): transl_table=11

SEQ ID NO: 66722 - protein, 463 aa, Streptomyces avermitilis MA-4680; identical to SEQ ID NO: 28365

SEQ ID NO: 66723 - DNA, 1170 bp, Bacillus cereus ATCC 14579; identical to SEQ ID NO: 28366
  CDS (1)..(1170): transl_table=11

SEQ ID NO: 66724 - protein, 389 aa, Bacillus cereus ATCC 14579; identical to SEQ ID NO: 28367

SEQ ID NO: 66725 - DNA, 1389 bp, Shigella flexneri 2a str. 2457T; identical to SEQ ID NO: 28368
  CDS (1)..(1389): transl_table=11

SEQ ID NO: 66726 - protein, 462 aa, Shigella flexneri 2a str. 2457T; identical to SEQ ID NO: 28369

SEQ ID NO: 66727 - DNA, 1203 bp, Chromobacterium violaceum ATCC 12472; identical to SEQ ID NO: 28370
  CDS (1)..(1203): transl_table=11

SEQ ID NO: 66728 - protein, 400 aa, Chromobacterium violaceum ATCC 12472; identical to SEQ ID NO: 28371

SEQ ID NO: 66729 - DNA, 1380 bp, Chromobacterium violaceum ATCC 12472; identical to SEQ ID NO: 28372
  CDS (1)..(1380): transl_table=11

SEQ ID NO: 66730 - protein, 459 aa, Chromobacterium violaceum ATCC 12472; identical to SEQ ID NO: 28373

SEQ ID NO: 66731 - DNA, 1284 bp, Chromobacterium violaceum ATCC 12472; identical to SEQ ID NO: 28374
  CDS (1)..(1284): transl_table=11

SEQ ID NO: 66732 - protein, 427 aa, Chromobacterium violaceum ATCC 12472; identical to SEQ ID NO: 28375

SEQ ID NO: 66733 - DNA, 1380 bp, Chromobacterium violaceum ATCC 12472; identical to SEQ ID NO: 28376
  CDS (1)..(1380): transl_table=11

SEQ ID NO: 66734 - protein, 459 aa, Chromobacterium violaceum ATCC 12472; identical to SEQ ID NO: 28377

SEQ ID NO: 66735 - DNA, 1332 bp, Corynebacterium diphtheriae NCTC 13129; identical to SEQ ID NO: 28378
  CDS (1)..(1332): transl_table=11

SEQ ID NO: 66736 - protein, 443 aa, Corynebacterium diphtheriae NCTC 13129; identical to SEQ ID NO: 28379

SEQ ID NO: 66737 - DNA, 1299 bp, Corynebacterium diphtheriae NCTC 13129; identical to SEQ ID NO: 28380
  CDS (1)..(1299): transl_table=11

SEQ ID NO: 66738 - protein, 432 aa, Corynebacterium diphtheriae NCTC 13129; identical to SEQ ID NO: 28381

SEQ ID NO: 66739 - DNA, 1281 bp, Cupriavidus necator; identical to SEQ ID NO: 28382
  CDS (1)..(1281): transl_table=11

SEQ ID NO: 66740 - protein, 426 aa, Cupriavidus necator; identical to SEQ ID NO: 28383

SEQ ID NO: 66741 - DNA, 1395 bp, Cupriavidus necator; identical to SEQ ID NO: 28384
  CDS (1)..(1395): transl_table=11

SEQ ID NO: 66742 - protein, 464 aa, Cupriavidus necator; identical to SEQ ID NO: 28385

SEQ ID NO: 66743 - DNA, 1458 bp, Mycobacterium avium subsp. paratuberculosis K-10; identical to SEQ ID NO: 28386
  CDS (1)..(1458): transl_table=11

SEQ ID NO: 66744 - protein, 485 aa, Mycobacterium avium subsp. paratuberculosis K-10; identical to SEQ ID NO: 28387

SEQ ID NO: 66745 - DNA, 1392 bp, Mycobacterium avium subsp. paratuberculosis K-10; identical to SEQ ID NO: 28388
  CDS (1)..(1392): transl_table=11

SEQ ID NO: 66746 - protein, 463 aa, Mycobacterium avium subsp. paratuberculosis K-10; identical to SEQ ID NO: 28389

SEQ ID NO: 66747 - DNA, 1392 bp, Mycobacterium avium subsp. paratuberculosis K-10; identical to SEQ ID NO: 28390
  CDS (1)..(1392): transl_table=11

SEQ ID NO: 66748 - protein, 463 aa, Mycobacterium avium subsp. paratuberculosis K-10; identical to SEQ ID NO: 28391

SEQ ID NO: 66749 - DNA, 1170 bp, Bacillus anthracis str. Sterne; identical to SEQ ID NO: 28392
  CDS (1)..(1170): transl_table=11

SEQ ID NO: 66750 - protein, 389 aa, Bacillus anthracis str. Sterne; identical to SEQ ID NO: 28393

SEQ ID NO: 66751 - DNA, 1170 bp, Bacillus thuringiensis serovar konkukian str. 97-27; identical to SEQ ID NO: 28394
  CDS (1)..(1170): transl_table=11

SEQ ID NO: 66752 - protein, 389 aa, Bacillus thuringiensis serovar konkukian str. 97-27; identical to SEQ ID NO: 28395

SEQ ID NO: 66753 - DNA, 1170 bp, Staphylococcus aureus subsp. aureus MRSA252; identical to SEQ ID NO: 28396
  CDS (1)..(1170): transl_table=11

SEQ ID NO: 66754 - protein, 389 aa, Staphylococcus aureus subsp. aureus MRSA252; identical to SEQ ID NO: 28397

SEQ ID NO: 66755 - DNA, 1170 bp, Staphylococcus aureus subsp. aureus MSSA476; identical to SEQ ID NO: 28398
  CDS (1)..(1170): transl_table=11

SEQ ID NO: 66756 - protein, 389 aa, Staphylococcus aureus subsp. aureus MSSA476; identical to SEQ ID NO: 28399

SEQ ID NO: 66757 - DNA, 1389 bp, Erwinia carotovora subsp. atroseptica SCRI1043; identical to SEQ ID NO: 28400
  CDS (1)..(1389): transl_table=11

SEQ ID NO: 66758 - protein, 462 aa, Erwinia carotovora subsp. atroseptica SCRI1043; identical to SEQ ID NO: 28401

SEQ ID NO: 66759 - DNA, 1317 bp, Propionibacterium acnes KPA171202; identical to SEQ ID NO: 28402
  CDS (1)..(1317): transl_table=11

SEQ ID NO: 66760 - protein, 438 aa, Propionibacterium acnes KPA171202; identical to SEQ ID NO: 28403

SEQ ID NO: 66761 - DNA, 1206 bp, Bacillus licheniformis ATCC 14580; identical to SEQ ID NO: 28404
  CDS (1)..(1206): transl_table=11

SEQ ID NO: 66762 - protein, 401 aa, Bacillus licheniformis ATCC 14580; identical to SEQ ID NO: 28405

SEQ ID NO: 66763 - DNA, 1185 bp, Bacillus licheniformis ATCC 14580; identical to SEQ ID NO: 28406
  CDS (1)..(1185): transl_table=11

SEQ ID NO: 66764 - protein, 394 aa, Bacillus licheniformis ATCC 14580; identical to SEQ ID NO: 28407

SEQ ID NO: 66765 - DNA, 1230 bp, Burkholderia mallei ATCC 23344; identical to SEQ ID NO: 28408
  CDS (1)..(1230): transl_table=11

SEQ ID NO: 66766 - protein, 409 aa, Burkholderia mallei ATCC 23344; identical to SEQ ID NO: 28409

SEQ ID NO: 66767 - DNA, 1404 bp, Burkholderia mallei ATCC 23344; identical to SEQ ID NO: 28410
  CDS (1)..(1404): transl_table=11

SEQ ID NO: 66768 - protein, 467 aa, Burkholderia mallei ATCC 23344; identical to SEQ ID NO: 28411

SEQ ID NO: 66769 - DNA, 1281 bp, Burkholderia pseudomallei K96243; identical to SEQ ID NO: 28412
  CDS (1)..(1281): transl_table=11

SEQ ID NO: 66770 - protein, 426 aa, Burkholderia pseudomallei K96243; identical to SEQ ID NO: 28413

SEQ ID NO: 66771 - DNA, 1386 bp, Burkholderia pseudomallei K96243; identical to SEQ ID NO: 28414
  CDS (1)..(1386): transl_table=11

SEQ ID NO: 66772 - protein, 461 aa, Burkholderia pseudomallei K96243; identical to SEQ ID NO: 28415

SEQ ID NO: 66773 - DNA, 1458 bp, Burkholderia pseudomallei K96243; identical to SEQ ID NO: 28416
  CDS (1)..(1458): transl_table=11

SEQ ID NO: 66774 - protein, 485 aa, Burkholderia pseudomallei K96243; identical to SEQ ID NO: 28417

SEQ ID NO: 66775 - DNA, 1275 bp, Burkholderia pseudomallei K96243; identical to SEQ ID NO: 28418
  CDS (1)..(1275): transl_table=11

SEQ ID NO: 66776 - protein, 424 aa, Burkholderia pseudomallei K96243; identical to SEQ ID NO: 28419

SEQ ID NO: 66777 - DNA, 1275 bp, Methylococcus capsulatus str. Bath; identical to SEQ ID NO: 28420
  CDS (1)..(1275): transl_table=11

SEQ ID NO: 66778 - protein, 424 aa, Methylococcus capsulatus str. Bath; identical to SEQ ID NO: 28421

SEQ ID NO: 66779 - DNA, 1470 bp, Nocardia farcinica IFM 10152; identical to SEQ ID NO: 28422
  CDS (1)..(1470): transl_table=11

SEQ ID NO: 66780 - protein, 489 aa, Nocardia farcinica IFM 10152; identical to SEQ ID NO: 28423

SEQ ID NO: 66781 - DNA, 1485 bp, Nocardia farcinica IFM 10152; identical to SEQ ID NO: 28424
  CDS (1)..(1485): transl_table=11

SEQ ID NO: 66782 - protein, 494 aa, Nocardia farcinica IFM 10152; identical to SEQ ID NO: 28425

SEQ ID NO: 66783 - DNA, 1323 bp, Haloarcula marismortui ATCC 43049; identical to SEQ ID NO: 28426
  CDS (1)..(1323): transl_table=11

SEQ ID NO: 66784 - protein, 440 aa, Haloarcula marismortui ATCC 43049; identical to SEQ ID NO: 28427

SEQ ID NO: 66785 - DNA, 1200 bp, Geobacillus kaustophilus HTA426; identical to SEQ ID NO: 28428
  CDS (1)..(1200): transl_table=11

SEQ ID NO: 66786 - protein, 399 aa, Geobacillus kaustophilus HTA426; identical to SEQ ID NO: 28429

SEQ ID NO: 66787 - DNA, 1203 bp, Geobacillus kaustophilus HTA426; identical to SEQ ID NO: 28430
  CDS (1)..(1203): transl_table=11

SEQ ID NO: 66788 - protein, 400 aa, Geobacillus kaustophilus HTA426; identical to SEQ ID NO: 28431

SEQ ID NO: 66789 - DNA, 1389 bp, Salmonella enterica subsp. enterica serovar Paratyphi A str. ATCC; identical to SEQ ID NO: 28432
  CDS (1)..(1389): transl_table=11

SEQ ID NO: 66790 - protein, 462 aa, Salmonella enterica subsp. enterica serovar Paratyphi A str. ATCC; identical to SEQ ID NO: 28433

SEQ ID NO: 66791 - DNA, 1332 bp, Idiomarina loihiensis L2TR; identical to SEQ ID NO: 28434
  CDS (1)..(1332): transl_table=11

SEQ ID NO: 66792 - protein, 443 aa, Idiomarina loihiensis L2TR; identical to SEQ ID NO: 28435

SEQ ID NO: 66793 - DNA, 1692 bp, Azoarcus sp. EbN1; identical to SEQ ID NO: 28436
  CDS (1)..(1692): transl_table=11

SEQ ID NO: 66794 - protein, 563 aa, Azoarcus sp. EbN1; identical to SEQ ID NO: 28437

SEQ ID NO: 66795 - DNA, 1377 bp, Azoarcus sp. EbN1; identical to SEQ ID NO: 28438
  CDS (1)..(1377): transl_table=11

SEQ ID NO: 66796 - protein, 458 aa, Azoarcus sp. EbN1; identical to SEQ ID NO: 28439

SEQ ID NO: 66797 - DNA, 1509 bp, Bacillus clausii KSM-K16; identical to SEQ ID NO: 28440
  CDS (1)..(1509): transl_table=11

SEQ ID NO: 66798 - protein, 502 aa, Bacillus clausii KSM-K16; identical to SEQ ID NO: 28441

SEQ ID NO: 66799 - DNA, 1206 bp, Bacillus clausii KSM-K16; identical to SEQ ID NO: 28442
  CDS (1)..(1206): transl_table=11

SEQ ID NO: 66800 - protein, 401 aa, Bacillus clausii KSM-K16; identical to SEQ ID NO: 28443

SEQ ID NO: 66801 - DNA, 1164 bp, Staphylococcus epidermidis RP62A; identical to SEQ ID NO: 28444
  CDS (1)..(1164): transl_table=11

SEQ ID NO: 66802 - protein, 387 aa, Staphylococcus epidermidis RP62A; identical to SEQ ID NO: 28445

SEQ ID NO: 66803 - DNA, 1389 bp, Salmonella enterica subsp. enterica serovar Choleraesuis str; identical to SEQ ID NO: 28446
  CDS (1)..(1389): transl_table=11

SEQ ID NO: 66804 - protein, 462 aa, Salmonella enterica subsp. enterica serovar Choleraesuis str; identical to SEQ ID NO: 28447

SEQ ID NO: 66805 - DNA, 1212 bp, Pseudomonas syringae pv. syringae B728a; identical to SEQ ID NO: 28448
  CDS (1)..(1212): transl_table=11

SEQ ID NO: 66806 - protein, 403 aa, Pseudomonas syringae pv. syringae B728a; identical to SEQ ID NO: 28449

SEQ ID NO: 66807 - DNA, 1158 bp, Staphylococcus haemolyticus JCSC1435; identical to SEQ ID NO: 28450
  CDS (1)..(1158): transl_table=11

SEQ ID NO: 66808 - protein, 385 aa, Staphylococcus haemolyticus JCSC1435; identical to SEQ ID NO: 28451

SEQ ID NO: 66809 - DNA, 1380 bp, Psychrobacter arcticum 273-4; identical to SEQ ID NO: 28452
  CDS (1)..(1380): transl_table=11

SEQ ID NO: 66810 - protein, 459 aa, Psychrobacter arcticum 273-4; identical to SEQ ID NO: 28453

SEQ ID NO: 66811 - DNA, 1212 bp, Pseudomonas syringae pv. phaseolicola 1448A; identical to SEQ ID NO: 28454
  CDS (1)..(1212): transl_table=11

SEQ ID NO: 66812 - protein, 403 aa, Pseudomonas syringae pv. phaseolicola 1448A; identical to SEQ ID NO: 28455

SEQ ID NO: 66813 - DNA, 1215 bp, Dechloromonas aromatica RCB; identical to SEQ ID NO: 28456
  CDS (1)..(1215): transl_table=11

SEQ ID NO: 66814 - protein, 404 aa, Dechloromonas aromatica RCB; identical to SEQ ID NO: 28457

SEQ ID NO: 66815 - DNA, 1290 bp, Ralstonia eutropha JMP134; identical to SEQ ID NO: 28458
  CDS (1)..(1290): transl_table=11

SEQ ID NO: 66816 - protein, 429 aa, Ralstonia eutropha JMP134; identical to SEQ ID NO: 28459

SEQ ID NO: 66817 - DNA, 1386 bp, Ralstonia eutropha JMP134; identical to SEQ ID NO: 28460
  CDS (1)..(1386): transl_table=11

SEQ ID NO: 66818 - protein, 461 aa, Ralstonia eutropha JMP134; identical to SEQ ID NO: 28461

SEQ ID NO: 66819 - DNA, 1362 bp, Shigella sonnei Ss046; identical to SEQ ID NO: 28462
  CDS (1)..(1362): transl_table=11

SEQ ID NO: 66820 - protein, 453 aa, Shigella sonnei Ss046; identical to SEQ ID NO: 28463

SEQ ID NO: 66821 - DNA, 1269 bp, Thiobacillus denitrificans ATCC 25259; identical to SEQ ID NO: 28464
  CDS (1)..(1269): transl_table=11

SEQ ID NO: 66822 - protein, 422 aa, Thiobacillus denitrificans ATCC 25259; identical to SEQ ID NO: 28465

SEQ ID NO: 66823 - DNA, 1677 bp, Thiobacillus denitrificans ATCC 25259; identical to SEQ ID NO: 28466
  CDS (1)..(1677): transl_table=11

SEQ ID NO: 66824 - protein, 558 aa, Thiobacillus denitrificans ATCC 25259; identical to SEQ ID NO: 28467

SEQ ID NO: 66825 - DNA, 1263 bp, Magnetospirillum magnetotacticum MS-1; identical to SEQ ID NO: 28468
  CDS (1)..(1263)

SEQ ID NO: 66826 - protein, 420 aa, Magnetospirillum magnetotacticum MS-1; identical to SEQ ID NO: 28469

SEQ ID NO: 66827 - DNA, 1407 bp, Pseudomonas aeruginosa UCBPP-PA14; identical to SEQ ID NO: 28470
  CDS (1)..(1407)

SEQ ID NO: 66828 - protein, 468 aa, Pseudomonas aeruginosa UCBPP-PA14; identical to SEQ ID NO: 28471

SEQ ID NO: 66829 - DNA, 1326 bp, Burkholderia cepacia R18194; identical to SEQ ID NO: 28472
  CDS (1)..(1326)

SEQ ID NO: 66830 - protein, 441 aa, Burkholderia cepacia R18194; identical to SEQ ID NO: 28473

SEQ ID NO: 66831 - DNA, 1326 bp, Burkholderia cenocepacia AU 1054; identical to SEQ ID NO: 28474
  CDS (1)..(1326): transl_table=11

SEQ ID NO: 66832 - protein, 441 aa, Burkholderia cenocepacia AU 1054; identical to SEQ ID NO: 28475

SEQ ID NO: 66833 - DNA, 1407 bp, Burkholderia pseudomallei S13; identical to SEQ ID NO: 28476
  CDS (1)..(1407)

SEQ ID NO: 66834 - protein, 468 aa, Burkholderia pseudomallei S13; identical to SEQ ID NO: 28477

SEQ ID NO: 66835 - DNA, 1212 bp, Polaromonas sp. JS666; identical to SEQ ID NO: 28478
  CDS (1)..(1212): transl_table=11

SEQ ID NO: 66836 - protein, 403 aa, Polaromonas sp. JS666; identical to SEQ ID NO: 28479

SEQ ID NO: 66837 - DNA, 1320 bp, Geobacter metallireducens GS-15; identical to SEQ ID NO: 28480
  CDS (1)..(1320): transl_table=11

SEQ ID NO: 66838 - protein, 439 aa, Geobacter metallireducens GS-15; identical to SEQ ID NO: 28481

SEQ ID NO: 66839 - DNA, 1230 bp, Nitrobacter hamburgensis X14; identical to SEQ ID NO: 28482
  CDS (1)..(1230): transl_table=11

SEQ ID NO: 66840 - protein, 409 aa, Nitrobacter hamburgensis X14; identical to SEQ ID NO: 28483

SEQ ID NO: 66841 - DNA, 1209 bp, Paracoccus denitrificans PD1222; identical to SEQ ID NO: 28484
  CDS (1)..(1209): transl_table=11

SEQ ID NO: 66842 - protein, 402 aa, Paracoccus denitrificans PD1222; identical to SEQ ID NO: 28485

SEQ ID NO: 66843 - DNA, 1401 bp, Pseudomonas aeruginosa; identical to SEQ ID NO: 28486
  CDS (1)..(1401): transl_table=11

SEQ ID NO: 66844 - protein, 466 aa, Pseudomonas aeruginosa; identical to SEQ ID NO: 28487

SEQ ID NO: 66845 - DNA, 1416 bp, Mycobacterium fortuitum; identical to SEQ ID NO: 28488
  CDS (1)..(1416): transl_table=11

SEQ ID NO: 66846 - protein, 471 aa, Mycobacterium fortuitum; identical to SEQ ID NO: 28489

SEQ ID NO: 66847 - DNA, 1527 bp, Populus tremula x Populus tremuloides; identical to SEQ ID NO: 28490
  CDS (1)..(1527)

SEQ ID NO: 66848 - protein, 508 aa, Populus tremula x Populus tremuloides; identical to SEQ ID NO: 28491

SEQ ID NO: 66849 - DNA, 1602 bp, Pseudomonas sp; identical to SEQ ID NO: 28492
  CDS (1)..(1602): transl_table=11

SEQ ID NO: 66850 - protein, 533 aa, Pseudomonas sp; identical to SEQ ID NO: 28493

SEQ ID NO: 66851 - DNA, 1302 bp, Halomonas maura; identical to SEQ ID NO: 28494
  CDS (1)..(1302): transl_table=11

SEQ ID NO: 66852 - protein, 433 aa, Halomonas maura; identical to SEQ ID NO: 28495

SEQ ID NO: 66853 - DNA, 1254 bp, Rhizobium sp; identical to SEQ ID NO: 28496
  CDS (1)..(1254): transl_table=11

SEQ ID NO: 66854 - protein, 417 aa, Rhizobium sp; identical to SEQ ID NO: 28497

SEQ ID NO: 66855 - DNA, 1311 bp, Halobacterium mediterranei; identical to SEQ ID NO: 28498
  CDS (1)..(1311): transl_table=11

SEQ ID NO: 66856 - protein, 436 aa, Halobacterium mediterranei; identical to SEQ ID NO: 28499

SEQ ID NO: 66857 - DNA, 1650 bp, Physcomitrella patens; identical to SEQ ID NO: 28500
  CDS (1)..(1650)

SEQ ID NO: 66858 - protein, 549 aa, Physcomitrella patens; identical to SEQ ID NO: 28501

SEQ ID NO: 66859 - DNA, 1353 bp, Corynebacterium glutamicum; identical to SEQ ID NO: 28502
  CDS (1)..(1353): transl_table=11

SEQ ID NO: 66860 - protein, 450 aa, Corynebacterium glutamicum; identical to SEQ ID NO: 28503

SEQ ID NO: 66861 - DNA, 1284 bp, Paracoccus halodenitrificans; identical to SEQ ID NO: 28504
  CDS (1)..(1284): transl_table=11

SEQ ID NO: 66862 - protein, 427 aa, Paracoccus halodenitrificans; identical to SEQ ID NO: 28505

SEQ ID NO: 66863 - DNA, 1593 bp, Paracoccus halodenitrificans; identical to SEQ ID NO: 28506
  CDS (1)..(1593): transl_table=11

SEQ ID NO: 66864 - protein, 530 aa, Paracoccus halodenitrificans; identical to SEQ ID NO: 28507

SEQ ID NO: 66865 - DNA, 2718 bp, Paracoccus pantotrophus; identical to SEQ ID NO: 28508
  CDS (1)..(2718): transl_table=11

SEQ ID NO: 66866 - protein, 905 aa, Paracoccus pantotrophus; identical to SEQ ID NO: 28509

SEQ ID NO: 66867 - DNA, 1266 bp, Pseudomonas fluorescens; identical to SEQ ID NO: 28510
  CDS (1)..(1266): transl_table=11

SEQ ID NO: 66868 - protein, 421 aa, Pseudomonas fluorescens; identical to SEQ ID NO: 28511

SEQ ID NO: 66869 - DNA, 1332 bp, Thermus thermophilus; identical to SEQ ID NO: 28512
  CDS (1)..(1332): transl_table=11

SEQ ID NO: 66870 - protein, 443 aa, Thermus thermophilus; identical to SEQ ID NO: 28513

SEQ ID NO: 66871 - DNA, 1308 bp, Thermus thermophilus; identical to SEQ ID NO: 28514
  CDS (1)..(1308): transl_table=11

SEQ ID NO: 66872 - protein, 435 aa, Thermus thermophilus; identical to SEQ ID NO: 28515

SEQ ID NO: 66873 - DNA, 1449 bp, Cylindrotheca fusiformis; identical to SEQ ID NO: 28516
  CDS (1)..(1449)

SEQ ID NO: 66874 - protein, 482 aa, Cylindrotheca fusiformis; identical to SEQ ID NO: 28517

SEQ ID NO: 66875 - DNA, 1449 bp, Cylindrotheca fusiformis; identical to SEQ ID NO: 28518
  CDS (1)..(1449)

SEQ ID NO: 66876 - protein, 482 aa, Cylindrotheca fusiformis; identical to SEQ ID NO: 28519

SEQ ID NO: 66877 - DNA, 1449 bp, Cylindrotheca fusiformis; identical to SEQ ID NO: 28520
  CDS (1)..(1449)

SEQ ID NO: 66878 - protein, 482 aa, Cylindrotheca fusiformis; identical to SEQ ID NO: 28521

SEQ ID NO: 66879 - DNA, 1212 bp, Pseudomonas aeruginosa; identical to SEQ ID NO: 28522
  CDS (1)..(1212): transl_table=11

SEQ ID NO: 66880 - protein, 403 aa, Pseudomonas aeruginosa; identical to SEQ ID NO: 28523

SEQ ID NO: 66881 - DNA, 1389 bp, Escherichia coli; identical to SEQ ID NO: 28524
  CDS (1)..(1389): transl_table=11

SEQ ID NO: 66882 - protein, 462 aa, Escherichia coli; identical to SEQ ID NO: 28525

SEQ ID NO: 66883 - DNA, 1389 bp, Salmonella typhimurium; identical to SEQ ID NO: 28526
  CDS (1)..(1389): transl_table=11

SEQ ID NO: 66884 - protein, 462 aa, Salmonella typhimurium; identical to SEQ ID NO: 28527

SEQ ID NO: 66885 - DNA, 1266 bp, Bacillus subtilis; identical to SEQ ID NO: 28528
  CDS (1)..(1266): transl_table=11

SEQ ID NO: 66886 - protein, 421 aa, Bacillus subtilis; identical to SEQ ID NO: 28529

SEQ ID NO: 66887 - DNA, 21 bp, Artificial sequence
  (1)..(21): primer
atgagtcactcatccgccccc

SEQ ID NO: 66888 - DNA, 27 bp, Artificial sequence
  (1)..(27): primer
ttattttttagaatgccgaccatatac

SEQ ID NO: 66889 - protein, 512 aa, Artificial sequence; identical to SEQ ID NO: 28532
  Variant (2)..(9): xaa in position 2 to 9 is any amino acid
  Variant (11)..(11): xaa in position 11 is any amino acid
  Variant (13)..(13): xaa in position 13 is any amino acid
  Variant (16)..(16): xaa in position 16 is any amino acid
  Variant (18)..(22): xaa in position 18 to 22 is any amino acid
  Variant (23)..(24): xaa in position 23 to 24 is any or no amino acid
  Variant (26)..(38): xaa in position 26 to 38 is any amino acid
  Variant (39)..(49): xaa in position 39 to 49 is any or no amino acid
  Variant (51)..(51): xaa in position 51 is any amino acid
  Variant (53)..(54): xaa in position 53 to 54 is any amino acid
  Variant (55)..(55): xaa in position 55 is any or no amino acid
  Variant (57)..(57): xaa in position 57 is any amino acid
  Variant (60)..(60): xaa in position 60 is any amino acid
  Variant (64)..(72): xaa in position 64 to 72 is any amino acid
  Variant (74)..(74): xaa in position 74 is any amino acid
  Variant (76)..(86): xaa in position 76 to 86 is any amino acid
  Variant (88)..(101): xaa in position 88 to 101 is any amino acid
  Variant (102)..(110): xaa in position 102 to 110 is any or no amino acid
  Variant (112)..(112): xaa in position 112 is any amino acid
  Variant (113)..(113): xaa in position 113 is any or no amino acid
  Variant (115)..(117): xaa in position 115 to 117 is any amino acid
  Variant (119)..(119): xaa in position 119 is any amino acid
  Variant (123)..(123): xaa in position 123 is any amino acid
  Variant (126)..(127): xaa in position 126 to 127 is any amino acid
  Variant (129)..(133): xaa in position 129 to 133 is any amino acid
  Variant (137)..(140): xaa in position 137 to 140 is any amino acid
  Variant (142)..(142): xaa in position 142 is any amino acid
  Variant (144)..(144): xaa in position 144 is any amino acid
  Variant (147)..(147): xaa in position 147 is any amino acid
  Variant (150)..(150): xaa in position 150 is any amino acid
  Variant (151)..(151): xaa in position 151 is any or no amino acid
  Variant (153)..(153): xaa in position 153 is any amino acid
  Variant (155)..(156): xaa in position 155 to 156 is any amino acid
  Variant (158)..(162): xaa in position 158 to 162 is any amino acid
  Variant (164)..(164): xaa in position 164 is any or no amino acid
  Variant (166)..(181): xaa in position 166 to 181 is any amino acid
  Variant (182)..(210): xaa in position 182 to 210 is any or no amino acid
  Variant (212)..(212): xaa in position 212 is any amino acid
  Variant (214)..(215): xaa in position 214 to 215 is any amino acid
  Variant (217)..(243): xaa in position 217 to 243 is any amino acid
  Variant (244)..(314): xaa in position 244 to 314 is any or no amino acid
  Variant (316)..(320): xaa in position 316 to 320 is any amino acid
  Variant (322)..(324): xaa in position 322 to 324 is any amino acid
  Variant (327)..(327): xaa in position 327 is any amino acid
  Variant (331)..(342): xaa in position 331 to 342 is any amino acid
  Variant (344)..(357): xaa in position 344 to 357 is any amino acid
  Variant (358)..(377): xaa in position 358 to 377 is any or no amino acid
  Variant (379)..(381): xaa in position 379 to 381 is any amino acid
  Variant (383)..(384): xaa in position 383 to 384 is any amino acid
  Variant (387)..(387): xaa in position 387 is any amino acid
  Variant (392)..(392): xaa in position 392 is any amino acid
  Variant (395)..(432): xaa in position 395 to 432 is any amino acid
  Variant (433)..(455): xaa in position 433 to 455 is any or no amino acid
  Variant (457)..(457): xaa in position 457 is any amino acid
  Variant (459)..(459): xaa in position 459 is any amino acid
  Variant (462)..(462): xaa in position 462 is any amino acid
  Variant (464)..(465): xaa in position 464 to 465 is any amino acid
  Variant (467)..(469): xaa in position 467 to 469 is any amino acid
  Variant (471)..(474): xaa in position 471 to 474 is any amino acid
  Variant (475)..(497): xaa in position 475 to 497 is any or no amino acid
  Variant (499)..(501): xaa in position 499 to 501 is any amino acid
  Variant (503)..(507): xaa in position 503 to 507 is any amino acid
  Variant (510)..(510): xaa in position 510 is any amino acid

SEQ ID NO: 66890 - protein, 19 aa, Artificial sequence
  Variant (2)..(10): xaa in position 2 to 10 is any amino acid
  Variant (11)..(11): xaa in position 11 is any or no amino acid
  Variant (13)..(13): xaa in position 13 is any amino acid
  Variant (14)..(14): xaa in position 14 is Ala, Ile or Val
  Variant (16)..(16): xaa in position 16 is any amino acid
  Variant (17)..(17): xaa in position 17 is Ile, Leu, Met or Val
  Variant (18)..(18): xaa in position 18 is any amino acid
  Variant (19)..(19): xaa in position 19 is Ala, Gly or Ser
LXXXXXXXXXXFXXWXXXX

SEQ ID NO: 66891 - protein, 45 aa, Artificial sequence; identical to SEQ ID NO: 28534
  Variant (2)..(3): xaa in position 2 to 3 is any amino acid
  Variant (4)..(4): xaa in position 4 is any or no amino acid
  Variant (6)..(6): xaa in position 6 is Ala, Gly or Thr
  Variant (7)..(7): xaa in position 7 is any amino acid
  Variant (9)..(9): xaa in position 9 is Ala, Gly or Ser
  Variant (10)..(12): xaa in position 10 to 12 is any amino acid
  Variant (13)..(13): xaa in position 13 is Ala, Gly, Pro, Ser or Thr
  Variant (14)..(15): xaa in position 14 to 15 is any amino acid
  Variant (16)..(16): xaa in position 16 is Ala, Gly, Asn, Pro or Ser
  Variant (17)..(18): xaa in position 17 to 18 is any amino acid
  Variant (19)..(19): xaa in position 19 is Phe, His or Tyr
  Variant (20)..(24): xaa in position 20 to 24 is any amino acid
  Variant (26)..(26): xaa in position 26 is any amino acid
  Variant (27)..(27): xaa in position 27 is Ala, Ser or Val
  Variant (28)..(28): xaa in position 28 is any amino acid
  Variant (30)..(31): xaa in position 30 to 31 is any amino acid
  Variant (32)..(33): xaa in position 32 to 33 is any or no amino acid
  Variant (35)..(38): xaa in position 35 to 38 is any amino acid
  Variant (39)..(39): xaa in position 39 is Ala, Gly or Val
  Variant (40)..(44): xaa in position 40 to 44 is any amino acid
  Variant (45)..(45): xaa in position 45 is Phe, Ile, Leu or Val

SEQ ID NO: 66892 - protein, 24 aa, Artificial sequence
  Variant (2)..(3): xaa in position 2 to 3 is any amino acid
  Variant (4)..(4): xaa in position 4 is any or no amino acid
  Variant (6)..(6): xaa in position 6 is any or no amino acid
  Variant (8)..(8): xaa in position 8 is Ala, Gly or Ser
  Variant (9)..(9): xaa in position 9 is Phe or Tyr
  Variant (10)..(10): xaa in position 10 is Ala, Ile or Val
  Variant (11)..(11): xaa in position 11 is Ala or Gly
  Variant (12)..(12): xaa in position 12 is any amino acid
  Variant (13)..(13): xaa in position 13 is Ala, Gly, Ser or Thr
  Variant (14)..(15): xaa in position 14 to 15 is any amino acid
  Variant (16)..(16): xaa in position 16 is Phe, Leu, Met or Val
  Variant (17)..(17): xaa in position 17 is Ala, Gly, Pro, Ser or Thr
  Variant (18)..(23): xaa in position 18 to 23 is any amino acid
  Variant (24)..(24): xaa in position 24 is Phe or Tyr
YXXXFXGXXXXXXXXXXXXXXXXX

SEQ ID NO: 66893 - protein, 33 aa, Artificial sequence; identical to SEQ ID NO: 28536
  Variant (2)..(19): xaa in position 2 to 19 is any amino acid
  Variant (20)..(22): xaa in position 20 to 22 is any or no amino acid
  Variant (24)..(24): xaa in position 24 is Phe, Ile, Leu, Met or Val
  Variant (25)..(25): xaa in position 25 is any amino acid
  Variant (26)..(26): xaa in position 26 is Ala, Gly or Ser
  Variant (27)..(28): xaa in position 27 to 28 is any amino acid
  Variant (30)..(30): xaa in position 30 is Ala, Cys, Gly, Asn, Ser or Thr
  Variant (31)..(31): xaa in position 31 is any amino acid
  Variant (33)..(33): xaa in position 33 is Ala, Gly, Pro or Ser

SEQ ID NO: 66894 - DNA, 291 bp, Escherichia coli K12; identical to SEQ ID NO: 18608
  CDS (1)..(291): transl_table=11

SEQ ID NO: 66895 - protein, 96 aa, Escherichia coli K12; identical to SEQ ID NO: 18609

SEQ ID NO: 66896 - DNA, 216 bp, Bacteriophage 933W; identical to SEQ ID NO: 18610
  CDS (1)..(216): transl_table=11

SEQ ID NO: 66897 - protein, 71 aa, Bacteriophage 933W; identical to SEQ ID NO: 18611

SEQ ID NO: 66898 - DNA, 291 bp, Bacteriophage VT2-Sa; identical to SEQ ID NO: 18612
  CDS (1)..(291): transl_table=11

SEQ ID NO: 66899 - protein, 96 aa, Bacteriophage VT2-Sa; identical to SEQ ID NO: 18613

SEQ ID NO: 66900 - DNA, 315 bp, Escherichia coli O157:H7 EDL933; identical to SEQ ID NO: 18614
  CDS (1)..(315): transl_table=11

SEQ ID NO: 66901 - protein, 104 aa, Escherichia coli O157:H7 EDL933; identical to SEQ ID NO: 18615

SEQ ID NO: 66902 - DNA, 315 bp, Escherichia coli O157:H7 EDL933; identical to SEQ ID NO: 18616
  CDS (1)..(315): transl_table=11

SEQ ID NO: 66903 - protein, 104 aa, Escherichia coli O157:H7 EDL933; identical to SEQ ID NO: 18617

SEQ ID NO: 66904 - DNA, 273 bp, Escherichia coli O157:H7 EDL933; identical to SEQ ID NO: 18618
  CDS (1)..(273): transl_table=11

SEQ ID NO: 66905 - protein, 90 aa, Escherichia coli O157:H7 EDL933; identical to SEQ ID NO: 18619

SEQ ID NO: 66906 - DNA, 216 bp, Escherichia coli O157:H7; identical to SEQ ID NO: 18620
  CDS (1)..(216): transl_table=11

SEQ ID NO: 66907 - protein, 71 aa, Escherichia coli O157:H7; identical to SEQ ID NO: 18621

SEQ ID NO: 66908 - DNA, 207 bp, Escherichia coli O157:H7; identical to SEQ ID NO: 18622
  CDS (1)..(207): transl_table=11

SEQ ID NO: 66909 - protein, 68 aa, Escherichia coli O157:H7; identical to SEQ ID NO: 18623

SEQ ID NO: 66910 - DNA, 216 bp, Escherichia coli O157:H7; identical to SEQ ID NO: 18624
  CDS (1)..(216): transl_table=11

SEQ ID NO: 66911 - protein, 71 aa, Escherichia coli O157:H7; identical to SEQ ID NO: 18625

SEQ ID NO: 66912 - DNA, 216 bp, Escherichia coli O157:H7; identical to SEQ ID NO: 18626
  CDS (1)..(216): transl_table=11

SEQ ID NO: 66913 - protein, 71 aa, Escherichia coli O157:H7; identical to SEQ ID NO: 18627

SEQ ID NO: 66914 - DNA, 216 bp, Escherichia coli O157:H7; identical to SEQ ID NO: 18628
  CDS (1)..(216): transl_table=11

SEQ ID NO: 66915 - protein, 71 aa, Escherichia coli O157:H7; identical to SEQ ID NO: 18629

SEQ ID NO: 66916 - DNA, 207 bp, Escherichia coli O157:H7; identical to SEQ ID NO: 18630
  CDS (1)..(207): transl_table=11

SEQ ID NO: 66917 - protein, 68 aa, Escherichia coli O157:H7; identical to SEQ ID NO: 18631

SEQ ID NO: 66918 - DNA, 207 bp, Escherichia coli O157:H7; identical to SEQ ID NO: 18632
  CDS (1)..(207): transl_table=11

SEQ ID NO: 66919 - protein, 68 aa, Escherichia coli O157:H7; identical to SEQ ID NO: 18633

SEQ ID NO: 66920 - DNA, 216 bp, Shigella flexneri 2a str. 301; identical to SEQ ID NO: 18634
  CDS (1)..(216): transl_table=11

SEQ ID NO: 66921 - protein, 71 aa, Shigella flexneri 2a str. 301; identical to SEQ ID NO: 18635

SEQ ID NO: 66922 - DNA, 216 bp, Shigella flexneri 2a str. 301; identical to SEQ ID NO: 18636
  CDS (1)..(216): transl_table=11

SEQ ID NO: 66923 - protein, 71 aa, Shigella flexneri 2a str. 301; identical to SEQ ID NO: 18637

SEQ ID NO: 66924 - DNA, 321 bp, Escherichia coli CFT073; identical to SEQ ID NO: 18638
  CDS (1)..(321): transl_table=11

SEQ ID NO: 66925 - protein, 106 aa, Escherichia coli CFT073; identical to SEQ ID NO: 18639

SEQ ID NO: 66926 - DNA, 216 bp, Escherichia coli CFT073; identical to SEQ ID NO: 18640
  CDS (1)..(216): transl_table=11

SEQ ID NO: 66927 - protein, 71 aa, Escherichia coli CFT073; identical to SEQ ID NO: 18641

SEQ ID NO: 66928 - DNA, 216 bp, Shigella flexneri 2a str. 2457T; identical to SEQ ID NO: 18642
  CDS (1)..(216): transl_table=11

SEQ ID NO: 66929 - protein, 71 aa, Shigella flexneri 2a str. 2457T; identical to SEQ ID NO: 18643

SEQ ID NO: 66930 - DNA, 180 bp, Shigella flexneri 2a str. 2457T; identical to SEQ ID NO: 18644
  CDS (1)..(180): transl_table=11

SEQ ID NO: 66931 - protein, 59 aa, Shigella flexneri 2a str. 2457T; identical to SEQ ID NO: 18645

SEQ ID NO: 66932 - DNA, 213 bp, Yersinia pseudotuberculosis IP 32953; identical to SEQ ID NO: 18646
  CDS (1)..(213): transl_table=11

SEQ ID NO: 66933 - protein, 70 aa, Yersinia pseudotuberculosis IP 32953; identical to SEQ ID NO: 18647

SEQ ID NO: 66934 - DNA, 216 bp, Shigella sonnei Ss046; identical to SEQ ID NO: 18648
  CDS (1)..(216): transl_table=11

SEQ ID NO: 66935 - protein, 71 aa, Shigella sonnei Ss046; identical to SEQ ID NO: 18649

SEQ ID NO: 66936 - DNA, 216 bp, Shigella sonnei Ss046; identical to SEQ ID NO: 18650
  CDS (1)..(216): transl_table=11

SEQ ID NO: 66937 - protein, 71 aa, Shigella sonnei Ss046; identical to SEQ ID NO: 18651

SEQ ID NO: 66938 - DNA, 207 bp, Bacteriophage H19B; identical to SEQ ID NO: 18652
  CDS (1)..(207): transl_table=11

SEQ ID NO: 66939 - protein, 68 aa, Bacteriophage H19B; identical to SEQ ID NO: 18653

SEQ ID NO: 66940 - DNA, 291 bp, Stx1; identical to SEQ ID NO: 18654
  CDS (1)..(291): transl_table=11

SEQ ID NO: 66941 - protein, 96 aa, Stx1; identical to SEQ ID NO: 18655

SEQ ID NO: 66942 - DNA, 150 bp, Escherichia coli; identical to SEQ ID NO: 18656
  CDS (1)..(150): transl_table=11

SEQ ID NO: 66943 - protein, 49 aa, Escherichia coli; identical to SEQ ID NO: 18657

SEQ ID NO: 66944 - DNA, 216 bp, Escherichia coli; identical to SEQ ID NO: 18658
  CDS (1)..(216): transl_table=11

SEQ ID NO: 66945 - protein, 71 aa, Escherichia coli; identical to SEQ ID NO: 18659

SEQ ID NO: 66946 - DNA, 216 bp, Shigella dysenteriae; identical to SEQ ID NO: 18660
  CDS (1)..(216): transl_table=11

SEQ ID NO: 66947 - protein, 71 aa, Shigella dysenteriae; identical to SEQ ID NO: 18661

SEQ ID NO: 66948 - DNA, 216 bp, Escherichia coli O6; identical to SEQ ID NO: 18662
  CDS (1)..(216): transl_table=11

SEQ ID NO: 66949 - protein, 71 aa, Escherichia coli O6; identical to SEQ ID NO: 18663

SEQ ID NO: 66950 - DNA, 216 bp, Bacteriophage P21; identical to SEQ ID NO: 18664
  CDS (1)..(216): transl_table=11

SEQ ID NO: 66951 - protein, 71 aa, Bacteriophage P21; identical to SEQ ID NO: 18665

SEQ ID NO: 66952 - DNA, 24 bp, Artificial sequence
  (1)..(24): primer
atgctgtcaaaactaccccgtaga

SEQ ID NO: 66953 - DNA, 23 bp, Artificial sequence
  (1)..(23): primer
ttactctcctctcgcagccttac

SEQ ID NO: 66954 - protein, 71 aa, Artificial sequence; identical to SEQ ID NO: 18668
  Variant (2)..(3): xaa in position 2 to 3 is any amino acid
  Variant (14)..(14): xaa in position 14 is any amino acid
  Variant (18)..(20): xaa in position 18 to 20 is any amino acid
  Variant (24)..(24): xaa in position 24 is any amino acid
  Variant (27)..(27): xaa in position 27 is any amino acid
  Variant (30)..(30): xaa in position 30 is any amino acid
  Variant (37)..(37): xaa in position 37 is any amino acid
  Variant (47)..(47): xaa in position 47 is any amino acid
  Variant (49)..(49): xaa in position 49 is any amino acid
  Variant (67)..(67): xaa in position 67 is any amino acid

SEQ ID NO: 66955 - protein, 10 aa, Artificial sequence
  Variant (2)..(2): xaa in position 2 is Asp or Glu
  Variant (5)..(5): xaa in position 5 is Ser or Thr
  Variant (7)..(7): xaa in position 7 is Gly or Ser
  Variant (8)..(8): xaa in position 8 is Ile or Val
  Variant (9)..(9): xaa in position 9 is Ala or Ser
MXKIXTXXXY

SEQ ID NO: 66956 - protein, 6 aa, Artificial sequence
  Variant (2)..(2): xaa in position 2 is Phe or Leu
  Variant (5)..(5): xaa in position 5 is any amino acid
WXLQXL

SEQ ID NO: 66957 - protein, 14 aa, Artificial sequence
  Variant (5)..(5): xaa in position 5 is any or no amino acid
  Variant (7)..(7): xaa in position 7 is any or no amino acid
PSQWXAXIGVLGSL

SEQ ID NO: 66958 - DNA, 627 bp, Escherichia coli K12; identical to SEQ ID NO: 20534
  CDS (1)..(627): transl_table=11

SEQ ID NO: 66959 - protein, 208 aa, Escherichia coli K12; identical to SEQ ID NO: 20535

SEQ ID NO: 66960 - DNA, 519 bp, Archaeoglobus fulgidus DSM 4304; identical to SEQ ID NO: 20536
  CDS (1)..(519): transl_table=11

SEQ ID NO: 66961 - protein, 172 aa, Archaeoglobus fulgidus DSM 4304; identical to SEQ ID NO: 20537

SEQ ID NO: 66962 - DNA, 561 bp, Pyrococcus abyssi GE5; identical to SEQ ID NO: 20538
  CDS (1)..(561): transl_table=11

SEQ ID NO: 66963 - protein, 186 aa, Pyrococcus abyssi GE5; identical to SEQ ID NO: 20539

SEQ ID NO: 66964 - DNA, 621 bp, Vibrio cholerae O1 biovar eltor str. N16961; identical to SEQ ID NO: 20540
  CDS (1)..(621): transl_table=11

SEQ ID NO: 66965 - protein, 206 aa, Vibrio cholerae O1 biovar eltor str. N16961; identical to SEQ ID NO: 20541

SEQ ID NO: 66966 - DNA, 588 bp, Methanothermobacter thermautotrophicus str. Delta H; identical to SEQ ID NO: 20542
  CDS (1)..(588): transl_table=11

SEQ ID NO: 66967 - protein, 195 aa, Methanothermobacter thermautotrophicus str. Delta H; identical to SEQ ID NO: 20543

SEQ ID NO: 66968 - DNA, 678 bp, Halobacterium sp. NRC-1; identical to SEQ ID NO: 20544
  CDS (1)..(678): transl_table=11

SEQ ID NO: 66969 - protein, 225 aa, Halobacterium sp. NRC-1; identical to SEQ ID NO: 20545

SEQ ID NO: 66970 - DNA, 612 bp, Sinorhizobium meliloti 1021; identical to SEQ ID NO: 20546
  CDS (1)..(612): transl_table=11

SEQ ID NO: 66971 - protein, 203 aa, Sinorhizobium meliloti 1021; identical to SEQ ID NO: 20547

SEQ ID NO: 66972 - DNA, 588 bp, Clostridium perfringens str. 13; identical to SEQ ID NO: 20548
  CDS (1)..(588): transl_table=11

SEQ ID NO: 66973 - protein, 195 aa, Clostridium perfringens str. 13; identical to SEQ ID NO: 20549

SEQ ID NO: 66974 - DNA, 564 bp, Pyrococcus furiosus DSM 3638; identical to SEQ ID NO: 20550
  CDS (1)..(564): transl_table=11

SEQ ID NO: 66975 - protein, 187 aa, Pyrococcus furiosus DSM 3638; identical to SEQ ID NO: 20551

SEQ ID NO: 66976 - DNA, 585 bp, Methanosarcina acetivorans C2A; identical to SEQ ID NO: 20552
  CDS (1)..(585): transl_table=11

SEQ ID NO: 66977 - protein, 194 aa, Methanosarcina acetivorans C2A; identical to SEQ ID NO: 20553

SEQ ID NO: 66978 - DNA, 618 bp, Streptomyces coelicolor A3(2); identical to SEQ ID NO: 20554
  CDS (1)..(618): transl_table=11

SEQ ID NO: 66979 - protein, 205 aa, Streptomyces coelicolor A3(2); identical to SEQ ID NO: 20555

SEQ ID NO: 66980 - DNA, 612 bp, Vibrio parahaemolyticus RIMD 2210633; identical to SEQ ID NO: 20556
  CDS (1)..(612): transl_table=11

SEQ ID NO: 66981 - protein, 203 aa, Vibrio parahaemolyticus RIMD 2210633; identical to SEQ ID NO: 20557

SEQ ID NO: 66982 - DNA, 678 bp, Vibrio vulnificus YJ016; identical to SEQ ID NO: 20558
  CDS (1)..(678): transl_table=11

SEQ ID NO: 66983 - protein, 225 aa, Vibrio vulnificus YJ016; identical to SEQ ID NO: 20559

SEQ ID NO: 66984 - DNA, 774 bp, Thermus thermophilus HB27; identical to SEQ ID NO: 20560
  CDS (1)..(774): transl_table=11

SEQ ID NO: 66985 - protein, 257 aa, Thermus thermophilus HB27; identical to SEQ ID NO: 20561

SEQ ID NO: 66986 - DNA, 618 bp, Desulfotalea psychrophila LSv54; identical to SEQ ID NO: 20562
  CDS (1)..(618): transl_table=11

SEQ ID NO: 66987 - protein, 205 aa, Desulfotalea psychrophila LSv54; identical to SEQ ID NO: 20563

SEQ ID NO: 66988 - DNA, 597 bp, Legionella pneumophila subsp. pneumophila str. Philadelphia 1; identical to SEQ ID NO: 20564
  CDS (1)..(597): transl_table=11

SEQ ID NO: 66989 - protein, 198 aa, Legionella pneumophila subsp. pneumophila str. Philadelphia 1; identical to SEQ ID NO: 20565

SEQ ID NO: 66990 - DNA, 588 bp, Legionella pneumophila subsp. pneumophila str. Philadelphia 1; identical to SEQ ID NO: 20566
  CDS (1)..(588): transl_table=11

SEQ ID NO: 66991 - protein, 195 aa, Legionella pneumophila subsp. pneumophila str. Philadelphia 1; identical to SEQ ID NO: 20567

SEQ ID NO: 66992 - DNA, 657 bp, Nocardia farcinica IFM 10152; identical to SEQ ID NO: 20568
  CDS (1)..(657): transl_table=11

SEQ ID NO: 66993 - protein, 218 aa, Nocardia farcinica IFM 10152; identical to SEQ ID NO: 20569

SEQ ID NO: 66994 - DNA, 597 bp, Legionella pneumophila str. Paris; identical to SEQ ID NO: 20570
  CDS (1)..(597): transl_table=11

SEQ ID NO: 66995 - protein, 198 aa, Legionella pneumophila str. Paris; identical to SEQ ID NO: 20571

SEQ ID NO: 66996 - DNA, 597 bp, Legionella pneumophila str. Lens; identical to SEQ ID NO: 20572
  CDS (1)..(597): transl_table=11

SEQ ID NO: 66997 - protein, 198 aa, Legionella pneumophila str. Lens; identical to SEQ ID NO: 20573

SEQ ID NO: 66998 - DNA, 630 bp, Photobacterium profundum SS9; identical to SEQ ID NO: 20574
  CDS (1)..(630): transl_table=11

SEQ ID NO: 66999 - protein, 209 aa, Photobacterium profundum SS9; identical to SEQ ID NO: 20575

SEQ ID NO: 67000 - DNA, 774 bp, Thermus thermophilus HB8; identical to SEQ ID NO: 20576
  CDS (1)..(774): transl_table=11

SEQ ID NO: 67001 - protein, 257 aa, Thermus thermophilus HB8; identical to SEQ ID NO: 20577

SEQ ID NO: 67002 - DNA, 639 bp, Idiomarina loihiensis L2TR; identical to SEQ ID NO: 20578
  CDS (1)..(639): transl_table=11

SEQ ID NO: 67003 - protein, 212 aa, Idiomarina loihiensis L2TR; identical to SEQ ID NO: 20579

SEQ ID NO: 67004 - DNA, 600 bp, Francisella tularensis subsp. tularensis SCHU S4; identical to SEQ ID NO: 20580
  CDS (1)..(600): transl_table=11

SEQ ID NO: 67005 - protein, 199 aa, Francisella tularensis subsp. tularensis SCHU S4; identical to SEQ ID NO: 20581

SEQ ID NO: 67006 - DNA, 783 bp, Ehrlichia ruminantium str. Welgevonden; identical to SEQ ID NO: 20582
  CDS (1)..(783): transl_table=11

SEQ ID NO: 67007 - protein, 260 aa, Ehrlichia ruminantium str. Welgevonden; identical to SEQ ID NO: 20583

SEQ ID NO: 67008 - DNA, 570 bp, Thermococcus kodakarensis KOD1; identical to SEQ ID NO: 20584
  CDS (1)..(570): transl_table=11

SEQ ID NO: 67009 - protein, 189 aa, Thermococcus kodakarensis KOD1; identical to SEQ ID NO: 20585

SEQ ID NO: 67010 - DNA, 783 bp, Ehrlichia ruminantium str. Gardel; identical to SEQ ID NO: 20586
  CDS (1)..(783): transl_table=11

SEQ ID NO: 67011 - protein, 260 aa, Ehrlichia ruminantium str. Gardel; identical to SEQ ID NO: 20587

SEQ ID NO: 67012 - DNA, 609 bp, Vibrio fischeri ES114; identical to SEQ ID NO: 20588
  CDS (1)..(609): transl_table=11

SEQ ID NO: 67013 - protein, 202 aa, Vibrio fischeri ES114; identical to SEQ ID NO: 20589

SEQ ID NO: 67014 - DNA, 666 bp, Corynebacterium jeikeium K411; identical to SEQ ID NO: 20590
  CDS (1)..(666): transl_table=11

SEQ ID NO: 67015 - protein, 221 aa, Corynebacterium jeikeium K411; identical to SEQ ID NO: 20591

SEQ ID NO: 67016 - DNA, 678 bp, Thermobifida fusca YX; identical to SEQ ID NO: 20592
  CDS (1)..(678): transl_table=11

SEQ ID NO: 67017 - protein, 225 aa, Thermobifida fusca YX; identical to SEQ ID NO: 20593

SEQ ID NO: 67018 - DNA, 780 bp, Ehrlichia canis str. Jake; identical to SEQ ID NO: 20594
  CDS (1)..(780): transl_table=11

SEQ ID NO: 67019 - protein, 259 aa, Ehrlichia canis str. Jake; identical to SEQ ID NO: 20595

SEQ ID NO: 67020 - DNA, 534 bp, Methanosarcina barkeri str. fusaro; identical to SEQ ID NO: 20596
  CDS (1)..(534): transl_table=11

SEQ ID NO: 67021 - protein, 177 aa, Methanosarcina barkeri str. fusaro; identical to SEQ ID NO: 20597

SEQ ID NO: 67022 - DNA, 582 bp, Dehalococcoides sp. CBDB1; identical to SEQ ID NO: 20598
  CDS (1)..(582): transl_table=11

SEQ ID NO: 67023 - protein, 193 aa, Dehalococcoides sp. CBDB1; identical to SEQ ID NO: 20599

SEQ ID NO: 67024 - DNA, 609 bp, Rhodobacter sphaeroides 2.4.1; identical to SEQ ID NO: 20600
  CDS (1)..(609)

SEQ ID NO: 67025 - protein, 202 aa, Rhodobacter sphaeroides 2.4.1; identical to SEQ ID NO: 20601

SEQ ID NO: 67026 - DNA, 795 bp, Magnetospirillum magnetotacticum MS-1; identical to SEQ ID NO: 20602
  CDS (1)..(795)

SEQ ID NO: 67027 - protein, 264 aa, Magnetospirillum magnetotacticum MS-1; identical to SEQ ID NO: 20603

SEQ ID NO: 67028 - DNA, 795 bp, Deinococcus geothermalis DSM 11300; identical to SEQ ID NO: 20604
  CDS (1)..(795): transl_table=11

SEQ ID NO: 67029 - protein, 264 aa, Deinococcus geothermalis DSM 11300; identical to SEQ ID NO: 20605

SEQ ID NO: 67030 - DNA, 900 bp, Anaeromyxobacter dehalogenans 2CP-C; identical to SEQ ID NO: 20606
  CDS (1)..(900): transl_table=11

SEQ ID NO: 67031 - protein, 299 aa, Anaeromyxobacter dehalogenans 2CP-C; identical to SEQ ID NO: 20607

SEQ ID NO: 67032 - DNA, 645 bp, Chromohalobacter salexigens DSM 3043; identical to SEQ ID NO: 20608
  CDS (1)..(645): transl_table=11

SEQ ID NO: 67033 - protein, 214 aa, Chromohalobacter salexigens DSM 3043; identical to SEQ ID NO: 20609

SEQ ID NO: 67034 - DNA, 663 bp, Solibacter usitatus Ellin6076; identical to SEQ ID NO: 20610
  CDS (1)..(663): transl_table=11

SEQ ID NO: 67035 - protein, 220 aa, Solibacter usitatus Ellin6076; identical to SEQ ID NO: 20611

SEQ ID NO: 67036 - DNA, 582 bp, Exiguobacterium sp. 255-15; identical to SEQ ID NO: 20612
  CDS (1)..(582): transl_table=11

SEQ ID NO: 67037 - protein, 193 aa, Exiguobacterium sp. 255-15; identical to SEQ ID NO: 20613

SEQ ID NO: 67038 - DNA, 777 bp, Ehrlichia chaffeensis str. Sapulpa; identical to SEQ ID NO: 20614
  CDS (1)..(777): transl_table=11

SEQ ID NO: 67039 - protein, 258 aa, Ehrlichia chaffeensis str. Sapulpa; identical to SEQ ID NO: 20615

SEQ ID NO: 67040 - DNA, 612 bp, Jannaschia sp. CCS1; identical to SEQ ID NO: 20616
  CDS (1)..(612): transl_table=11

SEQ ID NO: 67041 - protein, 203 aa, Jannaschia sp. CCS1; identical to SEQ ID NO: 20617

SEQ ID NO: 67042 - DNA, 603 bp, Sphingopyxis alaskensis RB2256; identical to SEQ ID NO: 20618
  CDS (1)..(603): transl_table=11

SEQ ID NO: 67043 - protein, 200 aa, Sphingopyxis alaskensis RB2256; identical to SEQ ID NO: 20619

SEQ ID NO: 67044 - DNA, 561 bp, Mesorhizobium sp. BNC1; identical to SEQ ID NO: 20620
  CDS (1)..(561): transl_table=11

SEQ ID NO: 67045 - protein, 186 aa, Mesorhizobium sp. BNC1; identical to SEQ ID NO: 20621

SEQ ID NO: 67046 - DNA, 609 bp, Silicibacter sp. TM1040; identical to SEQ ID NO: 20622
  CDS (1)..(609): transl_table=11

SEQ ID NO: 67047 - protein, 202 aa, Silicibacter sp. TM1040; identical to SEQ ID NO: 20623

SEQ ID NO: 67048 - DNA, 666 bp, Shewanella frigidimarina NCIMB 400; identical to SEQ ID NO: 20624
  CDS (1)..(666): transl_table=11

SEQ ID NO: 67049 - protein, 221 aa, Shewanella frigidimarina NCIMB 400; identical to SEQ ID NO: 20625

SEQ ID NO: 67050 - DNA, 660 bp, Psychrobacter cryohalolentis K5; identical to SEQ ID NO: 20626
  CDS (1)..(660): transl_table=11

SEQ ID NO: 67051 - protein, 219 aa, Psychrobacter cryohalolentis K5; identical to SEQ ID NO: 20627

SEQ ID NO: 67052 - DNA, 648 bp, Nocardioides sp. JS614; identical to SEQ ID NO: 20628
  CDS (1)..(648): transl_table=11

SEQ ID NO: 67053 - protein, 215 aa, Nocardioides sp. JS614; identical to SEQ ID NO: 20629

SEQ ID NO: 67054 - DNA, 732 bp, uncultured archaeon GZfos19C7; identical to SEQ ID NO: 20630
  CDS (1)..(732)

SEQ ID NO: 67055 - protein, 243 aa, uncultured archaeon GZfos19C7; identical to SEQ ID NO: 20631

SEQ ID NO: 67056 - DNA, 591 bp, Aquifex aeolicus; identical to SEQ ID NO: 20632
  CDS (1)..(591): transl_table=11

SEQ ID NO: 67057 - protein, 196 aa, Aquifex aeolicus; identical to SEQ ID NO: 20633

SEQ ID NO: 67058 - DNA, 567 bp, Pyrococcus horikoshii; identical to SEQ ID NO: 20634
  CDS (1)..(567): transl_table=11

SEQ ID NO: 67059 - protein, 188 aa, Pyrococcus horikoshii; identical to SEQ ID NO: 20635

SEQ ID NO: 67060 - DNA, 22 bp, Artificial sequence
  (1)..(22): primer
atgcctgtgctagaccgccatc

SEQ ID NO: 67061 - DNA, 22 bp, Artificial sequence
  (1)..(22): primer
ttactgacgctggagcgacttc

SEQ ID NO: 67062 - protein, 219 aa, Artificial sequence; identical to SEQ ID NO: 20638
  Variant (2)..(5): xaa in position 2 to 5 is any amino acid
  Variant (9)..(14): xaa in position 9 to 14 is any amino acid
  Variant (16)..(16): xaa in position 16 is any amino acid
  Variant (18)..(27): xaa in position 18 to 27 is any amino acid
  Variant (28)..(31): xaa in position 28 to 31 is any or no amino acid
  Variant (33)..(35): xaa in position 33 to 35 is any amino acid
  Variant (37)..(37): xaa in position 37 is any amino acid
  Variant (39)..(42): xaa in position 39 to 42 is any amino acid
  Variant (44)..(44): xaa in position 44 is any amino acid
  Variant (48)..(48): xaa in position 48 is any amino acid
  Variant (52)..(55): xaa in position 52 to 55 is any amino acid
  Variant (56)..(58): xaa in position 56 to 58 is any or no amino acid
  Variant (60)..(61): xaa in position 60 to 61 is any amino acid
  Variant (63)..(64): xaa in position 63 to 64 is any amino acid
  Variant (67)..(69): xaa in position 67 to 69 is any amino acid
  Variant (71)..(79): xaa in position 71 to 79 is any amino acid
  Variant (81)..(90): xaa in position 81 to 90 is any amino acid
  Variant (91)..(102): xaa in position 91 to 102 is any or no amino acid
  Variant (104)..(127): xaa in position 104 to 127 is any amino acid
  Variant (128)..(161): xaa in position 128 to 161 is any or no amino acid
  Variant (163)..(163): xaa in position 163 is any amino acid
  Variant (165)..(166): xaa in position 165 to 166 is any amino acid
  Variant (168)..(194): xaa in position 168 to 194 is any amino acid
  Variant (195)..(214): xaa in position 195 to 214 is any or no amino acid
  Variant (216)..(218): xaa in position 216 to 218 is any amino acid

SEQ ID NO: 67063 - protein, 9 aa, Artificial sequence
  Variant (2)..(2): xaa in position 2 is Ala, Gly, Asn, Ser, Thr or Val
  Variant (3)..(3): xaa in position 3 is any amino acid
  Variant (6)..(6): xaa in position 6 is any amino acid
  Variant (7)..(7): xaa in position 7 is Ile, Leu, Met or Val
DXXDGXXAR

SEQ ID NO: 67064 - protein, 9 aa, Artificial sequence
  Variant (2)..(2): xaa in position 2 is Ala, Gly or Thr
  Variant (3)..(3): xaa in position 3 is any amino acid
  Variant (6)..(8): xaa in position 6 to 8 is any amino acid
GXXLDXXXD

SEQ ID NO: 67065 - DNA, 900 bp, Escherichia coli; identical to SEQ ID NO: 49564
  CDS (1)..(900)

SEQ ID NO: 67066 - protein, 299 aa, Escherichia coli; identical to SEQ ID NO: 49565

SEQ ID NO: 67067 - DNA, 1005 bp, Xenopus tropicalis; identical to SEQ ID NO: 49566
  CDS (1)..(1005)

SEQ ID NO: 67068 - protein, 334 aa, Xenopus tropicalis; identical to SEQ ID NO: 49567

SEQ ID NO: 67069 - DNA, 858 bp, Archaeoglobus fulgidus DSM 4304; identical to SEQ ID NO: 49568
  CDS (1)..(858): transl_table=11

SEQ ID NO: 67070 - protein, 285 aa, Archaeoglobus fulgidus DSM 4304; identical to SEQ ID NO: 49569

SEQ ID NO: 67071 - DNA, 879 bp, Mesorhizobium loti MAFF303099; identical to SEQ ID NO: 49570
  CDS (1)..(879): transl_table=11

SEQ ID NO: 67072 - protein, 292 aa, Mesorhizobium loti MAFF303099; identical to SEQ ID NO: 49571

SEQ ID NO: 67073 - DNA, 843 bp, Thermoplasma volcanium GSS1; identical to SEQ ID NO: 49572
  CDS (1)..(843): transl_table=11

SEQ ID NO: 67074 - protein, 280 aa, Thermoplasma volcanium GSS1; identical to SEQ ID NO: 49573

SEQ ID NO: 67075 - DNA, 852 bp, Pyrococcus abyssi GE5; identical to SEQ ID NO: 49574
  CDS (1)..(852): transl_table=11

SEQ ID NO: 67076 - protein, 283 aa, Pyrococcus abyssi GE5; identical to SEQ ID NO: 49575

SEQ ID NO: 67077 - DNA, 873 bp, Pyrococcus horikoshii OT3; identical to SEQ ID NO: 49576
  CDS (1)..(873): transl_table=11

SEQ ID NO: 67078 - protein, 290 aa, Pyrococcus horikoshii OT3; identical to SEQ ID NO: 49577

SEQ ID NO: 67079 - DNA, 918 bp, Aeropyrum pernix K1; identical to SEQ ID NO: 49578
  CDS (1)..(918): transl_table=11

SEQ ID NO: 67080 - protein, 305 aa, Aeropyrum pernix K1; identical to SEQ ID NO: 49579

SEQ ID NO: 67081 - DNA, 720 bp, Clostridium acetobutylicum ATCC 824; identical to SEQ ID NO: 49580
  CDS (1)..(720): transl_table=11

SEQ ID NO: 67082 - protein, 239 aa, Clostridium acetobutylicum ATCC 824; identical to SEQ ID NO: 49581

SEQ ID NO: 67083 - DNA, 852 bp, Bacillus halodurans C-125; identical to SEQ ID NO: 49582
  CDS (1)..(852): transl_table=11

SEQ ID NO: 67084 - protein, 283 aa, Bacillus halodurans C-125; identical to SEQ ID NO: 49583

SEQ ID NO: 67085 - DNA, 909 bp, Pseudomonas aeruginosa PAO1; identical to SEQ ID NO: 49584
  CDS (1)..(909): transl_table=11

SEQ ID NO: 67086 - protein, 302 aa, Pseudomonas aeruginosa PAO1; identical to SEQ ID NO: 49585

SEQ ID NO: 67087 - DNA, 900 bp, Lactococcus lactis subsp. lactis Il1403; identical to SEQ ID NO: 49586
  CDS (1)..(900): transl_table=11

SEQ ID NO: 67088 - protein, 299 aa, Lactococcus lactis subsp. lactis Il1403; identical to SEQ ID NO: 49587

SEQ ID NO: 67089 - DNA, 921 bp, Neisseria meningitidis MC58; identical to SEQ ID NO: 49588
  CDS (1)..(921): transl_table=11

SEQ ID NO: 67090 - protein, 306 aa, Neisseria meningitidis MC58; identical to SEQ ID NO: 49589

SEQ ID NO: 67091 - DNA, 843 bp, Methanothermobacter thermautotrophicus str. Delta H; identical to SEQ ID NO: 49590
  CDS (1)..(843)

SEQ ID NO: 67092 - protein, 280 aa, Methanothermobacter thermautotrophicus str. Delta H; identical to SEQ ID NO: 49591

SEQ ID NO: 67093 - DNA, 864 bp, Neisseria meningitidis Z2491; identical to SEQ ID NO: 49592
  CDS (1)..(864): transl_table=11

SEQ ID NO: 67094 - protein, 287 aa, Neisseria meningitidis Z2491; identical to SEQ ID NO: 49593

SEQ ID NO: 67095 - DNA, 909 bp, Xylella fastidiosa 9a5c; identical to SEQ ID NO: 49594
  CDS (1)..(909): transl_table=11

SEQ ID NO: 67096 - protein, 302 aa, Xylella fastidiosa 9a5c; identical to SEQ ID NO: 49595

SEQ ID NO: 67097 - DNA, 915 bp, Mycobacterium tuberculosis CDC1551; identical to SEQ ID NO: 49596
  CDS (1)..(915): transl_table=11

SEQ ID NO: 67098 - protein, 304 aa, Mycobacterium tuberculosis CDC1551; identical to SEQ ID NO: 49597

SEQ ID NO: 67099 - DNA, 681 bp, Sulfolobus solfataricus P2; identical to SEQ ID NO: 49598
  CDS (1)..(681): transl_table=11

SEQ ID NO: 67100 - protein, 226 aa, Sulfolobus solfataricus P2; identical to SEQ ID NO: 49599

SEQ ID NO: 67101 - DNA, 843 bp, Clostridium acetobutylicum ATCC 824; identical to SEQ ID NO: 49600
  CDS (1)..(843): transl_table=11

SEQ ID NO: 67102 - protein, 280 aa, Clostridium acetobutylicum ATCC 824; identical to SEQ ID NO: 49601

SEQ ID NO: 67103 - DNA, 822 bp, Sulfolobus tokodaii str. 7; identical to SEQ ID NO: 49602
  CDS (1)..(822): transl_table=11

SEQ ID NO: 67104 - protein, 273 aa, Sulfolobus tokodaii str. 7; identical to SEQ ID NO: 49603

SEQ ID NO: 67105 - DNA, 903 bp, Caulobacter crescentus CB15; identical to SEQ ID NO: 49604
  CDS (1)..(903): transl_table=11

SEQ ID NO: 67106 - protein, 300 aa, Caulobacter crescentus CB15; identical to SEQ ID NO: 49605

SEQ ID NO: 67107 - DNA, 882 bp, Caulobacter crescentus CB15; identical to SEQ ID NO: 49606
  CDS (1)..(882): transl_table=11

SEQ ID NO: 67108 - protein, 293 aa, Caulobacter crescentus CB15; identical to SEQ ID NO: 49607

SEQ ID NO: 67109 - DNA, 903 bp, Sinorhizobium meliloti 1021; identical to SEQ ID NO: 49608
  CDS (1)..(903): transl_table=11

SEQ ID NO: 67110 - protein, 300 aa, Sinorhizobium meliloti 1021; identical to SEQ ID NO: 49609

SEQ ID NO: 67111 - DNA, 843 bp, Synechocystis sp. PCC 6803; identical to SEQ ID NO: 49610
  CDS (1)..(843): transl_table=11

SEQ ID NO: 67112 - protein, 280 aa, Synechocystis sp. PCC 6803; identical to SEQ ID NO: 49611

SEQ ID NO: 67113 - DNA, 831 bp, Listeria monocytogenes EGD-e; identical to SEQ ID NO: 49612
  CDS (1)..(831): transl_table=11

SEQ ID NO: 67114 - protein, 276 aa, Listeria monocytogenes EGD-e; identical to SEQ ID NO: 49613

SEQ ID NO: 67115 - DNA, 885 bp, Nostoc sp. PCC 7120; identical to SEQ ID NO: 49614
  CDS (1)..(885): transl_table=11

SEQ ID NO: 67116 - protein, 294 aa, Nostoc sp. PCC 7120; identical to SEQ ID NO: 49615

SEQ ID NO: 67117 - DNA, 918 bp, Ralstonia solanacearum GMI1000; identical to SEQ ID NO: 49616
  CDS (1)..(918): transl_table=11

SEQ ID NO: 67118 - protein, 305 aa, Ralstonia solanacearum GMI1000; identical to SEQ ID NO: 49617

SEQ ID NO: 67119 - DNA, 894 bp, Agrobacterium tumefaciens str. C58; identical to SEQ ID NO: 49618
  CDS (1)..(894): transl_table=11

SEQ ID NO: 67120 - protein, 297 aa, Agrobacterium tumefaciens str. C58; identical to SEQ ID NO: 49619

SEQ ID NO: 67121 - DNA, 885 bp, Clostridium perfringens str. 13; identical to SEQ ID NO: 49620
  CDS (1)..(885): transl_table=11

SEQ ID NO: 67122 - protein, 294 aa, Clostridium perfringens str. 13; identical to SEQ ID NO: 49621

SEQ ID NO: 67123 - DNA, 1362 bp, Corynebacterium glutamicum ATCC 13032; identical to SEQ ID NO: 49622
  CDS (1)..(1362): transl_table=11

SEQ ID NO: 67124 - protein, 453 aa, Corynebacterium glutamicum ATCC 13032; identical to SEQ ID NO: 49623

SEQ ID NO: 67125 - DNA, 855 bp, Streptococcus pyogenes MGAS8232; identical to SEQ ID NO: 49624
  CDS (1)..(855): transl_table=11

SEQ ID NO: 67126 - protein, 284 aa, Streptococcus pyogenes MGAS8232; identical to SEQ ID NO: 49625

SEQ ID NO: 67127 - DNA, 810 bp, Methanosarcina mazei Go1; identical to SEQ ID NO: 49626
  CDS (1)..(810): transl_table=11

SEQ ID NO: 67128 - protein, 269 aa, Methanosarcina mazei Go1; identical to SEQ ID NO: 49627

SEQ ID NO: 67129 - DNA, 909 bp, Xanthomonas campestris pv. campestris str. ATCC 33913; identical to SEQ ID NO: 49628
  CDS (1)..(909): transl_table=11

SEQ ID NO: 67130 - protein, 302 aa, Xanthomonas campestris pv. campestris str. ATCC 33913; identical to SEQ ID NO: 49629

SEQ ID NO: 67131 - DNA, 900 bp, Xanthomonas axonopodis pv. citri str. 306; identical to SEQ ID NO: 49630
  CDS (1)..(900): transl_table=11

SEQ ID NO: 67132 - protein, 299 aa, Xanthomonas axonopodis pv. citri str. 306; identical to SEQ ID NO: 49631

SEQ ID NO: 67133 - DNA, 879 bp, Chlorobium tepidum TLS; identical to SEQ ID NO: 49632
  CDS (1)..(879): transl_table=11

SEQ ID NO: 67134 - protein, 292 aa, Chlorobium tepidum TLS; identical to SEQ ID NO: 49633

SEQ ID NO: 67135 - DNA, 915 bp, Thermosynechococcus elongatus BP-1; identical to SEQ ID NO: 49634
  CDS (1)..(915): transl_table=11

SEQ ID NO: 67136 - protein, 304 aa, Thermosynechococcus elongatus BP-1; identical to SEQ ID NO: 49635

SEQ ID NO: 67137 - DNA, 855 bp, Streptococcus agalactiae 2603V/R; identical to SEQ ID NO: 49636
  CDS (1)..(855): transl_table=11

SEQ ID NO: 67138 - protein, 284 aa, Streptococcus agalactiae 2603V/R; identical to SEQ ID NO: 49637

SEQ ID NO: 67139 - DNA, 849 bp, Oceanobacillus iheyensis HTE831; identical to SEQ ID NO: 49638
  CDS (1)..(849): transl_table=11

SEQ ID NO: 67140 - protein, 282 aa, Oceanobacillus iheyensis HTE831; identical to SEQ ID NO: 49639

SEQ ID NO: 67141 - DNA, 1443 bp, Bifidobacterium longum NCC2705; identical to SEQ ID NO: 49640
  CDS (1)..(1443): transl_table=11

SEQ ID NO: 67142 - protein, 480 aa, Bifidobacterium longum NCC2705; identical to SEQ ID NO: 49641

SEQ ID NO: 67143 - DNA, 921 bp, Leptospira interrogans serovar Lai str. 56601; identical to SEQ ID NO: 49642
  CDS (1)..(921): transl_table=11

SEQ ID NO: 67144 - protein, 306 aa, Leptospira interrogans serovar Lai str. 56601; identical to SEQ ID NO: 49643

SEQ ID NO: 67145 - DNA, 987 bp, Shewanella oneidensis MR-1; identical to SEQ ID NO: 49644
  CDS (1)..(987): transl_table=11

SEQ ID NO: 67146 - protein, 328 aa, Shewanella oneidensis MR-1; identical to SEQ ID NO: 49645

SEQ ID NO: 67147 - DNA, 921 bp, Shewanella oneidensis MR-1; identical to SEQ ID NO: 49646
  CDS (1)..(921): transl_table=11

SEQ ID NO: 67148 - protein, 306 aa, Shewanella oneidensis MR-1; identical to SEQ ID NO: 49647

SEQ ID NO: 67149 - DNA, 855 bp, Streptococcus mutans UA159; identical to SEQ ID NO: 49648
  CDS (1)..(855): transl_table=11

SEQ ID NO: 67150 - protein, 284 aa, Streptococcus mutans UA159; identical to SEQ ID NO: 49649

SEQ ID NO: 67151 - DNA, 855 bp, Streptococcus agalactiae NEM316; identical to SEQ ID NO: 49650
  CDS (1)..(855): transl_table=11

SEQ ID NO: 67152 - protein, 284 aa, Streptococcus agalactiae NEM316; identical to SEQ ID NO: 49651

SEQ ID NO: 67153 - DNA, 1380 bp, Corynebacterium efficiens YS-314; identical to SEQ ID NO: 49652
  CDS (1)..(1380): transl_table=11

SEQ ID NO: 67154 - protein, 459 aa, Corynebacterium efficiens YS-314; identical to SEQ ID NO: 49653

SEQ ID NO: 67155 - DNA, 903 bp, Pseudomonas putida KT2440; identical to SEQ ID NO: 49654
  CDS (1)..(903): transl_table=11

SEQ ID NO: 67156 - protein, 300 aa, Pseudomonas putida KT2440; identical to SEQ ID NO: 49655

SEQ ID NO: 67157 - DNA, 909 bp, Xylella fastidiosa Temecula1; identical to SEQ ID NO: 49656
  CDS (1)..(909): transl_table=11

SEQ ID NO: 67158 - protein, 302 aa, Xylella fastidiosa Temecula1; identical to SEQ ID NO: 49657

SEQ ID NO: 67159 - DNA, 843 bp, Lactobacillus plantarum WCFS1; identical to SEQ ID NO: 49658
  CDS (1)..(843): transl_table=11

SEQ ID NO: 67160 - protein, 280 aa, Lactobacillus plantarum WCFS1; identical to SEQ ID NO: 49659

SEQ ID NO: 67161 - DNA, 864 bp, Tropheryma whipplei str. Twist; identical to SEQ ID NO: 49660
  CDS (1)..(864): transl_table=11

SEQ ID NO: 67162 - protein, 287 aa, Tropheryma whipplei str. Twist; identical to SEQ ID NO: 49661

SEQ ID NO: 67163 - DNA, 906 bp, Pseudomonas syringae pv. tomato str. DC3000; identical to SEQ ID NO: 49662
  CDS (1)..(906): transl_table=11

SEQ ID NO: 67164 - protein, 301 aa, Pseudomonas syringae pv. tomato str. DC3000; identical to SEQ ID NO: 49663

SEQ ID NO: 67165 - DNA, 855 bp, Streptococcus pyogenes SSI-1; identical to SEQ ID NO: 49664
  CDS (1)..(855): transl_table=11

SEQ ID NO: 67166 - protein, 284 aa, Streptococcus pyogenes SSI-1; identical to SEQ ID NO: 49665

SEQ ID NO: 67167 - DNA, 855 bp, Bacteroides thetaiotaomicron VPI-5482; identical to SEQ ID NO: 49666
  CDS (1)..(855): transl_table=11

SEQ ID NO: 67168 - protein, 284 aa, Bacteroides thetaiotaomicron VPI-5482; identical to SEQ ID NO: 49667

SEQ ID NO: 67169 - DNA, 909 bp, Bacteroides thetaiotaomicron VPI-5482; identical to SEQ ID NO: 49668
  CDS (1)..(909): transl_table=11

SEQ ID NO: 67170 - protein, 302 aa, Bacteroides thetaiotaomicron VPI-5482; identical to SEQ ID NO: 49669

SEQ ID NO: 67171 - DNA, 849 bp, Bacteroides thetaiotaomicron VPI-5482; identical to SEQ ID NO: 49670
  CDS (1)..(849): transl_table=11

SEQ ID NO: 67172 - protein, 282 aa, Bacteroides thetaiotaomicron VPI-5482; identical to SEQ ID NO: 49671

SEQ ID NO: 67173 - DNA, 900 bp, Enterococcus faecalis V583; identical to SEQ ID NO: 49672
  CDS (1)..(900): transl_table=11

SEQ ID NO: 67174 - protein, 299 aa, Enterococcus faecalis V583; identical to SEQ ID NO: 49673

SEQ ID NO: 67175 - DNA, 855 bp, Bacillus cereus ATCC 14579; identical to SEQ ID NO: 49674
  CDS (1)..(855): transl_table=11

SEQ ID NO: 67176 - protein, 284 aa, Bacillus cereus ATCC 14579; identical to SEQ ID NO: 49675

SEQ ID NO: 67177 - DNA, 915 bp, Nitrosomonas europaea ATCC 19718; identical to SEQ ID NO: 49676
  CDS (1)..(915): transl_table=11

SEQ ID NO: 67178 - protein, 304 aa, Nitrosomonas europaea ATCC 19718; identical to SEQ ID NO: 49677

SEQ ID NO: 67179 - DNA, 855 bp, Bacillus anthracis str. Ames; identical to SEQ ID NO: 49678
  CDS (1)..(855): transl_table=11

SEQ ID NO: 67180 - protein, 284 aa, Bacillus anthracis str. Ames; identical to SEQ ID NO: 49679

SEQ ID NO: 67181 - DNA, 849 bp, Ruegeria sp. PR1b; identical to SEQ ID NO: 49680
  CDS (1)..(849): transl_table=11

SEQ ID NO: 67182 - protein, 282 aa, Ruegeria sp. PR1b; identical to SEQ ID NO: 49681

SEQ ID NO: 67183 - DNA, 897 bp, Bordetella pertussis Tohama I; identical to SEQ ID NO: 49682
  CDS (1)..(897): transl_table=11

SEQ ID NO: 67184 - protein, 298 aa, Bordetella pertussis Tohama I; identical to SEQ ID NO: 49683

SEQ ID NO: 67185 - DNA, 906 bp, Prochlorococcus marinus str. MIT 9313; identical to SEQ ID NO: 49684
  CDS (1)..(906): transl_table=11

SEQ ID NO: 67186 - protein, 301 aa, Prochlorococcus marinus str. MIT 9313; identical to SEQ ID NO: 49685

SEQ ID NO: 67187 - DNA, 909 bp, Synechococcus sp. WH 8102; identical to SEQ ID NO: 49686
  CDS (1)..(909): transl_table=11

SEQ ID NO: 67188 - protein, 302 aa, Synechococcus sp. WH 8102; identical to SEQ ID NO: 49687

SEQ ID NO: 67189 - DNA, 933 bp, Chromobacterium violaceum ATCC 12472; identical to SEQ ID NO: 49688
  CDS (1)..(933): transl_table=11

SEQ ID NO: 67190 - protein, 310 aa, Chromobacterium violaceum ATCC 12472; identical to SEQ ID NO: 49689

SEQ ID NO: 67191 - DNA, 858 bp, Porphyromonas gingivalis W83; identical to SEQ ID NO: 49690
  CDS (1)..(858): transl_table=11

SEQ ID NO: 67192 - protein, 285 aa, Porphyromonas gingivalis W83; identical to SEQ ID NO: 49691

SEQ ID NO: 67193 - DNA, 903 bp, Gloeobacter violaceus PCC 7421; identical to SEQ ID NO: 49692
  CDS (1)..(903): transl_table=11

SEQ ID NO: 67194 - protein, 300 aa, Gloeobacter violaceus PCC 7421; identical to SEQ ID NO: 49693

SEQ ID NO: 67195 - DNA, 882 bp, Vibrio vulnificus YJ016; identical to SEQ ID NO: 49694
  CDS (1)..(882): transl_table=11

SEQ ID NO: 67196 - protein, 293 aa, Vibrio vulnificus YJ016; identical to SEQ ID NO: 49695

SEQ ID NO: 67197 - DNA, 1347 bp, Corynebacterium diphtheriae NCTC 13129; identical to SEQ ID NO: 49696
  CDS (1)..(1347): transl_table=11

SEQ ID NO: 67198 - protein, 448 aa, Corynebacterium diphtheriae NCTC 13129; identical to SEQ ID NO: 49697

SEQ ID NO: 67199 - DNA, 894 bp, Rhodopseudomonas palustris CGA009; identical to SEQ ID NO: 49698
  CDS (1)..(894): transl_table=11

SEQ ID NO: 67200 - protein, 297 aa, Rhodopseudomonas palustris CGA009; identical to SEQ ID NO: 49699

SEQ ID NO: 67201 - DNA, 843 bp, Geobacter sulfurreducens PCA; identical to SEQ ID NO: 49700
  CDS (1)..(843): transl_table=11

SEQ ID NO: 67202 - protein, 280 aa, Geobacter sulfurreducens PCA; identical to SEQ ID NO: 49701

SEQ ID NO: 67203 - DNA, 924 bp, Mycobacterium avium subsp. paratuberculosis K-10; identical to SEQ ID NO: 49702
  CDS (1)..(924): transl_table=11

SEQ ID NO: 67204 - protein, 307 aa, Mycobacterium avium subsp. paratuberculosis K-10; identical to SEQ ID NO: 49703

SEQ ID NO: 67205 - DNA, 987 bp, Lactobacillus johnsonii NCC 533; identical to SEQ ID NO: 49704
  CDS (1)..(987): transl_table=11

SEQ ID NO: 67206 - protein, 328 aa, Lactobacillus johnsonii NCC 533; identical to SEQ ID NO: 49705

SEQ ID NO: 67207 - DNA, 921 bp, Leptospira interrogans serovar Copenhageni str. Fiocruz L1-130; identical to SEQ ID NO: 49706
  CDS (1)..(921): transl_table=11

SEQ ID NO: 67208 - protein, 306 aa, Leptospira interrogans serovar Copenhageni str. Fiocruz L1-130; identical to SEQ ID NO: 49707

SEQ ID NO: 67209 - DNA, 885 bp, Parachlamydia sp. UWE25; identical to SEQ ID NO: 49708
  CDS (1)..(885): transl_table=11

SEQ ID NO: 67210 - protein, 294 aa, Parachlamydia sp. UWE25; identical to SEQ ID NO: 49709

SEQ ID NO: 67211 - DNA, 876 bp, Desulfovibrio vulgaris subsp. vulgaris str. Hildenborough; identical to SEQ ID NO: 49710
  CDS (1)..(876): transl_table=11

SEQ ID NO: 67212 - protein, 291 aa, Desulfovibrio vulgaris subsp. vulgaris str. Hildenborough; identical to SEQ ID NO: 49711

SEQ ID NO: 67213 - DNA, 810 bp, Picrophilus torridus DSM 9790; identical to SEQ ID NO: 49712
  CDS (1)..(810): transl_table=11

SEQ ID NO: 67214 - protein, 269 aa, Picrophilus torridus DSM 9790; identical to SEQ ID NO: 49713

SEQ ID NO: 67215 - DNA, 909 bp, Acinetobacter sp. ADP1; identical to SEQ ID NO: 49714
  CDS (1)..(909): transl_table=11

SEQ ID NO: 67216 - protein, 302 aa, Acinetobacter sp. ADP1; identical to SEQ ID NO: 49715

SEQ ID NO: 67217 - DNA, 852 bp, Erwinia carotovora subsp. atroseptica SCRI1043; identical to SEQ ID NO: 49716
  CDS (1)..(852): transl_table=11

SEQ ID NO: 67218 - protein, 283 aa, Erwinia carotovora subsp. atroseptica SCRI1043; identical to SEQ ID NO: 49717

SEQ ID NO: 67219 - DNA, 855 bp, Streptococcus pyogenes MGAS10394; identical to SEQ ID NO: 49718
  CDS (1)..(855): transl_table=11

SEQ ID NO: 67220 - protein, 284 aa, Streptococcus pyogenes MGAS10394; identical to SEQ ID NO: 49719

SEQ ID NO: 67221 - DNA, 888 bp, Leifsonia xyli subsp. xyli str. CTCB07; identical to SEQ ID NO: 49720
  CDS (1)..(888): transl_table=11

SEQ ID NO: 67222 - protein, 295 aa, Leifsonia xyli subsp. xyli str. CTCB07; identical to SEQ ID NO: 49721

SEQ ID NO: 67223 - DNA, 855 bp, Bacillus cereus E33L; identical to SEQ ID NO: 49722
  CDS (1)..(855): transl_table=11

SEQ ID NO: 67224 - protein, 284 aa, Bacillus cereus E33L; identical to SEQ ID NO: 49723

SEQ ID NO: 67225 - DNA, 885 bp, Legionella pneumophila subsp. pneumophila str. Philadelphia 1; identical to SEQ ID NO: 49724
  CDS (1)..(885): transl_table=11

SEQ ID NO: 67226 - protein, 294 aa, Legionella pneumophila subsp. pneumophila str. Philadelphia 1; identical to SEQ ID NO: 49725

SEQ ID NO: 67227 - DNA, 891 bp, Bacteroides fragilis YCH46; identical to SEQ ID NO: 49726
  CDS (1)..(891): transl_table=11

SEQ ID NO: 67228 - protein, 296 aa, Bacteroides fragilis YCH46; identical to SEQ ID NO: 49727

SEQ ID NO: 67229 - DNA, 897 bp, Burkholderia mallei ATCC 23344; identical to SEQ ID NO: 49728
  CDS (1)..(897): transl_table=11

SEQ ID NO: 67230 - protein, 298 aa, Burkholderia mallei ATCC 23344; identical to SEQ ID NO: 49729

SEQ ID NO: 67231 - DNA, 906 bp, Methylococcus capsulatus str. Bath; identical to SEQ ID NO: 49730
  CDS (1)..(906): transl_table=11

SEQ ID NO: 67232 - protein, 301 aa, Methylococcus capsulatus str. Bath; identical to SEQ ID NO: 49731

SEQ ID NO: 67233 - DNA, 858 bp, Nocardia farcinica IFM 10152; identical to SEQ ID NO: 49732
  CDS (1)..(858): transl_table=11

SEQ ID NO: 67234 - protein, 285 aa, Nocardia farcinica IFM 10152; identical to SEQ ID NO: 49733

SEQ ID NO: 67235 - DNA, 885 bp, Legionella pneumophila str. Lens; identical to SEQ ID NO: 49734
  CDS (1)..(885): transl_table=11

SEQ ID NO: 67236 - protein, 294 aa, Legionella pneumophila str. Lens; identical to SEQ ID NO: 49735

SEQ ID NO: 67237 - DNA, 873 bp, Streptococcus thermophilus LMG 18311; identical to SEQ ID NO: 49736
  CDS (1)..(873): transl_table=11

SEQ ID NO: 67238 - protein, 290 aa, Streptococcus thermophilus LMG 18311; identical to SEQ ID NO: 49737

SEQ ID NO: 67239 - DNA, 897 bp, Azoarcus sp. EbN1; identical to SEQ ID NO: 49738
  CDS (1)..(897): transl_table=11

SEQ ID NO: 67240 - protein, 298 aa, Azoarcus sp. EbN1; identical to SEQ ID NO: 49739

SEQ ID NO: 67241 - DNA, 870 bp, Synechococcus elongatus PCC 6301; identical to SEQ ID NO: 49740
  CDS (1)..(870): transl_table=11

SEQ ID NO: 67242 - protein, 289 aa, Synechococcus elongatus PCC 6301; identical to SEQ ID NO: 49741

SEQ ID NO: 67243 - DNA, 894 bp, Gluconobacter oxydans 621H; identical to SEQ ID NO: 49742
  CDS (1)..(894): transl_table=11

SEQ ID NO: 67244 - protein, 297 aa, Gluconobacter oxydans 621H; identical to SEQ ID NO: 49743

SEQ ID NO: 67245 - DNA, 909 bp, Xanthomonas oryzae pv. oryzae KACC10331; identical to SEQ ID NO: 49744
  CDS (1)..(909): transl_table=11

SEQ ID NO: 67246 - protein, 302 aa, Xanthomonas oryzae pv. oryzae KACC10331; identical to SEQ ID NO: 49745

SEQ ID NO: 67247 - DNA, 864 bp, Neisseria gonorrhoeae FA 1090; identical to SEQ ID NO: 49746
  CDS (1)..(864): transl_table=11

SEQ ID NO: 67248 - protein, 287 aa, Neisseria gonorrhoeae FA 1090; identical to SEQ ID NO: 49747

SEQ ID NO: 67249 - DNA, 864 bp, Bacteroides fragilis NCTC 9343; identical to SEQ ID NO: 49748
  CDS (1)..(864): transl_table=11

SEQ ID NO: 67250 - protein, 287 aa, Bacteroides fragilis NCTC 9343; identical to SEQ ID NO: 49749

SEQ ID NO: 67251 - DNA, 891 bp, Bacteroides fragilis NCTC 9343; identical to SEQ ID NO: 49750
  CDS (1)..(891): transl_table=11

SEQ ID NO: 67252 - protein, 296 aa, Bacteroides fragilis NCTC 9343; identical to SEQ ID NO: 49751

SEQ ID NO: 67253 - DNA, 849 bp, Sulfolobus acidocaldarius DSM 639; identical to SEQ ID NO: 49752
  CDS (1)..(849): transl_table=11

SEQ ID NO: 67254 - protein, 282 aa, Sulfolobus acidocaldarius DSM 639; identical to SEQ ID NO: 49753

SEQ ID NO: 67255 - DNA, 852 bp, Rhodobacter sphaeroides 2.4.1; identical to SEQ ID NO: 49754
  CDS (1)..(852)

SEQ ID NO: 67256 - protein, 283 aa, Rhodobacter sphaeroides 2.4.1; identical to SEQ ID NO: 49755

SEQ ID NO: 67257 - DNA, 891 bp, Nostoc punctiforme PCC 73102; identical to SEQ ID NO: 49756
  CDS (1)..(891)

SEQ ID NO: 67258 - protein, 296 aa, Nostoc punctiforme PCC 73102; identical to SEQ ID NO: 49757

SEQ ID NO: 67259 - DNA, 1452 bp, Bifidobacterium longum DJO10A; identical to SEQ ID NO: 49758
  CDS (1)..(1452)

SEQ ID NO: 67260 - protein, 483 aa, Bifidobacterium longum DJO10A; identical to SEQ ID NO: 49759

SEQ ID NO: 67261 - DNA, 909 bp, Pseudomonas aeruginosa UCBPP-PA14; identical to SEQ ID NO: 49760
  CDS (1)..(909)

SEQ ID NO: 67262 - protein, 302 aa, Pseudomonas aeruginosa UCBPP-PA14; identical to SEQ ID NO: 49761

SEQ ID NO: 67263 - DNA, 894 bp, Fusobacterium nucleatum subsp. vincentii ATCC 49256; identical to SEQ ID NO: 49762
  CDS (1)..(894): transl_table=11

SEQ ID NO: 67264 - protein, 297 aa, Fusobacterium nucleatum subsp. vincentii ATCC 49256; identical to SEQ ID NO: 49763

SEQ ID NO: 67265 - DNA, 891 bp, Anabaena variabilis ATCC 29413; identical to SEQ ID NO: 49764
  CDS (1)..(891)

SEQ ID NO: 67266 - protein, 296 aa, Anabaena variabilis ATCC 29413; identical to SEQ ID NO: 49765

SEQ ID NO: 67267 - DNA, 915 bp, Ralstonia eutropha JMP134; identical to SEQ ID NO: 49766
  CDS (1)..(915)

SEQ ID NO: 67268 - protein, 304 aa, Ralstonia eutropha JMP134; identical to SEQ ID NO: 49767

SEQ ID NO: 67269 - DNA, 897 bp, Rubrivivax gelatinosus PM1; identical to SEQ ID NO: 49768
  CDS (1)..(897)

SEQ ID NO: 67270 - protein, 298 aa, Rubrivivax gelatinosus PM1; identical to SEQ ID NO: 49769

SEQ ID NO: 67271 - DNA, 837 bp, Burkholderia fungorum LB400; identical to SEQ ID NO: 49770
  CDS (1)..(837)

SEQ ID NO: 67272 - protein, 278 aa, Burkholderia fungorum LB400; identical to SEQ ID NO: 49771

SEQ ID NO: 67273 - DNA, 906 bp, Psychrobacter sp. 273-4; identical to SEQ ID NO: 49772
  CDS (1)..(906)

SEQ ID NO: 67274 - protein, 301 aa, Psychrobacter sp. 273-4; identical to SEQ ID NO: 49773

SEQ ID NO: 67275 - DNA, 900 bp, Azotobacter vinelandii AvOP; identical to SEQ ID NO: 49774
  CDS (1)..(900): transl_table=11

SEQ ID NO: 67276 - protein, 299 aa, Azotobacter vinelandii AvOP; identical to SEQ ID NO: 49775

SEQ ID NO: 67277 - DNA, 885 bp, Burkholderia vietnamiensis G4; identical to SEQ ID NO: 49776
  CDS (1)..(885): transl_table=11

SEQ ID NO: 67278 - protein, 294 aa, Burkholderia vietnamiensis G4; identical to SEQ ID NO: 49777

SEQ ID NO: 67279 - DNA, 900 bp, Burkholderia cenocepacia AU 1054; identical to SEQ ID NO: 49778
  CDS (1)..(900): transl_table=11

SEQ ID NO: 67280 - protein, 299 aa, Burkholderia cenocepacia AU 1054; identical to SEQ ID NO: 49779

SEQ ID NO: 67281 - DNA, 975 bp, Polaromonas sp. JS666; identical to SEQ ID NO: 49780
  CDS (1)..(975): transl_table=11

SEQ ID NO: 67282 - protein, 324 aa, Polaromonas sp. JS666; identical to SEQ ID NO: 49781

SEQ ID NO: 67283 - DNA, 897 bp, Frankia sp. CcI3; identical to SEQ ID NO: 49782
  CDS (1)..(897): transl_table=11

SEQ ID NO: 67284 - protein, 298 aa, Frankia sp. CcI3; identical to SEQ ID NO: 49783

SEQ ID NO: 67285 - DNA, 810 bp, Methanococcoides burtonii DSM 6242; identical to SEQ ID NO: 49784
  CDS (1)..(810): transl_table=11

SEQ ID NO: 67286 - protein, 269 aa, Methanococcoides burtonii DSM 6242; identical to SEQ ID NO: 49785

SEQ ID NO: 67287 - DNA, 876 bp, Shewanella baltica OS155; identical to SEQ ID NO: 49786
  CDS (1)..(876): transl_table=11

SEQ ID NO: 67288 - protein, 291 aa, Shewanella baltica OS155; identical to SEQ ID NO: 49787

SEQ ID NO: 67289 - DNA, 906 bp, Shewanella amazonensis SB2B; identical to SEQ ID NO: 49788
  CDS (1)..(906): transl_table=11

SEQ ID NO: 67290 - protein, 301 aa, Shewanella amazonensis SB2B; identical to SEQ ID NO: 49789

SEQ ID NO: 67291 - DNA, 879 bp, Pelodictyon phaeoclathratiforme BU-1; identical to SEQ ID NO: 49790
  CDS (1)..(879): transl_table=11

SEQ ID NO: 67292 - protein, 292 aa, Pelodictyon phaeoclathratiforme BU-1; identical to SEQ ID NO: 49791

SEQ ID NO: 67293 - DNA, 921 bp, Ralstonia metallidurans CH34; identical to SEQ ID NO: 49792
  CDS (1)..(921): transl_table=11

SEQ ID NO: 67294 - protein, 306 aa, Ralstonia metallidurans CH34; identical to SEQ ID NO: 49793

SEQ ID NO: 67295 - DNA, 888 bp, Mesorhizobium sp. BNC1; identical to SEQ ID NO: 49794
  CDS (1)..(888): transl_table=11

SEQ ID NO: 67296 - protein, 295 aa, Mesorhizobium sp. BNC1; identical to SEQ ID NO: 49795

SEQ ID NO: 67297 - DNA, 915 bp, Nitrobacter hamburgensis X14; identical to SEQ ID NO: 49796
  CDS (1)..(915): transl_table=11

SEQ ID NO: 67298 - protein, 304 aa, Nitrobacter hamburgensis X14; identical to SEQ ID NO: 49797

SEQ ID NO: 67299 - DNA, 855 bp, Streptococcus mutans; identical to SEQ ID NO: 49798
  CDS (1)..(855): transl_table=11

SEQ ID NO: 67300 - protein, 284 aa, Streptococcus mutans; identical to SEQ ID NO: 49799

SEQ ID NO: 67301 - DNA, 867 bp, Serratia marcescens; identical to SEQ ID NO: 49800
  CDS (1)..(867): transl_table=11

SEQ ID NO: 67302 - protein, 288 aa, Serratia marcescens; identical to SEQ ID NO: 49801

SEQ ID NO: 67303 - DNA, 885 bp, Actinobacillus actinomycetemcomitans; identical to SEQ ID NO: 49802
  CDS (1)..(885): transl_table=11

SEQ ID NO: 67304 - protein, 294 aa, Actinobacillus actinomycetemcomitans; identical to SEQ ID NO: 49803

SEQ ID NO: 67305 - DNA, 918 bp, Streptomyces glaucescens; identical to SEQ ID NO: 49804
  CDS (1)..(918): transl_table=11

SEQ ID NO: 67306 - protein, 305 aa, Streptomyces glaucescens; identical to SEQ ID NO: 49805

SEQ ID NO: 67307 - DNA, 900 bp, Enterococcus faecalis; identical to SEQ ID NO: 49806
  CDS (1)..(900): transl_table=11

SEQ ID NO: 67308 - protein, 299 aa, Enterococcus faecalis; identical to SEQ ID NO: 49807

SEQ ID NO: 67309 - DNA, 867 bp, Sphingomonas sp; identical to SEQ ID NO: 49808
  CDS (1)..(867): transl_table=11

SEQ ID NO: 67310 - protein, 288 aa, Sphingomonas sp; identical to SEQ ID NO: 49809

SEQ ID NO: 67311 - DNA, 828 bp, Rhizobium meliloti; identical to SEQ ID NO: 49810
  CDS (1)..(828): transl_table=11

SEQ ID NO: 67312 - protein, 275 aa, Rhizobium meliloti; identical to SEQ ID NO: 49811

SEQ ID NO: 67313 - DNA, 891 bp, Azorhizobium caulinodans; identical to SEQ ID NO: 49812
  CDS (1)..(891): transl_table=11

SEQ ID NO: 67314 - protein, 296 aa, Azorhizobium caulinodans; identical to SEQ ID NO: 49813

SEQ ID NO: 67315 - DNA, 852 bp, Streptococcus pneumoniae; identical to SEQ ID NO: 49814
  CDS (1)..(852): transl_table=11

SEQ ID NO: 67316 - protein, 283 aa, Streptococcus pneumoniae; identical to SEQ ID NO: 49815

SEQ ID NO: 67317 - DNA, 852 bp, Streptococcus pneumoniae; identical to SEQ ID NO: 49816
  CDS (1)..(852): transl_table=11

SEQ ID NO: 67318 - protein, 283 aa, Streptococcus pneumoniae; identical to SEQ ID NO: 49817

SEQ ID NO: 67319 - DNA, 882 bp, Pseudomonas fluorescens; identical to SEQ ID NO: 49818
  CDS (1)..(882): transl_table=11

SEQ ID NO: 67320 - protein, 293 aa, Pseudomonas fluorescens; identical to SEQ ID NO: 49819

SEQ ID NO: 67321 - DNA, 1005 bp, Xenopus laevis; identical to SEQ ID NO: 49820
  CDS (1)..(1005)

SEQ ID NO: 67322 - protein, 334 aa, Xenopus laevis; identical to SEQ ID NO: 49821

SEQ ID NO: 67323 - DNA, 900 bp, Shigella boydii; identical to SEQ ID NO: 49822
  CDS (1)..(900): transl_table=11

SEQ ID NO: 67324 - protein, 299 aa, Shigella boydii; identical to SEQ ID NO: 49823

SEQ ID NO: 67325 - DNA, 915 bp, Streptomyces griseus subsp; identical to SEQ ID NO: 49824
  CDS (1)..(915): transl_table=11

SEQ ID NO: 67326 - protein, 304 aa, Streptomyces griseus subsp; identical to SEQ ID NO: 49825

SEQ ID NO: 67327 - DNA, 924 bp, Saccharopolyspora erythraea; identical to SEQ ID NO: 49826
  CDS (1)..(924): transl_table=11

SEQ ID NO: 67328 - protein, 307 aa, Saccharopolyspora erythraea; identical to SEQ ID NO: 49827

SEQ ID NO: 67329 - DNA, 909 bp, Xanthomonas campestris pv; identical to SEQ ID NO: 49828
  CDS (1)..(909): transl_table=11

SEQ ID NO: 67330 - protein, 302 aa, Xanthomonas campestris pv; identical to SEQ ID NO: 49829

SEQ ID NO: 67331 - DNA, 870 bp, Yersinia enterocolitica; identical to SEQ ID NO: 49830
  CDS (1)..(870): transl_table=11

SEQ ID NO: 67332 - protein, 289 aa, Yersinia enterocolitica; identical to SEQ ID NO: 49831

SEQ ID NO: 67333 - DNA, 843 bp, Lactobacillus rhamnosus; identical to SEQ ID NO: 49832
  CDS (1)..(843): transl_table=11

SEQ ID NO: 67334 - protein, 280 aa, Lactobacillus rhamnosus; identical to SEQ ID NO: 49833

SEQ ID NO: 67335 - DNA, 843 bp, Lactobacillus rhamnosus; identical to SEQ ID NO: 49834
  CDS (1)..(843): transl_table=11

SEQ ID NO: 67336 - protein, 280 aa, Lactobacillus rhamnosus; identical to SEQ ID NO: 49835

SEQ ID NO: 67337 - DNA, 843 bp, Lactobacillus rhamnosus; identical to SEQ ID NO: 49836
  CDS (1)..(843): transl_table=11

SEQ ID NO: 67338 - protein, 280 aa, Lactobacillus rhamnosus; identical to SEQ ID NO: 49837

SEQ ID NO: 67339 - DNA, 912 bp, Acetobacter tropicalis; identical to SEQ ID NO: 49838
  CDS (1)..(912): transl_table=11

SEQ ID NO: 67340 - protein, 303 aa, Acetobacter tropicalis; identical to SEQ ID NO: 49839

SEQ ID NO: 67341 - DNA, 900 bp, Escherichia coli; identical to SEQ ID NO: 49840
  CDS (1)..(900): transl_table=11

SEQ ID NO: 67342 - protein, 299 aa, Escherichia coli; identical to SEQ ID NO: 49841

SEQ ID NO: 67343 - DNA, 900 bp, Shigella dysenteriae; identical to SEQ ID NO: 49842
  CDS (1)..(900): transl_table=11

SEQ ID NO: 67344 - protein, 299 aa, Shigella dysenteriae; identical to SEQ ID NO: 49843

SEQ ID NO: 67345 - DNA, 963 bp, Mus musculus; identical to SEQ ID NO: 49844
  CDS (1)..(963)

SEQ ID NO: 67346 - protein, 320 aa, Mus musculus; identical to SEQ ID NO: 49845

SEQ ID NO: 67347 - DNA, 879 bp, Yersinia enterocolitica; identical to SEQ ID NO: 49846
  CDS (1)..(879): transl_table=11

SEQ ID NO: 67348 - protein, 292 aa, Yersinia enterocolitica; identical to SEQ ID NO: 49847

SEQ ID NO: 67349 - DNA, 855 bp, Streptococcus oralis; identical to SEQ ID NO: 49848
  CDS (1)..(855): transl_table=11

SEQ ID NO: 67350 - protein, 284 aa, Streptococcus oralis; identical to SEQ ID NO: 49849

SEQ ID NO: 67351 - DNA, 900 bp, Shigella boydii; identical to SEQ ID NO: 49850
  CDS (1)..(900): transl_table=11

SEQ ID NO: 67352 - protein, 299 aa, Shigella boydii; identical to SEQ ID NO: 49851

SEQ ID NO: 67353 - DNA, 885 bp, Clostridium thermosaccharolyticum; identical to SEQ ID NO: 49852
  CDS (1)..(885): transl_table=11

SEQ ID NO: 67354 - protein, 294 aa, Clostridium thermosaccharolyticum; identical to SEQ ID NO: 49853

SEQ ID NO: 67355 - DNA, 891 bp, Klebsiella terrigena; identical to SEQ ID NO: 49854
  CDS (1)..(891): transl_table=11

SEQ ID NO: 67356 - protein, 296 aa, Klebsiella terrigena; identical to SEQ ID NO: 49855

SEQ ID NO: 67357 - DNA, 861 bp, Bacillus stearothermophilus; identical to SEQ ID NO: 49856
  CDS (1)..(861): transl_table=11

SEQ ID NO: 67358 - protein, 286 aa, Bacillus stearothermophilus; identical to SEQ ID NO: 49857

SEQ ID NO: 67359 - DNA, 846 bp, Bacillus stearothermophilus; identical to SEQ ID NO: 49858
  CDS (1)..(846): transl_table=11

SEQ ID NO: 67360 - protein, 281 aa, Bacillus stearothermophilus; identical to SEQ ID NO: 49859

SEQ ID NO: 67361 - DNA, 849 bp, Bacillus stearothermophilus; identical to SEQ ID NO: 49860
  CDS (1)..(849): transl_table=11

SEQ ID NO: 67362 - protein, 282 aa, Bacillus stearothermophilus; identical to SEQ ID NO: 49861

SEQ ID NO: 67363 - DNA, 864 bp, Bacteroides coprosuis; identical to SEQ ID NO: 49862
  CDS (1)..(864): transl_table=11

SEQ ID NO: 67364 - protein, 287 aa, Bacteroides coprosuis; identical to SEQ ID NO: 49863

SEQ ID NO: 67365 - DNA, 852 bp, Thermotoga sp; identical to SEQ ID NO: 49864
  CDS (1)..(852): transl_table=11

SEQ ID NO: 67366 - protein, 283 aa, Thermotoga sp; identical to SEQ ID NO: 49865

SEQ ID NO: 67367 - DNA, 867 bp, Sphingomonas elodea; identical to SEQ ID NO: 49866
  CDS (1)..(867): transl_table=11

SEQ ID NO: 67368 - protein, 288 aa, Sphingomonas elodea; identical to SEQ ID NO: 49867

SEQ ID NO: 67369 - DNA, 852 bp, Streptococcus gordonii; identical to SEQ ID NO: 49868
  CDS (1)..(852): n means a or g or c or t/u, s means g or c

SEQ ID NO: 67370 - protein, 283 aa, Streptococcus gordonii; identical to SEQ ID NO: 49869
  Xaa in position 200 is unknown

SEQ ID NO: 67371 - DNA, 888 bp, Vibrio cholerae; identical to SEQ ID NO: 49870
  CDS (1)..(888): transl_table=11

SEQ ID NO: 67372 - protein, 295 aa, Vibrio cholerae; identical to SEQ ID NO: 49871

SEQ ID NO: 67373 - DNA, 855 bp, Vibrio cholerae; identical to SEQ ID NO: 49872
  CDS (1)..(855): transl_table=11

SEQ ID NO: 67374 - protein, 284 aa, Vibrio cholerae; identical to SEQ ID NO: 49873

SEQ ID NO: 67375 - DNA, 891 bp, Vibrio cholerae; identical to SEQ ID NO: 49874
  CDS (1)..(891): transl_table=11

SEQ ID NO: 67376 - protein, 296 aa, Vibrio cholerae; identical to SEQ ID NO: 49875

SEQ ID NO: 67377 - DNA, 891 bp, Vibrio cholerae; identical to SEQ ID NO: 49876
  CDS (1)..(891): transl_table=11

SEQ ID NO: 67378 - protein, 296 aa, Vibrio cholerae; identical to SEQ ID NO: 49877

SEQ ID NO: 67379 - DNA, 891 bp, Vibrio cholerae; identical to SEQ ID NO: 49878
  CDS (1)..(891): transl_table=11

SEQ ID NO: 67380 - protein, 296 aa, Vibrio cholerae; identical to SEQ ID NO: 49879

SEQ ID NO: 67381 - DNA, 891 bp, Vibrio cholerae; identical to SEQ ID NO: 49880
  CDS (1)..(891): transl_table=11

SEQ ID NO: 67382 - protein, 296 aa, Vibrio cholerae; identical to SEQ ID NO: 49881

SEQ ID NO: 67383 - DNA, 873 bp, Vibrio vulnificus; identical to SEQ ID NO: 49882
  CDS (1)..(873): transl_table=11

SEQ ID NO: 67384 - protein, 290 aa, Vibrio vulnificus; identical to SEQ ID NO: 49883

SEQ ID NO: 67385 - DNA, 900 bp, Lactococcus lactis subsp; identical to SEQ ID NO: 49884
  CDS (1)..(900): transl_table=11

SEQ ID NO: 67386 - protein, 299 aa, Lactococcus lactis subsp; identical to SEQ ID NO: 49885

SEQ ID NO: 67387 - DNA, 867 bp, Streptomyces roseochromogenes subsp; identical to SEQ ID NO: 49886
  CDS (1)..(867): transl_table=11

SEQ ID NO: 67388 - protein, 288 aa, Streptomyces roseochromogenes subsp; identical to SEQ ID NO: 49887

SEQ ID NO: 67389 - DNA, 837 bp, Streptococcus suis; identical to SEQ ID NO: 49888
  CDS (1)..(837): transl_table=11

SEQ ID NO: 67390 - protein, 278 aa, Streptococcus suis; identical to SEQ ID NO: 49889

SEQ ID NO: 67391 - DNA, 903 bp, Aeromonas hydrophila; identical to SEQ ID NO: 49890
  CDS (1)..(903): transl_table=11

SEQ ID NO: 67392 - protein, 300 aa, Aeromonas hydrophila; identical to SEQ ID NO: 49891

SEQ ID NO: 67393 - DNA, 903 bp, Aeromonas hydrophila; identical to SEQ ID NO: 49892
  CDS (1)..(903): transl_table=11

SEQ ID NO: 67394 - protein, 300 aa, Aeromonas hydrophila; identical to SEQ ID NO: 49893

SEQ ID NO: 67395 - DNA, 1002 bp, Lactobacillus gasseri; identical to SEQ ID NO: 49894
  CDS (1)..(1002): transl_table=11

SEQ ID NO: 67396 - protein, 333 aa, Lactobacillus gasseri; identical to SEQ ID NO: 49895

SEQ ID NO: 67397 - DNA, 921 bp, Leptospira interrogans; identical to SEQ ID NO: 49896
  CDS (1)..(921): transl_table=11

SEQ ID NO: 67398 - protein, 306 aa, Leptospira interrogans; identical to SEQ ID NO: 49897

SEQ ID NO: 67399 - DNA, 900 bp, Shigella boydii; identical to SEQ ID NO: 49898
  CDS (1)..(900): transl_table=11

SEQ ID NO: 67400 - protein, 299 aa, Shigella boydii; identical to SEQ ID NO: 49899

SEQ ID NO: 67401 - DNA, 900 bp, Shigella boydii; identical to SEQ ID NO: 49900
  CDS (1)..(900): transl_table=11

SEQ ID NO: 67402 - protein, 299 aa, Shigella boydii; identical to SEQ ID NO: 49901

SEQ ID NO: 67403 - DNA, 918 bp, Saccharopolyspora spinosa; identical to SEQ ID NO: 49902
  CDS (1)..(918): transl_table=11

SEQ ID NO: 67404 - protein, 305 aa, Saccharopolyspora spinosa; identical to SEQ ID NO: 49903

SEQ ID NO: 67405 - DNA, 849 bp, Aneurinibacillus thermoaerophilus; identical to SEQ ID NO: 49904
  CDS (1)..(849): transl_table=11

SEQ ID NO: 67406 - protein, 282 aa, Aneurinibacillus thermoaerophilus; identical to SEQ ID NO: 49905

SEQ ID NO: 67407 - DNA, 894 bp, Acinetobacter calcoaceticus; identical to SEQ ID NO: 49906
  CDS (1)..(894): transl_table=11

SEQ ID NO: 67408 - protein, 297 aa, Acinetobacter calcoaceticus; identical to SEQ ID NO: 49907

SEQ ID NO: 67409 - DNA, 897 bp, Burkholderia mallei; identical to SEQ ID NO: 49908
  CDS (1)..(897): transl_table=11

SEQ ID NO: 67410 - protein, 298 aa, Burkholderia mallei; identical to SEQ ID NO: 49909

SEQ ID NO: 67411 - DNA, 930 bp, Azospirillum brasilense; identical to SEQ ID NO: 49910
  CDS (1)..(930): transl_table=11

SEQ ID NO: 67412 - protein, 309 aa, Azospirillum brasilense; identical to SEQ ID NO: 49911

SEQ ID NO: 67413 - DNA, 879 bp, Actinobacillus actinomycetemcomitans; identical to SEQ ID NO: 49912
  CDS (1)..(879): transl_table=11

SEQ ID NO: 67414 - protein, 292 aa, Actinobacillus actinomycetemcomitans; identical to SEQ ID NO: 49913

SEQ ID NO: 67415 - DNA, 888 bp, Acetobacter xylinus; identical to SEQ ID NO: 49914
  CDS (1)..(888): transl_table=11

SEQ ID NO: 67416 - protein, 295 aa, Acetobacter xylinus; identical to SEQ ID NO: 49915

SEQ ID NO: 67417 - DNA, 900 bp, Salmonella enterica; identical to SEQ ID NO: 49916
  CDS (1)..(900): transl_table=11

SEQ ID NO: 67418 - protein, 299 aa, Salmonella enterica; identical to SEQ ID NO: 49917

SEQ ID NO: 67419 - DNA, 900 bp, Salmonella enterica; identical to SEQ ID NO: 49918
  CDS (1)..(900): transl_table=11

SEQ ID NO: 67420 - protein, 299 aa, Salmonella enterica; identical to SEQ ID NO: 49919

SEQ ID NO: 67421 - DNA, 867 bp, Streptomyces rishiriensis; identical to SEQ ID NO: 49920
  CDS (1)..(867): transl_table=11

SEQ ID NO: 67422 - protein, 288 aa, Streptomyces rishiriensis; identical to SEQ ID NO: 49921

SEQ ID NO: 67423 - DNA, 879 bp, Actinobacillus actinomycetemcomitans; identical to SEQ ID NO: 49922
  CDS (1)..(879): transl_table=11

SEQ ID NO: 67424 - protein, 292 aa, Actinobacillus actinomycetemcomitans; identical to SEQ ID NO: 49923

SEQ ID NO: 67425 - DNA, 885 bp, Streptomyces antibioticus; identical to SEQ ID NO: 49924
  CDS (1)..(885): transl_table=11

SEQ ID NO: 67426 - protein, 294 aa, Streptomyces antibioticus; identical to SEQ ID NO: 49925

SEQ ID NO: 67427 - DNA, 876 bp, Streptomyces nogalater; identical to SEQ ID NO: 49926
  CDS (1)..(876): transl_table=11

SEQ ID NO: 67428 - protein, 291 aa, Streptomyces nogalater; identical to SEQ ID NO: 49927

SEQ ID NO: 67429 - DNA, 921 bp, Leptospira interrogans; identical to SEQ ID NO: 49928
  CDS (1)..(921): transl_table=11

SEQ ID NO: 67430 - protein, 306 aa, Leptospira interrogans; identical to SEQ ID NO: 49929

SEQ ID NO: 67431 - DNA, 879 bp, Actinobacillus actinomycetemcomitans; identical to SEQ ID NO: 49930
  CDS (1)..(879): transl_table=11

SEQ ID NO: 67432 - protein, 292 aa, Actinobacillus actinomycetemcomitans; identical to SEQ ID NO: 49931

SEQ ID NO: 67433 - DNA, 855 bp, Streptococcus pneumoniae; identical to SEQ ID NO: 49932
  CDS (1)..(855): transl_table=11

SEQ ID NO: 67434 - protein, 284 aa, Streptococcus pneumoniae; identical to SEQ ID NO: 49933

SEQ ID NO: 67435 - DNA, 891 bp, Klebsiella pneumoniae; identical to SEQ ID NO: 49934
  CDS (1)..(891): transl_table=11

SEQ ID NO: 67436 - protein, 296 aa, Klebsiella pneumoniae; identical to SEQ ID NO: 49935

SEQ ID NO: 67437 - DNA, 921 bp, Leptospira borgpetersenii; identical to SEQ ID NO: 49936
  CDS (1)..(921): transl_table=11

SEQ ID NO: 67438 - protein, 306 aa, Leptospira borgpetersenii; identical to SEQ ID NO: 49937

SEQ ID NO: 67439 - DNA, 906 bp, Escherichia coli; identical to SEQ ID NO: 49938
  CDS (1)..(906): transl_table=11

SEQ ID NO: 67440 - protein, 301 aa, Escherichia coli; identical to SEQ ID NO: 49939

SEQ ID NO: 67441 - DNA, 891 bp, Rhizobium sp; identical to SEQ ID NO: 49940
  CDS (1)..(891): transl_table=11

SEQ ID NO: 67442 - protein, 296 aa, Rhizobium sp; identical to SEQ ID NO: 49941

SEQ ID NO: 67443 - DNA, 900 bp, Salmonella typhimurium; identical to SEQ ID NO: 49942
  CDS (1)..(900): transl_table=11

SEQ ID NO: 67444 - protein, 299 aa, Salmonella typhimurium; identical to SEQ ID NO: 49943

SEQ ID NO: 67445 - DNA, 915 bp, Streptomyces griseus; identical to SEQ ID NO: 49944
  CDS (1)..(915): transl_table=11

SEQ ID NO: 67446 - protein, 304 aa, Streptomyces griseus; identical to SEQ ID NO: 49945

SEQ ID NO: 67447 - DNA, 26 bp, Artificial sequence
  (1)..(26): primer
atgaatatcctcctttttggcaaaac

SEQ ID NO: 67448 - DNA, 27 bp, Artificial sequence
  (1)..(27): primer
ttaaattgctgtagtcgtaaataattc

SEQ ID NO: 67449 - protein, 351 aa, Artificial sequence; identical to SEQ ID NO: 49948
  Variant (2)..(3): xaa in position 2 to 3 is any amino acid
  Variant (6)..(6): xaa in position 6 is any amino acid
  Variant (8)..(9): xaa in position 8 to 9 is any amino acid
  Variant (11)..(19): xaa in position 11 to 19 is any amino acid
  Variant (20)..(63): xaa in position 20 to 63 is any or no amino acid
  Variant (65)..(69): xaa in position 65 to 69 is any amino acid
  Variant (70)..(70): xaa in position 70 is any or no amino acid
  Variant (73)..(73): xaa in position 73 is any amino acid
  Variant (75)..(75): xaa in position 75 is any amino acid
  Variant (78)..(78): xaa in position 78 is any amino acid
  Variant (81)..(89): xaa in position 81 to 89 is any amino acid
  Variant (90)..(91): xaa in position 90 to 91 is any or no amino acid
  Variant (93)..(99): xaa in position 93 to 99 is any amino acid
  Variant (101)..(113): xaa in position 101 to 113 is any amino acid
  Variant (120)..(120): xaa in position 120 is any amino acid
  Variant (122)..(133): xaa in position 122 to 133 is any amino acid
  Variant (134)..(141): xaa in position 134 to 141 is any or no amino acid
  Variant (143)..(145): xaa in position 143 to 145 is any amino acid
  Variant (148)..(149): xaa in position 148 to 149 is any amino acid
  Variant (151)..(152): xaa in position 151 to 152 is any amino acid
  Variant (155)..(165): xaa in position 155 to 165 is any amino acid
  Variant (166)..(173): xaa in position 166 to 173 is any or no amino acid
  Variant (176)..(176): xaa in position 176 is any amino acid
  Variant (178)..(182): xaa in position 178 to 182 is any amino acid
  Variant (184)..(184): xaa in position 184 is any amino acid
  Variant (185)..(189): xaa in position 185 to 189 is any or no amino acid
  Variant (192)..(193): xaa in position 192 to 193 is any amino acid
  Variant (195)..(205): xaa in position 195 to 205 is any amino acid
  Variant (206)..(213): xaa in position 206 to 213 is any or no amino acid
  Variant (215)..(216): xaa in position 215 to 216 is any amino acid
  Variant (219)..(219): xaa in position 219 is any amino acid
  Variant (221)..(221): xaa in position 221 is any amino acid
  Variant (224)..(228): xaa in position 224 to 228 is any amino acid
  Variant (230)..(239): xaa in position 230 to 239 is any amino acid
  Variant (240)..(257): xaa in position 240 to 257 is any or no amino acid
  Variant (259)..(260): xaa in position 259 to 260 is any amino acid
  Variant (262)..(268): xaa in position 262 to 268 is any amino acid
  Variant (269)..(273): xaa in position 269 to 273 is any or no amino acid
  Variant (275)..(277): xaa in position 275 to 277 is any amino acid
  Variant (279)..(296): xaa in position 279 to 296 is any amino acid
  Variant (297)..(316): xaa in position 297 to 316 is any or no amino acid
  Variant (318)..(318): xaa in position 318 is any amino acid
  Variant (321)..(322): xaa in position 321 to 322 is any amino acid
  Variant (324)..(324): xaa in position 324 is any amino acid
  Variant (326)..(335): xaa in position 326 to 335 is any amino acid
  Variant (336)..(350): xaa in position 336 to 350 is any or no amino acid

SEQ ID NO: 67450 - protein, 10 aa, Artificial sequence
  Variant (2)..(3): xaa in position 2 to 3 is any or no amino acid
  Variant (6)..(6): xaa in position 6 is Leu or Val
  Variant (7)..(7): xaa in position 7 is Ala, Gly, Ser or Val
  Variant (8)..(9): xaa in position 8 to 9 is any amino acid
  Variant (10)..(10): xaa in position 10 is Phe, Ile, Leu, Met or Val
GXXGQXXXXX

SEQ ID NO: 67451 - protein, 11 aa, Artificial sequence
  Variant (2)..(2): xaa in position 2 is any or no amino acid
  Variant (4)..(4): xaa in position 4 is His, Trp or Tyr
  Variant (6)..(6): xaa in position 6 is any amino acid
  Variant (9)..(9): xaa in position 9 is any amino acid
  Variant (10)..(10): xaa in position 10 is Ala, Cys or Ser
AXAXTXVDXXE

SEQ ID NO: 67452 - protein, 8 aa, Artificial sequence
  Variant (7)..(7): xaa in position 7 is any amino acid
STDYVFXG

SEQ ID NO: 67453 - protein, 13 aa, Artificial sequence
  Variant (2)..(2): xaa in position 2 is any amino acid
  Variant (3)..(3): xaa in position 3 is Gly, Asn, Ser or Thr
  Variant (4)..(4): xaa in position 4 is any amino acid
  Variant (7)..(7): xaa in position 7 is any amino acid
  Variant (8)..(8): xaa in position 8 is Ser or Thr
  Variant (10)..(11): xaa in position 10 to 11 is any amino acid
PXXXYGXXKXXGE

SEQ ID NO: 67454 - protein, 10 aa, Artificial sequence
  Variant (2)..(2): xaa in position 2 is any amino acid
  Variant (3)..(3): xaa in position 3 is Ala, Cys, Gly or Ser
  Variant (5)..(5): xaa in position 5 is Leu or Val
  Variant (6)..(6): xaa in position 6 is any amino acid
  Variant (7)..(7): xaa in position 7 is Ala, Cys, Gly or Ser
  Variant (8)..(9): xaa in position 8 to 9 is any amino acid
RXXWXXXXXG

SEQ ID NO: 67455 - protein, 17 aa, Artificial sequence
  Variant (2)..(2): xaa in position 2 is any amino acid
  Variant (3)..(3): xaa in position 3 is any or no amino acid
  Variant (5)..(5): xaa in position 5 is any or no amino acid
  Variant (7)..(7): xaa in position 7 is any amino acid
  Variant (9)..(9): xaa in position 9 is any amino acid
  Variant (11)..(11): xaa in position 11 is Ser or Thr
  Variant (12)..(12): xaa in position 12 is any amino acid
  Variant (13)..(13): xaa in position 13 is Ala, Ser, Thr or Val
  Variant (14)..(15): xaa in position 14 to 15 is any amino acid
  Variant (16)..(16): xaa in position 16 is Ile or Leu
  Variant (17)..(17): xaa in position 17 is Ala, Asn or Val
VXXDXQXGXPXXXXXXX

SEQ ID NO: 67456 - protein, 9 aa, Artificial sequence
  Variant (2)..(2): xaa in position 2 is any amino acid
  Variant (5)..(6): xaa in position 5 to 6 is any amino acid
  Variant (8)..(8): xaa in position 8 is any amino acid
  Variant (9)..(9): xaa in position 9 is Leu or Met
AXRPXXSXX

SEQ ID NO: 67457 - DNA, 417 bp, Escherichia coli K12; identical to SEQ ID NO: 50153
  CDS (1)..(417): transl_table=11

SEQ ID NO: 67458 - protein, 138 aa, Escherichia coli K12; identical to SEQ ID NO: 50154

SEQ ID NO: 67459 - DNA, 495 bp, Escherichia coli CFT073; identical to SEQ ID NO: 50155
  CDS (1)..(495): transl_table=11

SEQ ID NO: 67460 - protein, 164 aa, Escherichia coli CFT073; identical to SEQ ID NO: 50156

SEQ ID NO: 67461 - DNA, 507 bp, Serratia marcescens; identical to SEQ ID NO: 50157
  CDS (1)..(507): transl_table=11

SEQ ID NO: 67462 - protein, 168 aa, Serratia marcescens; identical to SEQ ID NO: 50158

SEQ ID NO: 67463 - DNA, 28 bp, Artificial sequence
  (1)..(28): primer
atgatgactaaaacccaaataaataaat

SEQ ID NO: 67464 - DNA, 26 bp, Artificial sequence
  (1)..(26): primer
ttaaatcagtaagttggcagcatcac

SEQ ID NO: 67465 - protein, 121 aa, Artificial sequence; identical to SEQ ID NO: 50161
  Variant (2)..(4): xaa in position 2 to 4 is any amino acid
  Variant (6)..(9): xaa in position 6 to 9 is any amino acid
  Variant (12)..(14): xaa in position 12 to 14 is any amino acid
  Variant (16)..(24): xaa in position 16 to 24 is any amino acid
  Variant (26)..(46): xaa in position 26 to 46 is any amino acid
  Variant (48)..(52): xaa in position 48 to 52 is any amino acid
  Variant (55)..(59): xaa in position 55 to 59 is any amino acid
  Variant (66)..(66): xaa in position 66 is any amino acid
  Variant (70)..(73): xaa in position 70 to 73 is any amino acid
  Variant (75)..(77): xaa in position 75 to 77 is any amino acid
  Variant (79)..(82): xaa in position 79 to 82 is any amino acid
  Variant (83)..(85): xaa in position 83 to 85 is any or no amino acid
  Variant (87)..(90): xaa in position 87 to 90 is any amino acid
  Variant (92)..(94): xaa in position 92 to 94 is any amino acid
  Variant (96)..(96): xaa in position 96 is any amino acid
  Variant (98)..(102): xaa in position 98 to 102 is any amino acid
  Variant (104)..(104): xaa in position 104 is any amino acid
  Variant (106)..(110): xaa in position 106 to 110 is any amino acid
  Variant (113)..(116): xaa in position 113 to 116 is any amino acid
  Variant (118)..(118): xaa in position 118 is any amino acid
  Variant (120)..(120): xaa in position 120 is any amino acid

SEQ ID NO: 67466 - protein, 25 aa, Artificial sequence
  Variant (2)..(3): xaa in position 2 to 3 is any or no amino acid
  Variant (5)..(5): xaa in position 5 is Met or Val
  Variant (6)..(6): xaa in position 6 is Ala or Asn
  Variant (8)..(8): xaa in position 8 is any amino acid
  Variant (9)..(9): xaa in position 9 is any or no amino acid
  Variant (12)..(12): xaa in position 12 is Phe or Leu
  Variant (13)..(13): xaa in position 13 is Ala or Glu
  Variant (14)..(14): xaa in position 14 is Ala or Ser
  Variant (16)..(16): xaa in position 16 is Leu or Val
  Variant (17)..(17): xaa in position 17 is any amino acid
  Variant (18)..(18): xaa in position 18 is Glu or Pro
  Variant (19)..(19): xaa in position 19 is Glu or Ser
  Variant (20)..(20): xaa in position 20 is Phe or Val
  Variant (21)..(21): xaa in position 21 is Ile or Leu
  Variant (22)..(22): xaa in position 22 is Glu or Lys
  Variant (23)..(23): xaa in position 23 is Asp or Ser
  Variant (24)..(24): xaa in position 24 is Ile or Leu
KXXMXXDXXYPXXXPXXXXXXXXXI

SEQ ID NO: 67467 - protein, 33 aa, Artificial sequence; identical to SEQ ID NO: 50163
  Variant (2)..(2): xaa in position 2 is Phe or Ile
  Variant (3)..(3): xaa in position 3 is any amino acid
  Variant (4)..(4): xaa in position 4 is Asn or Thr
  Variant (5)..(5): xaa in position 5 is Gln or Arg
  Variant (6)..(6): xaa in position 6 is Leu or Pro
  Variant (9)..(10): xaa in position 9 to 10 is any amino acid
  Variant (11)..(11): xaa in position 11 is any or no amino acid
  Variant (13)..(13): xaa in position 13 is any amino acid
  Variant (14)..(14): xaa in position 14 is any or no amino acid
  Variant (21)..(21): xaa in position 21 is any amino acid
  Variant (25)..(25): xaa in position 25 is any amino acid
  Variant (26)..(26): xaa in position 26 is any or no amino acid
  Variant (28)..(30): xaa in position 28 to 30 is any amino acid
  Variant (31)..(31): xaa in position 31 is Ile or Val
  Variant (32)..(32): xaa in position 32 is Pro or Gln
  Variant (33)..(33): xaa in position 33 is Ala or Glu

SEQ ID NO: 67468 - protein, 37 aa, Artificial sequence; identical to SEQ ID NO: 50164
  Variant (2)..(6): xaa in position 2 to 6 is any amino acid
  Variant (7)..(7): xaa in position 7 is any or no amino acid
  Variant (9)..(9): xaa in position 9 is any amino acid
  Variant (10)..(10): xaa in position 10 is any or no amino acid
  Variant (12)..(12): xaa in position 12 is Asp or Asn
  Variant (14)..(14): xaa in position 14 is Asp or Glu
  Variant (15)..(15): xaa in position 15 is any amino acid
  Variant (16)..(16): xaa in position 16 is Phe or Tyr
  Variant (17)..(17): xaa in position 17 is Ile or Val
  Variant (18)..(18): xaa in position 18 is Asp or Asn
  Variant (20)..(20): xaa in position 20 is Asp or Asn
  Variant (22)..(22): xaa in position 22 is Gln or Thr
  Variant (23)..(23): xaa in position 23 is Asp or Glu
  Variant (24)..(24): xaa in position 24 is Lys or Arg
  Variant (25)..(26): xaa in position 25 to 26 is Leu or Val
  Variant (29)..(29): xaa in position 29 is Asp or Glu
  Variant (30)..(30): xaa in position 30 is any amino acid
  Variant (31)..(31): xaa in position 31 is Gly or Ser
  Variant (32)..(32): xaa in position 32 is Ile or Met
  Variant (34)..(34): xaa in position 34 is Ile or Leu
  Variant (36)..(36): xaa in position 36 is Ala or Thr

SEQ ID NO: 67469 - DNA, 672 bp, Escherichia coli
  CDS (1)..(672)
atgacctggtctcgtcgccagtttctcaccggcgtcggcgtgctggcagccgtcagcggcaccgcagggcgcgtggtggcgaaaacgttgaatatcaatggggtgcgttacggcatggtgcatgacgagtcgttatgcatcggctgtaccgcctgtatggatgcttgtcgggaagtgaacaaggtgccggaaggcgtctcgcgcctgacgattattcgtagcgagccgcagggcgaatttcctgatgtgaaatatcgcttcttccgtaagtcttgccagcactgcgatcatgcgccgtgcgttgacgtctgcccgaccggtgcgtcttttcgtgatgccgctagcgggattgtcgatgttaatcctgatctctgcgtcggttgtcagtactgcatcgccgcctgtccgtaccgcgtgcgctttatccatccggtcacgaagacggcggacaaatgcgatttctgccgtaaaaccaatttgcaggccggtaagctgcccgcgtgtgttgaggcttgcccgacgaaggcgctgacgtttggcaatctggacgatcctaacagtgagatttcgcaactgctgcgccagaagcctacttaccgctacaagctggcgctgggaaccaaaccgaagctgtaccgcgtaccgtttaaatacggggaggtgagccaatga

SEQ ID NO: 67470 - protein, 223 aa, Escherichia coli
MTWSRRQFLTGVGVLAAVSGTAGRVVAKTLNINGVRYGMVHDESLCIGCTACMDACREVNKVPEGVSRLTIIRSEPQGEFPDVKYRFFRKSCQHCDHAPCVDVCPTGASFRDAASGIVDVNPDLCVGCQYCIAACPYRVRFIHPVTKTADKCDFCRKTNLQAGKLPACVEACPTKALTFGNLDDPNSEISQLLRQKPTYRYKLALGTKPKLYRVPFKYGEVSQ

SEQ ID NO: 67471 - DNA, 543 bp, Archaeoglobus fulgidus DSM 4304
  CDS (1)..(543): transl_table=11
atggagaacggcgacagatacgtttacgttgtggatgtttcgaagtgctacggctgcctttcctgcgttgctgcatgtgccgctgaaaacaacgttcccgtcggctacttccgcacgtgggttgagagatatgcaatgaacggaagggtagccttcgtgccaaagatatgtaaccactgtgataatccatcttgcgtccacgcctgtccagtcaatgccacctacaaaaccgaggaaggcttggttctgattgacgacgagatttgtattgggtgtggtgcgtgcatacaggcttgcccctatggagcgaggttcagaaaccccgttaagggcacggctgacaaatgcaccctctgcaaccacagaattccagaaaggctcccggcctgcgtcgagtcgtgcccaacctctgcgagggtttacggcaaaatgagcgataaggcggtgaaggaaatactctccaagaaaaacgctgtggtgcttaaggcttacacgggcaacgagccccatacctattacgtaagccttacgggggtggagtaa

SEQ ID NO: 67472 - protein, 180 aa, Archaeoglobus fulgidus DSM 4304
MENGDRYVYVVDVSKCYGCLSCVAACAAENNVPVGYFRTWVERYAMNGRVAFVPKICNHCDNPSCVHACPVNATYKTEEGLVLIDDEICIGCGACIQACPYGARFRNPVKGTADKCTLCNHRIPERLPACVESCPTSARVYGKMSDKAVKEILSKKNAVVLKAYTGNEPHTYYVSLTGVE

SEQ ID NO: 67473 - DNA, 756 bp, Archaeoglobus fulgidus DSM 4304
  CDS (1)..(756): transl_table=11
atggtgaggtatggaatggttatagacctgaacagatgtataggctgcagaagctgcgctgttatttgcaaaattcacaactctctcccgccgggcacttggtggcacagagttgagaccgtagggagcaaagaacatcaaactccgtcgggagattaccccaatctgactgaactttacctcccagtcccctgcatgcattgcgataatccaccctgcgttaaggtatgccccgtcggtgcaacgtggaaaagagaggacggggttgtgctggtggactttgagaggtgcattggctgcaggtactgcatgactgcctgcccttatggtgtgaggcagtttaactgggaagataaggataaggcggtagagaaaggtttcaaggcggcaggatttgaaggtgagtacgtagaaggatacaggcacggatatcccattgatcacagaaccaaagacggaaggctggtttacacgcccaagagaccaagaggagtggttgaaaagtgcacattctgtgtgcagtatattgacaaaggtctaaagcccgcatgtgttagaggctgtccagggaatgcgaggattttcggagacctcgatgaccctaacagtgagatttcaaaggtgttgagggacggggcacacacgagattgctggaagatttggggacggagccaaaggtgttctaccttttacctatgaaaagggctgaaagaggagaagttaggtattctccagaactggaggtgaaattgtga

SEQ ID NO: 67474 - protein, 251 aa, Archaeoglobus fulgidus DSM 4304
MVRYGMVIDLNRCIGCRSCAVICKIHNSLPPGTWWHRVETVGSKEHQTPSGDYPNLTELYLPVPCMHCDNPPCVKVCPVGATWKREDGVVLVDFERCIGCRYCMTACPYGVRQFNWEDKDKAVEKGFKAAGFEGEYVEGYRHGYPIDHRTKDGRLVYTPKRPRGVVEKCTFCVQYIDKGLKPACVRGCPGNARIFGDLDDPNSEISKVLRDGAHTRLLEDLGTEPKVFYLLPMKRAERGEVRYSPELEVKL

SEQ ID NO: 67475 - DNA, 549 bp, Archaeoglobus fulgidus DSM 4304
  CDS (1)..(549): transl_table=11
atggcaagatacggcatggtcatagaccttgagaagtgtctcggctgtgaggcgtgcgttacggcatgcatcgaggagaacaacgttccctacgagacggggctgagaacccaggttcacagggttgttaccggcaagttccccaacgtctcgacgatgtacatgcacagaatatgccagcactgcgagcatcccggctgtgttcacgtatgccctactggggcgagctacgtaaacgaggatggcatagttctgatagactacgacctctgcatcgggtgcaagtactgcatggtcgcatgcccttacctggcaagatatatccacccagagaggcacacacctgacaagtgcactttctgcgttcacagggttaaggaggggaagcttccggcttgcgttgagacttgtccagctaacgcgcgaatcttcggagacctcgatgacccgaacagcgaggtggcgaagctggtggcggagaacagagctatccctattggcgcggagtacggtacgaagccgaaggtgttttatataagaccgaggtga

SEQ ID NO: 67476 - protein, 182 aa, Archaeoglobus fulgidus DSM 4304
MARYGMVIDLEKCLGCEACVTACIEENNVPYETGLRTQVHRVVTGKFPNVSTMYMHRICQHCEHPGCVHVCPTGASYVNEDGIVLIDYDLCIGCKYCMVACPYLARYIHPERHTPDKCTFCVHRVKEGKLPACVETCPANARIFGDLDDPNSEVAKLVAENRAIPIGAEYGTKPKVFYIRPR

SEQ ID NO: 67477 - DNA, 735 bp, Mesorhizobium loti MAFF303099
  CDS (1)..(735): transl_table=11
atgacctgcctgccaagccaaagcggcaagaaactcggcctggtcatcgacctcgatacctgcgtcggttgccaggcctgcgtcaccgcctgcaaggaatggaacaccggcggccacatggcgccgctgaccgacatcgacccctatggcggccatgtcgacggcgtctggttcaaccgcgtgcacagttatgagcacaccaccgagatgggcgggcgcacggtcaacttcccgcgctcctgcctgcattgcgagacgccggcctgcgtcaccgtctgcccgaccggcgcttcctacaagcgcgcctcggacggcatcgtgctgatcgacgaggacaaatgcatcggctgcaaattgtgcagttgggcctgcccctatggggctcgcgaattcgacaccgatgtcggcgtgatgaagaaatgcacgctctgcgtcgaccgcatctacaacgacaatctggccgaagaagaccgtgtgccggcctgcgtcgcggcctgcccgaccagcgcccggcacttcggtgatctcggcgatccccactccgccgtctcgcaactggtggcggagcgcggcggcgtcgacctgatggcggaactcggctatcacccgaccaacaaatatctgccgccgcgcgcccatacgcagcgtgccgcatcggtgccggcgaaggcgctggagccggtgcgggccgaaggcggcttcctcggctgggtcgatcgcatgctttcgaactga

SEQ ID NO: 67478 - protein, 244 aa, Mesorhizobium loti MAFF303099
MTCLPSQSGKKLGLVIDLDTCVGCQACVTACKEWNTGGHMAPLTDIDPYGGHVDGVWFNRVHSYEHTTEMGGRTVNFPRSCLHCETPACVTVCPTGASYKRASDGIVLIDEDKCIGCKLCSWACPYGAREFDTDVGVMKKCTLCVDRIYNDNLAEEDRVPACVAACPTSARHFGDLGDPHSAVSQLVAERGGVDLMAELGYHPTNKYLPPRAHTQRAASVPAKALEPVRAEGGFLGWVDRMLSN

SEQ ID NO: 67479 - DNA, 501 bp, Pyrococcus abyssi GE5
  CDS (1)..(501): transl_table=11
atgaggttgaggattgaggtgaacgtttcaaggtgtgctggatgcaggtactgcgagctctggtgttcctattcccacgaaggggtcttcagtctttctctgtcgaggataacaatagtcaaggacgacctgctgggcatggacgtgccggtggtctgcaggcagtgcgaccctgccccttgcatggaggcttgccccacgggggccataaagcgcgaaaacggcgtcctggtggtcagtgcggaggagtgtaccgggtgcggggaatgcgtcagagcttgccccttcggggccgtaaagcttcacgtccggactaaggtggccctcatatgtgacctctgcggaggagaccccgtgtgtatcgctaaatgtcccacgaacgcattgagcctgtcaaacctgtcagatattgaaccgaacggttcaggttcaagggaatatgagtacgctctcaggctccacaaaaaccttgcacgggagtggggtataaatgtcagatag

SEQ ID NO: 67480 - protein, 166 aa, Pyrococcus abyssi GE5
MRLRIEVNVSRCAGCRYCELWCSYSHEGVFSLSLSRITIVKDDLLGMDVPVVCRQCDPAPCMEACPTGAIKRENGVLVVSAEECTGCGECVRACPFGAVKLHVRTKVALICDLCGGDPVCIAKCPTNALSLSNLSDIEPNGSGSREYEYALRLHKNLAREWGINVR

SEQ ID NO: 67481 - DNA, 495 bp, Pyrococcus abyssi GE5
  CDS (1)..(495): transl_table=11
atgagcaagaagatattcctcgactataggaggtgcatcgcttgtaaagcttgtgaggtagcctgcgagatggagcacggtgaagccaggataagggttttcgagttccccgatttaacgagcatccccttcaactgtcgtcactgcgagagagcaccttgcctagaggtgtgtccaaccggagccctatacagagattgtgataacgctgtggccttcgaccccctaaagtgcattggctgtttaatgtgtgcagttgcctgtcccttcggagttccaaagctcgatgaggccaataagataatggacaagtgcgacctctgcgccgatagaagagctcaaggcaagcttccagcatgtgtctcagcctgtcccaccgatgcgttgaagtacggggacataaacgagatactctggaagagggaaggtagggtagtgctgaacctaaaggaagccagggataagagtgtaggtaagctagcttacctcctctga

SEQ ID NO: 67482 - protein, 164 aa, Pyrococcus abyssi GE5
MSKKIFLDYRRCIACKACEVACEMEHGEARIRVFEFPDLTSIPFNCRHCERAPCLEVCPTGALYRDCDNAVAFDPLKCIGCLMCAVACPFGVPKLDEANKIMDKCDLCADRRAQGKLPACVSACPTDALKYGDINEILWKREGRVVLNLKEARDKSVGKLAYLL

SEQ ID NO: 67483 - DNA, 753 bp, Aeropyrum pernix K1
  CDS (1)..(753): transl_table=11
gtgatatcaaactgtatattacaatatataggcatgagggaggggtgcctaatgaagcgttccccttcaacagcatgtagcacgtgcaacacgaggagagagttcctgaagaagacggcaaaagcggcagtggcaacgtcatccctcatactgctaggatccgtcacaataaagtctcaggcagccagcgagagggtaagaggcagacgctttgcgatgtttatcgacgtcgacaagtgctacggctgctacgcgtgtgtcgttgcctgtgcccacgagaacaatgtgcctataggagtatataggacttggatagaaaggtatgtgaaggaggacggtactcccgtttatgtccccaaacagtgcaaccactgtgataacccgtcctgtgttgatgtctgtcctgtaaaggcaacctacgtcaacgaggacggcattgtcctcgtggatgacgacctatgcataggctgtggagcatgtatacagaactgcccctacggagctaggttctacaaccccatcaaaggagtcgcggacaagtgtaccttctgcgtccacagaatatactccgacatgcttcccgcctgtgtagaggcctgtccgacgggtgcaagggtgttcggcgagcttgccgacgaggaaagcgaggtctcgaagctcataaggagcaacaatgtccagcagctcaagccatggaccggcaacgacccacagatattctacaaggacttgccccaggaggctaacacctag

SEQ ID NO: 67484 - protein, 250 aa, Aeropyrum pernix K1
MISNCILQYIGMREGCLMKRSPSTACSTCNTRREFLKKTAKAAVATSSLILLGSVTIKSQAASERVRGRRFAMFIDVDKCYGCYACVVACAHENNVPIGVYRTWIERYVKEDGTPVYVPKQCNHCDNPSCVDVCPVKATYVNEDGIVLVDDDLCIGCGACIQNCPYGARFYNPIKGVADKCTFCVHRIYSDMLPACVEACPTGARVFGELADEESEVSKLIRSNNVQQLKPWTGNDPQIFYKDLPQEANT

SEQ ID NO: 67485 - DNA, 513 bp, Aquifex aeolicus VF5
  CDS (1)..(513): transl_table=11
atgaagcgtcctataatgctcatagacctggacaggtgcataggctgcctttcctgtgaagtagcctgcgttcaggagaagggactggagagcctgtatataagacccatgaaagttttcagggtagaaggtatatctgaagaaccgggagctttttactaccccatgaactgctttcactgcgacccagctccctgtgtggttgcatgccctacatccgcaatgagaaagagggagaaggacggtatagtttacgtggaacaaactctgtgcataggctgtaaagcgtgcataatagcctgcccctacggagctataactttcaatcccgctacacaaaaagtagaaaagtgcgattactgctacaaaagggttgataaaggactgcttccctcctgcgttgagaagtgtgtaacgaactgtttatacttcgttgaggtagacgaagttccaaaagaaagacacaaattaaagaggatagacgagaaactttacgaggaaatcttcagctga

SEQ ID NO: 67486 - protein, 170 aa, Aquifex aeolicus VF5
MKRPIMLIDLDRCIGCLSCEVACVQEKGLESLYIRPMKVFRVEGISEEPGAFYYPMNCFHCDPAPCVVACPTSAMRKREKDGIVYVEQTLCIGCKACIIACPYGAITFNPATQKVEKCDYCYKRVDKGLLPSCVEKCVTNCLYFVEVDEVPKERHKLKRIDEKLYEEIFS

SEQ ID NO: 67487 - DNA, 765 bp, Aquifex aeolicus VF5
  CDS (1)..(765): transl_table=11
atgcctcagtacgcgctcgttatagatttgaacacctgtgttggttgtcacgcctgtgcgacgaattgcaaagagtggaacactcaggcggctttcgggcccttatccgattacgacccctacggaagggaagcttcaggagtctggtacaacaggatattcacttacgaaacgggagagttccccgaaacgcaggtctttcaccttccaaaatcatgtctccactgtcaggacgctccctgcgttcccgtttgccctacgggagcaagctacaaaagggaacaggacggaatagttctcgtgaactacgacgactgtataggttgtaagctatgttcctgggcatgtccttacggttgcagggagtttgacgaggcggacaaggtaatgaagaagtgtaccctctgtatagacaggatttacgacgagacacttcctcccgaacacagacagcccgcgtgcgttctcacttgtcccgcgagggcgaggttcttcggagacatagaagacccaaacagcgaggtttacaaactcattaaggaaagaaacggatttgtcctcttccccgatatgggaacgaacccggcaaaccactacctcccgagacaggaaacgaggataaaccttgaagagtttgaaaagcacatactaaagcccgacaacccgctcttcctggaagttatgaggagacaccacacctcttcaaaggctcaagcacaggaaacacctcaagaggaagtaacacattctgaagaattaccataa

SEQ ID NO: 67488 - protein, 254 aa, Aquifex aeolicus VF5
MPQYALVIDLNTCVGCHACATNCKEWNTQAAFGPLSDYDPYGREASGVWYNRIFTYETGEFPETQVFHLPKSCLHCQDAPCVPVCPTGASYKREQDGIVLVNYDDCIGCKLCSWACPYGCREFDEADKVMKKCTLCIDRIYDETLPPEHRQPACVLTCPARARFFGDIEDPNSEVYKLIKERNGFVLFPDMGTNPANHYLPRQETRINLEEFEKHILKPDNPLFLEVMRRHHTSSKAQAQETPQEEVTHSEELP

SEQ ID NO: 67489 - DNA, 459 bp, Thermotoga maritima MSB8
  CDS (1)..(459): transl_table=11
gtggtgatagcggtgagaagaatacttatcagggaagagtactgcatgggatgtaagctgtgtgagataaactgcgtcgctgcacaggtgggaacgggaaacctcataaaggtgtacagatacgtcccggaacttcccgaaccaaacgtgatagtggaagagcacgattacgtcactttcgcacttcagtgcagaaactgtgatgatccatcctgtctgaaggcctgtatgacgggcgcgatgcacagagatccaaaaacaggagccatcagagtgaatcaagaaaagtgtgtaggatgctggatgtgtgtgatggcctgtcccttcggtgtgataagaaggaacacgaaagaaaagaaagttgcctcaaagtgtgatctctgtgccgatagaggaactcctggctgtgtcgaaggctgtccaaacgaagcgctcgttctggttgaggtgagagaatga

SEQ ID NO: 67490 - protein, 152 aa, Thermotoga maritima MSB8
MVIAVRRILIREEYCMGCKLCEINCVAAQVGTGNLIKVYRYVPELPEPNVIVEEHDYVTFALQCRNCDDPSCLKACMTGAMHRDPKTGAIRVNQEKCVGCWMCVMACPFGVIRRNTKEKKVASKCDLCADRGTPGCVEGCPNEALVLVEVRE

SEQ ID NO: 67491 - DNA, 681 bp, Pasteurella multocida subsp. multocida str. Pm70
  CDS (1)..(681): transl_table=11
atgacagcttgctcacgccgaaactttgtttccggcatgggagcgttaatcctcatgacgggaacatcaataaaatcagtgggacagaacgcaagcgaggcgaaaaaaacaattcgttatgcgatgttacacgatgaaaccgcttgtatcggttgtactgcttgtatggatgcatgtcgtgaaaccaaccaggtcccagaaggggtttctcgtttggagattatccgtagtgagccttatggtgagtttccaaacgcagaatatgaatttttccgccattcttgtcagcattgtcacaatgcaccttgtgtgcatgtttgtccaacaggggcgtcttttgttgacaaggaaacaggtattgtcgatgtgcacaaagatctttgtgtcggttgccaatattgtattgctgtctgtccatatcgtgttcgatttattcaccccgtgtataaatcagccgataaatgtaacttctgtcgcgataccaatttagctaacggcaaattaccggcttgtgtggaatcttgcccaaccaatgcgttgacctttggggatctgaatgatcctgacagtgccatttcacaaaaagtcaaatcgcagcaagtgtatcggacgaaggtggaattaggcaccgatccacagctgtatcatgtaccagctaaaagaggggagctaagacgatga

SEQ ID NO: 67492 - protein, 226 aa, Pasteurella multocida subsp. multocida str. Pm70
MTACSRRNFVSGMGALILMTGTSIKSVGQNASEAKKTIRYAMLHDETACIGCTACMDACRETNQVPEGVSRLEIIRSEPYGEFPNAEYEFFRHSCQHCHNAPCVHVCPTGASFVDKETGIVDVHKDLCVGCQYCIAVCPYRVRFIHPVYKSADKCNFCRDTNLANGKLPACVESCPTNALTFGDLNDPDSAISQKVKSQQVYRTKVELGTDPQLYHVPAKRGELRR

SEQ ID NO: 67493 - DNA, 738 bp, Pasteurella multocida subsp. multocida str. Pm70
  CDS (1)..(738): transl_table=11
atgaaaatgagtaagcgtatttttctcaaaaatttatcattattaagtgtggggcaagcttttattccattgagtcaagcagaaaatgcttttcaacctgctagacgagagggaagtgaagcacatcgttatgccatgttggtggatttacgtcgttgtatcggttgtcaatcttgtactgtaagttgtgggattgagaatgcgacgccgattggcgaatttagaaccactgtgcgtcaatacgaagtcactgatgaaaaacaagtggtcaataatgtgttattaccacgtttatgtaatcactgtgataacccgccttgtgtaccagtttgtcctgtgcaagctacctatcaacgtaaagatggtatcgtggtggttgataatgaacgttgtataggttgtgcgtattgtgtacaagcttgtccttatgatgcacgttttattaacgaagaaacaaaaacagcagataaatgcacgttttgcacacatcgactggaggttggtttattacctgcttgtgtggaaagctgtgtgggtggcgcgcggattatcggcgatttacgcgatccaaatagtacgatcagcaaaatggtagaagaatttaaagcggaactcaaagtcttaaaaccaaattcgggtacagtgccgcatgtattctatttaggattagatgacgcctttgttaatcaagtgcaggggcaatctatgttatggcaaagtgcggagggaagattatga

SEQ ID NO: 67494 - protein, 245 aa, Pasteurella multocida subsp. multocida str. Pm70
MKMSKRIFLKNLSLLSVGQAFIPLSQAENAFQPARREGSEAHRYAMLVDLRRCIGCQSCTVSCGIENATPIGEFRTTVRQYEVTDEKQVVNNVLLPRLCNHCDNPPCVPVCPVQATYQRKDGIVVVDNERCIGCAYCVQACPYDARFINEETKTADKCTFCTHRLEVGLLPACVESCVGGARIIGDLRDPNSTISKMVEEFKAELKVLKPNSGTVPHVFYLGLDDAFVNQVQGQSMLWQSAEGRL

SEQ ID NO: 67495 - DNA, 621 bp, Pasteurella multocida subsp. multocida str. Pm70
  CDS (1)..(621): transl_table=11
atgagtgttcagtatggcttttattttgactcagatcgttgcaccggctgtaagacttgtgaattagcctgcaaagactataaagacctcgataccaacgtgaattttcgtcgcatttatgaatatgcaggtggtgactggcaacagcaggcaaatggatgttggcaacataatgtttttgcttattatttatcgatttcctgtaatcactgcgacaatcctgcttgtgtgtcagtttgtccaacgggtgcaatgcataaaacagaagatggctttgtcatcgtgaatgaagcaatctgtattggttgtcgttattgtcatatggcttgtccttatgatgcaccacaatatgatgcaatgaaagggcatatgactaaatgcgatggctgccattcacgtatattggaagggaaaaaaccgatttgtgttgatgcgtgtccattacgggctctagattttgcgcccattgatgaactacgcaaaacctatggtgatttagcggcgattgcgccattaccctcgccagaacatactgcgccaaatttggtgattaagaccaataaaaatgcgcgtccaacgggggatacaaccggttttttagcgaatccaagggaggtgtaa

SEQ ID NO: 67496 - protein, 206 aa, Pasteurella multocida subsp. multocida str. Pm70
MSVQYGFYFDSDRCTGCKTCELACKDYKDLDTNVNFRRIYEYAGGDWQQQANGCWQHNVFAYYLSISCNHCDNPACVSVCPTGAMHKTEDGFVIVNEAICIGCRYCHMACPYDAPQYDAMKGHMTKCDGCHSRILEGKKPICVDACPLRALDFAPIDELRKTYGDLAAIAPLPSPEHTAPNLVIKTNKNARPTGDTTGFLANPREV

SEQ ID NO: 67497 - DNA, 930 bp, Pseudomonas aeruginosa PAO1
  CDS (1)..(930): transl_table=11
atgagtagtcaggacatccacgcccgctccgcgaccaccacgccgatgccctcggtgcggaaccaggaggaagtggcgaaactgatcgacgtgtccaagtgcatcggttgcaaggcctgccaggtcgcctgctcggaatggaacgagctgcgcgacgaggtcggccacaaccacggcacctacgacaaccccatggacctgacggccgactcgtggacggtgatgcgtttcaccgagcacgagaacgaggccggcaacctcgagtggctgatccgcaaggatggctgcatgcactgcgccgagccgggctgcctgaaggcctgcccgagcccgggagcgatcgtgaagtacgccaacggcatcgtcgacttcaaccaggacaagtgcatcggttgcggctactgcatcaccggttgcccgttcgacatcccacggatctcgcagaaggaccacaaggcctacaagtgcagcctgtgttccgaccgcgtctcggtgggcatggagccggcctgcgtgaagacctgcccgaccggcgccatcgtcttcggcagcaaggaggacatgaaggaacacgccgccgaacgcatcgtcgacctgaagagccgcggttacgagaacgccggcctgtacgaccccgaaggggtgggcggcacccacgtgatgtacgtgctgcaccacgccgacaagccgtcgctctatgccggcctggccgaccagccgagcgtcagcccgctggtcagcctgtggaagggcgtgaccaagccgctggcgctgctggccatgggcgccacggtgctcgccgggttcttccactatgtgcgcgtcggtcccaaccgcgcggacgacgaggaagaccacgggcaagccgaggcaccggtgcaccaggtcgatccgtcggtacacacctttgacccgcacgagcgtcgttga

SEQ ID NO: 67498 - protein, 309 aa, Pseudomonas aeruginosa PAO1
MSSQDIHARSATTTPMPSVRNQEEVAKLIDVSKCIGCKACQVACSEWNELRDEVGHNHGTYDNPMDLTADSWTVMRFTEHENEAGNLEWLIRKDGCMHCAEPGCLKACPSPGAIVKYANGIVDFNQDKCIGCGYCITGCPFDIPRISQKDHKAYKCSLCSDRVSVGMEPACVKTCPTGAIVFGSKEDMKEHAAERIVDLKSRGYENAGLYDPEGVGGTHVMYVLHHADKPSLYAGLADQPSVSPLVSLWKGVTKPLALLAMGATVLAGFFHYVRVGPNRADDEEDHGQAEAPVHQVDPSVHTFDPHERR

SEQ ID NO: 67499 - DNA, 789 bp, Halobacterium sp. NRC-1
  CDS (1)..(789): transl_table=11
atgaccaactacggcctcgtcatcgatcaggaacgatgcatcggctgccagtcgtgttcgctcacgtgcaaacaggagaacaacgtcccgatggggcagttctggaaccgcgtgctcacgcagggcggcgaccacgttgacaccccgtcgggcgactaccccgagggcggcgacggtggcactctcgaaatgacctaccagccgacggcgtgccaacactgcgagaacgcgccctgtgtgaaggtctgcccggtgaacgccacgtacacccgggacgacggcatcgtggagatcgattacgacaaatgcatggggtgtcggtactgcatggcggcctgcccgtacaacgcccgtgtgttcaactgggacgagcccgagcaccgccccgaagacggcacgggagacgtggccgaacgaccacagggcgtcgtcgagaaatgcacgttctgcagccaccgcgtcgaggacggcctcgaccccgcctgcgtcgtgaactgtccggcggacgcccgcatcttcggtgacctggacgacgacgacagcaccgtctcgaagtacatcgcggagtacgacacccaccaactcctggacgagaagggaacggacccgagcacgtactacatcaacggcgagatgtcgcccggacgcccctggaagagcaagaagctcgaaagcgaactcgacgacgacgaggcagcgaaagcggcgcgacggcgcagcggcagcgtcgaaaacggatacgacgttaccccacacgtgccggcggagaccgcgggaggtgacgactga

SEQ ID NO: 67500 - protein, 262 aa, Halobacterium sp. NRC-1
MTNYGLVIDQERCIGCQSCSLTCKQENNVPMGQFWNRVLTQGGDHVDTPSGDYPEGGDGGTLEMTYQPTACQHCENAPCVKVCPVNATYTRDDGIVEIDYDKCMGCRYCMAACPYNARVFNWDEPEHRPEDGTGDVAERPQGVVEKCTFCSHRVEDGLDPACVVNCPADARIFGDLDDDDSTVSKYIAEYDTHQLLDEKGTDPSTYYINGEMSPGRPWKSKKLESELDDDEAAKAARRRSGSVENGYDVTPHVPAETAGGDD

SEQ ID NO: 67501 - DNA, 987 bp, Escherichia coli O157:H7 EDL933
  CDS (1)..(987): n means a or g or c or t/u, s means g or c
gtgaacagacgtaattttattaaagcagcctcctgcggggcattgctgacgggcgcgctgccgtctgtcagtcatgcggctgctgaaaaccgcccgccaattccgggatcgctggggatgttgtacgactcgaccttgtgcgtaggctgccaggcttgcgtcaccaagtgtcaggatatcaacttccctgaacgtaacccgcaaggggaacagacctggtcgaacaacgacaaactgtcgccgtataccaataacatcattcaagtgtggaccagcggcacaggggtcaacaaagaccaggaggagaasggctacgcgtacattaagaaacagtgtatgcactgcgtcgatccgaactgtgtctctgtgtgcccggtctctgcactgaaaaaagatccgaaaaccggcattgtccattacgacaaagacgtgtgcaccggttgccgttactgcatggtcgcctgtccgtacaacgtgccgaagtacgactacaacaacccgtttggtgcgctgcataagtgcgagctgtgcaaccagaaaggtgtggaacgtctcgataaaggcggtctgcctggctgcgtagaagtgtgcccggcgggcgcggtgatttttggtacgcgtgaagagctgatggcggaggcgaaaaaacgtctggcgctgaagcctggcagcgaataccactatccgcgtcagacgctgaaatctggcgacacttacctgcatacggtgccgaaatattatccgcatctgtacggcgagaaagagggcggcggtactcaggttctggtactgacgggtgtgccttatgaaaatctcgacctgccgaaactggacgatctttctaccggtgcgcgttccgaaaatattcaacacaccctgtataaaggcatgatgctaccactggctgtgctggcgggcttgaccgtgctggttcgtcgcaacaccaaaaacgaccatcacgacggaggagacgatcatgagtcatga

SEQ ID NO: 67502 - protein, 328 aa, Escherichia coli O157:H7 EDL933
  Xaa in position 103 is unknown
MNRRNFIKAASCGALLTGALPSVSHAAAENRPPIPGSLGMLYDSTLCVGCQACVTKCQDINFPERNPQGEQTWSNNDKLSPYTNNIIQVWTSGTGVNKDQEEXGYAYIKKQCMHCVDPNCVSVCPVSALKKDPKTGIVHYDKDVCTGCRYCMVACPYNVPKYDYNNPFGALHKCELCNQKGVERLDKGGLPGCVEVCPAGAVIFGTREELMAEAKKRLALKPGSEYHYPRQTLKSGDTYLHTVPKYYPHLYGEKEGGGTQVLVLTGVPYENLDLPKLDDLSTGARSENIQHTLYKGMMLPLAVLAGLTVLVRRNTKNDHHDGGDDHES

SEQ ID NO: 67503 - DNA, 903 bp, Escherichia coli O157:H7 EDL933
  CDS (1)..(903): n means a or g or c or t/u, s means g or c
atggcttatcaatctcaagatatcattcgtcgttccgcgactaacggtctgacccccgcgcctcaggcgcgggacttccaggaagaagtggcgaaactcatcgacgtcaccacctgtatcggctgtaaagcctgtcaggtggcgtgttcagagtggaacgacattcgcgataccgtcggcaataacattggggtgtacgacaaccccaatgatttaagcgccaaatcgtggacggtgatgcgcttctcggaagtggagcagaacgacaaactggaatggctgatccgcaaagacggctgtatgcactgttccgatccaggctgtctgaaagcgtgcccggcggaaggtgcaattattcagtatgccaacggtatcgtcgacttccagtccgagcagtgcattggctgcggttattgcattgcgggctgtccgttcgacattccgcgcctcaacccggaagacaaccgcgtctacaaatgtacgctgtgcgttgaccgcgtggtggttgggcaagaaccagcctgcgtgaagacctgcccaacgggcgcgattcacttcggtacgaaagagtcgatgaaaacgctggcgagcgagcgcgtggcggagctgaaaacccgcggttacgacaatgcgggcctgtacgatccggcaggcgtcggtggtacacacgttatgtacgtgctgcaccatgctgacaagccaaatctgtatcatggcttgccggagaacccggaaatcagcgaaaccgtgaaattctggaaaggcatctggaaaccgytcgcagctgttggctttgcggctaccttcgcagccagtatcttccactacgtgggtgtcggtccgaaccatgcggatgaggaagagaataatctgcacgaagagaaagacgaggagcgcaaatga

SEQ ID NO: 67504 - protein, 300 aa, Escherichia coli O157:H7 EDL933
  Xaa in position 260 is unknown
MAYQSQDIIRRSATNGLTPAPQARDFQEEVAKLIDVTTCIGCKACQVACSEWNDIRDTVGNNIGVYDNPNDLSAKSWTVMRFSEVEQNDKLEWLIRKDGCMHCSDPGCLKACPAEGAIIQYANGIVDFQSEQCIGCGYCIAGCPFDIPRLNPEDNRVYKCTLCVDRVVVGQEPACVKTCPTGAIHFGTKESMKTLASERVAELKTRGYDNAGLYDPAGVGGTHVMYVLHHADKPNLYHGLPENPEISETVKFWKGIWKPXAAVGFAATFAASIFHYVGVGPNHADEEENNLHEEKDEERK

SEQ ID NO: 67505 - DNA, 618 bp, Escherichia coli O157:H7
  CDS (1)..(618): transl_table=11
atgacaacccagtatggattttttattgattccagccgttgcaccggttgcaaaacctgcgagctggcttgtaaagactacaaagatttgatgccagaagtcagcttccgccgcatttatgaatatgctggtggcgactggcaggaagataacggtgtctggcaccagaacgtgtttgcctactatctgtcgatttcgtgcaaccactgcgaagatccggcttgtactaaagtctgcccgagcggtgcgatgcataaacgtgaagatggttttgttgtggtcgatgaagatgtgtgcattggctgccgctactgccatatggcttgcccgtatggcgcaccgcaatataacgaaacgaaaggccatatgaccaaatgcgatggttgttatgaccgtgttgcggagggtaaaaagccgatctgtgttgaatcttgtccgctgcgggcgctggatttcggccctatcgacgagctgcgtaaaaaacatggcgatctggcggccgttgcgccgttgccgcgagctcactttaccaaaccgaatattgtgatcaaacccaatgccaatagccgcccgaccggggataccactggctatctggcaaacccgaaggaggtgtga

SEQ ID NO: 67506 - protein, 205 aa, Escherichia coli O157:H7
MTTQYGFFIDSSRCTGCKTCELACKDYKDLMPEVSFRRIYEYAGGDWQEDNGVWHQNVFAYYLSISCNHCEDPACTKVCPSGAMHKREDGFVVVDEDVCIGCRYCHMACPYGAPQYNETKGHMTKCDGCYDRVAEGKKPICVESCPLRALDFGPIDELRKKHGDLAAVAPLPRAHFTKPNIVIKPNANSRPTGDTTGYLANPKEV

SEQ ID NO: 67507 - DNA, 885 bp, Escherichia coli O157:H7
  CDS (1)..(885): transl_table=11
atggctatggaaacgcaggacattatcaaaaggtccgcaactaactccatcacgccgccttctcaggtgcgtgattacaaagcagaagtcgcaaaacttatcgacgtttccacctgtatcggctgtaaagcctgtcaggtggcgtgttcggagtggaacgacatccgtgatgaagtggggcactgcgtcggggtttacgataaccccgccgatctgagcgccaagtcctggacggtgatgcgctttagcgaaaccgaacagagcggcaagctggagtggctgatccgtaaagatggctgtatgcactgtgaagatccgggctgcctgaaggcgtgcccgtctgccggtgcaatcattcagtacgctaacgggattgtcgatttccagtcggaaaactgcatcggctgtggttactgcattgccgggtgtccgtttaatattccgcgcctcaacaaagaggataaccgggtatataaatgcacgctctgcgtcgatcgcgtcagcgtcggccaggaaccggcttgtgtgaaaacctgtccgaccggggctatccacttcggcaccaagaaggagatgctggagctggcggaacagcgcgtggcgaaactgaaagcgcgtggttacgaacatgctggcgtctacaacccggaaggggtcggtggtacgcacgttatgtacgtgctgcatcacgccgatcagccggagctgtatcacggtctgccgaaagatccgaagatcgacacctcggtaagcctgtggaaaggcgcgttgaaaccgctggcagcggctggctttattgccacttttgcagggttgattttccactacatcggtattggcccgaataaggaagtggacgatgacgaggaggatcatcatgagtaa

SEQ ID NO: 67508 - protein, 294 aa, Escherichia coli O157:H7
MAMETQDIIKRSATNSITPPSQVRDYKAEVAKLIDVSTCIGCKACQVACSEWNDIRDEVGHCVGVYDNPADLSAKSWTVMRFSETEQSGKLEWLIRKDGCMHCEDPGCLKACPSAGAIIQYANGIVDFQSENCIGCGYCIAGCPFNIPRLNKEDNRVYKCTLCVDRVSVGQEPACVKTCPTGAIHFGTKKEMLELAEQRVAKLKARGYEHAGVYNPEGVGGTHVMYVLHHADQPELYHGLPKDPKIDTSVSLWKGALKPLAAAGFIATFAGLIFHYIGIGPNKEVDDDEEDHHE

SEQ ID NO: 67509 - DNA, 720 bp, Escherichia coli O157:H7
  CDS (1)..(720): transl_table=11
atgtcatggatagggtggacagttgcagccactgcattaggggataatcagatgtccttcactcgacgcaaatttgttctggggatgggaacagtaatcttttttactggttctgcgtcttctctgttagcgaacacgaggcaagaaaaggaagttcggtatgccatgattcatgacgagtcacggtgcaatggctgtaatatttgcgcccgcgcatgccgtaaaactaaccacgcccccgctcagggaagccgtttatcgatagcacacattccagtcaccgataacgacaacgaaacgcagtatcacttttttcgccagtcatgtcagcactgcgaagatgctccgtgcatcgacgtatgcccgacaggggcgtcgtggcgtgatgagcaggggatcgtgcgggtagaaaaatcgcagtgcatcggctgcagttattgcattggcgcttgtccgtaccaggttcgctaccttaaccctgtcactaaagtggcagataaatgtgatttctgcgctgagtcccgactggcaaaaggctttccgcccatttgcgtcagcgcttgcccggaacacgcattgatctttggtcgcgaagatagccctgaaattcaggcgtggttgcaggataataaatactatcaatatcagctacctggtgccgggaaaccgcatctgtatcgccggttcggtcaacatttgattaaaaaggaaaatgtatga

SEQ ID NO: 67510 - protein, 239 aa, Escherichia coli O157:H7
MSWIGWTVAATALGDNQMSFTRRKFVLGMGTVIFFTGSASSLLANTRQEKEVRYAMIHDESRCNGCNICARACRKTNHAPAQGSRLSIAHIPVTDNDNETQYHFFRQSCQHCEDAPCIDVCPTGASWRDEQGIVRVEKSQCIGCSYCIGACPYQVRYLNPVTKVADKCDFCAESRLAKGFPPICVSACPEHALIFGREDSPEIQAWLQDNKYYQYQLPGAGKPHLYRRFGQHLIKKENV

SEQ ID NO: 67511 - DNA, 630 bp, Escherichia coli O157:H7
  CDS (1)..(630): transl_table=11
atgagccaatttaaagaatttgcatctgtcagcgacaaacaattagggttctttattgactcttcgcgttgttcgggctgtaaagcgtgtcaggtggcctgtaaagacaaaaacaaccttgaggttgggcgacgttttcgccgcgtgtatgaagtgaacggaggtggcttcatcgccactggagagggcggtgtgagtcataatgtctttgcttataccctttctgtttcctgtaaccattgcgcggatccgatctgtaccaaaaattgcccgacgatggcgatgcataagcgtcccggagacggtattgtgcgcgtgaatactgataagtgcgtcggttgcggttactgcgcctggtcctgtccttacggcgcaccacaaatgaatgagcagaccgggcagatgtcgaaatgcgatttctgtattgatctgcaagctaaaggagaacaacccatttgcgtggcaacgtgcccgttgggggcgattaagttcggccctattgatgagttgcgtgaaaagtatggcgatgtcagtgatgtgaaaggtttacctgattcgtcgattacgcagccaaatctggtgattaaaccgcatcagggcgcggaaaaggaggcgtcacatcatgcatga

SEQ ID NO: 67512 - protein, 209 aa, Escherichia coli O157:H7
MSQFKEFASVSDKQLGFFIDSSRCSGCKACQVACKDKNNLEVGRRFRRVYEVNGGGFIATGEGGVSHNVFAYTLSVSCNHCADPICTKNCPTMAMHKRPGDGIVRVNTDKCVGCGYCAWSCPYGAPQMNEQTGQMSKCDFCIDLQAKGEQPICVATCPLGAIKFGPIDELREKYGDVSDVKGLPDSSITQPNLVIKPHQGAEKEASHHA

SEQ ID NO: 67513 - DNA, 687 bp, Sulfolobus solfataricus P2
  CDS (1)..(687): transl_table=11
atgtccacacaagtttcaaacccatatatacaatttgggaatactcaaccttgtaaacactggggattcgtggttaaggtagaccaatgtctaggctgtgatgcttgtgttgctgcgtgtacaatagagaatcaaacgccattctggcgaggtctatttagaactcatgttgaagatctagaattaggagaatatcccaacactcagagagtcttcgtacctagattgtgtatgcaatgtgaaaacccgccatgttattatgtatgtccaactggcgctacccaaattgttgctggaggtattgtagtggttgacgagtataaatgtatgggatgtctttactgtgttgaggcatgtccatatggtgctagatacttctacacttacgaggatattgagaagtccaaggagtattttggattgaattcaattcacgtggttcctcacgtagataaatgtactttctgctacggtacagccccagaaggcacttatactcctgcatgtgtaagaacttgtccgggtcatgccagagtatttgggtgtcttgatgatcctaatagtgaggttagtatattagttaatactgggcaagcagtagtgttgaatccggaattaaacgttcaacctaaagttttttacgtgtttaataggcagttgggtaggggaggaggtggtaactcatga

SEQ ID NO: 67514 - protein, 228 aa, Sulfolobus solfataricus P2
MSTQVSNPYIQFGNTQPCKHWGFVVKVDQCLGCDACVAACTIENQTPFWRGLFRTHVEDLELGEYPNTQRVFVPRLCMQCENPPCYYVCPTGATQIVAGGIVVVDEYKCMGCLYCVEACPYGARYFYTYEDIEKSKEYFGLNSIHVVPHVDKCTFCYGTAPEGTYTPACVRTCPGHARVFGCLDDPNSEVSILVNTGQAVVLNPELNVQPKVFYVFNRQLGRGGGGNS

SEQ ID NO: 67515 - DNA, 882 bp, Sulfolobus solfataricus P2
  CDS (1)..(882): transl_table=11
atgggttcgcaacagaaccctcctcttaaggtgataaatatgtcttctccccaaaatacaaccacaccacaaattaaattagatataagacaaggtggtgttcaacacgctccaccgtttagcttaaaggcaaactacgccataattactgatttaaacaagtgtttcggctgtggaggctgtcagatgtcatgcaaggaatggaacacatcggggatgtttggaccattaccagacctaaatccatacggagaattagacgttatgttctggctaagagtactctatgtagaagtaggaacatatccccagacaaaggtctacaatataccaataaactgcttccactgtataaacgcaccttgtacagaagtttgcccagtaggtgctacattcaagagaacagaggatggtatagtattagtcgactataacgaatgcatagggactaagtactgtatttacgcatgcccatacgggaatagattcttcgattacgtagaaggagttacaaagaagtgcacccattgtttcgataggatttatgatcctacattacccccagaggagaggataccggcgtgtatccacggatgtatggttcaagctagaatttgggctaatatcttagacccaactgaccctggtacaattttattctatgataaaggaggatttgtaatgggaccagaaactggagcacagccagcaagtggttatttgccatggcgtagcaaatacgctgaaagtgatgtccaattgttaagtgaagctgagtactacaacgtatggactgctaatggtgtagtgcaactcggcgcccaggggaacaactctacctatacagaagggaatggatcaaattccagctcaaattcataa

SEQ ID NO: 67516 - protein, 293 aa, Sulfolobus solfataricus P2
MGSQQNPPLKVINMSSPQNTTTPQIKLDIRQGGVQHAPPFSLKANYAIITDLNKCFGCGGCQMSCKEWNTSGMFGPLPDLNPYGELDVMFWLRVLYVEVGTYPQTKVYNIPINCFHCINAPCTEVCPVGATFKRTEDGIVLVDYNECIGTKYCIYACPYGNRFFDYVEGVTKKCTHCFDRIYDPTLPPEERIPACIHGCMVQARIWANILDPTDPGTILFYDKGGFVMGPETGAQPASGYLPWRSKYAESDVQLLSEAEYYNVWTANGVVQLGAQGNNSTYTEGNGSNSSSNS

SEQ ID NO: 67517 - DNA, 1176 bp, Sulfolobus tokodaii str. 7
  CDS (1)..(1176): transl_table=11
atggagagaagtctaggatttatattcgatcctaacaaatgcatagtctgtaatgcttgcgttaatgcttgtaatgaacattatggaaacctgaactggagatcccttttagtgtttcaaaatgaggtaaaaattggtatttctattgcttgtaatcattgtgaaaaccccctttgtatgaaagtttgcccagctaatgctatacataaagatgatatgggaatagtttacataaatggtaatgaatgtataggttgtggttattgccaatgggcttgtccttatgaagaacctaagtttaaccatgaaggaataatgacaaagtgtgatttatgtaggcaaaggattttgaaaaaagaaggattgccttattgtgttgaatcatgtcctactggtgcactatctttcggttggatagataaacctaaatatgatgcaccttacctagcaccttatgatattacaaaacctaagcttgaaataaagaagcccaaagaggaagagatcaaggcttcaccgctaaagagaagaagagaggaaagatatattgaacttttactctttacaattctttctgaactctctctagggattcttataactaggattccgttttattccttaatctctctcattcttttagctattggtttagttccgtcgattttccacgttaatagaagagaaagggcttatagggttataatgaatttaaaatcttcttggcttagtagggaagtattctttggcggtttatcattcctttcattactactggaactcgtaacacctagtttatactacttatcagttatactaatttccttatctgtattttcgtccattatgatatatatgctaaagaccacaccctcttggtataatcctaatacaccgttatccttcataggtactatatttaccgtattcccattaggattttacttcactcactctctgctattcttactaattcctttagtttttggagttattgaaataagtcttgcaaggaaagagaaaatactacatataccgtatttgatactcttggtaatttctatctttatcccgttaataagtattctagcctcattagttggtatttcatcagaaatcatagcaagacgtaatttctttgaaaagattacatactacggtctaccaagtccataa

SEQ ID NO: 67518 - protein, 391 aa, Sulfolobus tokodaii str. 7
MERSLGFIFDPNKCIVCNACVNACNEHYGNLNWRSLLVFQNEVKIGISIACNHCENPLCMKVCPANAIHKDDMGIVYINGNECIGCGYCQWACPYEEPKFNHEGIMTKCDLCRQRILKKEGLPYCVESCPTGALSFGWIDKPKYDAPYLAPYDITKPKLEIKKPKEEEIKASPLKRRREERYIELLLFTILSELSLGILITRIPFYSLISLILLAIGLVPSIFHVNRRERAYRVIMNLKSSWLSREVFFGGLSFLSLLLELVTPSLYYLSVILISLSVFSSIMIYMLKTTPSWYNPNTPLSFIGTIFTVFPLGFYFTHSLLFLLIPLVFGVIEISLARKEKILHIPYLILLVISIFIPLISILASLVGISSEIIARRNFFEKITYYGLPSP

SEQ ID NO: 67519 - DNA, 813 bp, Sulfolobus tokodaii str. 7
  CDS (1)..(813): transl_table=11
atgtcctctataactctaaatccgaaagaaggtggaattcaaaaatcccttcctttcacgccaaagaaaaactatgctataataactgacttaaacaagtgtttcggctgtgctggctgtcaaatgtcatgtaaagaatggaacacctctggaatgtttggaccgttaccagatctaaatccatatggagaattagatgttatgttctggctaagagtgctttatgttgaagttggtaactatccgcaaactaaagtttacaacatcccaataaactgtttccactgtatgaatgccccttgtgtaccagtatgtccagttggtgctacgtttaagagagaagaagacggaatagtattagtagattataatgagtgcataggaactaaatactgtatttatgcatgtccttacggtaatagattcttcgattatgttgaaggtgttacaaagaagtgtactcattgttttgatagaatttatgatccaacactaccgccagaagaaagaatcccagcttgtatacacggctgcatggttcaagcgagaatatgggctgatagattagatcccactgaccctggtaatatactgtttatagataaaggtggatttgttttaggtccagaaaccggtgctgatccagctagcggttatttaccgtggcgtagtgcatacgccgctgataacgatgttgaattacttagcgagtcagaatattataacgtatggacttcaaatggtgtagttattttaggatctcaaggaaataactctacctacacagaacaaaacggtaattctacaagttaa

SEQ ID NO: 67520 - protein, 270 aa, Sulfolobus tokodaii str. 7
MSSITLNPKEGGIQKSLPFTPKKNYAIITDLNKCFGCAGCQMSCKEWNTSGMFGPLPDLNPYGELDVMFWLRVLYVEVGNYPQTKVYNIPINCFHCMNAPCVPVCPVGATFKREEDGIVLVDYNECIGTKYCIYACPYGNRFFDYVEGVTKKCTHCFDRIYDPTLPPEERIPACIHGCMVQARIWADRLDPTDPGNILFIDKGGFVLGPETGADPASGYLPWRSAYAADNDVELLSESEYYNVWTSNGVVILGSQGNNSTYTEQNGNSTS

SEQ ID NO: 67521 - DNA, 618 bp, Escherichia coli K12
  CDS (1)..(618): transl_table=11
atgaccacacaatatggattttttatcgattccagccgctgtactggctgtaaaacctgcgaactggcgtgcaaagattttaaagatcttggcccggaagtcagtttccgccgtatttatgaatacgctggcggcgactggcaggaagataatggcgtctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcgccacagtacaatgctgaaaaagggcacatgacgaagtgcgatggttgttattcgcgcgtcgccgaggggaaacaacccatatgtgtcgaatcctgcccgctgcgtgcacttgagttcggtccaattgaagagctgcgccagaagcacggcactcttgctgccgtcgcgccactgccgcgcgcgcatttcacaaaacccaatatcgttatcaaacctaacgccaacagccgcccgaccggcgataccactggttatctggctaatccggaggaagtgtaa

SEQ ID NO: 67522 - protein, 205 aa, Escherichia coli K12
MTTQYGFFIDSSRCTGCKTCELACKDFKDLGPEVSFRRIYEYAGGDWQEDNGVWHQNVFAYYLSISCNHCDDPACTKVCPSGAMHKREDGFVVVDEDVCIGCRYCHMACPYGAPQYNAEKGHMTKCDGCYSRVAEGKQPICVESCPLRALEFGPIEELRQKHGTLAAVAPLPRAHFTKPNIVIKPNANSRPTGDTTGYLANPEEV

SEQ ID NO: 67523 - DNA, 720 bp, Escherichia coli K12
  CDS (1)..(720): transl_table=11
atgtcatggatagggtggacagttgcagccactgcattaggggataatcagatgtccttcactcgacgcaaatttgttctggggatgggaacagtaatcttttttactggttctgcgtcttctctgttagcgaacacgaggcaagaaaaggaagttcggtatgccatgattcatgacgagtcacggtgcaatggctgtaatatttgcgcccgcgcatgccgtaaaactaaccacgtccccgctcagggaagccgtttatcgatagcacacattccagtcaccgataacgacaacgaaacgcagtatcacttttttcgccagtcatgtcagcactgcgaagatgctccgtgcatcgacgtttgcccgacgggggcgtcgtggcgtgatgagcaggggatcgtgcgggtagaaaaatcgcagtgcatcggctgcagttattgcattggcgcttgtccgtaccaggttcgctaccttaaccctgtcactaaagtggcagataaatgtgatttctgcgctgagtcccgactggcaaaaggctttccgcccatttgcgtcagcgcctgcccggaacacgcattgatctttggtcgcgaagatagcccagaaattcaggcgtggttgcagcaaaataaatactatcaatatcagctacctggtgccgggaaaccgcatctgtatcgccggttcggtcaacatttgattaaaaaggaaaatgtatga

SEQ ID NO: 67524 - protein, 239 aa, Escherichia coli K12
MSWIGWTVAATALGDNQMSFTRRKFVLGMGTVIFFTGSASSLLANTRQEKEVRYAMIHDESRCNGCNICARACRKTNHVPAQGSRLSIAHIPVTDNDNETQYHFFRQSCQHCEDAPCIDVCPTGASWRDEQGIVRVEKSQCIGCSYCIGACPYQVRYLNPVTKVADKCDFCAESRLAKGFPPICVSACPEHALIFGREDSPEIQAWLQQNKYYQYQLPGAGKPHLYRRFGQHLIKKENV

SEQ ID NO: 67525 - DNA, 753 bp, Salmonella typhimurium LT2
  CDS (1)..(753): transl_table=11
atgtggacgggagtcaatatggacagcagtaaacggcaatttctccagcagcttggcgtcctgaccgctggcgcctcgctggttccgctggctgaagcgaaatttcctttttcgccggagcggcatgaaggctctccccgacaccgttacgccatgcttatcgatctgcggcgttgtatcggctgtcagtcctgtaccgtaagttgcactattgaaaaccaaacgccgcaaggcgcgtttcgtacgacggtgaaccaataccaggtccagcgtgaaggtagtcaggaagtcacgaatgtgctgttgccgcgtctgtgcaaccattgcgataaccccccctgtgtgccggtctgcccggtacaagccacctttcagcgggaagatggcattgtggtggtggataacaaacgctgcgtcggctgcgcctattgtgtccaggcgtgtccttacgacgcccgatttatcaatcatgaaacgcaaactgccgataaatgcacgttttgcgtccatcgtctggaagccggactgttacccgcttgcgtagagtcctgcgtcggcggcgcgcgtattattggcgatatcaaagatccccatagccgcatcgccaccatgcttcatcagcatcgcgacgctatcaaggtattaaagccggaaaacggcacgtcgccccatgttttctacctgggtctggacgacgcctttgtcaccccattaatgggccgtgcgcagcccgcgctttggcaggaggtctga

SEQ ID NO: 67526 - protein, 250 aa, Salmonella typhimurium LT2
MWTGVNMDSSKRQFLQQLGVLTAGASLVPLAEAKFPFSPERHEGSPRHRYAMLIDLRRCIGCQSCTVSCTIENQTPQGAFRTTVNQYQVQREGSQEVTNVLLPRLCNHCDNPPCVPVCPVQATFQREDGIVVVDNKRCVGCAYCVQACPYDARFINHETQTADKCTFCVHRLEAGLLPACVESCVGGARIIGDIKDPHSRIATMLHQHRDAIKVLKPENGTSPHVFYLGLDDAFVTPLMGRAQPALWQEV

SEQ ID NO: 67527 - DNA, 618 bp, Salmonella typhimurium LT2
  CDS (1)..(618): transl_table=11
atgacaacccagtatggattttttattgattccagtcgttgcaccggttgcaaaacctgcgaactggcctgcaaggactacaaagatctcactcccgacgtcagcttccgccgcatttatgagtatgcgggcggtgactggcaggaagataacggcgtctggcaccagaacgtctttgcctattatctctccatttcatgcaaccactgcgaagacccggcctgtaccaaagtctgcccgagcggcgcgatgcacaagcgcgatgacggttttgtggtggtgaacgaagaggtctgtatcggctgccgctactgccacatggcctgcccgtacggcgcgccgcagtacaacgcggccaaaggtcatatgaccaagtgcgacggctgttatgaccgtgtcgctgacggcaagaaaccgatttgcgtggagtcctgcccgctgcgggcactggactttggcccgatagacgaactgcgtaaaaaacacggtgagctggctgccgtcgcgccgttgccgcgcgcgcatttcacgaagccgaatattgtgattaaacccaacgccaacagccgcccgaccggggacactaccggttatctggccaatccgaaggaggtataa

SEQ ID NO: 67528 - protein, 205 aa, Salmonella typhimurium LT2
MTTQYGFFIDSSRCTGCKTCELACKDYKDLTPDVSFRRIYEYAGGDWQEDNGVWHQNVFAYYLSISCNHCEDPACTKVCPSGAMHKRDDGFVVVNEEVCIGCRYCHMACPYGAPQYNAAKGHMTKCDGCYDRVADGKKPICVESCPLRALDFGPIDELRKKHGELAAVAPLPRAHFTKPNIVIKPNANSRPTGDTTGYLANPKEV

SEQ ID NO: 67529 - DNA, 630 bp, Salmonella typhimurium LT2
  CDS (1)..(630): transl_table=11
atgagtcagtttacacattacccgccggtgagcgataaacaactgggatttttcatcgactcctcacgctgctccggttgtaaagcctgccaggtggcctgcaaagacaaaaacaatctggaagtaggccgtcgtttccgccgcgtctatgaagtcaagggcggaagtttcatcccgaccgggcagggtggggtcagcaataacgtatttgcttatacgctttccatttcctgcaaccactgtgcggaccctgtctgcaccaaaaattgcccgactaccgctatgcataaacgcccgggtgacggcattgtgcgcgttgataccgacaaatgcgtcggctgtggctattgcgcctggtcctgcccttatggcgcgccgcagcttaacgagcagaccggccaaatgtctaagtgcgacatgtgcgttgatttactggcgaaaggtgaaccgcccgtctgtgttgcgacctgtccgctggaggccatcaagtttggtccgattgatgaactgcgcgcgaagtacggtagcgtatgcgacgttaacgggctgccagattcatccataaccaaacctaatctggttgtcaaagcgcatcagggcgcagaaaaagagggtaaacgccatgcatga

SEQ ID NO: 67530 - protein, 209 aa, Salmonella typhimurium LT2
MSQFTHYPPVSDKQLGFFIDSSRCSGCKACQVACKDKNNLEVGRRFRRVYEVKGGSFIPTGQGGVSNNVFAYTLSISCNHCADPVCTKNCPTTAMHKRPGDGIVRVDTDKCVGCGYCAWSCPYGAPQLNEQTGQMSKCDMCVDLLAKGEPPVCVATCPLEAIKFGPIDELRAKYGSVCDVNGLPDSSITKPNLVVKAHQGAEKEGKRHA

SEQ ID NO: 67531 - DNA, 903 bp, Salmonella typhimurium LT2
  CDS (1)..(903): transl_table=11
atggcttatcaatcgcaagacatcattcgtcgttccgccactaacggtttcacccccgcgccccaggcgcgggaccaccaggaagaggtggcgaaactcatcgacgtcaccacctgtatcggctgtaaagcgtgtcaggtggcgtgctccgagtggaacgacatccgtgatgaagtgggcaataacgtcggggtgtatgacaacccggcggacttaaccgcgaaatcctggacggtgatgcgcttctcggaagtggaacagaacgacaaactggagtggctgatccgtaaggatggctgtatgcactgcgccgatccaggctgcctgaaggcctgtccggcggaaggggcgatcattcagtacgctaacggtattgtcgacttccagtccgagcagtgtatcggctgcggctactgtatcgctggctgcccgttcaacgtgccgcgcctcaacccggaagacaaccgcgtctataaatgtacgctgtgcgttgaccgcgtgaccgtcgggcaagaaccggcctgcgtgaagacctgtccaaccggcgccattcattttggctcgaaagaggatatgaaaacgctggcgggcgagcgtgtggcggaactaaaaacccgtggttatgacaacgcgggtctgtacgatccggcgggagtaggcggtacgcatgtcatgtacgtgctgcatcatgccgacaagccgaatctgtatcacggtctgccggaaaacccggaaatcagcgaaaccgttaagttctggaaaggcgtctggaaaccgctcgccgcgttcggttttgccgcgacctttgccgccagcgtcttccactatgtcggcgtcggcccgaaccgcgcggaagaggaagatgacaacctgcatgaagagaaagacgaggtgcgcaaatga

SEQ ID NO: 67532 - protein, 300 aa, Salmonella typhimurium LT2
MAYQSQDIIRRSATNGFTPAPQARDHQEEVAKLIDVTTCIGCKACQVACSEWNDIRDEVGNNVGVYDNPADLTAKSWTVMRFSEVEQNDKLEWLIRKDGCMHCADPGCLKACPAEGAIIQYANGIVDFQSEQCIGCGYCIAGCPFNVPRLNPEDNRVYKCTLCVDRVTVGQEPACVKTCPTGAIHFGSKEDMKTLAGERVAELKTRGYDNAGLYDPAGVGGTHVMYVLHHADKPNLYHGLPENPEISETVKFWKGVWKPLAAFGFAATFAASVFHYVGVGPNRAEEEDDNLHEEKDEVRK

SEQ ID NO: 67533 - DNA, 696 bp, Ralstonia solanacearum GMI1000
  CDS (1)..(696): transl_table=11
atggcgcgcatgaaattcatctgtgacagcgagcgctgcatcgagtgcaacgcctgcaccaccgcctgcaagaacgagcacgaggtgccgtggggcgtgagccggcgccgcgtggtcaccatcaacgacggcatggtcggcgcggagaaatccatctcggtggcgtgcatgcactgctccgacgcgccctgcatggcggtctgcccggtcgactgcttctaccgcaccgaggacggcgtggtgctgcacgacaaggacgtctgcatcggctgcggctactgttcgtacgcctgcccgttcggcgcgccgcagttcccgagccagggcaccttcggggtgcgcggcaagatggacaagtgcaccttctgcgcgggcgggccggagcccaacggcagcgatgccgagttcgagaagtacggccgcaaccggctggccgagggcaagctgccgctgtgcgcggagatgtgctcgaccaaggcgctgctgggcggcgacggggatgtcattgccgacatcctgcgcaatcgtgtcatgaagcggggaaaaggagcggagctgttcggctgggggacggcctacggaggcgcaggcaagagcgcccaggccgcaccggctgccccaactgctccagctgctccagctgctccagctgcccccgccgccaagccggacgcaccggcctcgggagcgtactag

SEQ ID NO: 67534 - protein, 231 aa, Ralstonia solanacearum GMI1000
MARMKFICDSERCIECNACTTACKNEHEVPWGVSRRRVVTINDGMVGAEKSISVACMHCSDAPCMAVCPVDCFYRTEDGVVLHDKDVCIGCGYCSYACPFGAPQFPSQGTFGVRGKMDKCTFCAGGPEPNGSDAEFEKYGRNRLAEGKLPLCAEMCSTKALLGGDGDVIADILRNRVMKRGKGAELFGWGTAYGGAGKSAQAAPAAPTAPAAPAAPAAPAAKPDAPASGAY

SEQ ID NO: 67535 - DNA, 645 bp, Pyrobaculum aerophilum str. IM2
  CDS (1)..(645): transl_table=11
gtgtctatccaaactactaggagggatgtgttaaaggccacagccgccgctgttataacactagccgttccgatatcggcgcaagctacagaaaaacgccgctgggctatgtatatcgacgtcagcaagtgttatggctgttatgcgtgtatggtggcttgcgccgccgagaataacgtgcctataggcgttttcagaacgtggattgagcgccacgtcacaaagggaggcacagttatcttcgtgccaaagcagtgtaatcactgcgaaaatgcgccgtgtgtgaagccatgtcccacaggcgctacttataaaactgaagatggacttgtcttagtaaatgacgacctttgtattggctgtggcgcgtgtatacaagcatgtccatacggcgccagattctttaacccagtgaagggagttgttgataaatgtacattctgttcccacagaatttaccaaggcaaattgccggcatgtgtagagacatgcccaaccggggcgagagtatttggcgatttaaacgaccccacatcgccagttttaaaactagttaacacaaacgcaacacaacggctgaaagtagaaactggcgcggagccaatgatcttctatagaaacttgccctcagaggcgggcctatga

SEQ ID NO: 67536 - protein, 214 aa, Pyrobaculum aerophilum str. IM2
MSIQTTRRDVLKATAAAVITLAVPISAQATEKRRWAMYIDVSKCYGCYACMVACAAENNVPIGVFRTWIERHVTKGGTVIFVPKQCNHCENAPCVKPCPTGATYKTEDGLVLVNDDLCIGCGACIQACPYGARFFNPVKGVVDKCTFCSHRIYQGKLPACVETCPTGARVFGDLNDPTSPVLKLVNTNATQRLKVETGAEPMIFYRNLPSEAGL

SEQ ID NO: 67537 - DNA, 846 bp, Pyrobaculum aerophilum str. IM2
  CDS (1)..(846): transl_table=11
gtgtccctgaccttccccaagcccaacgaaggagtcgcggtgcttgtggatatagacaagtgtattggatgccgcgcttgccaagtggcttgtaaagactggaacggaaggccggcggttaagacggagtttgcgggatctctcacgttgcctaaatggctcacggcggaggactggaaggttgtgttcttctatgagggcaaaactggcaagaagttaatgacgcctgctggagaagtgactttcagccagtttgaattggcgcccttgccgtacaattgtatgcactgcgccgctgccccgtgcgccagggcttgtcccgtcggtgcgattaaagtcactggcgagggggcagtcgttataaataaagaagagtgtataggatgtggatactgcgaagccgcctgtccatatgacgtccccaagaagggatctgatggaagatactacaagtgtactttctgtgtagataggattcaaaacggccgcgctcctgcgtgcgtagaggtatgtccaacgaatgtgttcacatttggcccagctagcgaagttatagccaaggcaagggaagagcagaggcgcggaagatatgtctacgggcttgaggtaaacgattatgttggcggctcagtccgttggatatatgtgacatcggataggagggcctttgcggttaagcaacacttctctaacgcaagcccgcgggctgcacaacaaataagagaggtgttaaagccgctgactttatacggaggggcgttgctggccgtgggtttgacgatagccggcatagcggcttggcgccagcgcagaaaagaggaaaaggaagaggctgggactaaataa

SEQ ID NO: 67538 - protein, 281 aa, Pyrobaculum aerophilum str. IM2
MSLTFPKPNEGVAVLVDIDKCIGCRACQVACKDWNGRPAVKTEFAGSLTLPKWLTAEDWKVVFFYEGKTGKKLMTPAGEVTFSQFELAPLPYNCMHCAAAPCARACPVGAIKVTGEGAVVINKEECIGCGYCEAACPYDVPKKGSDGRYYKCTFCVDRIQNGRAPACVEVCPTNVFTFGPASEVIAKAREEQRRGRYVYGLEVNDYVGGSVRWIYVTSDRRAFAVKQHFSNASPRAAQQIREVLKPLTLYGGALLAVGLTIAGIAAWRQRRKEEKEEAGTK

SEQ ID NO: 67539 - DNA, 699 bp, Pyrobaculum aerophilum str. IM2
  CDS (1)..(699): transl_table=11
atgaggccggtatttgtcattgacataaataaatgcgttgggtgccgcgcctgcgtagccgcgtgtattattgaatacggccaggtattcacagcggcgcgcccgtctaaccaggggaagccgcagacagtgaaattgaggacttgggttgagtggagggagggctatgacggcaagccgtataggaagttcatatcctcgttgtgttaccactgtgaggataccccgtgtcaaagagtctgtccaactggtgcaacctacaagactccagagggcgttgtgttaattgataaagatctatgtataggctgtggatactgcattatcgcctgtccatatggctctcgttatagacctgagccgcatgaatggcatgaggctgagaacaagccgcttgttaaagaggttgaagaggttacgcaatatggcggggtattattcaaatcgccagtgccaaacaaatgggcgtttagaattgactctgtggataaatgtacattctgctaccaccggtataaaggcgatgggaagttatggacgccggcttgtgttgaggtttgtccaactggctcaagattattcggcgatttggacaatcccaacgatcctgtggcagatttagtacgcaaaggcgtggccaggctagctaggccagatttaaagactggtggaagagtttattacgtgggggagctatga

SEQ ID NO: 67540 - protein, 232 aa, Pyrobaculum aerophilum str. IM2
MRPVFVIDINKCVGCRACVAACIIEYGQVFTAARPSNQGKPQTVKLRTWVEWREGYDGKPYRKFISSLCYHCEDTPCQRVCPTGATYKTPEGVVLIDKDLCIGCGYCIIACPYGSRYRPEPHEWHEAENKPLVKEVEEVTQYGGVLFKSPVPNKWAFRIDSVDKCTFCYHRYKGDGKLWTPACVEVCPTGSRLFGDLDNPNDPVADLVRKGVARLARPDLKTGGRVYYVGEL

SEQ ID NO: 67541 - DNA, 567 bp, Pyrobaculum aerophilum str. IM2
  CDS (1)..(567): transl_table=11
atgactcgcctagcccacctctgggatcaatcccgttgcataggatgcacagcgtgtatagcggcttgcaatgttgcaaactacagctcagatacaaaggaaaacaagacgtggggctggttacgctctaacattagacgaatagagatattaaggggaccgagacctatgcttctgctagtgcagtgtcaacactgcgacaatgcgccatgcgtcgcggtatgtcctactggcgcgtcgtataaagacgtagatgggctggtgaaaatgaggcccgagctgtgcataggctgtaaatactgtatggtcgcatgcccctatgaggccagatggcttgatgaagataccggcttacctaggaagtgcatgggagaggagtgtctaagtcgcgtttcacaaggcctacagccagtgtgcgtagaggtgtgtcccgcaggtgccagggcttttggcgatattgacaaccccacatctgagatatcgcgccgccttgccaaaagccgctacattagactattagaaaacaaaggaacagagccaaagtacttcgtagtcgtggggccatga

SEQ ID NO: 67542 - protein, 188 aa, Pyrobaculum aerophilum str. IM2
MTRLAHLWDQSRCIGCTACIAACNVANYSSDTKENKTWGWLRSNIRRIEILRGPRPMLLLVQCQHCDNAPCVAVCPTGASYKDVDGLVKMRPELCIGCKYCMVACPYEARWLDEDTGLPRKCMGEECLSRVSQGLQPVCVEVCPAGARAFGDIDNPTSEISRRLAKSRYIRLLENKGTEPKYFVVVGP

SEQ ID NO: 67543 - DNA, 600 bp, Chlorobium tepidum TLS
  CDS (1)..(600): transl_table=11
atggcccgttatggaatggtaatggatatgcgtacctgcgtcggctgtcaggcctgcatggcggcgtgttcgaccgaaaaccagaccccgttctggagcgagaagtttcggacgcatgtggaggacaaggagacaggagccttccccgatgtacgccgggtgcagcttccgcgcctctgcatgcactgcgaaaacaccccctgcctgtcggcctgcccgaccggggcgacccatatgaacaaggacggcatcgtgctggtcaactatgaccgttgcatcggctgctacgcctgctgcatcgcctgcccgtacgacgcccgctacgcctacgacagcgaggatgtccagaaggagcgcgaactgtacggcaaactggtcacgcacgacgtgccacatgtggacaaatgcaccttctgcgtgcagcgcctgtcggaaaaactcgaaccggcctgcgtcgccacctgcccgacccacacgcgcatcttcggcgacctcgatgaccgcaagagcgaggtgcacaagctcgccgcgagcggcaaggcgcaggcgctcaaccagggcctcggcacctcgccgaaagtattctacatcccatcataa

SEQ ID NO: 67544 - protein, 199 aa, Chlorobium tepidum TLS
MARYGMVMDMRTCVGCQACMAACSTENQTPFWSEKFRTHVEDKETGAFPDVRRVQLPRLCMHCENTPCLSACPTGATHMNKDGIVLVNYDRCIGCYACCIACPYDARYAYDSEDVQKERELYGKLVTHDVPHVDKCTFCVQRLSEKLEPACVATCPTHTRIFGDLDDRKSEVHKLAASGKAQALNQGLGTSPKVFYIPS

SEQ ID NO: 67545 - DNA, 777 bp, Chlorobium tepidum TLS
  CDS (1)..(777): transl_table=11
atgagtcaaaaccgtagagaatttctgaaaaaggccggtctgggcgctctcgccggcctgggtgccgccgcgggtctgttcccggcgttcgcgcttgagaataccgatatgtcgagctttaccaccaagccgacgccgggcaaggtgcgctggggaatgctggttgatacccgcaagtgcctcggcgactgcaaggagtgcatcgtccgttgccaccacgatcacaacgtgccggacttcggccatacgaagaacgaggtcaaatggatatggaagagcggttatgagaatgcgtttccgaccgccagcacgcagttccagaatcccgaagtgctggaacgccaggtgctgacgctctgcaaccactgcaccgagccgccctgcaccaaagcctgcccgaccgaggcgacctttaagcgctgggacggcatcgtctccatcgactaccatcgctgcattggctgccgcttctgcatggccgcctgcccgtacggttcgcgcagcttcaactggctcgatccgcgtccgcacatcaaggagctgagcaacacctacccgacacggatgcgcggcgtggtcgagaagtgcaacttctgctcggagcggctcgtcaagggcgagcttccggcctgcgtcgtcagctgtgcggagaatgcgcttaccttcggcgacctgaacgatccaaattcggagatccgcaagatgctcgccacgaacgaaaccatgcagcgcaagccggaactcggcacgctgccatcagtcttttacatcatctaa

SEQ ID NO: 67546 - protein, 258 aa, Chlorobium tepidum TLS
MSQNRREFLKKAGLGALAGLGAAAGLFPAFALENTDMSSFTTKPTPGKVRWGMLVDTRKCLGDCKECIVRCHHDHNVPDFGHTKNEVKWIWKSGYENAFPTASTQFQNPEVLERQVLTLCNHCTEPPCTKACPTEATFKRWDGIVSIDYHRCIGCRFCMAACPYGSRSFNWLDPRPHIKELSNTYPTRMRGVVEKCNFCSERLVKGELPACVVSCAENALTFGDLNDPNSEIRKMLATNETMQRKPELGTLPSVFYII

SEQ ID NO: 67547 - DNA, 618 bp, Shigella flexneri 2a str. 301
  CDS (1)..(618): transl_table=11
atgacaacccagtatggattttttattgattccagccgttgcgccggttgcaaaacctgcgagctggcttgtaaagactacaaagatttgacgccagaagtcagtttccgccgcatttatgaatatgctggcggcgactggcaggaagataacggtgtctggcaccagaacgtgtttgcctactatctgtcgatttcgtgcaaccactgcgaagatccggcttgtactaaagtctgcccgagcggtgcgatgcataaacgcgaagatggttttgttgtggtcgatgaagatgtatgcattggctgccgttactgtcatatggcttgcccgtatggcgcaccgcaatataacgaaacgaaaggccatatgaccaaatgcgatggttgttatgaccgtgttgcggagggtaaaaagccgatctgtgttgaatcttgcccgctgcgggcgctggatttcggccctatcgacgagctgcgtaaaaaacatggcgatctggcggccgttgcgccgttgccgcgagctcactttaccaaaccgaatattgtgatcaaacccaatgccaatagccgcccgaccggggataccactggctatctggcaaacccgaaggaggtgtga

SEQ ID NO: 67548 - protein, 205 aa, Shigella flexneri 2a str. 301
MTTQYGFFIDSSRCAGCKTCELACKDYKDLTPEVSFRRIYEYAGGDWQEDNGVWHQNVFAYYLSISCNHCEDPACTKVCPSGAMHKREDGFVVVDEDVCIGCRYCHMACPYGAPQYNETKGHMTKCDGCYDRVAEGKKPICVESCPLRALDFGPIDELRKKHGDLAAVAPLPRAHFTKPNIVIKPNANSRPTGDTTGYLANPKEV

SEQ ID NO: 67549 - DNA, 618 bp, Shigella flexneri 2a str. 301
  CDS (1)..(618): transl_table=11
atgaccacacaatatggattttttatcgattccagccgctgtactggctgtaaaacctgcgaactggcgtgcaaagattttaaagatcttggcccggaagtcagtttccgccgtatttatgaatatgctggctgcgactggcaggaagataatggcatctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcaccacagtacaatgctgaaaaagggcacatgacgaagtgcgatggttgttattcgcgcgtcgccgaggggaaacaacccatatgcgtcgaatcctgcccgctgcgtgcacttgagttcggtccaattgaagagctgcgccagaagcacggcactctggctgccgtcgcgccactgccgcgcgcgcatttcacaaaacccaatatcgttatcaaacctaacgccaacagccgcccgaccggcgataccactggttatctggctaatccggaggaagtgtaa

SEQ ID NO: 67550 - protein, 205 aa, Shigella flexneri 2a str. 301
MTTQYGFFIDSSRCTGCKTCELACKDFKDLGPEVSFRRIYEYAGCDWQEDNGIWHQNVFAYYLSISCNHCDDPACTKVCPSGAMHKREDGFVVVDEDVCIGCRYCHMACPYGAPQYNAEKGHMTKCDGCYSRVAEGKQPICVESCPLRALEFGPIEELRQKHGTLAAVAPLPRAHFTKPNIVIKPNANSRPTGDTTGYLANPEEV

SEQ ID NO: 67551 - DNA, 915 bp, Shewanella oneidensis MR-1
  CDS (1)..(915): transl_table=11
atggcgactcaagatatcattcaacgttccggcacttcgcaagccactccgcctgcacaggcaagagtgggtggcgtgaagcaaattgcgaagttgtttgacgcgactaagtgtaatggctgtaaagcctgtcaggtagcttgctcagaatggaatgacctgcgtgaagaggtgggttcgttccaagggacttatcaaaaccctgcatctctgtctccagagtgctggaccttgatgaagtacaacgagatcgaagaccaaggcaaattgcgctggcagtttactcactctgcctgtatgcactgcgccgatcccgcttgcttaaaggcttgctcgacctctggcgcaatcattcagcatgccaatggcactgtggatttcgattcggacaaatgtattggctgtggttattgtgccagtgcctgcccattcgatatcccgaagatcagcgccgtcgacaacaaggcctacaagtgcactatgtgttctgaccgcttggctgttgggctggaaccttcctgcgttaagtcctgtaccacgggtgcgctgcgttttggtacgcgcgaagacatgctgttcgcctccgaaaagcgtgttaacgagctgaaagaacgtggtttccctaaggcgggactctataacccagagggcgtgggtggtactggcatgctgatgatattgcatgatgtcactcagcctgaaacctacgaaatgcctaaggatccgcaaatcccattgtctgtcaccctgtggcaggactgggtgaaaccactgggtactgtcggacttcttgcgacggctgctgtggcttgcctgcataagatcaccgtcggtcgcaacatagtggaagaggaccaacccggctatcaaccgccagaggaagaggttaagcaagaagaggaggccaagaaatga

SEQ ID NO: 67552 - protein, 304 aa, Shewanella oneidensis MR-1
MATQDIIQRSGTSQATPPAQARVGGVKQIAKLFDATKCNGCKACQVACSEWNDLREEVGSFQGTYQNPASLSPECWTLMKYNEIEDQGKLRWQFTHSACMHCADPACLKACSTSGAIIQHANGTVDFDSDKCIGCGYCASACPFDIPKISAVDNKAYKCTMCSDRLAVGLEPSCVKSCTTGALRFGTREDMLFASEKRVNELKERGFPKAGLYNPEGVGGTGMLMILHDVTQPETYEMPKDPQIPLSVTLWQDWVKPLGTVGLLATAAVACLHKITVGRNIVEEDQPGYQPPEEEVKQEEEAKK

SEQ ID NO: 67553 - DNA, 675 bp, Shewanella oneidensis MR-1
  CDS (1)..(675): transl_table=11
atgactcaacaaacacaatatggtttctatttcgatagcagcaaatgtactggctgtaaaacttgtcatattgcctgtaaggaccgcatgactggcttggttcgtgcaaaagacgatgtgatgaataatggtgtcgctaatttgcccggtattatttggcgccgtgtttatgaatatggcggcggcaattggtcgcaaaatgtcgatggtagttttgagcaaaatgtctttgcctactacatgtctattggttgtaaccattgcagccagcctgtgtgtgttaaagcctgcccaacaggtgcaatgcataagcgccgcgaagatggcttagtccaagttgccactgaactatgtattggttgtgaaagttgtgcgagggcttgcccatatgatgcaccacagctggatatcgagcgtaaggtgatgaccaagtgtgatggttgcagcgatagacttgctgaaggtaaaaagcctatttgcgttgattcttgtcctttacgggcacttgactttgacactatggataatttacgagcgaaatatggagagggggatggtcatattgctcccttaccatcgccatcgattacttcgccaaacttgattatcaaggccaatcgaaatggtcaaccagttggtggtagtgggcaattattaaaccctgcagaagtgtaa

SEQ ID NO: 67554 - protein, 224 aa, Shewanella oneidensis MR-1
MTQQTQYGFYFDSSKCTGCKTCHIACKDRMTGLVRAKDDVMNNGVANLPGIIWRRVYEYGGGNWSQNVDGSFEQNVFAYYMSIGCNHCSQPVCVKACPTGAMHKRREDGLVQVATELCIGCESCARACPYDAPQLDIERKVMTKCDGCSDRLAEGKKPICVDSCPLRALDFDTMDNLRAKYGEGDGHIAPLPSPSITSPNLIIKANRNGQPVGGSGQLLNPAEV

SEQ ID NO: 67555 - DNA, 567 bp, Shewanella oneidensis MR-1
  CDS (1)..(567): transl_table=11
atgacgaaaagatatgtgatggtgcacgatgagaacaagtgcatcggctgccaagcctgtaacgtggcttgccgcagtgaaaacggcgttccagaaggggttacccgtttgcaggtgagagtcgaagggccctatggcgaaatgcccaatctgcactttaagtaccacagggtgtcttgtcagcagtgtgaagatgcgccttgtgtgaaggtgtgtccaacgggcgcggcctatgtgggcgaagatggcattgtctccatccacggcgacaagtgtgtgggttgtatgtactgcgtggcggcgtgcccctacaaagtgcgttttatgaatcccgaaaccaaagtggctgacaagtgtaacttctgtaaggacacccgcttagcccgtggtgaagagccagcctgtgtgactgtgtgtccaaccgatgccttggtgtttggcgatgctaacgatccacaaagtgaagtggccacactgctcaacactaagatcacttaccaagataagacccatttaggcactaaacctagggtatatcgcgttcctaccaaaagaggggggatttga

SEQ ID NO: 67556 - protein, 188 aa, Shewanella oneidensis MR-1
MTKRYVMVHDENKCIGCQACNVACRSENGVPEGVTRLQVRVEGPYGEMPNLHFKYHRVSCQQCEDAPCVKVCPTGAAYVGEDGIVSIHGDKCVGCMYCVAACPYKVRFMNPETKVADKCNFCKDTRLARGEEPACVTVCPTDALVFGDANDPQSEVATLLNTKITYQDKTHLGTKPRVYRVPTKRGGI

SEQ ID NO: 67557 - DNA, 618 bp, Shewanella oneidensis MR-1
  CDS (1)..(618): transl_table=11
atgcaagaaccaacccaatacggtttttatgtcgataccactaagtgcagtggttgcaaaacgtgtcaagtggcctgtaaggatcgcagtgatatcgaggtcggtaaacagtggcgcagaacctacgaatattgtggtggaaattggactgctgatgggcagggtgcttaccatcaagatgtatttgcctattatatttcaataagttgcaaccattgtagcaatccggtgtgtgttaaagcttgccctacgggggctatgtataaagagcgcagcactggcttagtgaaagtgaatcaggatctgtgtattggctgcgaaagctgtgctcgtgcttgtccttatgatgcaccacagatcgatccacaacgtaaagtgatgactaagtgtgatggttgcagcgaccgtgttgccaagggcctcaaaccaagttgtgtgatgtcctgcccgcagcgcgccttagattttggtttaattgccgagttaaagcaacagtatggcaacgatagcgatatatcaggtttgccatcatcttctattactcacccaaatttagtgttaaaggtgcatgctaaatcagggcagcgtggggagattattaacatcacagaagtgtaa

SEQ ID NO: 67558 - protein, 205 aa, Shewanella oneidensis MR-1
MQEPTQYGFYVDTTKCSGCKTCQVACKDRSDIEVGKQWRRTYEYCGGNWTADGQGAYHQDVFAYYISISCNHCSNPVCVKACPTGAMYKERSTGLVKVNQDLCIGCESCARACPYDAPQIDPQRKVMTKCDGCSDRVAKGLKPSCVMSCPQRALDFGLIAELKQQYGNDSDISGLPSSSITHPNLVLKVHAKSGQRGEIINITEV

SEQ ID NO: 67559 - DNA, 951 bp, Pseudomonas putida KT2440
  CDS (1)..(951): transl_table=11
atggccagccaagacatcatcgcccgctcggccaccactaccgtgccgccctcggtgcgtcagcaggaggaggtcgccaagctgatcgacactaccaagtgcatcggctgcaaggcctgccaggtggcgtgctcggagtggaatgaactgcgtgacgaggttggccacaaccacggcacctacgacaacccccaggacctcactgccgagacctggacactgatgcgctttaccgagcatgagcgcgacgacggcaacctggagtggctgatccgcaaggacggttgcatgcactgtgccgacccaggttgcctgaaggcatgcccgagcccgggcgcgatcatcaagcacgccaacggtatcgtcgacttcaaccaggaccactgcatcggctgcggctactgcatcaccggctgcccgttcaacatcccgcgtatctcgcagaaagaccacaaggcgtacaagtgcaccctgtgttccgatcgcgtgagcgtggggctggagccggcatgcgtgaaaacctgcccgaccggggcgatcgtgttcggcagcaaggacgagatgaaagtgcatgcggccgagcgcatcgtcgatctgaagtcgcggggctacgacaaggccgggctgtacgacccggacggcgtcggtggtacccacgtgatgtacgtgctgcaccatgccgacacgccgaagctgtatgccggcctgccggaccagccagtgatcagcccgttggtagggttgtggaagggcttcaccaagccgctggcgctgttggccatgggcgcggcggtgctggcggggttcttccactatgtgcggatcggcccacagcgtgtcgaggaggatgaacacccgacaccgccggacgaaagcgtgcatcaagtggacccgtcggtccatgtctatgatccgaagcagcccggtgggcaaggggagcagcggccatga

SEQ ID NO: 67560 - protein, 316 aa, Pseudomonas putida KT2440
MASQDIIARSATTTVPPSVRQQEEVAKLIDTTKCIGCKACQVACSEWNELRDEVGHNHGTYDNPQDLTAETWTLMRFTEHERDDGNLEWLIRKDGCMHCADPGCLKACPSPGAIIKHANGIVDFNQDHCIGCGYCITGCPFNIPRISQKDHKAYKCTLCSDRVSVGLEPACVKTCPTGAIVFGSKDEMKVHAAERIVDLKSRGYDKAGLYDPDGVGGTHVMYVLHHADTPKLYAGLPDQPVISPLVGLWKGFTKPLALLAMGAAVLAGFFHYVRIGPQRVEEDEHPTPPDESVHQVDPSVHVYDPKQPGGQGEQRP

SEQ ID NO: 67561 - DNA, 618 bp, Escherichia coli CFT073
  CDS (1)..(618): transl_table=11
atgacaacccagtatggattttttattgattccagccgttgcaccggttgcaaaacctgcgagctggcttgtaaagactacaaagatttgacgccagaagtcagcttccgccgcatttatgaatatgctggtggcgactggcaggaagataacggtgtctggcaccagaacgtgtttgcctactatctgtcgatttcatgtaaccactgcgaagatccggcttgtaccaaagtctgcccaagcggtgcgatgcataaacgtgaagatggttttgtcgttgtcgatgaagatgtgtgtattggctgtcgttactgccatatggcctgcccgtatggcgcaccgcagtacaacgcaaccaaaggtcatatgaccaaatgtgatggttgctatgaccgcgtcgcagaaggtaaaaaaccgatctgcgtcgaatcttgcccgctacgggcgctggatttcggacctatcgacgagctgcgtaaaaaacacggcgatctggcggctgttgcgccgttgccgcgtgcgcacttcaccaaaccgaatattgtgatcaaacctaacgccaatagccgcccaaccggggataccactggctatctggcaaacccgaaggaggtgtga

SEQ ID NO: 67562 - protein, 205 aa, Escherichia coli CFT073
MTTQYGFFIDSSRCTGCKTCELACKDYKDLTPEVSFRRIYEYAGGDWQEDNGVWHQNVFAYYLSISCNHCEDPACTKVCPSGAMHKREDGFVVVDEDVCIGCRYCHMACPYGAPQYNATKGHMTKCDGCYDRVAEGKKPICVESCPLRALDFGPIDELRKKHGDLAAVAPLPRAHFTKPNIVIKPNANSRPTGDTTGYLANPKEV

SEQ ID NO: 67563 - DNA, 885 bp, Escherichia coli CFT073
  CDS (1)..(885): transl_table=11
atggctatggaaacgcaggacattatcaaaaggtccgcaactaactccatcacgccgccttctcaggtgcgtgattacaaagcagaagtagcgaaacttatcgacgtttccacctgtatcggctgtaaagcctgtcaggtggcgtgttcggagtggaacgacatccgtgatgaagtggggcactgcgtcggggtttacgataaccccgccgatctgagcgccaagtcctggacggtgatgcgctttagcgaaaccgaacagaacggcaagctggagtggctgatccgtaaagacggctgtatgcactgtgaagatccgggctgcctgaaggcgtgcccgtctgctggtgcaatcattcagtacgctaacgggattgtcgatttccagtcggaaaattgcatcggctgtggttactgcattgccggttgtccgtttaatattccgcgcctcaacaaagaggataaccgggtatataaatgcaccctctgcgtcgatcgcgtcagcgtcggccaggaaccggcttgtgtgaaaacctgtccgaccggggctatccacttcggcaccaagaaggagatgctggagctggcggaacagcgcgtagcgaaactgaaagcgcgtggttacgaacatgctggcgtctacaacccggaaggggtcggtggtacgcacgttatgtacgtgctgcatcatgccgatcagccggagctgtatcatggtctgccgaaagatccgaagatcgatacctcggtaagcctgtggaaaggcgcgttgaaaccgctggcagcggctggctttattgccacttttgccgggttgattttccactacatcggtattggcccgaataaggaagtggacgatgacgaggagggaaatcatgagtaa

SEQ ID NO: 67564 - protein, 294 aa, Escherichia coli CFT073
MAMETQDIIKRSATNSITPPSQVRDYKAEVAKLIDVSTCIGCKACQVACSEWNDIRDEVGHCVGVYDNPADLSAKSWTVMRFSETEQNGKLEWLIRKDGCMHCEDPGCLKACPSAGAIIQYANGIVDFQSENCIGCGYCIAGCPFNIPRLNKEDNRVYKCTLCVDRVSVGQEPACVKTCPTGAIHFGTKKEMLELAEQRVAKLKARGYEHAGVYNPEGVGGTHVMYVLHHADQPELYHGLPKDPKIDTSVSLWKGALKPLAAAGFIATFAGLIFHYIGIGPNKEVDDDEEGNHE

SEQ ID NO: 67565 - DNA, 987 bp, Escherichia coli CFT073
  CDS (1)..(987): transl_table=11
gtgaacagacgtaattttattaaagcagcctcctgcggggcattgctgacgggcgcgctgccgtctgtcagtcatgcggctgctgaaaaccgcccgccaattccgggatcgctggggatgttgtacgactcgaccttgtgcgtaggctgccaggcttgcgtcaccaagtgtcaggatatcaacttccctgaacgtaacccgcaaggggaacagacctggtcgaacaacgacaaactgtcgccgtataccaataacatcattcaggtgtggaccagcggcacaggggtcaacaaagaccaggaggagaatggctacgcgtacattaagaaacagtgtatgcactgcgtcgatccgaactgtgtctctgtgtgcccggtctctgcgctgaaaaaagatccgaaaaccggcattgtccattacgacaaagatgtgtgcaccggctgccgttactgcatggtcgcctgcccatacaacgtgccgaagtacgactacaacaacccgtttggtgcgctgcataagtgcgagttgtgcaaccagaaaggtgtggaacgtctcgataaaggcggtctgcctggctgcgtagaagtgtgcccggcgggcgcggtgatttttggtacgcgtgaagagctgatggcggaggcgaaaaaacgtctggcgctgaagccgggcagcgaataccactatccgcgtcagacgctgaaatctggcgacacttacctgcatacggtgccgaaatattatccgcatctgtacggcgagaaagagggcggcggtactcaggttctggtactgacgggtgtgccttatgaaaatctcgacctgccgaaactggacgatctttctactggtgcgcgttccgaacatgtccaacacaccctgtataaaggcatgatgctaccactggctgtgctggcgggcttaaccgtgctggttcgtcgcaacactaaaaacgaccatcacgacggaggagacgatcatgagtcatga

SEQ ID NO: 67566 - protein, 328 aa, Escherichia coli CFT073
MNRRNFIKAASCGALLTGALPSVSHAAAENRPPIPGSLGMLYDSTLCVGCQACVTKCQDINFPERNPQGEQTWSNNDKLSPYTNNIIQVWTSGTGVNKDQEENGYAYIKKQCMHCVDPNCVSVCPVSALKKDPKTGIVHYDKDVCTGCRYCMVACPYNVPKYDYNNPFGALHKCELCNQKGVERLDKGGLPGCVEVCPAGAVIFGTREELMAEAKKRLALKPGSEYHYPRQTLKSGDTYLHTVPKYYPHLYGEKEGGGTQVLVLTGVPYENLDLPKLDDLSTGARSEHVQHTLYKGMMLPLAVLAGLTVLVRRNTKNDHHDGGDDHES

SEQ ID NO: 67567 - DNA, 600 bp, Vibrio vulnificus CMCP6
  CDS (1)..(600): transl_table=11
atgaaattcctctgcgacaccaaacgctgcatcgaatgcaacggttgtgtgaccgcttgtaaaaatgaaaacgacgacgcattagagtggggcattcagcgccgccgcgttgttaccttgaacgatggtgaaccgggcgaaaactccatctcagtggcctgtatgcactgtaccgatgccccttgtatggcggtttgtcctgcagactgttttgaacataccgaagatggcattgtgctccacaacaaagatctgtgtattggttgtggttactgcctgtttgcttgcccatttggtgcgcctcagttcccgaaacaagcctcatttggcgagcgtggcaaaatggacaaatgcaccttctgcgccggtggtccaaacaccgaaccgggctcagaagaagagcgtctgaagtatggtgccaaccgtatcgcagaaggcaaactgccaatgtgtgcttcgctgtgttcaactaaggccctcttggcaggtgatgcagagaaaatctccgacatcttccgtcaacgtgtcgtggaacgtggtgcaaaagaggccggttggaccaacggtgaagatctatcctacgatgcaactcgcagctaa

SEQ ID NO: 67568 - protein, 199 aa, Vibrio vulnificus CMCP6
MKFLCDTKRCIECNGCVTACKNENDDALEWGIQRRRVVTLNDGEPGENSISVACMHCTDAPCMAVCPADCFEHTEDGIVLHNKDLCIGCGYCLFACPFGAPQFPKQASFGERGKMDKCTFCAGGPNTEPGSEEERLKYGANRIAEGKLPMCASLCSTKALLAGDAEKISDIFRQRVVERGAKEAGWTNGEDLSYDATRS

SEQ ID NO: 67569 - DNA, 687 bp, Vibrio vulnificus CMCP6
  CDS (1)..(687): transl_table=11
atgagttgttcaagacgaaatttccttgctggtggtggcgcgttgatcatgacaacgggcattgctggcacttctatggtgactgggcgcttagcatttgcggaagaggataagggccaagcaattcgttatggcatgatccacgacgagaccgcctgtatcggatgtacggcttgtaccgatgcctgccgagaggtgaacaaagtccctgaaggcgtaagtcgattggagatcatacgcagtgagccgcacggtgagtacccgaatgtcgattaccgtttcacccgtaaatcttgccaacactgtgaaaacccaccttgtgtttatgtttgtcctaccggtgcggcgtacaaagatgaaaaaaccggcatcgtggatgtccacaaagaaaaatgtgtcggttgcggctattgccttgccgcgtgtccctatcaagtgcgcttctttaacccagtggatcactcggccgacaaatgcaatttctgtcgagacaccaatttggcgcaaggcaagctacccgcctgtgtggaatcttgtccaactaaggcactgatttttggtgatttaaatgatccgcaaagtgacgtgaatcgagtattggctgagaaggtctattaccgagacaaagtgcacttaggcacgaaacccaaattattcaaaatcccacatcaaaaaggggaggtgtag

SEQ ID NO: 67570 - protein, 228 aa, Vibrio vulnificus CMCP6
MSCSRRNFLAGGGALIMTTGIAGTSMVTGRLAFAEEDKGQAIRYGMIHDETACIGCTACTDACREVNKVPEGVSRLEIIRSEPHGEYPNVDYRFTRKSCQHCENPPCVYVCPTGAAYKDEKTGIVDVHKEKCVGCGYCLAACPYQVRFFNPVDHSADKCNFCRDTNLAQGKLPACVESCPTKALIFGDLNDPQSDVNRVLAEKVYYRDKVHLGTKPKLFKIPHQKGEV

SEQ ID NO: 67571 - DNA, 597 bp, Bradyrhizobium japonicum USDA 110
  CDS (1)..(597): transl_table=11
atggcacgtatgaagtttctctgcgacgccgaccgttgcatcgagtgcaacgcctgcgtcacggcctgcaagaacgagcacgaggtcccctggggcatcaaccgccgcagggtcgtcaccatcgccgatggcaagccgggcgaacgatcggtctcgatggcttgcatgcactgcacggatgcgccgtgcgcggcagtgtgcccggtgaactgtttctataccaccgccgatggcgtggtcctgcactccaaggatctctgcatcggctgcggctactgcttctacgcctgtccgtttggcgcgccgcaatatccgaaggtcggcaatttcggctcgcgcggaaaaatggacaaatgtacctattgcgccggcggacccgaggccgatggcagcaaggaggaatacgagaaatacggtgcgaaccgcctggccgagggcaagctgccgctgtgtgccgagatgtgctcgaccaagtcgctgctcgccggcgacggcgagatcatcgcccagatctataaggagcgcgtgctgaagcgcggctacggctcaggagcgtggggctggaagaccgcctatcgcgagacgatcgagtcctga

SEQ ID NO: 67572 - protein, 198 aa, Bradyrhizobium japonicum USDA 110
MARMKFLCDADRCIECNACVTACKNEHEVPWGINRRRVVTIADGKPGERSVSMACMHCTDAPCAAVCPVNCFYTTADGVVLHSKDLCIGCGYCFYACPFGAPQYPKVGNFGSRGKMDKCTYCAGGPEADGSKEEYEKYGANRLAEGKLPLCAEMCSTKSLLAGDGEIIAQIYKERVLKRGYGSGAWGWKTAYRETIES

SEQ ID NO: 67573 - DNA, 687 bp, Vibrio parahaemolyticus RIMD 2210633
  CDS (1)..(687): transl_table=11
atgaagtgttcaagacgaaattttttagccagtagcggcgcattgattttgaccactggcgttgctggcacctctgttgttagtgcttctctttatgccagtgatagcgagcaaaccaaacgttttggcatggttcatgatgaaaatgcgtgtataggatgtactgcgtgtactgaagcatgccgcgaagtgaataaagtgccagaaggggtgacccgcctaaaaattcatcgcagcgaacccattggggaatttcctgatgttgagtaccagtttacgcgtgaatcttgtcagcactgtgataatccaccatgtgtgtatgtttgccctacgggtgctgcgtataaagatgaatctacgggcatagttgatgtgcacaaagagcgatgtgtcggctgtggctattgtttggcggcttgtccttatcaagtgcgctttttcaaccctgttgaccattctgcagacaaatgtaacttctgccgtgataccaacctagcacaaggtaagcagccagcttgcgtggaatcttgcccaacaaaagcactcatctttggtgatttgaatgacccaactagcgaggtaagcaaagtcattgataaccatcttgtgtatcgcgataagtcacatttaggaacgcaacctaagctgtttaaaattccgcataacaaaggggaggtgtcatcatga

SEQ ID NO: 67574 - protein, 228 aa, Vibrio parahaemolyticus RIMD 2210633
MKCSRRNFLASSGALILTTGVAGTSVVSASLYASDSEQTKRFGMVHDENACIGCTACTEACREVNKVPEGVTRLKIHRSEPIGEFPDVEYQFTRESCQHCDNPPCVYVCPTGAAYKDESTGIVDVHKERCVGCGYCLAACPYQVRFFNPVDHSADKCNFCRDTNLAQGKQPACVESCPTKALIFGDLNDPTSEVSKVIDNHLVYRDKSHLGTQPKLFKIPHNKGEVSS

SEQ ID NO: 67575 - DNA, 768 bp, Vibrio parahaemolyticus RIMD 2210633
  CDS (1)..(768): transl_table=11
atggattccaccaaacgtcgctttcttagcgccattacagcgggtgccgcgttggtccccattgcaggtattggcaccgcaaccgcgggcaatgttattcgcaataaccaatccgccgaccgaaaaggacaagtcggaaaacgttacgccatggtgatcgatttacgtaaatgcgtcggctgccaagcgtgcaccgtaggttgcagtattgaaaaccaagcgccaatcggtcagttccgaaccacagtgaaacaatacgaagtcacgctcgatgacggttccacaaccacacaagaagcaaaggcctttatgctgcctcggctttgtaatcactgcgataacccgccgtgcgtagccgtttgtcccgttcaagcaacctttcagcgagaagatggcatcgtcatggtggataacagtcgctgcgtagcgtgtgcgtattgtgtacaagcctgcccttatgatgcacgttttatcaatgaagacacactcaccgctgacaaatgcaccttctgtgcacaccgcttagaacaaggtttgttacccgcttgtgtggaaacttgcgtgggcggcgctcgcgtgattggtgatttgaatgatccatcaagtgaagtccgccgcttaattacgaagcaccaagacaacatcaaagtgctaaagcccgatgaaaagaccaagccacacgtgttttacatcggcatggatgaacgcttcaccagccacatcgacgggcagccagctatttacgccccacaaggagatcgcgcatga

SEQ ID NO: 67576 - protein, 255 aa, Vibrio parahaemolyticus RIMD 2210633
MDSTKRRFLSAITAGAALVPIAGIGTATAGNVIRNNQSADRKGQVGKRYAMVIDLRKCVGCQACTVGCSIENQAPIGQFRTTVKQYEVTLDDGSTTTQEAKAFMLPRLCNHCDNPPCVAVCPVQATFQREDGIVMVDNSRCVACAYCVQACPYDARFINEDTLTADKCTFCAHRLEQGLLPACVETCVGGARVIGDLNDPSSEVRRLITKHQDNIKVLKPDEKTKPHVFYIGMDERFTSHIDGQPAIYAPQGDRA

SEQ ID NO: 67577 - DNA, 630 bp, Salmonella enterica subsp. enterica serovar Typhi Ty2
  CDS (1)..(630): transl_table=11
atgagccagtttacacattacccgccggtgagcgataaacaactgggatttttcatcgactcctcacgctgctccggttgtaaagcctgccaggtggcctgcaaagacaaaaacaatctggaagtaggccgtcgtttccgccgcgtctatgaagtcaagggcggaagtttcatcccgaccgggcagggcggggtcagcaataacgtatttgcttatacgctttctatttcctgcaaccactgtgcggatcctgtctgcaccaaaaattgcccgactaccgctatgcataaacgcccaggtgacggcattgtgcgcgttgataccgacaaatgcgtcggctgtggctattgcgcctggtcctgcccttatggcgcgccgcagcttaacgagcagaccggccaaatgtccaagtgcgacatgtgcgttgatttactggcgaaaggtgaatcgcccggctgtgtcgcgacctgtccgctggaggccatcaagtttggcccgattgatgaactgcgcgcgaagtacggtagcgtatgcgacgttaacgggctgccagattcatccataaccaaacctaatctggttgtcaaagcgcatcagggcgcagaaaaagagggtaaacgccatgcatga

SEQ ID NO: 67578 - protein, 209 aa, Salmonella enterica subsp. enterica serovar Typhi Ty2
MSQFTHYPPVSDKQLGFFIDSSRCSGCKACQVACKDKNNLEVGRRFRRVYEVKGGSFIPTGQGGVSNNVFAYTLSISCNHCADPVCTKNCPTTAMHKRPGDGIVRVDTDKCVGCGYCAWSCPYGAPQLNEQTGQMSKCDMCVDLLAKGESPGCVATCPLEAIKFGPIDELRAKYGSVCDVNGLPDSSITKPNLVVKAHQGAEKEGKRHA

SEQ ID NO: 67579 - DNA, 618 bp, Salmonella enterica subsp. enterica serovar Typhi Ty2
  CDS (1)..(618): transl_table=11
atgacaacccagtatggattttttattgattccagccgttgcaccggttgcaaaacctgcgaactggcctgcaaggactacaaagatctcactcccgacgtcagcttccgccgcatttatgagtatgcgggcggtgactggcaggaagataacggcgtctggcaccagaacgtctttgcctactatctctccatctcctgtaaccactgcgaagacccggcctgtaccaaagtctgcccgagcggcgcgatgcacaagcgcgatgacggttttgtggtggtgaatgaagaggtctgtatcggctgccgctactgccacatggcctgcccgtacggcgcgccgcagtacaacgcggccaaaggtcatatgaccaagtgcgacggctgttatgaccgggtggcggaaggcaagaaaccgatttgcgtggaatcctgcccgctgcgggcgctggatttcggcccgatagacgaactgcgcaaaaaacacggtgagctggctgccgtcgcgccgttgccgcgcacgcatttcacgaagccgaatattgtgattaaacccaacgccaacagccgcccgaccggggacaccaccggttatctggccaatccgaaggaggtataa

SEQ ID NO: 67580 - protein, 205 aa, Salmonella enterica subsp. enterica serovar Typhi Ty2
MTTQYGFFIDSSRCTGCKTCELACKDYKDLTPDVSFRRIYEYAGGDWQEDNGVWHQNVFAYYLSISCNHCEDPACTKVCPSGAMHKRDDGFVVVNEEVCIGCRYCHMACPYGAPQYNAAKGHMTKCDGCYDRVAEGKKPICVESCPLRALDFGPIDELRKKHGELAAVAPLPRTHFTKPNIVIKPNANSRPTGDTTGYLANPKEV

SEQ ID NO: 67581 - DNA, 558 bp, Salmonella enterica subsp. enterica serovar Typhi Ty2
  CDS (1)..(558): transl_table=11
atgagacgtgcgtttttagtgaatagcgataagtgcatcggctgccgcggctgtgctatggcgtgtaaaagctttaaccaactggagccggatcgcttctggcgctacgtttatccgttggataaagacatctatccacatgaagagcgggcgttttactcgctggcctgtaaccactgcgaacatccggcctgcgtcgccgcctgtccggtcgaagcctataccaaacgtgaagatggcgtggtggtgcataaccctgagcgctgcatcggctgtaaaaactgtattcgtaactgtccttatggcgcgccgcgttttaatgaagagacgcgtaaagcggaaaaatgcagtatatgctacgagcgtcttgatatcggtatgaatccggcgtgcgtgaacgcctgtccggtgggcgccttgtcgattatcgatttggatgccgatcctgtgcccgataatgcggtgcagtatccgccagggttcccgcatatgccacagctcaatccaggaacgcgctttattctggcgcgccagcctaagcagccggaggacaagtaa

SEQ ID NO: 67582 - protein, 185 aa, Salmonella enterica subsp. enterica serovar Typhi Ty2
MRRAFLVNSDKCIGCRGCAMACKSFNQLEPDRFWRYVYPLDKDIYPHEERAFYSLACNHCEHPACVAACPVEAYTKREDGVVVHNPERCIGCKNCIRNCPYGAPRFNEETRKAEKCSICYERLDIGMNPACVNACPVGALSIIDLDADPVPDNAVQYPPGFPHMPQLNPGTRFILARQPKQPEDK

SEQ ID NO: 67583 - DNA, 903 bp, Salmonella enterica subsp. enterica serovar Typhi Ty2
  CDS (1)..(903): transl_table=11
atggcttatcaatcgcaagacatcattcgtcgttccgccactaacggtttcacccccgcgccccaggcgcgggaccaccaggaagaggtggcgaaactcatcgacgtcaccacctgtatcggctgtaaagcgtgtcaggtggcgtgctccgagtggaacgacatccgtgatgaagtgggcaataacgtcggggtgtatgacaacccggcggacttaactgcgaaatcctggacggtgatgcgcttctcggaagtggaacagaacgacaaactggagtggctgatccgtaaggatggctgtatgcactgcgccgatcccggctgcctgaaggcctgtccggcggaaggggcgatcattcagtacgctaacggtattgtcgacttccagtccgagcagtgtatcggctgcggctactgtatcgctggctgcccgttcaacgtgccgcgcctcaacccggaagacaaccgcgtctataaatgtacgctgtgcgttgactgtgtggtggtcggccaggaaccggcctgcgtgaagacctgtccaaccggcgctattcattttggctcgaaagaggatatgaaaacgctggcgggcgagcgggtggcggaactcaaaacccgtggttatgacaatgcgggtctgtacgatccggcgggcgtaggcggtacgcatgtcatgtacgtgctgcatcatgccgacaagccgaatctgtatcacggtctgccggagaacccggaaatcagcgaaaccgttaagttctggaaaggcgtctggaaaccgctcgccgcgttcggttttgccgcgacctttgccgccagcgtcttccactatgtcggcgtcggcccgaaccgcgcggaagaggaagatgacaacctgcatgaagagaaagacgaggtgcgcaaatga

SEQ ID NO: 67584 - protein, 300 aa, Salmonella enterica subsp. enterica serovar Typhi Ty2
MAYQSQDIIRRSATNGFTPAPQARDHQEEVAKLIDVTTCIGCKACQVACSEWNDIRDEVGNNVGVYDNPADLTAKSWTVMRFSEVEQNDKLEWLIRKDGCMHCADPGCLKACPAEGAIIQYANGIVDFQSEQCIGCGYCIAGCPFNVPRLNPEDNRVYKCTLCVDCVVVGQEPACVKTCPTGAIHFGSKEDMKTLAGERVAELKTRGYDNAGLYDPAGVGGTHVMYVLHHADKPNLYHGLPENPEISETVKFWKGVWKPLAAFGFAATFAASVFHYVGVGPNRAEEEDDNLHEEKDEVRK

SEQ ID NO: 67585 - DNA, 618 bp, Shigella flexneri 2a str. 2457T
  CDS (1)..(618): transl_table=11
atgaccacacaatatggattttttatcgattccagccgctgtactggctgtaaaacctgcgaactggcgtgcaaagattttaaagatcttggcccggaagtcagtttccgccgtatttatgaatatgctggcggcgactggcaggaagataatggcatctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcaccacagtacaatgctgaaaaagggcacatgacgaagtgcgatggttgttattcgcgcgtcgccgaggggaaacaacccatatgcgtcgaatcctgcccgctgcgtgcacttgagttcggtccaattgaagagctgcgccagaagcacggcactctggctgccgtcgcgccactgccgcgcgcgcatttcacaaaacccaatatcgttatcaaacctaacgccaacagccgcccgaccggcgataccactggttatctggctaatccggaggaagtgtaa

SEQ ID NO: 67586 - protein, 205 aa, Shigella flexneri 2a str. 2457T
MTTQYGFFIDSSRCTGCKTCELACKDFKDLGPEVSFRRIYEYAGGDWQEDNGIWHQNVFAYYLSISCNHCDDPACTKVCPSGAMHKREDGFVVVDEDVCIGCRYCHMACPYGAPQYNAEKGHMTKCDGCYSRVAEGKQPICVESCPLRALEFGPIEELRQKHGTLAAVAPLPRAHFTKPNIVIKPNANSRPTGDTTGYLANPEEV

SEQ ID NO: 67587 - DNA, 678 bp, Haemophilus ducreyi 35000HP
  CDS (1)..(678): transl_table=11
atgagttgcacccgtagagattttgtctcaggagtaggtgctatcgctgttgtagcaagctcatcgcttgctacaacagtcactcttgcgactgataagaaagaaaaaaatattcgttatgctatggttcatgatgaaacctcttgcattggttgtacggcgtgtatggaggcgtgtcgtaccactaataaggtgcctgaaggcgtttctcgtttagagattattcggagtgagccctatggtgagtttcctaatgttgagtatgaatttttccgtcaatcttgccaacattgtactaatgcaccttgtgttgcggtatgtccaaccggtgcttcatttgttgatcctaacacaggtattgttgatgtagattcagatctctgtgttggttgtcaatattgtattgcggtttgtccatatcgagtacgttttattcatcctgagaaaaagtcggcagataaatgtaatttctgtcgtgatactaatttggcggaaggtaaacaacccgcttgtgttgaggcttgtccaactaaggcattaacgtttggtgatatgaatgattcgaacagcgctgtctttcaaaaagtgaagaataatccggtttatcgtactaaagtcgcattaggcactgaaccaaatttatatcatattccatttggtaagggggagcatagataa

SEQ ID NO: 67588 - protein, 225 aa, Haemophilus ducreyi 35000HP
MSCTRRDFVSGVGAIAVVASSSLATTVTLATDKKEKNIRYAMVHDETSCIGCTACMEACRTTNKVPEGVSRLEIIRSEPYGEFPNVEYEFFRQSCQHCTNAPCVAVCPTGASFVDPNTGIVDVDSDLCVGCQYCIAVCPYRVRFIHPEKKSADKCNFCRDTNLAEGKQPACVEACPTKALTFGDMNDSNSAVFQKVKNNPVYRTKVALGTEPNLYHIPFGKGEHR

SEQ ID NO: 67589 - DNA, 774 bp, Bordetella parapertussis 12822
  CDS (1)..(774): transl_table=11
atgcacaacgcgccctcctccgaccggccgcccgcgcccagcaaacgcggttttctcaaggaattgctggggctggccgccacggccaccgtcatccccatcgcccccgaagcgcgcgccggcatgaacgcccagccgccgcgccgtcccggcgccgcgggcaagcgctacggcatggtggtcgacctacgccaatgcatcggctgccaggcctgcacggtcagctgttcgatggaaaacctgccgcccatcgggcaattccgcaccaccgtgctgcagtacgaggtgctgcccgacgatggcggcccctgttcgatggtgatgctgccgcgcctgtgcaaccactgcgacaacccgccgtgcgtgccggtgtgcccggtgcaggccaccttccagcgcgaggacggcatcgtgctggtggacaacgaacgctgcgtgggctgcggctactgcgtgcaggcctgcccctacgacgcccgcttcatcaaccacgagacccagaccgccgacaagtgcacgttctgcgagcaccgcctggaggcgggcctgctgccggcctgcgtggagagctgcgtgggcggggcgcgcgtcatcggcgacctgaacgaccccgccagcgccgtctcgcggctgctggccgagcaccgcgacgaggtcaaggtgctcaagcccgacatgcgcaccgatccgcatgtgtattacatcggcctgcccgacgcgttcgtcaaccagatcgatggccaggccggcgtgcgcctggccggccggcactga

SEQ ID NO: 67590 - protein, 257 aa, Bordetella parapertussis 12822
MHNAPSSDRPPAPSKRGFLKELLGLAATATVIPIAPEARAGMNAQPPRRPGAAGKRYGMVVDLRQCIGCQACTVSCSMENLPPIGQFRTTVLQYEVLPDDGGPCSMVMLPRLCNHCDNPPCVPVCPVQATFQREDGIVLVDNERCVGCGYCVQACPYDARFINHETQTADKCTFCEHRLEAGLLPACVESCVGGARVIGDLNDPASAVSRLLAEHRDEVKVLKPDMRTDPHVYYIGLPDAFVNQIDGQAGVRLAGRH

SEQ ID NO: 67591 - DNA, 630 bp, Bordetella parapertussis 12822
  CDS (1)..(630): transl_table=11
atggctcgaatgaaatttgtctgtgatgcagagcgctgtatcgagtgcaatgcctgcgtgacggcatgcaagaacgagcacgaagtcccctggggcgtgaaccgccgccgcgtggtgacgctcaacgacggcgtgcccggcgagaagtccatttcggtggcctgcatgcactgcagcgacgcgccctgcatggcggtgtgcccggtcaactgcttctaccgcaccgacgagggtgtggtgctgcacaacaaggacacctgtatcggctgcggctactgttcgtacgcctgtccgttcggcgcgccgcagttcccctccgaaggggccttcggcgtgcgcggcaagatggacaagtgcacgttctgcgccggcgggccggaagagcacggcagcgccgaggagttcgaaaagtacggccgcaaccggctggccgagggcaagctgccggcctgcgccgaaatgtgttcgaccaaggcgctgctggccggcgacggcgacgtggtggccgacatcttccgcacccgcgtgatccatcgcggcaagggcgtggaggtctggggctggggcaccgcctatggctccaagcaggccgggcagccgccggccgccgacgccaaggccaagccatga

SEQ ID NO: 67592 - protein, 209 aa, Bordetella parapertussis 12822
MARMKFVCDAERCIECNACVTACKNEHEVPWGVNRRRVVTLNDGVPGEKSISVACMHCSDAPCMAVCPVNCFYRTDEGVVLHNKDTCIGCGYCSYACPFGAPQFPSEGAFGVRGKMDKCTFCAGGPEEHGSAEEFEKYGRNRLAEGKLPACAEMCSTKALLAGDGDVVADIFRTRVIHRGKGVEVWGWGTAYGSKQAGQPPAADAKAKP

SEQ ID NO: 67593 - DNA, 774 bp, Bordetella bronchiseptica RB50
  CDS (1)..(774): transl_table=11
atgcacaacgcgccctcctccgaccggccgcccgcgcccggcaaacgcggttttctcaaggaattgctggggctggccgccacggccaccgtcatccccatcgcccccgaagcgcgcgccggcatgaacgcccagccgccgcgccggcccggcgccgcgggcaagcgctacggcatggtggtcgacctgcgcaaatgcatcggctgccaggcctgcacggtcagctgttcgatggaaaacctgccgcccatcgggcaattccgcaccaccgtgctgcagtacgaggtgctgcccgacgatggcggcccctgttcgatggtgatgctgccgcgcctgtgcaaccactgcgacaacccgccgtgcgtgccggtgtgtccggtgcaggccaccttccagcgcgaggacggcatcgtgctggtggacaacgaacgctgcgtgggctgcggctattgcgtgcaggcctgcccctacgacgcccgcttcatcaaccacgagacccagaccgccgacaagtgcacgttctgcgagcaccgcctggaggcgggcctgctgccggcctgcgtggagagctgcgtgggcggggcgcgcgtcatcggcgacctgaacgaccccgccagcgccgtctcgcgcctgctggccgagcaccgcgacgaggtcaaggtgctcaagcccgacatgcgcaccgatccgcatgtgtattacatcggcctgcccgacgcgttcgtcaaccagatcgatggccaggccggcgtgcgcctggccggccggcactga

SEQ ID NO: 67594 - protein, 257 aa, Bordetella bronchiseptica RB50
MHNAPSSDRPPAPGKRGFLKELLGLAATATVIPIAPEARAGMNAQPPRRPGAAGKRYGMVVDLRKCIGCQACTVSCSMENLPPIGQFRTTVLQYEVLPDDGGPCSMVMLPRLCNHCDNPPCVPVCPVQATFQREDGIVLVDNERCVGCGYCVQACPYDARFINHETQTADKCTFCEHRLEAGLLPACVESCVGGARVIGDLNDPASAVSRLLAEHRDEVKVLKPDMRTDPHVYYIGLPDAFVNQIDGQAGVRLAGRH

SEQ ID NO: 67595 - DNA, 630 bp, Bordetella bronchiseptica RB50
  CDS (1)..(630): transl_table=11
atggctcgaatgaaatttgtctgtgatgcagagcgctgtatcgagtgcaatgcctgcgtgacggcatgcaagaacgagcacgaagtcccctggggcgtgaaccgccgccgcgtggtgacgctcaacgacggcgtgcccggcgagaagtccatttcggtggcctgcatgcactgcagcgacgcgccctgcatggcggtgtgcccggtcaactgcttctaccgcaccgacgagggtgtggtgctgcacaacaaggacacctgtatcggctgcggctactgttcgtacgcctgtccgttcggcgcgccgcagttcccctccgaaggggccttcggcgtgcgcggcaagatggacaagtgcacgttctgcgccggcgggccggaagagcacggcagcgccgaggagttcgaaaagtacggccgcaaccggctggccgagggcaagctgccggcctgcgccgaaatgtgttcgaccaaggcgctgctggccggcgacggcgacgtggtggccgacatcttccgcacccgcgtgatccatcgcggcaagggcgcggaggtctggggctggggcaccgtctatggctccaagcaggccgggcagccgccggccgccgacgccaaggccaagccatga

SEQ ID NO: 67596 - protein, 209 aa, Bordetella bronchiseptica RB50
MARMKFVCDAERCIECNACVTACKNEHEVPWGVNRRRVVTLNDGVPGEKSISVACMHCSDAPCMAVCPVNCFYRTDEGVVLHNKDTCIGCGYCSYACPFGAPQFPSEGAFGVRGKMDKCTFCAGGPEEHGSAEEFEKYGRNRLAEGKLPACAEMCSTKALLAGDGDVVADIFRTRVIHRGKGAEVWGWGTVYGSKQAGQPPAADAKAKP

SEQ ID NO: 67597 - DNA, 888 bp, Chromobacterium violaceum ATCC 12472
  CDS (1)..(888): transl_table=11
atgccattgcaatccctggatatccaccgccgctccgccagcccgaccgaaagccccaaggtccgccagacgctggaagtggccaagctgatcgacacctccacctgcataggctgcaaggcctgccaggtggcttgttccgaatggaacgacatccgcgaggaagtcggccacaacatcggggtctacgacaaccccaccgacctgtccgccaaggcctggacggtgatgcgcttcgccgaggaggaaagcaacggcaagctggagtggctgatccgcaaggacggctgcatgcactgcgccgaccccggctgtttgaaagcctgtccgtcgccgggcgccatcgtgcagtacagcaacggcatcgtcgacttccaccaggaaaactgcatcggctgcggttactgcatcgccggctgtccgttcaatattccgcgcatcagcaaggaagacaacaaggcttacaagtgcacgctgtgctcggaccgcgtcgccgtcggcctggagccggcttgcgtcaagacctgtcccaccggggccatccagttcggctccaaggaagacatgaaggaagtggcggcggaacgggtggcggatctgaagcggcgcggctatcaacacgccggcctgtacgatccgcaaggcgtgggcggcacccacgtgatgtacgtgctgcaccacgccgacaagccggaacagtactccggcctgccgaacaaccccgaaatcagccccaccgtgcagctgtggaagggcttgctcaagccgctggcgacgataggcatcgccgccgccggcctgttcggcttcctgcactacatcaccgtcgggcccaaccgcgccgatgacgaagcggaaagcgaaacccgcgaggaggacaagcaatga

SEQ ID NO: 67598 - protein, 295 aa, Chromobacterium violaceum ATCC 12472
MPLQSLDIHRRSASPTESPKVRQTLEVAKLIDTSTCIGCKACQVACSEWNDIREEVGHNIGVYDNPTDLSAKAWTVMRFAEEESNGKLEWLIRKDGCMHCADPGCLKACPSPGAIVQYSNGIVDFHQENCIGCGYCIAGCPFNIPRISKEDNKAYKCTLCSDRVAVGLEPACVKTCPTGAIQFGSKEDMKEVAAERVADLKRRGYQHAGLYDPQGVGGTHVMYVLHHADKPEQYSGLPNNPEISPTVQLWKGLLKPLATIGIAAAGLFGFLHYITVGPNRADDEAESETREEDKQ

SEQ ID NO: 67599 - DNA, 678 bp, Wolinella succinogenes DSM 1740
  CDS (1)..(678): transl_table=11
atggaacaggatggcagaagaagactatttttgaaatatataggagcgggcaccgcggtggtgggttcggcgctctcaggggtgagggccaatcaagaggtggaatctgtaggagagaagcctcattatgggatggtatttgaccaaaacaagtgcgtgggatgcacggagtgcgaggtgatgtgtaaaaaggtcaatagtgttccgcaggggcaagctagactctatgtgcaaaacaaaactaaccccgagactccaatggagaagcgatacactcgtgtctcctgccagcagtgcgaggatgcaccatgcgtttcggtctgtccaaccaaggcttgtcataaagatgaacaaacaggaatcgtcacaatgaatcctgaggattgcatcgcttgcaaatattgcatcgtggcgtgtccctatgatgttcgattcatcaatcatgagaccaaggcagcggagaattgcaatttctgtcttggcactaagctggccaaaaatgaggagcccgcgtgcgttcaagcctgtaaatacaaagcgctcgtctttggcgatctcaatgacaaagattcctatatcaatcagattttaggggtcaaagattcggtgcgcatgaagccattttttggcaccaaacccagcttgcgctacatacctgttgtgaaagtaggagtttag

SEQ ID NO: 67600 - protein, 225 aa, Wolinella succinogenes DSM 1740
MEQDGRRRLFLKYIGAGTAVVGSALSGVRANQEVESVGEKPHYGMVFDQNKCVGCTECEVMCKKVNSVPQGQARLYVQNKTNPETPMEKRYTRVSCQQCEDAPCVSVCPTKACHKDEQTGIVTMNPEDCIACKYCIVACPYDVRFINHETKAAENCNFCLGTKLAKNEEPACVQACKYKALVFGDLNDKDSYINQILGVKDSVRMKPFFGTKPSLRYIPVVKVGV

SEQ ID NO: 67601 - DNA, 564 bp, Wolinella succinogenes DSM 1740
  CDS (1)..(564): transl_table=11
atggcaagatacgcgatggccttagactataaaaactgtatcaactgcaaggcgtgcgaaaccgcctgcaaagaagagaacaatgtccccttgggcgatgagtattatcgaatttgggtgggagtgaaagagacagagggtgaatatcctttacttaacttttctcaaatgcgtttcatcccaagccaatgccaacattgcgaaaatgctccctgccaagaggtctgccctaccaatgcaacctattatgatgagcgcggctttgtttcggttgatcccaagaagtgcatcatgtgcacctactgcatgacagcttgcccctacgatgcaagatatgttgatcctagggctcatatcgttcaaaagtgcaacttctgttcagagacacgattggcacgaggagagactacgaccgcttgtcaagccacttgccccaccaaagtcagagtctttggcgacttggacgatccccatagtgaaatctctaagctcctccgagagcgtgagcattggacgatcaagccacatttgggcaccaagcctaagctcttttatctagtatag

SEQ ID NO: 67602 - protein, 187 aa, Wolinella succinogenes DSM 1740
MARYAMALDYKNCINCKACETACKEENNVPLGDEYYRIWVGVKETEGEYPLLNFSQMRFIPSQCQHCENAPCQEVCPTNATYYDERGFVSVDPKKCIMCTYCMTACPYDARYVDPRAHIVQKCNFCSETRLARGETTTACQATCPTKVRVFGDLDDPHSEISKLLREREHWTIKPHLGTKPKLFYLV

SEQ ID NO: 67603 - DNA, 699 bp, Wolinella succinogenes DSM 1740
  CDS (1)..(699): transl_table=11
atggcaaaaaattatgcaatggtcatagacctgaatcgatgcgttggatgtggcgcctgcgacttggcttgtaaaagcgaaaacaatacacccgtgggaatccattggtcaaatcacgtggtggagaccacaggggttttccctaatgtaggctttacttatagacccactctttgtaatcactgcgatgatgctccttgtgtgagggcttgtccaacgggagcgatgtataaagataaagagagtggcatgacgctccacaatgctgataagtgcattgggtgcaagagctgtatgttggcagacccctatcacgtcatctactacaactccaaacaacctcactataagtggacgactactaagcctacggtaatggggatgttttcacccaaggagatggcggataagtcaggtgctccctacccatactttaacgtggagcgaggtaaaacctatgaggcattacgttttaaaggcttggtggagaagtgcagtttttgtgatcatcgagtcaaggcaggcctcatgccgcattgcgtggtctcttgtccgggagatgcaagaatctttggcgatctgaatgatcccaaaagttctgtgagtcagcttttggctcaatatcctgcagagacgcttcttcctcacaaaggaaccaaagcgaaagtgttctatatccgaagttatgcgagggcttaa

SEQ ID NO: 67604 - protein, 232 aa, Wolinella succinogenes DSM 1740
MAKNYAMVIDLNRCVGCGACDLACKSENNTPVGIHWSNHVVETTGVFPNVGFTYRPTLCNHCDDAPCVRACPTGAMYKDKESGMTLHNADKCIGCKSCMLADPYHVIYYNSKQPHYKWTTTKPTVMGMFSPKEMADKSGAPYPYFNVERGKTYEALRFKGLVEKCSFCDHRVKAGLMPHCVVSCPGDARIFGDLNDPKSSVSQLLAQYPAETLLPHKGTKAKVFYIRSYARA

SEQ ID NO: 67605 - DNA, 810 bp, Wolinella succinogenes DSM 1740
  CDS (1)..(810): transl_table=11
atggcacacaagacgccactgagccgtcgagattttgtgcaaaaagcagggattttgcttgcaggaggaacggcgcttggagggaatcaagcccaagcgatcagcctccaaaatcctggtcgagatgccaaagaggctcgttatattggacaagagggaaagcgctttgggatggtgattgatctgagattgtgtgtgggatgccaagcctgcacgagcgcttgtaaaagtgaaaatagagtccccaaagataagtttcgaacctatgttcctgaatatgaattagggagctatccgagcgtgcgaaaagcttttttacctcagctttgcaaccactgcgaagccccttcgtgcgtgagcgtctgtcctacgggagccaccttcaagcgcacggatggaatcgtggttgtggacaacaccatttgctgggggtgtggctactgtcttaatgcctgtccttatgacaaacgctatttcaatcctctcaccaaagttgcagacaaatgcactctttgcgcccatcgagtggatgcagggctcttaccagcgtgtgtggagagctgcgtaggaggggcgagaatttttggtgacttgaatgatcctcatagcgcagtctcaaagctgcttcaaaacgctcccgcttcagtgctcaaccctgctcaggggactaaaccaagagttttttacatcggacttagccatgagatacagagcattcccgtgagtcaagccgtgctggatgattgggcaaagaagctagatggcttagcccctagcgaatgggctagcacctatgaaggaggaaaatag

SEQ ID NO: 67606 - protein, 269 aa, Wolinella succinogenes DSM 1740
MAHKTPLSRRDFVQKAGILLAGGTALGGNQAQAISLQNPGRDAKEARYIGQEGKRFGMVIDLRLCVGCQACTSACKSENRVPKDKFRTYVPEYELGSYPSVRKAFLPQLCNHCEAPSCVSVCPTGATFKRTDGIVVVDNTICWGCGYCLNACPYDKRYFNPLTKVADKCTLCAHRVDAGLLPACVESCVGGARIFGDLNDPHSAVSKLLQNAPASVLNPAQGTKPRVFYIGLSHEIQSIPVSQAVLDDWAKKLDGLAPSEWASTYEGGK

SEQ ID NO: 67607 - DNA, 654 bp, Wolinella succinogenes DSM 1740
  CDS (1)..(654): transl_table=11
atggaaaaaaatcaacaatttggattctatctcgaccagacaagatgcgtgggctgtcgaacctgtcaaatggcttgcaaggatggcaaagattctccactgggagtgaattttagacgcgtagtggagttcgagggaggcgcttggctcaccgaaaatccagacacccccacacccgtgggtgtcttcgcctactacacctccatagcgtgcaatcattgcgacgatcccgcctgtatcaaagcctgcccaacgggcgcgatgcacaaagggctatatggaattgtcgaggtgaatcaaagtcgctgtatcggctgtaaagcctgcgcgatggcctgtccttatggagcgccccaatttgactcacgccaaggacacatgagcaagtgcgatggttgcaaaactcgtttggaggagaatctagccccactttgcgtggaatcatgcccctttagagcgcttgaggcaggccctatcacagagcttagagccaagcatggccacgctgcttccatcgccccccttcccccttatgagcgcacccgtcccaatctctgcctcaaaccagagaaaaattcccagccctcaggtgattctagaggcattttccatcttccacaaaaccattcggaggtgaatcatgacattgtctaa

SEQ ID NO: 67608 - protein, 217 aa, Wolinella succinogenes DSM 1740
MEKNQQFGFYLDQTRCVGCRTCQMACKDGKDSPLGVNFRRVVEFEGGAWLTENPDTPTPVGVFAYYTSIACNHCDDPACIKACPTGAMHKGLYGIVEVNQSRCIGCKACAMACPYGAPQFDSRQGHMSKCDGCKTRLEENLAPLCVESCPFRALEAGPITELRAKHGHAASIAPLPPYERTRPNLCLKPEKNSQPSGDSRGIFHLPQNHSEVNHDIV

SEQ ID NO: 67609 - DNA, 798 bp, Vibrio vulnificus YJ016
  CDS (1)..(798): transl_table=11
atgatgttcatgccaataaagccaaagtgttgggcttggagcgcaaagagaaaatcaagatgtgtgtggattgccactctgactttaaccagaaagaagaggagaggtaatatgagttgttcaagacgaaatttccttgctggtggtggcgcgttgatcatgacaacgggcattgctggcacttctatggtgactgggcgcttagcatttgcggaagaggataagggccaagcaattcgttatggcatgatccacgacgagaccgcctgtatcggatgtacggcttgtaccgatgcctgccgagaggtgaacaaagtccctgaaggcgtaagtcgattggagatcatacgcagtgagccgcacggtgagtacccgaatgtcgattaccgttttacccgtaaatcttgccaacactgtgaaaacccaccttgcgtttacgtgtgtcctaccggtgcggcgtacaaagatgaaaaaaccggcatcgtggatgtccacaaagaaaaatgtgtcggttgcggctattgccttgccgcgtgcccatatcaagtacgtttctttaacccagttgatcactcggccgataaatgtaatttttgtcgtgacaccaatttggcgcaaggcaagctacccgcctgtgtggaatcttgtccaactaaggcactgatttttggtgatttaaatgatccgcaaagtgacgtgaatcgagtattggctgagaaggtctattaccgagacaaagtgcacttaggcacgaaacccaaattattcaaaatcccacatcaaaaaggggaggtgtag

SEQ ID NO: 67610 - protein, 265 aa, Vibrio vulnificus YJ016
MMFMPIKPKCWAWSAKRKSRCVWIATLTLTRKKRRGNMSCSRRNFLAGGGALIMTTGIAGTSMVTGRLAFAEEDKGQAIRYGMIHDETACIGCTACTDACREVNKVPEGVSRLEIIRSEPHGEYPNVDYRFTRKSCQHCENPPCVYVCPTGAAYKDEKTGIVDVHKEKCVGCGYCLAACPYQVRFFNPVDHSADKCNFCRDTNLAQGKLPACVESCPTKALIFGDLNDPQSDVNRVLAEKVYYRDKVHLGTKPKLFKIPHQKGEV

SEQ ID NO: 67611 - DNA, 609 bp, Vibrio vulnificus YJ016
  CDS (1)..(609): transl_table=11
atggctagaatgaaattcctctgcgacaccaaacgctgcatcgaatgcaacggctgtgtgaccgcttgtaaaaatgaaaacgacgacgcattagagtggggcattcagcgccgccgcgtagttaccttgaacgatggtgaaccgggcgaaaactccatctcagtggcctgtatgcactgtaccgatgccccttgtatggcggtttgtcctgcagactgttttgaacataccgaagatggcattgtgctccacaacaaagatctgtgtatcggttgtggttactgcctgtttgcttgcccatttggtgcgcctcagttcccgaaacaagcctcatttggcgagcgtggcaaaatggacaagtgtactttttgcgccggtggtccaaacaccgaaccgggctcagaagaagagcgtcagaagtatggtgccaaccgtatcgcagaaggcaaactgccaatgtgtgcttcgctgtgttcaactaaggccctcttggcaggtgatgcagagaaaatctccgatatcttccgtcaacgtgtcgtggaacgtggtgcaaaagaggccggttggaccaacggtgaagatctatcctacgatgcaactcgcagctaa

SEQ ID NO: 67612 - protein, 202 aa, Vibrio vulnificus YJ016
MARMKFLCDTKRCIECNGCVTACKNENDDALEWGIQRRRVVTLNDGEPGENSISVACMHCTDAPCMAVCPADCFEHTEDGIVLHNKDLCIGCGYCLFACPFGAPQFPKQASFGERGKMDKCTFCAGGPNTEPGSEEERQKYGANRIAEGKLPMCASLCSTKALLAGDAEKISDIFRQRVVERGAKEAGWTNGEDLSYDATRS

SEQ ID NO: 67613 - DNA, 768 bp, Vibrio vulnificus YJ016
  CDS (1)..(768): transl_table=11
atggattctagtaaacgtcgttttctcagcgccgtaagggcgggcgcagcgcttatccccatagctgggataggcacggcaactgcaggcacggtgatcagaaataacaaccaagccgatcgtaaaggtcaggtgggtaaacgttacgcaatggtggttgacctgcgtaaatgtgtcggctgtcaggcgtgcaccgtgggttgcagtattgagaaccaagcgccaataggccagttccgcacaacggttaaacagtatgaagtgactttagatgatggttcatcggtgatgcaagaagtgaagtctttcatgttgccgcgtctttgcaatcactgtgataacccaccttgtgttgcggtgtgtccggtccaagctacctaccaacgtgaagatggcatcgtgatggtggataacagccgctgtgtggcttgcgcatattgcgtgcaagcctgtccttatgatgcgcgctttattaaccaagagacgctgaccgcagataaatgcacgttctgcgcccaccgtcttgaagaaggactattacccgcttgtgttgaaacctgtgttggcggcgcccgtgtgattggcgatcttaacgatccaagtagcgaagtgaatcgtctacttaatgtgtatcgtgacgacattaaagtgcttaagccaaacgaagagaccaaaccgcatgtgttctacatcggcatgaatgaacgtttcaccaatcatatcgaaggccaagcggcgatttatgatccgcaaggagaaagcgtatga

SEQ ID NO: 67614 - protein, 255 aa, Vibrio vulnificus YJ016
MDSSKRRFLSAVRAGAALIPIAGIGTATAGTVIRNNNQADRKGQVGKRYAMVVDLRKCVGCQACTVGCSIENQAPIGQFRTTVKQYEVTLDDGSSVMQEVKSFMLPRLCNHCDNPPCVAVCPVQATYQREDGIVMVDNSRCVACAYCVQACPYDARFINQETLTADKCTFCAHRLEEGLLPACVETCVGGARVIGDLNDPSSEVNRLLNVYRDDIKVLKPNEETKPHVFYIGMNERFTNHIEGQAAIYDPQGESV

SEQ ID NO: 67615 - DNA, 774 bp, Geobacter sulfurreducens PCA
  CDS (1)..(774): transl_table=11
atgaatagacgcgagtttctcagacggagcatggtggttgtcgcggggttggcggtgccggcggcggctctggagcttgtcgacccgaaaaggctgctggcggcacggccggagttgcgctgggcctttctggttgatacctacaaatgcgtggggtgtggcttctgtgtcaaggcgtgcaaggtggagaacgaggtcccctacgaggccaacgtgactcgtacgtgggtcgagcgttacgtggtgaaaccggatggcgaggttctcattgattcgccacgtggcgcccgcgacggtttcaccgataagagaatcgaggtcggaacggggaaaccccgggacgtgggggatgaagaggtggaaaaagccttctttgtcccaaaactctgcaatcagtgcgacaacccgccctgcgtccaggtctgccccgtgggggccacctacaagaccgtcgacggggtcgtgctcgtggaccgctcatggtgcatcggctgcggctattgcatcatggggtgcccgtacggggtccgtttttttcatccggtgcacaaggtggcggagaagtgcaacttctgttaccaccggatttcccaggggcaggcgacggcgtgcgtcgacgcctgcccgttcggcgcccgccggatcggcaatcttcgcgatccgcatgacccgatcaccaagatcatcatggccgggcgggtcggcatcctcaaggaagagtacggaaccaagccccaggtctactatgtggggctctccaaggaggtacgctag

SEQ ID NO: 67616 - protein, 257 aa, Geobacter sulfurreducens PCA
MNRREFLRRSMVVVAGLAVPAAALELVDPKRLLAARPELRWAFLVDTYKCVGCGFCVKACKVENEVPYEANVTRTWVERYVVKPDGEVLIDSPRGARDGFTDKRIEVGTGKPRDVGDEEVEKAFFVPKLCNQCDNPPCVQVCPVGATYKTVDGVVLVDRSWCIGCGYCIMGCPYGVRFFHPVHKVAEKCNFCYHRISQGQATACVDACPFGARRIGNLRDPHDPITKIIMAGRVGILKEEYGTKPQVYYVGLSKEVR

SEQ ID NO: 67617 - DNA, 834 bp, Geobacter sulfurreducens PCA
  CDS (1)..(834): transl_table=11
atgagtgccggagccatcgactattcaaaaaccaagacgttcctgatcgataccaccaagtgcaccggctgccgcggctgccaggtggcctgcaagcagtggaaccagctgaaggccgagaatacgaccttcttcaccggcgaaggctaccagaacccgccggggatgagtgaattcaccttcacccgggtcaagttcaaggactaccagaagcacggccagaacgagttcgccttctacaaggagatgtgcatgcactgcaacgatcccgcatgcgcctccgtctgccccgtgggtgccttcgagaagaccgccgaagggccggtggtctaccactccaagaagtgcatcggctgccgtttctgcatggtggcatgccccttcggcatccccaagtacgagtggagcaaggcgttcccgctggtcaagaagtgcacgggctgctacagccgggtgaagaacggcctcgatcccgcctgcgccaccgcctgccccacggccataacctacggtccccgggatgaaatgatcaaggaggccgagaagcggatgtccgccaggcccgaccgctacgtgaaagtggtctacggcaaggaagaggccggcggcaccacggtcctctacctgacccagcagcccctggacgagctcggcttcaagccggtcaccaagcggccgctgccgtcctacacctggcaggccctgcgcctcgtgccggggatcttcctgaccgtgggcggcaccctctccctcattacctggttccagcaccgcaaggaccgggtccggaaggaagaagaggagcagaagaaccgcaaggaggggaaccaatga

SEQ ID NO: 67618 - protein, 277 aa, Geobacter sulfurreducens PCA
MSAGAIDYSKTKTFLIDTTKCTGCRGCQVACKQWNQLKAENTTFFTGEGYQNPPGMSEFTFTRVKFKDYQKHGQNEFAFYKEMCMHCNDPACASVCPVGAFEKTAEGPVVYHSKKCIGCRFCMVACPFGIPKYEWSKAFPLVKKCTGCYSRVKNGLDPACATACPTAITYGPRDEMIKEAEKRMSARPDRYVKVVYGKEEAGGTTVLYLTQQPLDELGFKPVTKRPLPSYTWQALRLVPGIFLTVGGTLSLITWFQHRKDRVRKEEEEQKNRKEGNQ

SEQ ID NO: 67619 - DNA, 918 bp, Geobacter sulfurreducens PCA
  CDS (1)..(918): transl_table=11
atgaaaagcacgactagacgcgatttcctcaagatgatggggatgaccggcgccgcctgcctggcgtgcgccgcgcccctgtcggcctccacgggcccggccggcgagagcgaaaccgccatcgccatgctttacgacgccaccaagtgcgtggggtgcaaggcgtgcatggcagcctgcaagcgggtcaacatggagcagaacaatctctcctacgagtacctgcccaccgacggggacaaactctgggacgcccccaaggacctgtccggcgacacccgcacggtcatcaagctctacaaggagtccgacacccgcttctcctacgtgaagcactcctgtatgcactgcacgaagcccggctgcgtgtccgcctgcccggtcaaggccatgaccaaggacccggtcaccggcgtggtggcctacaacaagaacgcctgcatcggctgccgctactgccaggtggcctgtccctacaacatcccccgcttccagtgggacaaggcgctgccccagatcgtcaagtgcgatttctgcaaggacacgaacctgaaggccaaggggatgcccgcctgcagcgagacctgccccgccggcgccattgccttcggcaagcgcacggatcttctggccgaggcccacaaccggatcaaggagaacccggaccgctacattccaaaggtctacggcgagaaggaagttggcggcgccaaccacctgtatctggccgccttcccgttccagaagctgggcctgcccgaactgaaggaggagtcgcccgccgccttctccgagcatatccagcacaccatctacaaggggttcatcgccccggttgccctctacgggaccctggcggccattgccctcaggaacaagaagaagcaggaagatctcggacacggggaggacgattaa

SEQ ID NO: 67620 - protein, 305 aa, Geobacter sulfurreducens PCA
MKSTTRRDFLKMMGMTGAACLACAAPLSASTGPAGESETAIAMLYDATKCVGCKACMAACKRVNMEQNNLSYEYLPTDGDKLWDAPKDLSGDTRTVIKLYKESDTRFSYVKHSCMHCTKPGCVSACPVKAMTKDPVTGVVAYNKNACIGCRYCQVACPYNIPRFQWDKALPQIVKCDFCKDTNLKAKGMPACSETCPAGAIAFGKRTDLLAEAHNRIKENPDRYIPKVYGEKEVGGANHLYLAAFPFQKLGLPELKEESPAAFSEHIQHTIYKGFIAPVALYGTLAAIALRNKKKQEDLGHGEDD

SEQ ID NO: 67621 - DNA, 480 bp, Geobacter sulfurreducens PCA
  CDS (1)..(480): transl_table=11
atgcagaagctgatccgcgtcgagccggccaaatgcgtcggctgcaagtcgtgcgagctggcctgttcgttcaggcaccgcggggagttcgcgcccagcaaggcccgcatcgtcaatgaggttttcctggaggaggccaagttcatcaccgtcacctgcatgcagtgcgacgatccctggtgcctcaaggcatgccccaagggggccatcgccaaagatgcggccagcggcgtggtggcagtggacgagctgaagtgcgtgggctgccgcacctgcgtcagcgcctgtcccttcggcatgatcaagtaccttcccgagaccaggaaggccgacaagtgcacgctctgcgctcccgatgtacccgaatgcgtcatcttctgccccacccactgcctgacattcgccgaggaagacgcgccgctgcgggcaaaggtgctcaaattcgtccagaccgtcaaagacggccagatggaggtgtga

SEQ ID NO: 67622 - protein, 159 aa, Geobacter sulfurreducens PCA
MQKLIRVEPAKCVGCKSCELACSFRHRGEFAPSKARIVNEVFLEEAKFITVTCMQCDDPWCLKACPKGAIAKDAASGVVAVDELKCVGCRTCVSACPFGMIKYLPETRKADKCTLCAPDVPECVIFCPTHCLTFAEEDAPLRAKVLKFVQTVKDGQMEV

SEQ ID NO: 67623 - DNA, 975 bp, Mycobacterium avium subsp. paratuberculosis K-10
  CDS (1)..(975): transl_table=11
atgggccagctgaccggaccgaccgacccggccgccgacgccggctgggcggatcgcaagccgcgcaagggttttttcaccgacacctcgatctgcatcgggtgcaaggcctgcgaggtcgcctgcaaggaatggaaccgcaacccgcaggacggcgacctcgagctgctgggctcgtcctacgacaacaccggcgcgctgggcgccagcacctggcggcacgtggccttcgtcgaacagggtcgcgaacgcatcgagcaggcacgcgaatccggcagggcgctcatcgatttgggcatgccgaccctccccggcgcggcctccgagccgaccgagccggcggtgccgcacaccccggagttccgctggctgatgtcctcggacgtctgcaagcactgcacgcacgccggctgcctggacgtctgccccaccggcgcgctgtttcgcaccgaattcggcacggtggtggtgcagcacgacgtctgcaacggatgcggcacctgcgtggcgggctgcccgttcggggtcgtcgagcggcgcaacgacgggacctacgcgacaccggcgcaacggccggaccgccccagcgaggagatcgtcaccggcgtcgcgcagaagtgcacgctgtgttacgaccggctgctcgaggacgagatcccggcgtgcgccaagacctgccccaccacctcgatcaagttcggcgaccacgacgacctggtggccatggcgcgccggcgggtggccgccctgcacgcccaggggctcaccgaggcccggctgtacggggccaacgagcacgacggcgtcggcggcaccggctccatcttcttgctgctcgacgaacccgaggtctacggtctgccgcccgacccgcgggtgtgcaccgccgacctgacgaccatgttcaagcgggccgggctggccgcggccggcatggtcggggcggccgtgctggcgttttggaggagccggtga

SEQ ID NO: 67624 - protein, 324 aa, Mycobacterium avium subsp. paratuberculosis K-10
MGQLTGPTDPAADAGWADRKPRKGFFTDTSICIGCKACEVACKEWNRNPQDGDLELLGSSYDNTGALGASTWRHVAFVEQGRERIEQARESGRALIDLGMPTLPGAASEPTEPAVPHTPEFRWLMSSDVCKHCTHAGCLDVCPTGALFRTEFGTVVVQHDVCNGCGTCVAGCPFGVVERRNDGTYATPAQRPDRPSEEIVTGVAQKCTLCYDRLLEDEIPACAKTCPTTSIKFGDHDDLVAMARRRVAALHAQGLTEARLYGANEHDGVGGTGSIFLLLDEPEVYGLPPDPRVCTADLTTMFKRAGLAAAGMVGAAVLAFWRSR

SEQ ID NO: 67625 - DNA, 3102 bp, Bdellovibrio bacteriovorus HD100
  CDS (1)..(3102): transl_table=11
atgaaaaaagcgcttcgcccgaaagtggagcgcgacacaaaatactggaacagtcttgaacaatggagcaacgatccagagttcaacaaaattgcttccactgaattccagtcctctccattgcgtgagagtgacgatgaaggcggctgggcacgccgtgaattcctgaagctgatgggtgcatcccttgcgatggcttctgcaggttgcatccgtcgtccggttcagaaaatcgttccttacaataaacaaccagaagaagtgactctgggtatggcgaactactatacctctgcttacttcgatggttctgacgctttgggtgttttggttaaaacacgtgaaggccgtcctattaaaattgaagcaaaccctggtcatccattcagcatcagcggtttgagcatccgttcccaggcttctttgttgtccatgtatgatcctgaaagactgaaaggtcctcagcgcaacctgttcaacgaaaagaaatccaacagccaggttatcgacgttaagtgggaagacctggataaaaaagttgctgagcagctgaaaaaaggtgacgttgtcatcctttccggcaacgtggcttctccggcaacccgcgcggtgatcggtgatttcgctcaaggtttcaaagccaaacacgtggtttgggaagctctttccaatgacgacgttcgtgaaggtcaaaaagcctcttacggcgacgacgtggttccggcgttccgcttcgataaagcgaaaatgatcgtttccatcgacgctgacttcctgggtacatggatttctcctacagcgttcacgaatcagttcgttgaaggccgtaaagacatcaaaaacatgaaccgtttggtgtccttcgattctaattactctttgactggcgccaatgcggacatccgcatgaaaatcaagccttcccagcaactggatgttgtgatgggtcttcttcacgaaatcatcgtgaagaaaggtgcttcctctcacgctggcaacagcgcggtgaaagcggctttggctccgtttgctgacgtggctaaaaaactgaatgtggaacctgctttgttcgcgaaagtggcggcagatctttgggctaatcagggcacttccctggtggttgcaggtggtatcaccactctgactgaaaaatccaaagaacttcaggtggcagtgaacttcctgaactccatcctgggtaacgacggcaagacagttgaccacaacggtggaaacaaaggtgacaaagcttctcaggcggatatggctgctttgatcaaagacatgaaagatggcaaagtgaaaactttgatcatccaccgtgtgaatccaggcttcgttctgggcgcggacatgggctttgctgaggctatcaaaaaagtcgacctggttgtttacacaggtgaccgtatcgacgaaacaggcgtctttgctgactacatcactccggacaaccacgcgttggaatcctggagcgatatggaactggcttccggtgtttacagcatctgccagccgtccatccgtccaatgtacgacactcgttccttccagttgtcattgatgacttgggcgtaccttgcgaacatgggtccatcccgtcttcgtgactacgagaccttctatgattacctgcgcgtcttctggaaatctgacatcttccctaaatacggaaaaggtcagtccttcgaggacttctggcagacggctctgcaaaaaggttatgtcggggagatcaactctggttcttcttctcgttccttcaaagtggatgcattcacatccatcaaacctgcagcggcaaaagaaggctttgaactggctctttattccacttctcaacacggtgatggatcgcttgcgaacgtttcctggttgcatgagcttccagatccagtgaccaaagcagtttgggacaactatgtgatggtttctttggcgacggctgaaaagcacggcctgaaacaagcgactgtggttgaactgactgtgggcggtaaaaccctggaacttccagtgttgatccagccgggtctgcatgatgacgttttggcagtggctgtcggcttcggtcgcacgcgcgctggtaaagtgggtaatggcatcggtcaaaacgcctttgtctttgtgactgctaaagacggtaaaactgttgccgctggttcttcagcgactttcaagaaaacttccaaaaagtatgaacttgcgatcacgcaaggtcaccacacaatggaaggccgtacgatcgccgttgaagcgacattggctgattacaacaaaaagaaatccacaggcatcccgcacccacacgtttggtccatctggtccggccacgaatacagtggtcacaaatggggcatggcggttgatcttcactcctgcacaggctgttcttcctgcgtgattgcatgtcaatccgagaacaacatcccggttgtgggtaagcgctatgtgatcgaaggtcgtgaaatgcactggttgcgtatcgaccgttactacatcggcaatccggaaaacgcagaagcggtcttccagccggtgatgtgccaacactgtgacaatgctccgtgcgaaacggtgtgtccggttctggcgacggttcactctgacgagggtctgaacgacatggtttacaaccgttgcgttggtactcgttattgcgcgaataactgcccgtacaaagtacgtcgtttcaactggttcaactatgcgaaactgatcgagaagccgatgcacatggctctgaatccttctgtgggtgttcgtacccgcggggtgatggagaaatgtacattctgcgttcaaagaatccaggatgccaaaacagtggctcgcaatgaaaaacgtcagttgaaagacggggatgttaaggttgcgtgtcagactgcatgtcctgcaggcggtatcgtattcggcgacctgaacgatccaaacagtgcggtagccaaaatcttcaaaactgaagaacgtggttacgcacttcttgaagagtggcatgcggctccgtccgttcgctatctttccaagatccgtaacaatgataaagaatcaactggtgatcaaaaaggtcacggtactgcaaaacaaggtgagcactcatga

SEQ ID NO: 67626 - protein, 1033 aa, Bdellovibrio bacteriovorus HD100
MKKALRPKVERDTKYWNSLEQWSNDPEFNKIASTEFQSSPLRESDDEGGWARREFLKLMGASLAMASAGCIRRPVQKIVPYNKQPEEVTLGMANYYTSAYFDGSDALGVLVKTREGRPIKIEANPGHPFSISGLSIRSQASLLSMYDPERLKGPQRNLFNEKKSNSQVIDVKWEDLDKKVAEQLKKGDVVILSGNVASPATRAVIGDFAQGFKAKHVVWEALSNDDVREGQKASYGDDVVPAFRFDKAKMIVSIDADFLGTWISPTAFTNQFVEGRKDIKNMNRLVSFDSNYSLTGANADIRMKIKPSQQLDVVMGLLHEIIVKKGASSHAGNSAVKAALAPFADVAKKLNVEPALFAKVAADLWANQGTSLVVAGGITTLTEKSKELQVAVNFLNSILGNDGKTVDHNGGNKGDKASQADMAALIKDMKDGKVKTLIIHRVNPGFVLGADMGFAEAIKKVDLVVYTGDRIDETGVFADYITPDNHALESWSDMELASGVYSICQPSIRPMYDTRSFQLSLMTWAYLANMGPSRLRDYETFYDYLRVFWKSDIFPKYGKGQSFEDFWQTALQKGYVGEINSGSSSRSFKVDAFTSIKPAAAKEGFELALYSTSQHGDGSLANVSWLHELPDPVTKAVWDNYVMVSLATAEKHGLKQATVVELTVGGKTLELPVLIQPGLHDDVLAVAVGFGRTRAGKVGNGIGQNAFVFVTAKDGKTVAAGSSATFKKTSKKYELAITQGHHTMEGRTIAVEATLADYNKKKSTGIPHPHVWSIWSGHEYSGHKWGMAVDLHSCTGCSSCVIACQSENNIPVVGKRYVIEGREMHWLRIDRYYIGNPENAEAVFQPVMCQHCDNAPCETVCPVLATVHSDEGLNDMVYNRCVGTRYCANNCPYKVRRFNWFNYAKLIEKPMHMALNPSVGVRTRGVMEKCTFCVQRIQDAKTVARNEKRQLKDGDVKVACQTACPAGGIVFGDLNDPNSAVAKIFKTEERGYALLEEWHAAPSVRYLSKIRNNDKESTGDQKGHGTAKQGEHS

SEQ ID NO: 67627 - DNA, 588 bp, Thermus thermophilus HB27
  CDS (1)..(588): transl_table=11
atgccccgctacgccatggccattgacctaagcctctgcgtgggctgcgccgcctgcgccgtggcctgcaagatggaaaacgaggtccctcccggggtcttcaacctctggatccgggagcgggaggtgggggaataccccaacctggtggtggagttccgccccgagcagtgcctgcactgcgaaaaccccccttgcgtgcccgtctgccccacgggggccagctaccaaaccaaagacggcctggtgctggtagaccccaaaaagtgcatcgcctgcggggcctgcattgccgcctgcccctacgatgcccgctacctgcacccggcaggttacgtgagcaagtgcaccttctgcgcccaccggctggaaaagggcaaggtgccggcctgcgtggagacctgccccacctactgccgcacctttggcgacctggaggacccggaaagccccgtggccaaggcccttaaggcggcagagcgggtggacgtgctaaggcccgagcagggtacaaggcccaagctcttctacctgaacgccccttccaagaaggggctcacccgggaaagcgaggtgcaccatggctga

SEQ ID NO: 67628 - protein, 195 aa, Thermus thermophilus HB27
MPRYAMAIDLSLCVGCAACAVACKMENEVPPGVFNLWIREREVGEYPNLVVEFRPEQCLHCENPPCVPVCPTGASYQTKDGLVLVDPKKCIACGACIAACPYDARYLHPAGYVSKCTFCAHRLEKGKVPACVETCPTYCRTFGDLEDPESPVAKALKAAERVDVLRPEQGTRPKLFYLNAPSKKGLTRESEVHHG

SEQ ID NO: 67629 - DNA, 1002 bp, Desulfovibrio vulgaris subsp. vulgaris str. Hildenborough
  CDS (1)..(1002): transl_table=11
atgagcagatactgtatcgtcaccgaccaggaccgctgcatcagctgcaaggcgtgcgaggtgcattgcaaggtcgccaacaacgtccccgtcggggcgcgtctgggcatgcacatcgcctccggaccgcacgacgtggacggcaggcccgacatccgcaccatgttcatgccctgcttccagtgcgacgaaccgtggtgcgttcccgtttgccccacaggggccatcgccaagcgcgaaagcgacggcatcgtcgccatcgacgcggacacgtgcgtcggctgcaaggcgtgcatcaccgcctgcccgtggcgcgtaccgcaatggaaccccgtcaccgaaaaggccgtcaaatgcgacctgtgccgcgaccgtctcgacgccgggctgcgacccgcctgcgtcaccgcctgcaccacacacgcccttgaactggtttccgcagaggtgggcgcatccctgccctgtaccggcatcgacgccgtgcgcaaggtggcggcgcgcccggtgcctgcctccatgccccccgccccgaaaggtcagcggcagccgcgcctcggtgatgtggagaaggccatcgccgcaggagaggtgcagaccctcgtagtgctgtgtcaggccctcgacgacgccctgccaacgccgtacgaggcaggttgcatcccgcagggcatggccctttcggacgcccgcctgcgccccgacctcggtgacgtgcccctgccgccacagaccatgctgcgcaaggtgcgctgcgcccgtcgctttgccgccaagtcgcttccgaagttccttgccgcaggactgaaggcccttctcgtcttcgcctgccccccgacgatgtgcgccagccatgaggacggcaaaatccccgccacgggcctcgccgacctcgcccgggcctgtgcggatgccggggtgcgccttgtcgtgcacgaagcctgcccagcaggccccgacgccgtccgcgatgcggtggccgccttcagccggcaggcctga

SEQ ID NO: 67630 - protein, 333 aa, Desulfovibrio vulgaris subsp. vulgaris str. Hildenborough
MSRYCIVTDQDRCISCKACEVHCKVANNVPVGARLGMHIASGPHDVDGRPDIRTMFMPCFQCDEPWCVPVCPTGAIAKRESDGIVAIDADTCVGCKACITACPWRVPQWNPVTEKAVKCDLCRDRLDAGLRPACVTACTTHALELVSAEVGASLPCTGIDAVRKVAARPVPASMPPAPKGQRQPRLGDVEKAIAAGEVQTLVVLCQALDDALPTPYEAGCIPQGMALSDARLRPDLGDVPLPPQTMLRKVRCARRFAAKSLPKFLAAGLKALLVFACPPTMCASHEDGKIPATGLADLARACADAGVRLVVHEACPAGPDAVRDAVAAFSRQA

SEQ ID NO: 67631 - DNA, 768 bp, Desulfovibrio vulgaris subsp. vulgaris str. Hildenborough
  CDS (1)..(768): transl_table=11
atgtcttctttcaaggaattcaagatcaagtgggggatggtcatcgacctcgacaaatgtacgggctgcggcgcgtgcatggttgcctgtcaggccgagaacaacatcgccccgcagcctgatgccagcaacaagctgaagtcgctgaactggcttgtggtgtacgaactcaacaacggcaagccgttccccgagcacgacgtggcctacctgccccgtccgtgcatgcagtgcggcaagccttcatgcgtgtcggtgtgccctgtcgtggcgaccgacaagaacgaggaaggcggcatcgtcagccaggtgtacccgcgatgcatcggttgccggtactgcatggcctcgtgcccctaccatgcccgttacttcaactggttcgaccccacgtggcccgaaggtatggacaagaccctcacccccgacgtctccgtacgtccgcgcggtgtcgtggaaaagtgcaccttctgccaccaccgcttcatgcaggccaaggataaggcccgtgtcgaaggacgcgaccccagcgccctgcgtgacggtgactacgtgacctcgtgcaccgaggcgtgccccaacggcgccatcatcttcggggacttcaacaaccccgagcatcgtgtgcatgaactccacaagagcaagtatgccttcaggctgctcgaacgcctcggcaccgacccgcaggtgtactacctgagccgccgtgaatgggtgcgtcgccttggcgacaactatctcgaacacgaaaaggtcaaggggtag

SEQ ID NO: 67632 - protein, 255 aa, Desulfovibrio vulgaris subsp. vulgaris str. Hildenborough
MSSFKEFKIKWGMVIDLDKCTGCGACMVACQAENNIAPQPDASNKLKSLNWLVVYELNNGKPFPEHDVAYLPRPCMQCGKPSCVSVCPVVATDKNEEGGIVSQVYPRCIGCRYCMASCPYHARYFNWFDPTWPEGMDKTLTPDVSVRPRGVVEKCTFCHHRFMQAKDKARVEGRDPSALRDGDYVTSCTEACPNGAIIFGDFNNPEHRVHELHKSKYAFRLLERLGTDPQVYYLSRREWVRRLGDNYLEHEKVKG

SEQ ID NO: 67633 - DNA, 786 bp, Desulfovibrio vulgaris subsp. vulgaris str. Hildenborough
  CDS (1)..(786): transl_table=11
atgaacaacagcagaagacgattcctgaagatcgccagcctctcggttttcggccttggggccaagggcgtccttgatgtcgccgctggcaccaccccggacgccgctgcgctgaccggcaaatatgaagacggtgcgaccgcgctcaaggcgaaacgctgggccatggtcatcgacatgcgcaagttcacctcccccgaggactactcgcgcgtcatcgaggcctgtcactcgatccacaacgttccttccatcgaaggcaatcaggagatcaagtggctctggacggacacctacgaagcgaccttccctgacgacatgaacccccacctgtcgcaggaagttctcgaacgccgttatctgctcctgtgcaaccactgcgagaacccgccctgcgtgcgtgtgtgtcccaccaaggccacattcaagcgcgccgacggcatcgtcgtcatggactaccaccgttgcatcggttgccgcttctgcatggccggttgcccctacggcgcccgtagcttcaacttcggcgacccgcagccgcacatcaaggccatcaatccgaagttcccggcccgcacacgcggtgtcgtggaaaagtgcaccttctgtagcgaacggcttgccgtgggccagctgcccgcgtgcgtggaggcctccaacggcgccattctcttcggcgacctggatgacccgaactcgcccgtacgtaaggccctgaacgaaaactacagcattcgccgcaagcccagtgtaggcacccagcccggcgtctactacatcgtctag

SEQ ID NO: 67634 - protein, 261 aa, Desulfovibrio vulgaris subsp. vulgaris str. Hildenborough
MNNSRRRFLKIASLSVFGLGAKGVLDVAAGTTPDAAALTGKYEDGATALKAKRWAMVIDMRKFTSPEDYSRVIEACHSIHNVPSIEGNQEIKWLWTDTYEATFPDDMNPHLSQEVLERRYLLLCNHCENPPCVRVCPTKATFKRADGIVVMDYHRCIGCRFCMAGCPYGARSFNFGDPQPHIKAINPKFPARTRGVVEKCTFCSERLAVGQLPACVEASNGAILFGDLDDPNSPVRKALNENYSIRRKPSVGTQPGVYYIV

SEQ ID NO: 67635 - DNA, 699 bp, Erwinia carotovora subsp. atroseptica SCRI1043
  CDS (1)..(699): transl_table=11
atggaagaattatctcgccgtcgttttattgcctatatgggaagtgcgattgccgttagtggaaatatcggtctcgtacaagctcaaaatgagccagaaaaaacgcagggtaaattagccgttaaatatggcttattacataacgaaatgcgttgtatcggatgcaaagcctgtatcaaggcctgcaaagagacgaataacgtccctgatggcgtaacccggctggacatactgcaaaccgtcgacattcccgccgtcgagaaaacgcgcgccatcaagcaatttttccgtaagtcctgccagcactgtgagaatccgccctgcgttgccgtctgcccaacgggggcgtcctttaaagatgcgctcaccggcattgttgacgtcaacgataaacgctgcgtgggttgtcgctactgtattgccgcgtgcccttatcatgtgcgtttcatcaaccccgtcacgaaaacggcagacaaatgcaatttttgtcgggaaaccaatctggcggcagggaaacagcccgcctgcgtcgaaatctgccccactaaagcgttggtatttggcgatctcaacgaccctgaaagcaacattgccaagatgatcgagagcaacgcgacctaccgctccaaggtttatttgggcaccgaacctcaactctatcgtatgcctgggaaacgaggagtaatcgacaatgcataa

SEQ ID NO: 67636 - protein, 232 aa, Erwinia carotovora subsp. atroseptica SCRI1043
MEELSRRRFIAYMGSAIAVSGNIGLVQAQNEPEKTQGKLAVKYGLLHNEMRCIGCKACIKACKETNNVPDGVTRLDILQTVDIPAVEKTRAIKQFFRKSCQHCENPPCVAVCPTGASFKDALTGIVDVNDKRCVGCRYCIAACPYHVRFINPVTKTADKCNFCRETNLAAGKQPACVEICPTKALVFGDLNDPESNIAKMIESNATYRSKVYLGTEPQLYRMPGKRGVIDNA

SEQ ID NO: 67637 - DNA, 1011 bp, Erwinia carotovora subsp. atroseptica SCRI1043
  CDS (1)..(1011): transl_table=11
gtggacagacgtaattttctaaaactggctactggcggggtgatgacggtcggcatcgccccctctgcgttggctaaagcagagaacaagccgccaattccgaactcgcttggcatgctgtatgactcaacgctgtgcgtggggtgtcaggcatgcgtcagccagtgtcagcgcatcaaccacagtgatgcaccgcatggtgcgacatacgcctacgcgggtacggaaccgatgtggtctaacaacgataagctcagcccctacaccaacaacattattcaggtgtggagtgatgggagcggcgtacataaagaccagacggaaaatggttacgcctatatcaaaaaacagtgcatgcactgtgtggatcccaattgtgtatccgtctgcccggtgcaagcattacgcaaagacgcccatacaggcatcgtgcattacgatcccgatgtgtgtaccggttgccgttactgcatcgtggggtgcccgtttaatgtgccgaaatatgactatgacgacccgttcggaaaaattcacaagtgtgagctttgcaatcagaagggcgttgagcggttggataacggagggttgccggggtgtgttgaagtctgcccgacgggggcggtgattttcggcacgcgggagcaactgctggatgaagctaaaatgcgccttgcagggaaaacaggcgagccttaccggttcccacgccagacattgcaggggaacgaccggtacgaacatcctcttccacattaccagcagcatgtatacggcgagttggaggggggcggaacacaggtgctggtgttgactggcgtaccgtttgaaaacttagggttgccactgctggatagcctatcaacgggggcgcgttccgaacatgtacagcactccttgtataaaggcatggttctgccgtttgctgcactggccgggatcactttcctggtgcagcgcaacatgggtaagcacgatcaggacgaaaaagaggatgaacatgacgatgcataa

SEQ ID NO: 67638 - protein, 336 aa, Erwinia carotovora subsp. atroseptica SCRI1043
MDRRNFLKLATGGVMTVGIAPSALAKAENKPPIPNSLGMLYDSTLCVGCQACVSQCQRINHSDAPHGATYAYAGTEPMWSNNDKLSPYTNNIIQVWSDGSGVHKDQTENGYAYIKKQCMHCVDPNCVSVCPVQALRKDAHTGIVHYDPDVCTGCRYCIVGCPFNVPKYDYDDPFGKIHKCELCNQKGVERLDNGGLPGCVEVCPTGAVIFGTREQLLDEAKMRLAGKTGEPYRFPRQTLQGNDRYEHPLPHYQQHVYGELEGGGTQVLVLTGVPFENLGLPLLDSLSTGARSEHVQHSLYKGMVLPFAALAGITFLVQRNMGKHDQDEKEDEHDDA

SEQ ID NO: 67639 - DNA, 672 bp, Erwinia carotovora subsp. atroseptica SCRI1043
  CDS (1)..(672): transl_table=11
atgagttgctctcgtcgtcaatttcttgcccgtatgggcggggtgattgccatcaccagcacggcgggacaagtcgtcgcacagacgctgaatatcaacggcgtccgctacggcatgatccatgatgaatcgctctgtatcggctgtacggcctgcatggatgcctgccgtgaagtcaatcaggtgccggaaagtgtatcgcgtctgacgatcattcgcagcgaaccgattgggacattcccagacgtgaaatatcgctttttccgtcactcctgccagcactgtgaaaattcaccctgcgttgacgtatgtccaaccggagcctcgtttcgtgatgcggcaagcggcattgtggatgtgaatcccgatctgtgcgtcgggtgccaatactgtattgcggcttgcccttatcaggtgcgctttattcatccgcagacgaaaacggcggataagtgcgatttttgccgcaagactaacctgaaagccggaaaactgcccgcctgtgtgttgtcttgtccgacgaacgcgctgacgttcggtaaccttgacgaccctgacagcgacatttcccgtcagcttcgtcaacagccgacctatcgctacaaaatcgcgctcggcactcgtcctaaggtttatcgcgtaccgtttaaatacggggaggttcatcaatga

SEQ ID NO: 67640 - protein, 223 aa, Erwinia carotovora subsp. atroseptica SCRI1043
MSCSRRQFLARMGGVIAITSTAGQVVAQTLNINGVRYGMIHDESLCIGCTACMDACREVNQVPESVSRLTIIRSEPIGTFPDVKYRFFRHSCQHCENSPCVDVCPTGASFRDAASGIVDVNPDLCVGCQYCIAACPYQVRFIHPQTKTADKCDFCRKTNLKAGKLPACVLSCPTNALTFGNLDDPDSDISRQLRQQPTYRYKIALGTRPKVYRVPFKYGEVHQ

SEQ ID NO: 67641 - DNA, 642 bp, Propionibacterium acnes KPA171202
  CDS (1)..(642): transl_table=11
atgggagagaagaactatacggcaaaaggagccaagtacggcttcttctttgaccagacactgtgcaccgggtgcaaagcctgccaaatcgcctgcatcgacaaacacgacctgcccacgggggtgcggtggcgccgagtcgtcgagtacagcggaggaacttggcagatctcgggggacactttcaacccctcagtcttcacctactacacgtcagtctcatgcaaccactgcgaggacccgatctgcatgaaagtctgccctaccacggcaatgtcccgccgcgatgacggcaccgtctacgtcgaccaagacaagtgcgtgggatgtcgatactgtgagtgggcgtgcccgtatagcgcaccgcagtaccgcaaggacactggccgaatgagcaaatgcgatctgtgctacgactatcgcagtaagggtaaagagccagcctgtgtagccgcttgcccgtcgcgagctctggattggggacctatcgatgagctgcgcagcacatacggcaatgaggacgccatcgctccactgcctgatccttcggtaaccaaaccgcacctagtgatcactgcgcatcgtgacgcccagaggtgggacgagggcaccggcgagatcgctaataccaaggagatctga

SEQ ID NO: 67642 - protein, 213 aa, Propionibacterium acnes KPA171202
MGEKNYTAKGAKYGFFFDQTLCTGCKACQIACIDKHDLPTGVRWRRVVEYSGGTWQISGDTFNPSVFTYYTSVSCNHCEDPICMKVCPTTAMSRRDDGTVYVDQDKCVGCRYCEWACPYSAPQYRKDTGRMSKCDLCYDYRSKGKEPACVAACPSRALDWGPIDELRSTYGNEDAIAPLPDPSVTKPHLVITAHRDAQRWDEGTGEIANTKEI

SEQ ID NO: 67643 - DNA, 594 bp, Desulfotalea psychrophila LSv54
  CDS (1)..(594): transl_table=11
atggcaagaatgaaatttttatgcgatgtagaacgttgcatcgactgtagtggttgtatcgtcgcctgtaaagagggcaatcacgtgcccgttggagtgaaccgacgtcgtgttgtcacccttgaccagggaaagcctggtgaaaaatccatctccatctcatgtatgcactgtgccgatgcaccatgtatagctgtctgccccgttgatgcgatctatcaacgagatgatggcattgtcctggcggataagaaaaaatgtattggctgtggctattgctttatggcctgccctttcggtgcacctcaatttcccaagggagcagtttttggtgcccgtggtgccatggataagtgtaccttctgtgccggtggtcccgaagagactttcagcgacgaagagaaacgtctctacggacaaaacaggattgcagagggcaaaccaccgctctgctctggtatgtgtgccaccaaggcgcttcttgccggcgatgctgatattatagccgatgtctatcggaagcgtgtctttcaacgtggttcaggcgccggggcttggggctgggatcgggcatacaaaaaagacgataagtaa

SEQ ID NO: 67644 - protein, 197 aa, Desulfotalea psychrophila LSv54
MARMKFLCDVERCIDCSGCIVACKEGNHVPVGVNRRRVVTLDQGKPGEKSISISCMHCADAPCIAVCPVDAIYQRDDGIVLADKKKCIGCGYCFMACPFGAPQFPKGAVFGARGAMDKCTFCAGGPEETFSDEEKRLYGQNRIAEGKPPLCSGMCATKALLAGDADIIADVYRKRVFQRGSGAGAWGWDRAYKKDDK

SEQ ID NO: 67645 - DNA, 465 bp, Desulfotalea psychrophila LSv54
  CDS (1)..(465): transl_table=11
atgagtgacgttctcaagaacaatgagttccctgtgatgtgtaatcactgtgagaatcctccctgtgtgcgtgtttgtcctaccaaggctacctttatcgaggaacataatggcatcgtagagatggattaccatcgttgtattggttgtcgtttctgtatggtggcatgtccctatggagctcgaagctttaactgggaagatcctcgcccacatattaaagagtacaatcacgaatttccaacccgtatgcgtggtgttgtggagaagtgtactttttgtgcggaacgtttggcacttggtcaagaaccagcttgtcttgaagcaattaaggaatccggcgcaatgatctttggtgaccttaatgatccaaactctgaagtttcaaaggttctcaaagagaacccaaccattcagagaaagccgagttatggaactaaaccatcagtcttttacatagtgtga

SEQ ID NO: 67646 - protein, 154 aa, Desulfotalea psychrophila LSv54
MSDVLKNNEFPVMCNHCENPPCVRVCPTKATFIEEHNGIVEMDYHRCIGCRFCMVACPYGARSFNWEDPRPHIKEYNHEFPTRMRGVVEKCTFCAERLALGQEPACLEAIKESGAMIFGDLNDPNSEVSKVLKENPTIQRKPSYGTKPSVFYIV

SEQ ID NO: 67647 - DNA, 618 bp, Yersinia pseudotuberculosis IP 32953
  CDS (1)..(618): transl_table=11
atgacaacgcaatatggtttttacatcgactccagccgttgtacagggtgtaaaacgtgcgagttggcctgcaaagactttaaaaatctctcaccggatgtcagctttagacgtatttacgaatacgctggcggtgattggcagcaggataacgggacatggcaccagaatgtgttcgcttactacctgtctatcgcctgtaaccactgtagtgaccccgcctgtactaaggtgtgtccgagtggtgctatgcataagcgtaatgatggttttgtggtggttaacgaagatatctgcatcggttgccgctactgccatatggcctgcccttacggtgcgccgcaatatgatgctgaaaaagggcacatgaccaagtgcgacggttgttacgaacgggtggcggtagggaagaaacctatctgtgtcgattcctgtccactgcgtgcattggatatggcccctatcgatgaattacgcgaaaaatacggtgatttagctgaaattgcgcctctgcctgccgctcacttcacgctgccgaatatcgtactaaaacctaatgccaacagccgcccggtcagagataccaccggtcatctggcaaacccgaaggaggtataa

SEQ ID NO: 67648 - protein, 205 aa, Yersinia pseudotuberculosis IP 32953
MTTQYGFYIDSSRCTGCKTCELACKDFKNLSPDVSFRRIYEYAGGDWQQDNGTWHQNVFAYYLSIACNHCSDPACTKVCPSGAMHKRNDGFVVVNEDICIGCRYCHMACPYGAPQYDAEKGHMTKCDGCYERVAVGKKPICVDSCPLRALDMAPIDELREKYGDLAEIAPLPAAHFTLPNIVLKPNANSRPVRDTTGHLANPKEV

SEQ ID NO: 67649 - DNA, 714 bp, Symbiobacterium thermophilum IAM 14863
  CDS (1)..(714): transl_table=11
atgacccgctacgcctacttcgtggacctctccctctgcgccgggtgcgaggcctgcacggtggcgtgtcaggcgctgaacgggctggactggaacatccgctataccaaggtggaccggatggtggtgggcacctacccgaacgtgaaatccagcttcgtcaccacccagtgcctgcactgcgacgatccgccctgcgcggcggtctgccccaccggcgcgacgtacaagaccgccgacgggccggtgaagatcgacgacgagaactgtatcggctgccagtactgcatgacggcctgcccttacgaggccaggacgtacgatgcggctgcggacgtggtgcggaagtgctcgttctgccacgaccggctcggggcgggcgagcggcccgcctgcgagcagacctgcctgaccggcgcccgcatggtcggtgacctggacgatcctaccgacccgatccaccagcagatctcggccccggacgtgatccacatcgagggcaccagcttctactaccggctgccggagcacctggaccgggccgcgctcccggccgacttcaagccctcggtcgcgacgttcgcctggcagtcgatcgtccagcccgtgggccagatcctgatgggctccacggtcgccgcgctgctgctgagtctggcggtcaacgccttccggaaccgcggaaaggagggtgcacaggatggcaacggttaa

SEQ ID NO: 67650 - protein, 237 aa, Symbiobacterium thermophilum IAM 14863
MTRYAYFVDLSLCAGCEACTVACQALNGLDWNIRYTKVDRMVVGTYPNVKSSFVTTQCLHCDDPPCAAVCPTGATYKTADGPVKIDDENCIGCQYCMTACPYEARTYDAAADVVRKCSFCHDRLGAGERPACEQTCLTGARMVGDLDDPTDPIHQQISAPDVIHIEGTSFYYRLPEHLDRAALPADFKPSVATFAWQSIVQPVGQILMGSTVAALLLSLAVNAFRNRGKEGAQDGNG

SEQ ID NO: 67651 - DNA, 558 bp, Symbiobacterium thermophilum IAM 14863
  CDS (1)..(558): transl_table=11
gtggcacagaaaggcttttactatgacatgaccgcctgcgtcgggtgcaaggcttgctacatcgcgtgcaaggataagaacgacctgcccctgggggtcatgtaccgcaatgtctacacctttgagggcgggcggtacccgaagccgtggatcttcaacatctccatctcgtgcaaccactgcagcgacccgcggtgcgtgaccaactgcccgaccggcgcctcctacaagcgggaggaagacggcctggtcctggtcgaccaggaggcctgtatcgggtgccagtactgcgtctggtcgtgcccctacggcgcccggcactacctcgaggagcagggtgtcgtgggcaagtgcaacggctgcgtcgacctggtcgaacggggtcagaacccggcctgcgtggacgcctgcgtcatgcgcgcgctggagttcggcgacctggacgaactgaagcgcaggcatcccgaagccgaggtcttcaccagctggggagccccgggcgccgagctgaccgggccctcgatgctggtcaccctgaagccgcaagcccggcggtag

SEQ ID NO: 67652 - protein, 185 aa, Symbiobacterium thermophilum IAM 14863
MAQKGFYYDMTACVGCKACYIACKDKNDLPLGVMYRNVYTFEGGRYPKPWIFNISISCNHCSDPRCVTNCPTGASYKREEDGLVLVDQEACIGCQYCVWSCPYGARHYLEEQGVVGKCNGCVDLVERGQNPACVDACVMRALEFGDLDELKRRHPEAEVFTSWGAPGAELTGPSMLVTLKPQARR

SEQ ID NO: 67653 - DNA, 651 bp, Symbiobacterium thermophilum IAM 14863
  CDS (1)..(651): transl_table=11
atgacgacacagctcggctttcacgtggacatggagaagtgcatcggctgcaaggcatgcgaggcggcctgcaaggacttctaccggctgccgcccgagatccgctggcgccgggtgcgctccttcgagacgggcgagtttcccaaggccatccgggtccacctgagcctggcctgcaaccactgcgaggatccggcctgcatgaagggctgcccggtggaagcgtacaccaagcgggctgacggtctggtgatccacgaccccaccgcctgcatcggctgccaatactgcacctggacctgcccgtatagcgtgccccagttcgaccccgagcagggcgtggtctccaagtgcaacggctgctaccaactggtggaccagggccagctgccccgctgcgtccaggcctgcctgaccggtgcgctcagcttcggcgaggtggtggcccacgaggcgcagaagcggcaggcggtgcggcaggcgccgggcttcccggacccgtcggtcacccggccggcaacccggttcgcctggccggagaaagggccgcagcctgatcgtcaggtacgggtcgcgccacctgccggtgacgggacgagcgtcgggggtgcggcggaaaccgtggtggccgcggcgggggaggtgcggtag

SEQ ID NO: 67654 - protein, 216 aa, Symbiobacterium thermophilum IAM 14863
MTTQLGFHVDMEKCIGCKACEAACKDFYRLPPEIRWRRVRSFETGEFPKAIRVHLSLACNHCEDPACMKGCPVEAYTKRADGLVIHDPTACIGCQYCTWTCPYSVPQFDPEQGVVSKCNGCYQLVDQGQLPRCVQACLTGALSFGEVVAHEAQKRQAVRQAPGFPDPSVTRPATRFAWPEKGPQPDRQVRVAPPAGDGTSVGGAAETVVAAAGEVR

SEQ ID NO: 67655 - DNA, 771 bp, Symbiobacterium thermophilum IAM 14863
  CDS (1)..(771): transl_table=11
gtgcagccttcggcggccctgcgtgggcacctccccgagaccctggcacggtccttgcatccatctccgggtgaagtccacagatccagcaagggagtgacccccatgaccgcagcagcccgggatcccggctcccggcacgagccctactgggtgatggtcatcgacctgcagaagtgcatcggctgcgacacctgcaccgtctcctgcaaggccgaaaaccgcaccccgccgggcgtcagctacaacgttgtcctggaaatggagctcggcgagtaccccaacacccggcgggcgtacgtgccccggccctgcatgcagtgcgacagtccgccctgcgccggcgtctgcccggtgggcgccacctacaagggcgagagcggcattgtcgtcatcgacgacgaccggtgcatcggctgccggtactgcatcgccgcctgcccctacggcgcccggtccttcgacttcggcgagaactacgacgagatgctgggctacaccgaggtccaggcccccgagtatggggtcgaccgggggccgcgccgcaggggcgagacgcccatcggcacggtgcgcaagtgcacgttctgcctgcaccgcatccaccggggcgaggagcccgcctgcgtggagacctgcatcggcgacgcccggtactttggcgacctgaacgaccccaactcggtggtggccaagctggccgccagcccgcgggccttccggctgaaggaggagctgggcacgcagccccgggtcatctacctgaagtag

SEQ ID NO: 67656 - protein, 256 aa, Symbiobacterium thermophilum IAM 14863
MQPSAALRGHLPETLARSLHPSPGEVHRSSKGVTPMTAAARDPGSRHEPYWVMVIDLQKCIGCDTCTVSCKAENRTPPGVSYNVVLEMELGEYPNTRRAYVPRPCMQCDSPPCAGVCPVGATYKGESGIVVIDDDRCIGCRYCIAACPYGARSFDFGENYDEMLGYTEVQAPEYGVDRGPRRRGETPIGTVRKCTFCLHRIHRGEEPACVETCIGDARYFGDLNDPNSVVAKLAASPRAFRLKEELGTQPRVIYLK

SEQ ID NO: 67657 - DNA, 597 bp, Symbiobacterium thermophilum IAM 14863
  CDS (1)..(597): transl_table=11
atgcaatacgggttcttcatcgatgccaagtactgcgccggatgcaagacctgccagatcgcctgtaaggaccgggcgagcctcgaggttggccagctgttccgcaaggtggtgaactacgaggacggcggctgggtgcagcgcggtgaaggctgggtccacaacgtcacctcgtactggttctccatcagctgcaaccactgcgccgatccggcctgcgtgtacgtctgccccaccggggcgatgtacaagcggtccgacaacggcctcgtgctcgtgaaccaggacgactgcgtggggtgccagagctgcgtctgggcctgcccgtacgacgccccccagtacaaccctgaggtgggcagggtgcacaagtgcgacggctgcatcgaccgggtggaggccgggcagcggccggtctgcgtggacgcctgcccgtaccagctgatcgacttcggcgacatcgaggaactgcgggccaagcacggcggcacggcctgggtgcaggggctggccgatccgtcccgtacccgcccgtccctcctggtcaacccgccgaccggggccatcagctcgccgattggagggagccgcaagtga

SEQ ID NO: 67658 - protein, 198 aa, Symbiobacterium thermophilum IAM 14863
MQYGFFIDAKYCAGCKTCQIACKDRASLEVGQLFRKVVNYEDGGWVQRGEGWVHNVTSYWFSISCNHCADPACVYVCPTGAMYKRSDNGLVLVNQDDCVGCQSCVWACPYDAPQYNPEVGRVHKCDGCIDRVEAGQRPVCVDACPYQLIDFGDIEELRAKHGGTAWVQGLADPSRTRPSLLVNPPTGAISSPIGGSRK

SEQ ID NO: 67659 - DNA, 792 bp, Symbiobacterium thermophilum IAM 14863
  CDS (1)..(792): transl_table=11
atgacctacgggatgctcatcgacctgtccaagtgcatgggctgccggggctgccaggtggcctgcaagcagtggaacgacctcccgggtgaggacacgagcgtggggcccgacttcaccaacccgcagaagcgctcggcctacacctggaccaccatcgacttcgtgaccgccgaggtgaacggccgcaccgtggccaccttcaccaagtccggctgcatgcactgcctggagccggcctgcgagtcggtctgcatcgccggcgccatcaagcggcaggcgaacggcgcggtcaccatcgaccacgacaagtgcatcggctgccgctactgccagctgggctgccccttcggtgtgcccaagtacgagtacgacaagccggtgccccgcatgcagaagtgcaccctgtgctacgaccgcatctcggagggcctggagccggcctgcgcggccacctgccccagcggcgccatcctcttcggcgagcgggaagagctgctgaagctcgccaggcagcgcatcgccgaggggggcggccggtacatcgaccacgtgtacggcgagcacgaggcgggcggcaccgccgtcctgtacatctcccccgtgccgctggacctgaccgccctgaacaccgacgtcacgaccgagtcggtgcccggcttcacctggaaggccatgcggcagctgccggtcctggtgggcagcgtcgcagccctgtcgctgggactcatggcctactcgcggcggcgcgcccagcttgaggcgctggcgaaggggggtggcgagcagtga

SEQ ID NO: 67660 - protein, 263 aa, Symbiobacterium thermophilum IAM 14863
MTYGMLIDLSKCMGCRGCQVACKQWNDLPGEDTSVGPDFTNPQKRSAYTWTTIDFVTAEVNGRTVATFTKSGCMHCLEPACESVCIAGAIKRQANGAVTIDHDKCIGCRYCQLGCPFGVPKYEYDKPVPRMQKCTLCYDRISEGLEPACAATCPSGAILFGEREELLKLARQRIAEGGGRYIDHVYGEHEAGGTAVLYISPVPLDLTALNTDVTTESVPGFTWKAMRQLPVLVGSVAALSLGLMAYSRRRAQLEALAKGGGEQ

SEQ ID NO: 67661 - DNA, 876 bp, Symbiobacterium thermophilum IAM 14863
  CDS (1)..(876): transl_table=11
atgggtcgcgcagcaacctgggagacctggcggcctgatcccgccaacacccggcagcacgtcgccatgctggtcgacacctccgagtgcatcgggtgcaagggctgcgaggtcgcctgcaagcagtggaaccagaacgaggcccgcatcaaccaggatccgggcacctaccagagccacccggccctggacgcggagacctggaccgtcatccgcttctttgagaccgaagaagagaacggcatgtccatgtggctgatgcagaagcacagctgcatgcactgcaccgacgcgggctgcgtcaccgcctgccccaccgacgccctgcagtacggcgactacggcctggtgacgctgaaccaggatgcgtgcatcggctgcggctactgcgaggcggcctgcccgttcgactgcatccacgtcgaccggacggcctggggccagcgggcgcagaaggcgggcaagtgcaccttctgctacgaccgcatcgcccagggcatgcagcccgcgtgcgtcgccacctgcccaaccgactgcatcaagtacggcgaccgcgacgccctgatcgcgtggggccgggagcgggtggcacagcttcaggccatgggctacaagaacgccaacctctacggcgtcgacgagatgggcggcctgcaccacctctacgtgctgctggagccgcccgagacctacggcctgccggtcgcccccgaactctcgcccgtcctccggctgtggaagtacgtcctgcaacccatcggcaaggcggtgctgggcgtgggcctcttcggcctcatcgtcaactggctcgccgcccggcgggtcttcaagggcggcctctcgccccatgagaccgccgaatcgctgcacgactag

SEQ ID NO: 67662 - protein, 291 aa, Symbiobacterium thermophilum IAM 14863
MGRAATWETWRPDPANTRQHVAMLVDTSECIGCKGCEVACKQWNQNEARINQDPGTYQSHPALDAETWTVIRFFETEEENGMSMWLMQKHSCMHCTDAGCVTACPTDALQYGDYGLVTLNQDACIGCGYCEAACPFDCIHVDRTAWGQRAQKAGKCTFCYDRIAQGMQPACVATCPTDCIKYGDRDALIAWGRERVAQLQAMGYKNANLYGVDEMGGLHHLYVLLEPPETYGLPVAPELSPVLRLWKYVLQPIGKAVLGVGLFGLIVNWLAARRVFKGGLSPHETAESLHD

SEQ ID NO: 67663 - DNA, 939 bp, Mannheimia succiniciproducens MBEL55E
  CDS (1)..(939): transl_table=11
atgtccgcagtacaagaacaaaacattatcaagcgctccgccacttccggcgtcacgccgccgccgcaagtccgcaaagacgtggtggaagtcgctaaacttatcgatgtcaccacctgtatcggttgtaaagcctgtcaggtcgcttgttccgaatggaacgatatccgcgctccgcaggaacaatgcgttggggtttacgataatccccgcgacatgaacgcccaacaatggacggtaatgaagttcagcgaagtggaggaaaacgaccggctggaatggctgatccgcaaagacggctgtatgcactgcgccgaaccgggctgcttaaaagcctgtccggcaccgggcgccattatccaatacgccaacgggattgtggatttccaatcggaaaaatgtatcggttgcggttattgtatcgccggctgtccgtttaatgtgccgaaaatgagtaatgaagacaaccgcgtatacaaatgtaccctctgtgtggatcgcgtcaatgtgggtcaagagcccgcctgcgtaaaaacctgcccgaccggcgccattcatttcggctccaaagaggaaatgctgcactatgcggaaacccgggtggcggatttgaaatcccgcggctatgacaatgccggcatctataatcccgaaggcgtaggcggtactcatgtgatgtacgtgttgcaccacgcggacagaccggagctctatgccggcttaccgaaagatccggaaatcgacgttaccgtcaaactttggaaagacatcttaaaaccggtggcggcagtcgcgatgggtggcctggcattagccgaaatcgcccattatgtaggggtcggtccgaataatgaagaagatgtggaagatcacagcgcccacttcgaacgggaagatgcggaagaagaacaatcacatcataacaaaggtggcaaataa

SEQ ID NO: 67664 - protein, 312 aa, Mannheimia succiniciproducens MBEL55E
MSAVQEQNIIKRSATSGVTPPPQVRKDVVEVAKLIDVTTCIGCKACQVACSEWNDIRAPQEQCVGVYDNPRDMNAQQWTVMKFSEVEENDRLEWLIRKDGCMHCAEPGCLKACPAPGAIIQYANGIVDFQSEKCIGCGYCIAGCPFNVPKMSNEDNRVYKCTLCVDRVNVGQEPACVKTCPTGAIHFGSKEEMLHYAETRVADLKSRGYDNAGIYNPEGVGGTHVMYVLHHADRPELYAGLPKDPEIDVTVKLWKDILKPVAAVAMGGLALAEIAHYVGVGPNNEEDVEDHSAHFEREDAEEEQSHHNKGGK

SEQ ID NO: 67665 - DNA, 681 bp, Mannheimia succiniciproducens MBEL55E
  CDS (1)..(681): transl_table=11
atgacagcttgctcacgccgaaactttgtttccggaatgggtgcgttaatcctcacaacgggaacatcagttaaattatcggcacaaggtgaaaagcctaacgaaacggcgccaaaacgctatgcaatggtacatgacgaaacttcatgtatcggttgtacggcctgtatggatgcctgccgtgagactaaccaagtgccagaaggtgtttctcgtttggaaattctccgtagcgagcctcatggcgaatttccgaaccaggaatatgaatttttccgtcaatcttgtcaacattgcactaacgcgccttgtgtggcggtatgtccgacaggtgcttcgttcattgaccctgaaacgggtattgttgatgtaaacaaagatctttgcgtaggttgccaatattgtatcgccgtatgtccttatcgcgtacgttttattcatccggtgcataaaactgccgataaatgtaatttctgccgcgataccaatcttgcagcaggcaaacaaccggcttgtgttgaagcttgcccgactaaagcattaacctttggtgatatgaatgatccaaatagcgcggtcgcacgtaaagtaagagaaaatccggtgtatcgtaccaaattaacattaggtaccgagccgaatctttaccatatcccatttgcaaaaggagagcatagataa

SEQ ID NO: 67666 - protein, 226 aa, Mannheimia succiniciproducens MBEL55E
MTACSRRNFVSGMGALILTTGTSVKLSAQGEKPNETAPKRYAMVHDETSCIGCTACMDACRETNQVPEGVSRLEILRSEPHGEFPNQEYEFFRQSCQHCTNAPCVAVCPTGASFIDPETGIVDVNKDLCVGCQYCIAVCPYRVRFIHPVHKTADKCNFCRDTNLAAGKQPACVEACPTKALTFGDMNDPNSAVARKVRENPVYRTKLTLGTEPNLYHIPFAKGEHR

SEQ ID NO: 67667 - DNA, 993 bp, Mannheimia succiniciproducens MBEL55E
  CDS (1)..(993): transl_table=11
atggatagacgtaaatttataaaagcaggcatgcttggcggcgtcgcatctgcgctacctttaaatgccgctcatgcggaagtcaaaaatcaagaacctattcccggtgccttaggcatgttgtatgactctacgttatgtgtgggctgccaggcttgtgtggcggaatgccagaaaatcaacggaacgccggttaatccgaaaggcgaacaaacctggtccaataacgataaattatcgccttttacccgtaatgtcattcaggtttggtctgaaggtgaaggtaccaataaagatcagccgcaaaacggttatgcttacataaaaaaacaatgtatgcattgcgttgatccgaactgtgtaagcgtttgtccggttcaagccctgacgaaaaacccgaaaacaggtattgtgggctacgatccggatatttgcaccggttgccgttattgtatggtggcttgtccttttgacgtgcctaaatatgattatgataatcctctgggtcaaatcagcaaatgcgaactttgtaaccaaaaaggcgttgagcgcattgttcaaggcaaattgcccggctgttgccatgtttgcccgaccggcgccattatttttggttcccgcgaagaattaatggcggaggctaaacgccgtttaagtatgactcagggaacggattatgaatttccccgccaacatgtaaacagcaaagataaatatcaggcgaaaattcccgcttacgaacagcatatttacggtgaaattgaaggcggcggtactcaggtattggttttaagcggtgtaccttttgaaaacctcggtttgcctcaattagacgaaatagcaaccggcgcccgtgccgcccacttacaacatactttatacagaggcatgattcttcctttagtcggacttgcggggttaacctttataacttaccgcaatatgcacggtaaaaaaccagaacatcaccaagaggaggataataatgagtaa

SEQ ID NO: 67668 - protein, 330 aa, Mannheimia succiniciproducens MBEL55E
MDRRKFIKAGMLGGVASALPLNAAHAEVKNQEPIPGALGMLYDSTLCVGCQACVAECQKINGTPVNPKGEQTWSNNDKLSPFTRNVIQVWSEGEGTNKDQPQNGYAYIKKQCMHCVDPNCVSVCPVQALTKNPKTGIVGYDPDICTGCRYCMVACPFDVPKYDYDNPLGQISKCELCNQKGVERIVQGKLPGCCHVCPTGAIIFGSREELMAEAKRRLSMTQGTDYEFPRQHVNSKDKYQAKIPAYEQHIYGEIEGGGTQVLVLSGVPFENLGLPQLDEIATGARAAHLQHTLYRGMILPLVGLAGLTFITYRNMHGKKPEHHQEEDNNE

SEQ ID NO: 67669 - DNA, 798 bp, Burkholderia pseudomallei K96243
  CDS (1)..(798): transl_table=11
atgacgcaaatggcgctcgtgatcgatctgaacgtgtgcgtggggtgccacgcgtgcgtgacgagctgcaaggaatggaacacgtcgggcgacgcgggcgtgctgtctgacttgcgcccatatgacgccgatccgtccggcaccttcttcaaccgcgtgcagacgttcgaggcgggcgaatttccgctcgccgacacgatccacttcccgaagtcgtgcctgcattgcgaagacccgccgtgcgtgccggtctgcccgacgggcgcgagctacaagcgcgaggaagacgggctcgtgctcgtcgattacgacaagtgcatcggctgcaagtactgcacgtgggcgtgcccatatggcgcgcgcgagctcgacgaagtgcgcaaggagatgacgaagtgcacgctttgcgcggaccgcattcacgacgagacgctgcccgagcgcgatcgcaagcccgcgtgcgtgctcgcgtgcccgacgtcggcgcgcctgttcggcgacatccacgatccgaattcgaccgtgtcgcaggcaatccgcgagcgcggcggctatcagttgatgccggaatggggaacgcggcccgcgaatcattacctgccgcgccgcacgacgaccgcgtgcgggagcgggggcggcggtggtagcgacgggagcggaggcggcggttgcggtagcggcgccgcgtgcgcgtgccggccggcggacgcgaagcccgcgcccgcctcggccggcgacgcactcgcgcacgggcagccgaatctcgccgcgctcgcgaagcgcatccgatctgaatga

SEQ ID NO: 67670 - protein, 265 aa, Burkholderia pseudomallei K96243
MTQMALVIDLNVCVGCHACVTSCKEWNTSGDAGVLSDLRPYDADPSGTFFNRVQTFEAGEFPLADTIHFPKSCLHCEDPPCVPVCPTGASYKREEDGLVLVDYDKCIGCKYCTWACPYGARELDEVRKEMTKCTLCADRIHDETLPERDRKPACVLACPTSARLFGDIHDPNSTVSQAIRERGGYQLMPEWGTRPANHYLPRRTTTACGSGGGGGSDGSGGGGCGSGAACACRPADAKPAPASAGDALAHGQPNLAALAKRIRSE

SEQ ID NO: 67671 - DNA, 873 bp, Methylococcus capsulatus str. Bath
  CDS (1)..(873): transl_table=11
atggcattgcaatccctcgacatcgtccgccgctccgccaccacgacgcccagcccgcagcagcggcagacgacggaggtggccaagctcatcgacgtcaccaagtgcatcggctgcaaggcctgccagtcggcctgccaggagtggaacgatctgcgggaggaagtcggcatcaacgagggttcctaccagaacccgcacgatctcaccgccaattcctggaccctgatgcgctttaccgagaccgaggaaaacggcaccctcgaatggctgatccgcaaggacggctgcatgcactgcgccgaccccggctgcctcaaggcctgcccctcgccgggcgcgatcatccaatacagtaacggcatcgtcgatttccacgaggaaaactgcatcggctgcggctactgcatcgccggctgcccgttcgacattccccgcctttcccccaaggacggcaaggcctacaagtgcaccctgtgttcggaccgcgtgtcggtggggctggagccggcctgcatcaaatcctgcccgacccaggcgctggtgttcggcagcaaggaagacatgatcgaacacgccaacgagcgcatcgccgacctcaaggagcgcggcttcgagaacgccggcctctacgacccgccgggagtgggcggcacccacgtgatgtacgtgctgcaccatgccgacaagccgcagctctacgatggtctgccccaatcccctcggatcagcggtctggtcggcctgtggaaaggcatcttcaagcccctggccacggctgccctggcgctcaccgcactggccgggtttttccactatgtcacggtcggccccaacgagacgggggaggacgaagaggaggaaaaggcatga

SEQ ID NO: 67672 - protein, 290 aa, Methylococcus capsulatus str. Bath
MALQSLDIVRRSATTTPSPQQRQTTEVAKLIDVTKCIGCKACQSACQEWNDLREEVGINEGSYQNPHDLTANSWTLMRFTETEENGTLEWLIRKDGCMHCADPGCLKACPSPGAIIQYSNGIVDFHEENCIGCGYCIAGCPFDIPRLSPKDGKAYKCTLCSDRVSVGLEPACIKSCPTQALVFGSKEDMIEHANERIADLKERGFENAGLYDPPGVGGTHVMYVLHHADKPQLYDGLPQSPRISGLVGLWKGIFKPLATAALALTALAGFFHYVTVGPNETGEDEEEEKA

SEQ ID NO: 67673 - DNA, 693 bp, Photobacterium profundum SS9
  CDS (1)..(693): transl_table=11
atgacgtgttcaagacgaaattttttagcgggtgctggtgcggtgatttttaccaccggagttagcgctggtagcggtgtacttggtcgccaatcgttagtcgcgaccatggacgacggtgttaaacgctatggcatggtgcatgatgaaacattgtgtattggctgtactgcgtgtactgatgcttgtcgtgaagtaaacaaagtacctgaaggtgtttctcgactagaaatagtgcgcagtgagcctcagggagaatacccggatgtgagctatcagttcactcggatttcttgtcagcattgtgataatgcaccttgtgtgcatgtttgtccgacaggggcttctttcaaagatcctgatactggcattgtcgatgttgatcctttcaaatgcgtaggttgtggctattgccttgctgcgtgtccgtataaggttcgtttctttaatccagaaacaaaatctgcagataaatgtgatttttgtcgtaagaccaacctgaaggaaggcaaactgccagcctgtgttgaatcttgcccaactaagtcactgacgtttggtgatctgaatgatccaaacagtgaagtgtcgaagttattagagcaaaaaaccgtttatcgacaaaaggtggaattaggtacatcaccgaagttatataaagtgccttatggaaaaggggagataaaaggatga

SEQ ID NO: 67674 - protein, 230 aa, Photobacterium profundum SS9
MTCSRRNFLAGAGAVIFTTGVSAGSGVLGRQSLVATMDDGVKRYGMVHDETLCIGCTACTDACREVNKVPEGVSRLEIVRSEPQGEYPDVSYQFTRISCQHCDNAPCVHVCPTGASFKDPDTGIVDVDPFKCVGCGYCLAACPYKVRFFNPETKSADKCDFCRKTNLKEGKLPACVESCPTKSLTFGDLNDPNSEVSKLLEQKTVYRQKVELGTSPKLYKVPYGKGEIKG

SEQ ID NO: 67675 - DNA, 669 bp, Photobacterium profundum SS9
  CDS (1)..(669): transl_table=11
ttgttatcaggcattggtgcaataaccgcgggggccgcactaattccagtcgtacaagccagcaacgcctcaacaggcaacattgtggtgggcaataaatataaaaacaacaatcagcctgatcgcaaaggcatggtaggaaaacgctatgccatggtggtcgatttgcgtaaatgtgttggctgccaagcctgtacggtcggctgcagtattgaaaaccaagcgcctattggccaattccgcaccaccgtaaagcaatatgaagttacccttgatgatggtagtacaggcacgaaacaggtgaagtcttttatgctgccgcgtctgtgtaaccattgtgataacccaccctgcgtcaaagtctgcccagtacaggccacttaccaacgtgaagacggcattgttatggtcgataacaagcgctgtgttgcctgtgcctattgcgtacaggcttgcccttacgatgctcgcttcatcaatgaagaaacccttacagccgataaatgtacgttttgcgcacatcggttagagcaaggtttactgcctgcttgtgtggaaacgtgtgtaggtggtgcgcggatcattggggatttaaataacccaagcagcgaaataaaccgactgctcgttgaacataaagacgaactaaacaaccacctactaaagtag

SEQ ID NO: 67676 - protein, 222 aa, Photobacterium profundum SS9
MLSGIGAITAGAALIPVVQASNASTGNIVVGNKYKNNNQPDRKGMVGKRYAMVVDLRKCVGCQACTVGCSIENQAPIGQFRTTVKQYEVTLDDGSTGTKQVKSFMLPRLCNHCDNPPCVKVCPVQATYQREDGIVMVDNKRCVACAYCVQACPYDARFINEETLTADKCTFCAHRLEQGLLPACVETCVGGARIIGDLNNPSSEINRLLVEHKDELNNHLLK

SEQ ID NO: 67677 - DNA, 831 bp, Haloarcula marismortui ATCC 43049
  CDS (1)..(831): transl_table=11
atgacgaactatggcctcgtaatcgaccaggagcggtgtatcggctgtcaggcatgcgcagtgtcatgtaaacaggagaacaacgtcccgatgggacagttctggaaccgcgtcctcacggagggcggcgacaagatggacaccccgtccggtggctaccccgaagacggcggcagcggggcgctagatatgcagtaccagccgacggcgtgccagcactgcgaaaacgcgccctgcgtgaaggtctgtccggtcaacgcgacgtacacccgggacgacggaattgtcgaaatcgactacgacaaatgcatcggctgtcgctactgtatggccgcctgcccgtacaacgcgcgggtgttcaactgggacgaacccgaccatatgcccgaggaggggacgggcgacgttgccgcccggccacagggcgtcgtcgagaagtgtacgttctgtagccatcgcgtcgacgagggactcgacccggcctgtgtcgtcaactgtcctgccgacgcacgcatcttcggtgaccttgacgacgagggaagcaccgtctcgaagtacatcaacgagtacgagacggaccggctcctcgaagaccgcgggacgaacccgaagacacactacatcagcggcgagatgagccccggtcggccacagacgtcggataaaatggagagcgagctcgacgatgtctctccgtggtccgatgggtcagaggacgtgccagctgaggccggtgaaagcgacagcagtggctcgggtggaagccaccactccatcgagggtgatgcagctccacacgtcccagcagtggggtccggaggtgatgactga

SEQ ID NO: 67678 - protein, 276 aa, Haloarcula marismortui ATCC 43049
MTNYGLVIDQERCIGCQACAVSCKQENNVPMGQFWNRVLTEGGDKMDTPSGGYPEDGGSGALDMQYQPTACQHCENAPCVKVCPVNATYTRDDGIVEIDYDKCIGCRYCMAACPYNARVFNWDEPDHMPEEGTGDVAARPQGVVEKCTFCSHRVDEGLDPACVVNCPADARIFGDLDDEGSTVSKYINEYETDRLLEDRGTNPKTHYISGEMSPGRPQTSDKMESELDDVSPWSDGSEDVPAEAGESDSSGSGGSHHSIEGDAAPHVPAVGSGGDD

SEQ ID NO: 67679 - DNA, 663 bp, Haloarcula marismortui ATCC 43049
  CDS (1)..(663): transl_table=11
atgtcaacaggcaatgaagtgatgcacgacggcgtgatgagtaccggcgaggatgcgcgcatcttcccggatgttgaggcgtgtatcgactgtggtggctgtgttgtctcctgtaagcgtacgtgggacgtcccacgggacgaacagcgaatcagtatcgcgacgatgctcgaaggccaggaagccgcatcggggctcaacgccagcagcggccaggcgataggccaaggtgagtcacccggcgagacagcagtcccgatgcagtgctatcactgttcgaacgcgccgtgcgtctcggtgtgtccgaccgactcgctcatctcgaaggagaacggcttcgtgcgggtccgtgacgacctctgtatcggttgccagtactgcctctcggcgtgtccgttcggcgcgccacagttccccgacgaggacagcggggtcgccaacctcgtcggcagcggtggcaacatggacaagtgtaccatgtgcgaggaacgtcaagatgtcggcaaggggccggcctgcgccgaggagtgtgccaccgacgccatcctggtcgggacgccggcccagatatcggacgaactggacaacagggacagcggcacgttcttcaacgacgtggctatggacatcatctttggcgaggacgccagtgagttccaatga

SEQ ID NO: 67680 - protein, 220 aa, Haloarcula marismortui ATCC 43049
MSTGNEVMHDGVMSTGEDARIFPDVEACIDCGGCVVSCKRTWDVPRDEQRISIATMLEGQEAASGLNASSGQAIGQGESPGETAVPMQCYHCSNAPCVSVCPTDSLISKENGFVRVRDDLCIGCQYCLSACPFGAPQFPDEDSGVANLVGSGGNMDKCTMCEERQDVGKGPACAEECATDAILVGTPAQISDELDNRDSGTFFNDVAMDIIFGEDASEFQ

SEQ ID NO: 67681 - DNA, 630 bp, Salmonella enterica subsp. enterica serovar Paratyphi A str. ATCC
  CDS (1)..(630): transl_table=11
atgagtcagtttacacattacccgccggtgagcgataaacaactgggatttttcatcgactcctcacgctgctccggttgtaaagcctgccaggtggcctgcaaagacaaaaacaatctggaagtaggccgtcgtttccgccgcgtctatgaagtcaagggcggaagtttcatcccgaccgggcagggcggggtcagcaataacgtatttgcttatacgctttccatttcctgcaaccactgtgcggaccctgtctgcaccaaaaattgcccgactaccgctatgcataaacgcccgggcgacggcatcgtgcgcgttgataccgacaaatgcgtcggctgtggctattgcgcctggtcctgcccttacgacgcgccgcagcttaacgagcagaccagccaaatgtccaagtgcgacatgtgcgttgatttactggcgaaaggtgaactgcccgtctgcgtcgcgacctgtccgctggaggccatcaagtttggcccgattgatgaactgcgcgcgaagtacgatagcgtatgcgacgttaacgggctgccagattcatccataaccaaacctaatctggttgtcaaagcgcatcagggcgcagaaaaagagggtaaacgccatgcatga

SEQ ID NO: 67682 - protein, 209 aa, Salmonella enterica subsp. enterica serovar Paratyphi A str. ATCC
MSQFTHYPPVSDKQLGFFIDSSRCSGCKACQVACKDKNNLEVGRRFRRVYEVKGGSFIPTGQGGVSNNVFAYTLSISCNHCADPVCTKNCPTTAMHKRPGDGIVRVDTDKCVGCGYCAWSCPYDAPQLNEQTSQMSKCDMCVDLLAKGELPVCVATCPLEAIKFGPIDELRAKYDSVCDVNGLPDSSITKPNLVVKAHQGAEKEGKRHA

SEQ ID NO: 67683 - DNA, 618 bp, Salmonella enterica subsp. enterica serovar Paratyphi A str. ATCC
  CDS (1)..(618): transl_table=11
atgacaactcagtatggattttttattgattccagccgttgcaccggttgcaaaacctgcgaactggcctgcaaggactacaaagatttgaccccggatgtcagtttccggcggatatatgaatacgcaggcggcgactggcaggaagataacggcgtctggcatcagaacgtctttgcctactatctctccatttcgtgcaaccactgcgaagacccggcctgtaccaaagtctgcccgagcggcgcgatgcacaagcgcgatgacggttttgtggtggtgaacgaagaggtctgtatcggctgtcgctactgccacatggcctgcccgtacggcgcgccgcagtacaacgcggccaaaggtcatatgaccaagtgcgacggctgttatgaccgggtggcggaaggcaagaaaccgatttgcgtggaatcctgcccgctgcgggcgctggatttcggcccgatagacgaactgcgcaaaaaacacggtgagctggctgccgtcgcgccgttgccgcgcgcgcatttcacgaagccgaatattgtgattaaacccaacgccaacagccgcccgaccggggacaccaccggttatctggccaatccgaaggaggtataa

SEQ ID NO: 67684 - protein, 205 aa, Salmonella enterica subsp. enterica serovar Paratyphi A str. ATCC
MTTQYGFFIDSSRCTGCKTCELACKDYKDLTPDVSFRRIYEYAGGDWQEDNGVWHQNVFAYYLSISCNHCEDPACTKVCPSGAMHKRDDGFVVVNEEVCIGCRYCHMACPYGAPQYNAAKGHMTKCDGCYDRVAEGKKPICVESCPLRALDFGPIDELRKKHGELAAVAPLPRAHFTKPNIVIKPNANSRPTGDTTGYLANPKEV

SEQ ID NO: 67685 - DNA, 618 bp, Salmonella enterica subsp. enterica serovar Paratyphi A str. ATCC
  CDS (1)..(618): transl_table=11
atgacaacccagtatggattttttattgattccagccgttgcaccggttgcaaaacctgcgaactggcctgcaaggactacaaagatttgaccccggatgtcagcttccgccgcatttatgagtatgcgggcggcgactggcaggaagataacagcgtctggcaccagaacgtctttgcctactatctctccatctcctgtaaccactgcgaagacccggcctgtaccaaagtctgcccgagcggcgcgatgcacaagcgcgatgacggttttgtggtggtggatgaagacgtatgtatcggctgccgctactgccacatggcctgcccgtacggcgcgccgcagtacaacgccgccaaaggtcatatgaccaagtgcgacggctgttatgatcgggtggcggaaggcaagaaaccgatctgcgtggaatcctgcccgctgcgggcgctggactttggtcctatcgacgaactgcgcaaaaaacacagtgagctggctgccgtcgcgccgttgccgcgcgcgcatttcacgaagccgaatattgtgattaaacccaacgccaacagccgcccgaccggggacaccaccggttatctggccaatccgaaggaggtataa

SEQ ID NO: 67686 - protein, 205 aa, Salmonella enterica subsp. enterica serovar Paratyphi A str. ATCC
MTTQYGFFIDSSRCTGCKTCELACKDYKDLTPDVSFRRIYEYAGGDWQEDNSVWHQNVFAYYLSISCNHCEDPACTKVCPSGAMHKRDDGFVVVDEDVCIGCRYCHMACPYGAPQYNAAKGHMTKCDGCYDRVAEGKKPICVESCPLRALDFGPIDELRKKHSELAAVAPLPRAHFTKPNIVIKPNANSRPTGDTTGYLANPKEV

SEQ ID NO: 67687 - DNA, 558 bp, Salmonella enterica subsp. enterica serovar Paratyphi A str. ATCC
  CDS (1)..(558): transl_table=11
atgagacgtgcgtttttagtgaatagcgataagtgcatcggctgccgcggctgtgctatggcgtgtaaaagctttaaccaactggagccggatcgcttctggcgctacgtttatccgttggataaagacatctatccacatgaagagcgggcgttttactcgctggcctgtaaccactgcgaacatccggcctgcgtcgccgcctgtccggtcgaagcctataccaaacgtgaagatggcgtggtggtgcataaccctgagcgctgcatcggctgtaaaaactgtattcgtaactgtccttatggcgcgccgcgttttaatgaagagacgcgtaaagcggaaaaatgcagtatgtgctacgagcgtcttgatatcggtatgaatccggcgtgcgtgaacgcctgtccggtgggcgccttgtcgattatcgatttggatgccgatcctgtgcccgataatgcggtgcagtatccgccagggttcccgcatatgccacagctcaatccaggaacgcgctttattctggcgcgccagcctaagcagccggaggacaagtaa

SEQ ID NO: 67688 - protein, 185 aa, Salmonella enterica subsp. enterica serovar Paratyphi A str. ATCC
MRRAFLVNSDKCIGCRGCAMACKSFNQLEPDRFWRYVYPLDKDIYPHEERAFYSLACNHCEHPACVAACPVEAYTKREDGVVVHNPERCIGCKNCIRNCPYGAPRFNEETRKAEKCSMCYERLDIGMNPACVNACPVGALSIIDLDADPVPDNAVQYPPGFPHMPQLNPGTRFILARQPKQPEDK

SEQ ID NO: 67689 - DNA, 987 bp, Salmonella enterica subsp. enterica serovar Paratyphi A str. ATCC
  CDS (1)..(987): transl_table=11
gtgaacagacgtgactttattaaagcagcctccggtggagcattgctgttgggcgccgcgccgtctgtcagccatgcggctgcagaaaaccgtccgccgattccaggttcgttgggcatgctgtatgactccactctgtgcgttggctgtcaggcctgcgtcacaaagtgtcaggatatcaacttcccggcgcgtaacccggaaggggagcagacctggtcgaacaacgacaaactgtcgccgtataccaataacattatccaggtatggcgtagcggcacgggcgtgaacaaagatcaggaagagaacggctatgcctacatcaagaaacagtgtatgcactgcgttgatcctaactgcgtttccgtttgcccggtgtcggcgctgaaaaaagatccgaaaaccggcatcgtccactatgacaaagatgtctgcaccggctgccgttactgtatggtcgcctgcccgtacaacgtacctaagtacgactacaacaacccgtttggcgcgcttcacaagtgtgagttgtgtaaccagaaaggcgttgagcgtctggataaaggcggtttgcctgggtgcgtggaagtttgtccggcaggggccgtcattttcggtactcgtgaagagctgatggcggaagcgaaaaaacgtctggccctcaaaccaggcagtgaatatcactatccgcgccagacgttgaaaacggacgacacctatctgcatacggtgcctaaatactacccacacctctacggtgaaaaagagggcggcggtacacaggtgctggtgctgacaggcgttccttatgaagatttggatctgccgaagctggatgacctttcaaccggagcgcgctccgagcatgttcaacacacgctttataaaggcatgatactacccctggctgcgctggcgggcttaaccgtgctggttcgtcgtaatagcaaaaacgaccatcacgatggaggagacgatcatgagtcatga

SEQ ID NO: 67690 - protein, 328 aa, Salmonella enterica subsp. enterica serovar Paratyphi A str. ATCC
MNRRDFIKAASGGALLLGAAPSVSHAAAENRPPIPGSLGMLYDSTLCVGCQACVTKCQDINFPARNPEGEQTWSNNDKLSPYTNNIIQVWRSGTGVNKDQEENGYAYIKKQCMHCVDPNCVSVCPVSALKKDPKTGIVHYDKDVCTGCRYCMVACPYNVPKYDYNNPFGALHKCELCNQKGVERLDKGGLPGCVEVCPAGAVIFGTREELMAEAKKRLALKPGSEYHYPRQTLKTDDTYLHTVPKYYPHLYGEKEGGGTQVLVLTGVPYEDLDLPKLDDLSTGARSEHVQHTLYKGMILPLAALAGLTVLVRRNSKNDHHDGGDDHES

SEQ ID NO: 67691 - DNA, 903 bp, Salmonella enterica subsp. enterica serovar Paratyphi A str. ATCC
  CDS (1)..(903): transl_table=11
atggcttatcaatcgcaagacatcattcgtcgttccgccactaacggtttcacccccgcgccccaggcgcgggaccaccaggaagaggtggcgaaactcatcgacgtcaccacctgtatcggctgtaaagcgtgtcaggtggcgtgctccgagtggaacgacatccgtgatgaagtgggcaataacgtcggggtgtatgacaacccggcggacttaactgcgaaatcctggacggtgatgcgcttctcggaagtggaacagaacgacaaactggagtggctgatccgtaaggatggctgtatgcactgcgccgatcccggctgcctgaaggcctgtccggcggaaggggcgatcattcagtatgctaacggtattgtcgacttccagtccgagcagtgtatcggctgcggctactgtatcgctggctgcccgttcaacgtgccgcgctttaacccggaagacaaccgcgtctataaatgtacgctgtgcgtcgaccgagtgaccgtggggcaagaaccggcctgcgtgaagacctgtccaaccggcgccattcattttggctcgaaagaggatatgaaaacgctggcgggcgagcgggtggcggaactcaaaacccgtggttatgacaacgcgggactgtacgatccggccggcgtaggcggtacgcatgtcatgtacgtgctgcatcatgccgacaagccgaatctgtatcacggtctgccggagaacccggaaatcagcgaaaccgtcaagttctggaaaggcgtctggaaaccgctcgccgcgttcggttttgccgcgacctttgccgccagcgtcttccactatgtcggcgtcggcccgaaccgcgcggaagaggaagatgacaacctgcatgaagagaaagacgaggtgcgcaaatga

SEQ ID NO: 67692 - protein, 300 aa, Salmonella enterica subsp. enterica serovar Paratyphi A str. ATCC
MAYQSQDIIRRSATNGFTPAPQARDHQEEVAKLIDVTTCIGCKACQVACSEWNDIRDEVGNNVGVYDNPADLTAKSWTVMRFSEVEQNDKLEWLIRKDGCMHCADPGCLKACPAEGAIIQYANGIVDFQSEQCIGCGYCIAGCPFNVPRFNPEDNRVYKCTLCVDRVTVGQEPACVKTCPTGAIHFGSKEDMKTLAGERVAELKTRGYDNAGLYDPAGVGGTHVMYVLHHADKPNLYHGLPENPEISETVKFWKGVWKPLAAFGFAATFAASVFHYVGVGPNRAEEEDDNLHEEKDEVRK

SEQ ID NO: 67693 - DNA, 672 bp, Salmonella enterica subsp. enterica serovar Paratyphi A str. ATCC
  CDS (1)..(672): transl_table=11
atgagttgcacccgacgtcaatttattacccgcgtcggcgcgctggcggcggtcagtgggatggcaggacgcgttgtagcgaacacgttgaatattaacggcgtgcgttatggcatggtacacgatgagtcattatgcatcggctgcacggcctgcatggatgcctgtcgggaagtcaacaacgtgccggaaggcgtatcgcgcctgacgattattcgcagcgagccgcaggggacgtttcctgatgtgaaatatcgcttcttccgccactcgtgccagcattgcgaccatgccccctgcgttgacgtctgcccgaccggcgcatcattccgcgatgccgccagtggtattgtcgacgtgaacccggacctttgcgtcggctgtcagtactgcattgccgcgtgtccctaccgcgtgcgctttatccatccggtcagtaagacggcggataagtgcgatttctgccggaaaactaacctgaaagcgggcaaacagcccgcctgcgttgagtcatgtccaacgaaggcgctgacgtttggtaatctggacgatcccaacagcgatatctcccgtttgttgcggcagaaaaccacctatcgttacaagctggcgctgggcacaaaaccgaaggtctaccgcgttccctttaactatggggaggtgagccaatga

SEQ ID NO: 67694 - protein, 223 aa, Salmonella enterica subsp. enterica serovar Paratyphi A str. ATCC
MSCTRRQFITRVGALAAVSGMAGRVVANTLNINGVRYGMVHDESLCIGCTACMDACREVNNVPEGVSRLTIIRSEPQGTFPDVKYRFFRHSCQHCDHAPCVDVCPTGASFRDAASGIVDVNPDLCVGCQYCIAACPYRVRFIHPVSKTADKCDFCRKTNLKAGKQPACVESCPTKALTFGNLDDPNSDISRLLRQKTTYRYKLALGTKPKVYRVPFNYGEVSQ

SEQ ID NO: 67695 - DNA, 768 bp, Azoarcus sp. EbN1
  CDS (1)..(768): transl_table=11
atgagcgacgcacacgacgaccaacctaacggacgccgcaagttcgtcacggccctggccgcaggcgcgacagcgaccgcggtggctttgacggccagggccaagcccgaggaccggggcgcggccagcgaaggaaaggccatccagtacggcatgctgatcgatgtgcgtcgctgcatcggttgccattcctgcaccgtcgcctgcaagagcgagcacgacgtgccggccggggtgaaccgcagctgggtcgagtacgtggagaagggcgaatatccgaacgtcgcccgcagtttcctgccgcggctgtgcaaccactgctcggtcccgcagtgcgttagcgtgtgcccgacgggcgccacttacaagcgcccggaggatggcgtggtggtcgtcgactccggggtctgcatcggctgcaagtactgcatccaggcctgcccttacgacgcgcgctttctcaatcctcataccggctttgccgacaagtgcgatttctgtatcggccgcgtgaccaacgggctggtaccggcctgcgtcgagacctgcatcggcggcgcgcgcatcttcggcgaagtgagtgaccctgacagcacgatctcccggctgatcgcgaaaaatcccgtcaccgtgttgcggcgggagatgggaaccatgcccaacgtgtattacatcggcgcggaccactccgacgagagcgacgcccgtcgcccggaggtgcgctatgtccgcgtcacgacccaccgcccgcagctcaagaggagatga

SEQ ID NO: 67696 - protein, 255 aa, Azoarcus sp. EbN1
MSDAHDDQPNGRRKFVTALAAGATATAVALTARAKPEDRGAASEGKAIQYGMLIDVRRCIGCHSCTVACKSEHDVPAGVNRSWVEYVEKGEYPNVARSFLPRLCNHCSVPQCVSVCPTGATYKRPEDGVVVVDSGVCIGCKYCIQACPYDARFLNPHTGFADKCDFCIGRVTNGLVPACVETCIGGARIFGEVSDPDSTISRLIAKNPVTVLRREMGTMPNVYYIGADHSDESDARRPEVRYVRVTTHRPQLKRR

SEQ ID NO: 67697 - DNA, 606 bp, Azoarcus sp. EbN1
  CDS (1)..(606): transl_table=11
atggcacgcatgaaattcctgtgtgacgccgagcgctgcatcgaatgcaacggctgcgtcacggcctgcaagaacgagcacgaagtgccgtggggcatcaatcgccgacgcgtcgtcacgatcaacgacggggtgccgggcgagcgctcgatgtcggtggcgtgcatgcactgctcggacgcgccgtgcatcgcggtgtgtccgacgaacgtgatctatcacaccgaggaaggcgtcgtgctgcacgacaaggacggttgcatcggctgcggctactgcttctacgcctgtccgttcggcgcgccgcagttcccgaacggcccggcggcgttcggcgcgcgcggcaagatggacaaatgcacgttctgcgccggcggtccggaagaaaaccactccgacgccgagttcgagaagtacggccgcaaccggctcgccgccggcaagttgccgctgtgcgccgagatgtgctcgacgaaagcactgctcgccggcgacgcggccgagctttccgacatcttccgcgaacgcgcgctgcggcgcggcaaagggttcgaggcgtggggctggatgacggcgtatggcaaggacaaggaggaagcgaaatga

SEQ ID NO: 67698 - protein, 201 aa, Azoarcus sp. EbN1
MARMKFLCDAERCIECNGCVTACKNEHEVPWGINRRRVVTINDGVPGERSMSVACMHCSDAPCIAVCPTNVIYHTEEGVVLHDKDGCIGCGYCFYACPFGAPQFPNGPAAFGARGKMDKCTFCAGGPEENHSDAEFEKYGRNRLAAGKLPLCAEMCSTKALLAGDAAELSDIFRERALRRGKGFEAWGWMTAYGKDKEEAK

SEQ ID NO: 67699 - DNA, 603 bp, Azoarcus sp. EbN1
  CDS (1)..(603): transl_table=11
atgagatggggaatggtgatcgacctcaagcgctgcatcgcctgttacggctgccagctcgcgtgcaaggcggagaacggcacgccacccggggtgttcttcgcccggctgctcaagcatgaagaggggcagttcccgacggtgcgacaactgttcctgccggtgctgtgcaaccactgcgaggacccgccgtgcgtggaagtgtgcccgaccggcgcaagcttcaagtgcgacgacggcatcgtcgatattgatcccgacaagtgcgtcggctgtcgcacctgcatgatggcctgcccgtacggcaatcgctacttcaacgacaagccgcagcactacttcccgcaaggctcgacaccgttcgaggagaagcgcaccgcgcgccaccagaccgacgtggtgatgaagtgcaacttctgccgcgaccgcgtcaaggccggcaagcagccggcctgcgtcgcgaactgcccgaccgtggcgcgctacttcggcgacctcgacgacccgaacagcgaagtctcgcgcctcatcaaggaccgcggcggttttccgctgcacccggagttgggcaccggaccttccgtttattacctgccggcctga

SEQ ID NO: 67700 - protein, 200 aa, Azoarcus sp. EbN1
MRWGMVIDLKRCIACYGCQLACKAENGTPPGVFFARLLKHEEGQFPTVRQLFLPVLCNHCEDPPCVEVCPTGASFKCDDGIVDIDPDKCVGCRTCMMACPYGNRYFNDKPQHYFPQGSTPFEEKRTARHQTDVVMKCNFCRDRVKAGKQPACVANCPTVARYFGDLDDPNSEVSRLIKDRGGFPLHPELGTGPSVYYLPA

SEQ ID NO: 67701 - DNA, 711 bp, Azoarcus sp. EbN1
  CDS (1)..(711): transl_table=11
atgagtgaagaactcagggtctcgccgatcgagaccagggaggtgccgggcaagcgccggttcgcgatggtggtcgacacgcgtcgctgcatcggctgcatggcctgccaggtggcgtgcaaggctgagtacgacaccccgctcggggtcaatcgcacctgggtgccgtacaaggtggtcggcaagtaccccaacgtgaagaagcacttcctgccgcggctgtgcaaccactgcgacgatccgccctgcgtccgcagctgcccggtggaggccaccttcaaggtggacgacggcggcttcgtgctgcaacgctacgagcgctgcatcggctgccgtagctgcatggcggcctgcccctacaacgcgcgcttcatgctgccctcgcaccggacctacacgccgatcaccaaggtggtcgacaaatgcaccttctgcttccatcgcgtcacccagaacctggtgccggcctgcgtgcagacctgcatcgggcgctcgcgcatcttcggcgacctcaacgatcccaacagcgaggtttcgtatctggtggcgacccacgccacccaggtgctgcgccccgaggaaggaaccaagccgcacgtcttctacatcggcgccgatcgcaatgcgaccgagttcccgcgcgacgcctaccgccaacccgaggtgatggagcaggagcgcaccgcgttcaagcgccacttcgacatctga

SEQ ID NO: 67702 - protein, 236 aa, Azoarcus sp. EbN1
MSEELRVSPIETREVPGKRRFAMVVDTRRCIGCMACQVACKAEYDTPLGVNRTWVPYKVVGKYPNVKKHFLPRLCNHCDDPPCVRSCPVEATFKVDDGGFVLQRYERCIGCRSCMAACPYNARFMLPSHRTYTPITKVVDKCTFCFHRVTQNLVPACVQTCIGRSRIFGDLNDPNSEVSYLVATHATQVLRPEEGTKPHVFYIGADRNATEFPRDAYRQPEVMEQERTAFKRHFDI

SEQ ID NO: 67703 - DNA, 594 bp, Silicibacter pomeroyi DSS-3
  CDS (1)..(594): transl_table=11
atggcaagagcaaagtttctctgtgacgccgagcgctgcatcgagtgcaacgcctgcgtgaccgcctgcaagaacgagcacgaagtgccctggggcatcaaccgccgcagggtggttacgatcaatgacggcaaaccgggcgaacgctcgatctcggtggcctgcatgcattgctcggacgccccctgtatggcggtctgcccggtggactgcttctatcagaccgaagacggtgtggtgttgcattccaaggatctgtgcatcggctgtggctattgcttctacgcgtgcccgtttggcgcgccgcaatatccgcaggcgggcaacttcggatcgcgcggcaagatggacaagtgcaccttctgcgccggtggcccggaagagacccattcgacggccgaattcgccaaatacgggcgcaaccggatcgccgagggcaagctgcccatctgcgccgagatgtgttcgaccaaggcactgctggccggtgacggcgacgtggtctcggccatctaccgcgaacgcgtcgtggcgcgcggctttggtacaggcgcctggggctggggcaccgcctatgaccagaagggcggctga

SEQ ID NO: 67704 - protein, 197 aa, Silicibacter pomeroyi DSS-3
MARAKFLCDAERCIECNACVTACKNEHEVPWGINRRRVVTINDGKPGERSISVACMHCSDAPCMAVCPVDCFYQTEDGVVLHSKDLCIGCGYCFYACPFGAPQYPQAGNFGSRGKMDKCTFCAGGPEETHSTAEFAKYGRNRIAEGKLPICAEMCSTKALLAGDGDVVSAIYRERVVARGFGTGAWGWGTAYDQKGG

SEQ ID NO: 67705 - DNA, 807 bp, Silicibacter pomeroyi DSS-3
  CDS (1)..(807): transl_table=11
ttgccaagaaaattcgtcgaattttcttgcgtgtgcccgtggctgctggagcgtgacatgacggagctgccgcagaagaccgaccgtaagctggggctggtgatcgacctcgatacctgtgtcggctgccatgcctgcgtgatttcctgcaagggatggaacaccgagaattacggcgccccgctcagcgatcaggatccgtatggcgccgatccgtcgggcaccttcctgaaccgggtgcattcctatgaggtgcagccgcccgaggggcacgcccagctggtccatttcccgaaatcctgcctgcattgcgaggacgcgccctgtgtgaccgtctgcccgacgggcgccagctacaaacgctccgaggacgggatcgtgctggtcaacgagagcgattgcatcggctgtggcctctgcgcctgggcctgcccctatggcgcgcgtgagctggatctggccgaaggcgtgatgaagaaatgcaccctgtgtgtggatcgtatctataacgagaacctgcccgaggaggaccgcgtcccctcctgtgtgcgcacctgcccggcgggtgcgcggcatttcggcgatctgggtgatccggatagcgcggtgtcgcacctggtggccgagcgcggcggcatggatctgatgcccgaaatgggcaccaggcccgtgaacaagtatctgccgccccggcccaaggaccagatcgaagcgcagatcgacattctggcgcccctgctggcgccggtcgccgatgagcccaaggggttcatggcctggctcgacaaggcactggagaaactctga

SEQ ID NO: 67706 - protein, 268 aa, Silicibacter pomeroyi DSS-3
MPRKFVEFSCVCPWLLERDMTELPQKTDRKLGLVIDLDTCVGCHACVISCKGWNTENYGAPLSDQDPYGADPSGTFLNRVHSYEVQPPEGHAQLVHFPKSCLHCEDAPCVTVCPTGASYKRSEDGIVLVNESDCIGCGLCAWACPYGARELDLAEGVMKKCTLCVDRIYNENLPEEDRVPSCVRTCPAGARHFGDLGDPDSAVSHLVAERGGMDLMPEMGTRPVNKYLPPRPKDQIEAQIDILAPLLAPVADEPKGFMAWLDKALEKL

SEQ ID NO: 67707 - DNA, 939 bp, Dehalococcoides ethenogenes 195
  CDS (1)..(939): transl_table=11
atgacagataaacgtaaacagggaaattcccagtcaactccccctccaacccgcagggattttataaaaagctccggtggtgtgctgggtctggcagctataataaagctggacgaaggcactcagaatttcaaagcggctgttgcacccccctctgcggccagctttccgccggaagaaaccactttccttcccagccctgttaaggaagacccccttatccggatgcaggaagatttgcgccgggccatgcagaaaccagccgccgaacgccactgggctatggtaataaaccttaggaaatgtgtcggctgtcatgcctgcaccgaagcctgcatctcggaaaacaaactccctccgggggtgatataccgctttgttatggacgaagagatgggccagtaccctaatgtctcccggcgtttcactccccgcccctgcatgcactgtgacaatcccccctgcaccaaagtctgcccggtgggtgccacctttaaacagccggacgggatagtggtaattgactatcaccgctgcataggctgccgtttttgcatagtggcctgcccttatgttgcccggactatggactacggcgataactatctggaagacgaacctgaggactccggcctggtgctgggttatgagcaaggcggggtctggcaaagtgcccccagttttgaatacggctaccaacattcacgcacccccaaacgggactcacccatcggcaatgccagaaaatgccatttctgtctgcaccgcttggaaaagggcatgctgccggcctgtgtcaccacctgcatcggccgggtaaactacttcggtgatgccaatgaccctgacagcctggtttcggaactgatagccaacccgggcattatccagcttaaatcagagctgggcactgacccttcagtttattatttattttaa

SEQ ID NO: 67708 - protein, 312 aa, Dehalococcoides ethenogenes 195
MTDKRKQGNSQSTPPPTRRDFIKSSGGVLGLAAIIKLDEGTQNFKAAVAPPSAASFPPEETTFLPSPVKEDPLIRMQEDLRRAMQKPAAERHWAMVINLRKCVGCHACTEACISENKLPPGVIYRFVMDEEMGQYPNVSRRFTPRPCMHCDNPPCTKVCPVGATFKQPDGIVVIDYHRCIGCRFCIVACPYVARTMDYGDNYLEDEPEDSGLVLGYEQGGVWQSAPSFEYGYQHSRTPKRDSPIGNARKCHFCLHRLEKGMLPACVTTCIGRVNYFGDANDPDSLVSELIANPGIIQLKSELGTDPSVYYLF

SEQ ID NO: 67709 - DNA, 804 bp, Dehalococcoides ethenogenes 195
  CDS (1)..(804): transl_table=11
atgcctaatggaatgctgattgataccactagatgtactggttgtcgaggctgtcaggtagcctgtaaacagtggaacgaaaaccctgctgtcaagacaactttcagtcctgaagtgaccaatcccctggaacagaacgcattcaactacaacctgctggagtgcagggagattgaagaagacggaaaacttaactggattttcgctcacaagaggtgtttgcactgctatgaaccggcttgcgtttcggtatgtccggtcggtgccctccacaaacggcctaccggtgcagtagtctgggatcaggacaaatgcttcggctgccgttactgccagaacgcctgccccttccaaatccccaaatttgagtgggatgacaactgggctaaaatcaccaaatgcaccatgtgctggaacagagtggaaaacggtgtagaaccggcttgtgcagctacctgccccaccggtgctatcaaattcggcgaacgggctgacctgctggccgaagcctatgaaagacttgcaaatgaccctgacagatattacccctatgtttacggcgaaaaagaagccggcggtactcatgttttgtatttaagcagtgttgaacccgaaaaaatcggctttgacatgcatgagaatgagttcttccccagcttcaccagagaattcctgggcaacatacctttggaaatctctatagtagcttcgctgatggttggcatatggtatttccgcggccgcagaattcaggcgcaggcacacgatgccgagcatgctgaaaacaaggctggcaagcactag

SEQ ID NO: 67710 - protein, 267 aa, Dehalococcoides ethenogenes 195
MPNGMLIDTTRCTGCRGCQVACKQWNENPAVKTTFSPEVTNPLEQNAFNYNLLECREIEEDGKLNWIFAHKRCLHCYEPACVSVCPVGALHKRPTGAVVWDQDKCFGCRYCQNACPFQIPKFEWDDNWAKITKCTMCWNRVENGVEPACAATCPTGAIKFGERADLLAEAYERLANDPDRYYPYVYGEKEAGGTHVLYLSSVEPEKIGFDMHENEFFPSFTREFLGNIPLEISIVASLMVGIWYFRGRRIQAQAHDAEHAENKAGKH

SEQ ID NO: 67711 - DNA, 432 bp, Dehalococcoides ethenogenes 195
  CDS (1)..(432): transl_table=11
atgaaaagggtacagattaaagaagaactttgtatgggctgcggcctgtgccgtgtagcctgccagaccgaacactcggtctctcatgacgttatcaaggccgtcaaaaaggaaaatcagaagcccagaatacgggtggaacgcaagggtgagataagtttctctgtgccctgccgccactgtgatgagccatggtgtgcttattcctgtatcagcggtgctatgacccgtgaccccataaccggcattgtttccagtgaccctgaaagatgtatcggctgttggacatgcattgtggcctgcccgaatagcgctcttataaaagacaaggctaaccatgtaattctcaagtgtgatttgtgcgggggcaaagaaatacccgcttgcgtagccaactgccctaatgaagctctggggctggttgacggctaa

SEQ ID NO: 67712 - protein, 143 aa, Dehalococcoides ethenogenes 195
MKRVQIKEELCMGCGLCRVACQTEHSVSHDVIKAVKKENQKPRIRVERKGEISFSVPCRHCDEPWCAYSCISGAMTRDPITGIVSSDPERCIGCWTCIVACPNSALIKDKANHVILKCDLCGGKEIPACVANCPNEALGLVDG

SEQ ID NO: 67713 - DNA, 507 bp, Thermococcus kodakarensis KOD1
  CDS (1)..(507): transl_table=11
atgacgaggaggatactccacgttgattacagcctttgcattggttgtgagacgtgcgaaggagtctgcgactttattcacggcggcagacccaacataaaggtctattacaccattacagggatccccgttcccataaactgtcgtcactgtgagaaagccccatgtatggacgtctgtcctgcgggggcgatctaccgcgacagcgatggggccgttataataaaccccaataagtgcataggctgtctgatgtgcctcgccgcctgtcctttcggagttcccacttttgatgtcaagctcaaggcagttactaagtgcgacatgtgtgctgatagaagaaggcttggaacggccccagcgtgtgccgaaatgtgtccggcaggggccatattcttcggaaagcccgaggaagtcgaggaaaaagttaggagaagaaccgccgaaaagatagcacgggagcggctggcggcggttaacttggagggagtcggacggatgctctga

SEQ ID NO: 67714 - protein, 168 aa, Thermococcus kodakarensis KOD1
MTRRILHVDYSLCIGCETCEGVCDFIHGGRPNIKVYYTITGIPVPINCRHCEKAPCMDVCPAGAIYRDSDGAVIINPNKCIGCLMCLAACPFGVPTFDVKLKAVTKCDMCADRRRLGTAPACAEMCPAGAIFFGKPEEVEEKVRRRTAEKIARERLAAVNLEGVGRML

SEQ ID NO: 67715 - DNA, 501 bp, Thermococcus kodakarensis KOD1
  CDS (1)..(501): transl_table=11
atggccagaaagaccgtttttatagacttttcaaagtgcatcgagtgccgcgcctgtgaggtagcctgcgagcgcgaacacaacggaagatcattcataaacgtctttgaatggcaggaaatggccgcgatggccctcaactgccgccactgtgagaaggctccctgcctcgaggtctgcccgacaaacgcactctatcgcgatggggatggagcagttctgctcgccccccagaagtgcattggctgtctgatgtgtggaatcgtgtgcccctttggaataccagagcttgactcccttgacaagataatgatgaagtgcgacctctgcgcccacaggagagccgaaggaaagctcccggcgtgtgtggaaacctgcccgaccgatgcccttctcttcggcgacttcaacgacatccaaaggatgaggagacaaaagttcaccgaaaaggcgatagagatagccaagagcggcgagagaatacagttcaggggtgtgtag

SEQ ID NO: 67716 - protein, 166 aa, Thermococcus kodakarensis KOD1
MARKTVFIDFSKCIECRACEVACEREHNGRSFINVFEWQEMAAMALNCRHCEKAPCLEVCPTNALYRDGDGAVLLAPQKCIGCLMCGIVCPFGIPELDSLDKIMMKCDLCAHRRAEGKLPACVETCPTDALLFGDFNDIQRMRRQKFTEKAIEIAKSGERIQFRGV

SEQ ID NO: 67717 - DNA, 687 bp, Vibrio fischeri ES114
  CDS (1)..(687): transl_table=11
atgagttgttctagacgaaattttttagctggttcaggtgcggttattttcacaacaggtgttgcgacaacatcattaataaacagtaaaaaaaccttagcgtattccatggaagatggttcaaagcgttatggtatggttcatgatgaaaacgcgtgtatcggctgcacagcatgtacggaagcatgtagagaagtaaaccgtgttcctgaaggggtaacacgtttagaaatcatccgtagtgagcccaaaggtgagtttcctgatgttgaataccgttttactcgtaagtcatgtcaacattgtgaaaatgctccttgtgtaatggtgtgtcctaccggtgcggcatataaagatgaaacaacaggaattgttgatgttcataacgaaaaatgtgttggctgtggctattgtttggcagcttgtccgtatcaagttcgtttctttaatcctgtgactaaatcggcagataagtgtgatttttgccgtgaaacaaacttagcagaaggtaagcaaccggcttgtgttgaatcttgtccgacaaaagcactgacctttggtgatttaaacgataaagatagcgagattaatgcggtattgaatagtaacccagtataccgtgacaaagtggatctaggtaccaagcctaaattgtataagattccatatttaaaaggggagatttaa

SEQ ID NO: 67718 - protein, 228 aa, Vibrio fischeri ES114
MSCSRRNFLAGSGAVIFTTGVATTSLINSKKTLAYSMEDGSKRYGMVHDENACIGCTACTEACREVNRVPEGVTRLEIIRSEPKGEFPDVEYRFTRKSCQHCENAPCVMVCPTGAAYKDETTGIVDVHNEKCVGCGYCLAACPYQVRFFNPVTKSADKCDFCRETNLAEGKQPACVESCPTKALTFGDLNDKDSEINAVLNSNPVYRDKVDLGTKPKLYKIPYLKGEI

SEQ ID NO: 67719 - DNA, 618 bp, Salmonella enterica subsp. enterica serovar Choleraesuis str
  CDS (1)..(618): transl_table=11
atgacaacccagtatggattttttattgattccagccgttgcaccggttgcaaaacctgcgaactggcctgcaaggactacaaagatttgaccccggatgtcagcttccgtcgcatttatgagtatgcaggtggcgactggcaggaggataacggcgtctggcaccagaacgtctttgcctactatctctccatctcctgtaaccactgcgaagacccggcctgcaccaaagtctgcccgagcggcgcgatgcacaagcgcgatgacggttttgtggtggtgaacgaagaggtctgtatcggttgccgctactgccacatggcctgcccgtacggcgcgccgcagtacaacgcggccaaaggtcatatgaccaagtgcgatggctgttatgaccgggtggcggaaggtaagaaaccgatctgcgtcgaatcctgtccgctgcgggcgctggatttcggcccgatagacgaactgcgcaaaatacacggtgagctggctgccgtcgcgccgttgccgcgcgcgcatttcacgaagccgaatattgtgattaaacccaacgccaacagccgcccgaccggggacaccaccggttatctggccaatccgaaggaggtataa

SEQ ID NO: 67720 - protein, 205 aa, Salmonella enterica subsp. enterica serovar Choleraesuis str
MTTQYGFFIDSSRCTGCKTCELACKDYKDLTPDVSFRRIYEYAGGDWQEDNGVWHQNVFAYYLSISCNHCEDPACTKVCPSGAMHKRDDGFVVVNEEVCIGCRYCHMACPYGAPQYNAAKGHMTKCDGCYDRVAEGKKPICVESCPLRALDFGPIDELRKIHGELAAVAPLPRAHFTKPNIVIKPNANSRPTGDTTGYLANPKEV

SEQ ID NO: 67721 - DNA, 735 bp, Salmonella enterica subsp. enterica serovar Choleraesuis str
  CDS (1)..(735): transl_table=11
atggacagcagtaaacggcaatttctccagcagcttggcgtcctgaccgctggcgcctcgctggttccgctggctgaagcgaaatttcctttttcgccggagcggcatgaaggctctccccgacaccgttacgccatgcttatcgacctgcggcgttgtatcggctgtcagtcctgtaccgtaagttgcactattgaaaaccaaacgccgcaaggcgcgtttcgtacgacggtgaaccaataccaggtccagcgtgaaggtagtcaggaagtcacgaatgtgctgttgccgcgtctgtgcaaccattgcgataaccccccctgtgtgccggtctgcccggtacaagccacctttcagcgggaagatggcattgtggtggtggataacaaacgctgcgtcggctgcgcctattgtgtacaggcgtgtccttacgacgcccgatttatcaatcatgaaacgcaaactgccgataaatgcacgttttgcgtccatcgtctggaagccgggctgttacccgcttgcgtagagtcctgcgtcggcggcgcgcgtattattggcgatatcaaagatccccatagccgcatcgccaccatgcttcatcagcatcgcgacgctatcaaggtattaaagccggaaaacggcacgtcgccccatgttttctacctgggtctggacgacgcctttgtcaccccattaatgggccgtgcgcagcccgcgctttggcaggaggtctga

SEQ ID NO: 67722 - protein, 244 aa, Salmonella enterica subsp. enterica serovar Choleraesuis str
MDSSKRQFLQQLGVLTAGASLVPLAEAKFPFSPERHEGSPRHRYAMLIDLRRCIGCQSCTVSCTIENQTPQGAFRTTVNQYQVQREGSQEVTNVLLPRLCNHCDNPPCVPVCPVQATFQREDGIVVVDNKRCVGCAYCVQACPYDARFINHETQTADKCTFCVHRLEAGLLPACVESCVGGARIIGDIKDPHSRIATMLHQHRDAIKVLKPENGTSPHVFYLGLDDAFVTPLMGRAQPALWQEV

SEQ ID NO: 67723 - DNA, 579 bp, Salmonella enterica subsp. enterica serovar Choleraesuis str
  CDS (1)..(579): transl_table=11
atgaatcatttaacgaatcagtacgtcatgctgcatgatgaaaaacgttgtatcggctgccaggcgtgtaccgttgcctgcaaagtgcttaatgacgtaccggagggatttagccgcgtacaggtacaaattcgcgcccctgaacaggcatccaacgcactaacccattttcaatttgtccgcgtctcctgtcagcactgtgaaaatgcgccatgtgtcagcgtttgtcctaccggagcgtcatatcgtgatgaaaacgggatcgtgcaggtggataaatcgcgctgtattggctgcgattattgtgttgccgcgtgtcctttccatgtgcgctatttgaatccgcaaaccggcgtcgccgacaagtgtaacttctgtgccgacacgcggttggcggctggccagtctccggcgtgcgtatccgtttgcccaacggacgcgctgaaattcggcagactggatgagagcgagatccagcgctgggtcggtcagaaagaggtctatcgccagcaggaagcgcgtagcggcgcggtcagtctgtaccgtcgtaaagaaatccatcaggagggtaaagcatga

SEQ ID NO: 67724 - protein, 192 aa, Salmonella enterica subsp. enterica serovar Choleraesuis str
MNHLTNQYVMLHDEKRCIGCQACTVACKVLNDVPEGFSRVQVQIRAPEQASNALTHFQFVRVSCQHCENAPCVSVCPTGASYRDENGIVQVDKSRCIGCDYCVAACPFHVRYLNPQTGVADKCNFCADTRLAAGQSPACVSVCPTDALKFGRLDESEIQRWVGQKEVYRQQEARSGAVSLYRRKEIHQEGKA

SEQ ID NO: 67725 - DNA, 630 bp, Salmonella enterica subsp. enterica serovar Choleraesuis str
  CDS (1)..(630): transl_table=11
atgagtcagtttacacattacccgccggtgagcgataaacaactgggatttttcatcgactcctcacgctgctccggttgtaaagcctgccaggtggcctgcaaagacaaaaacaatctggaagtaggccgtcgtttcctccgcgtctatgaagtcaagggcggaagtttcatcccgaccgggcagggtggggtcagcaataacgtatttgcttatacgctttccatttcctgcaaccactgtgcggaccctgtctgcaccaaaaattgcccgactaccgctatgcataaacgcccgggtgacggcattgtgcgcgttgataccgacaaatgcgtcggctgtggctattgcgcctggtcctgcccttatggcgcgccgcagcttaacgagcagaccggccaaatgtctaagtgcgacatgtgcgttgatttactggcgaaaggtgaaccgcccgtctgtgttgcgacctgtccgctggaggccatcaagtttggtccgattgatgaactgcgcgcgaagtacggtagcgtatgcgacgttaacgggctgccagattcatccataaccaaacctaatctggttgttaaagcgcatcagggcgcagaaaaagagggtaaacgccatgcatga

SEQ ID NO: 67726 - protein, 209 aa, Salmonella enterica subsp. enterica serovar Choleraesuis str
MSQFTHYPPVSDKQLGFFIDSSRCSGCKACQVACKDKNNLEVGRRFLRVYEVKGGSFIPTGQGGVSNNVFAYTLSISCNHCADPVCTKNCPTTAMHKRPGDGIVRVDTDKCVGCGYCAWSCPYGAPQLNEQTGQMSKCDMCVDLLAKGEPPVCVATCPLEAIKFGPIDELRAKYGSVCDVNGLPDSSITKPNLVVKAHQGAEKEGKRHA

SEQ ID NO: 67727 - DNA, 903 bp, Salmonella enterica subsp. enterica serovar Choleraesuis str
  CDS (1)..(903): transl_table=11
atggcttatcaatcgcaagacatcattcgtcgttccgccactaacggtttcacccccgcgccccaggcgcgggaccaccaggaagaggtggcgaaactcatcgacgtcaccacctgtatcggctgtaaagcgtgtcaggtggcgtgctccgagtggaacgacatccgtgatgaagtgggcaataacgtcggggtgtatgacaacccggcggacttaaccgcgaaatcctggacggtgatgcgcttctcggaagtggaacagaacgacaaactggagtggctgatccgtaaggatggctgtatgcactgcgccgatccaggctgcctgaaggcctgtccggcggaaggggcgatcattcagtacgctaacggtattgtcgacttccagtccgagcagtgtatcggctgcggctactgtatcgctggctgcccgttcaacgtgccgcgcctcaacccggaagacaaccgcgtctataaatgtacgctgtgcgttgaccgtgtggtggtcggccaggaaccggcctgcgtgaagacctgtccaaccggcgccattcattttggctcgaaagaggatatgaaaacgctggcgggcgagcgggtggcggaactaaaaacccgtggttatgacaacgcgggtctgtacgatccggcgggcgtaggcggtacgcatgtcatgtacgtgctgcatcatgccgacaagccgaatctgtatcacggtctgccggagaacccggaaatcagcgaaaccgttaagttctggaaaggcgtctggaaaccgctcgccgcgttcggttttgccgcgacctttgccgccagcgtcttccactatgtcggcgtcggcccgagccgcgcggaagaggaagatgacaacctgcatgaagagaaagacgaggtgcgcaaatga

SEQ ID NO: 67728 - protein, 300 aa, Salmonella enterica subsp. enterica serovar Choleraesuis str
MAYQSQDIIRRSATNGFTPAPQARDHQEEVAKLIDVTTCIGCKACQVACSEWNDIRDEVGNNVGVYDNPADLTAKSWTVMRFSEVEQNDKLEWLIRKDGCMHCADPGCLKACPAEGAIIQYANGIVDFQSEQCIGCGYCIAGCPFNVPRLNPEDNRVYKCTLCVDRVVVGQEPACVKTCPTGAIHFGSKEDMKTLAGERVAELKTRGYDNAGLYDPAGVGGTHVMYVLHHADKPNLYHGLPENPEISETVKFWKGVWKPLAAFGFAATFAASVFHYVGVGPSRAEEEDDNLHEEKDEVRK

SEQ ID NO: 67729 - DNA, 672 bp, Salmonella enterica subsp. enterica serovar Choleraesuis str
  CDS (1)..(672): transl_table=11
atgagttgcacccgacgtcaatttattacccgcgtcggcgcgctggcggcggtcagtgggatggcaggacgcgttgtagcgaacacgttgaatattaacggcgtgcgttatggcatggtacacgatgagtcattatgcatcggctgcacggcctgcatggatgcctgtcgggaagtcaacaacgtgccggaaggcgtatcgcgcctgacgattattcgcagcgagccgcaggggacgtttcctgatgtgaaatatcgcttcttccgccactcgtgccagcattgcgaccatgccccctgcgttgacgtctgcccgacgggggcatcattccgcgatgccgccagtggtattgtcgacgtgaacccggacctttgcgtcggctgtcagtactgcattgccgcgtgtccctaccgcgtgcgctttatccatccggtcagtaagacggcggataagtgcgatttctgccggaaaatcaacctgaaagcgggcaaacagcccgcctgcgttgagtcatgtccaacgaaggcgctgacgtttggtaatctggacgatcccaacagcgatatctcccgtttgttgcggcaaaaaaccacctatcgttacaagctggcgctgggcacaaaaccgaaggtctaccgcgttccctttaactatggggaggtgagccaatga

SEQ ID NO: 67730 - protein, 223 aa, Salmonella enterica subsp. enterica serovar Choleraesuis str
MSCTRRQFITRVGALAAVSGMAGRVVANTLNINGVRYGMVHDESLCIGCTACMDACREVNNVPEGVSRLTIIRSEPQGTFPDVKYRFFRHSCQHCDHAPCVDVCPTGASFRDAASGIVDVNPDLCVGCQYCIAACPYRVRFIHPVSKTADKCDFCRKINLKAGKQPACVESCPTKALTFGNLDDPNSDISRLLRQKTTYRYKLALGTKPKVYRVPFNYGEVSQ

SEQ ID NO: 67731 - DNA, 939 bp, Haemophilus influenzae 86-028NP
  CDS (1)..(939): transl_table=11
atggctggaactgctcaaggcgttcaaacgcaagacgttattaaaatctccgcaacatctggtttaacaccagcaccacaagcgagagatcataaagttgaagtcgcaaaattaattgatgtttcaacttgtataggatgtaaagcctgtcaagtgggttgttcagagtggaatgatattcgctctgatatcaatgcacaatgtgttggggtttatgacaatccagttgatcttgatgcaaaagcatggacggtgatgcgttttaacgaagttgaagaaaacgatcgtttagaatggctgattcgtaaagatggctgtatgcactgcacagaacctggttgtttaaaggcttgtcctgcacccggtgcaatcattcaatatgctaacggtattgtagatttccaatccgataaatgtattggttgtggttattgtattgcaggctgtccattcaatattccacgaatgaatcctgaagacaatcgtgtatacaaatgtactctttgtgtggatcgtgtttctgtgggacaagagccagcttgcgtgaaaacctgtccaacaggtgctattcgtttcggctctaaagaagaaatgaaaatttacgcagaacaacgcgtggcagatttaaaatcccgtggttatgaaaacgcaggactttacgatcctccaggtgtaggcggtacacacgtaatgtatgtgttgcatcacgcagataaacctgagctttacaatggtcttccaaaagatcctcaaattgatttgagtgtgaccttatggaaagatgtattgaaaccagtcgctgcagttgcaatgggtggtctagctctagcagaagttgcgcactacttaaccgttggcccaaatgtagaagaagatgtggaagatcatcatcacgaatttgaagaaaataaaccatccaagggggaaaataatgagtaa

SEQ ID NO: 67732 - protein, 312 aa, Haemophilus influenzae 86-028NP
MAGTAQGVQTQDVIKISATSGLTPAPQARDHKVEVAKLIDVSTCIGCKACQVGCSEWNDIRSDINAQCVGVYDNPVDLDAKAWTVMRFNEVEENDRLEWLIRKDGCMHCTEPGCLKACPAPGAIIQYANGIVDFQSDKCIGCGYCIAGCPFNIPRMNPEDNRVYKCTLCVDRVSVGQEPACVKTCPTGAIRFGSKEEMKIYAEQRVADLKSRGYENAGLYDPPGVGGTHVMYVLHHADKPELYNGLPKDPQIDLSVTLWKDVLKPVAAVAMGGLALAEVAHYLTVGPNVEEDVEDHHHEFEENKPSKGENNE

SEQ ID NO: 67733 - DNA, 618 bp, Haemophilus influenzae 86-028NP
  CDS (1)..(618): transl_table=11
atggaacaatatggtttttattttgattctgaacgctgcacaggctgtaaaacttgtgaattagcctgtaaggattacaaagatcttggcacagaagtcaattttcgtcgtatttatgaatatacaggtggtcagtggaatcaacaagcagatggatgctggcatcaaaatatatttgcttattatatgtctatttcttgtaatcattgtgcagatcctgcttgtacaaaagtttgcccaactggtgcaatgcacaaaaatgcagatggtttcgtgatcgtcaatgaagaaatttgtatcggttgtcgttattgccatatggcatgtccttatgatgcaccgcaatatgatgcacaaaaaggtcatatgacaaaatgtgatggatgttattctcgcgtaaaatcaggtcaaaaaccgatttgtgctgatgcctgcccactacgagcattggatttcgctcctattgatgaacttcgagcaaaatacggcactcaagcctccatcgcaccactaccaccggctgatatcactcaaccaaatttagttgtaaaacccaataaacacgctcgtttaagtggcgatacaagtgggttcttaggaaacccaagagaggtgtaa

SEQ ID NO: 67734 - protein, 205 aa, Haemophilus influenzae 86-028NP
MEQYGFYFDSERCTGCKTCELACKDYKDLGTEVNFRRIYEYTGGQWNQQADGCWHQNIFAYYMSISCNHCADPACTKVCPTGAMHKNADGFVIVNEEICIGCRYCHMACPYDAPQYDAQKGHMTKCDGCYSRVKSGQKPICADACPLRALDFAPIDELRAKYGTQASIAPLPPADITQPNLVVKPNKHARLSGDTSGFLGNPREV

SEQ ID NO: 67735 - DNA, 678 bp, Haemophilus influenzae 86-028NP
  CDS (1)..(678): transl_table=11
atgacagtctgctcacgccgaaactttgtttctggcatgggggcagtgatccttatgacgggaacatctttaccttcttttgcaaaagaagacaaggcggataaacctaaacgttacgcaatgatacatgatgaaaatgcgtgtatcggttgtacagcctgtatggactcatgtcgtgatgtaaaccaagtgccagaaggcgtttctcgcttagagattctacgtagtgaaccttatggggaatttccaaatcaagaatacgagttctttcgtcaatcttgccaacattgtacaaatgcaccttgtgtagcagtttgtccaactggtgcatcttttattgataaagagactggcattgtagatgtacataaagatttatgcgtaggctgccaatactgtatagcagtttgcccatatcgtgtacgttttattcatccagtacatcgtaccgcagataaatgtaacttctgccgcgatacaaatttagccaatggtaaacaacctgcttgcgtagaggcttgcccaaccaaagcattaacctttggggatatgaatgatccaacaagtgcagtttcacgtaaagtgaaagaaaaaccggtttatcgcactaaagtggaattaggtacacaaccaaacttatatcacattccattccaacatggggagcctagaagatga

SEQ ID NO: 67736 - protein, 225 aa, Haemophilus influenzae 86-028NP
MTVCSRRNFVSGMGAVILMTGTSLPSFAKEDKADKPKRYAMIHDENACIGCTACMDSCRDVNQVPEGVSRLEILRSEPYGEFPNQEYEFFRQSCQHCTNAPCVAVCPTGASFIDKETGIVDVHKDLCVGCQYCIAVCPYRVRFIHPVHRTADKCNFCRDTNLANGKQPACVEACPTKALTFGDMNDPTSAVSRKVKEKPVYRTKVELGTQPNLYHIPFQHGEPRR

SEQ ID NO: 67737 - DNA, 834 bp, Sulfolobus acidocaldarius DSM 639
  CDS (1)..(834): transl_table=11
atgtcctccacaaatagtactcaaccccaacaaataaccctagacatgtatcaaaacggagttgaatataggttaccgtttaaaccatctaagaactttgcaataataacggatttaaataagtgctttggctgtgcaggttgccagatgtcatgtaaagagtggaacacatcaggtatgttcggaccattacctgaccttaacccttacggagacctagacgtaatgttctggctgagagtgctaaacgttgaagtggggaattggccccaaactaaggtttataatataccaataaactgcttccactgtatgaatgccccttgtgtaccagtatgtccagtgggggcaactttcaagagagttgaagacggtatagtccttgtcgactataacaaatgcataggttgtaaatactgcatttatggctgcccctatggtaacaggttctttgatccagttcaaggagttgtgaaaaagtgtacccattgttttgatagactatacgatacaaccataccaccagaggagagaattccagcatgtattcacggatgcatggttcaggctagaatctgggcaaatatattggatcctacagatccaggaactatactgtttgtggataaaggtggatttgtgatgggacctgagactggagcaaatcctgccagcggttacttaccatggagaagtgattatgcagggaatgaggatgtagagttactatcccaagaagagtacttcaacgtctggactgcaacaggtgtggttcaattagggtcacagggaaccaacagtacaacaactcaaagcaataactccagtagttaa

SEQ ID NO: 67738 - protein, 277 aa, Sulfolobus acidocaldarius DSM 639
MSSTNSTQPQQITLDMYQNGVEYRLPFKPSKNFAIITDLNKCFGCAGCQMSCKEWNTSGMFGPLPDLNPYGDLDVMFWLRVLNVEVGNWPQTKVYNIPINCFHCMNAPCVPVCPVGATFKRVEDGIVLVDYNKCIGCKYCIYGCPYGNRFFDPVQGVVKKCTHCFDRLYDTTIPPEERIPACIHGCMVQARIWANILDPTDPGTILFVDKGGFVMGPETGANPASGYLPWRSDYAGNEDVELLSQEEYFNVWTATGVVQLGSQGTNSTTTQSNNSSS

SEQ ID NO: 67739 - DNA, 696 bp, Dechloromonas aromatica RCB
  CDS (1)..(696): transl_table=11
atgagtgaaggatcaaaagtttcaacaggtgggggcaagaagcgctatgcgatggtggtcgatacccgccgctgcatcggttgcatggcttgtcaggtcgcctgcaaggcggagtacgacaccccgctgggtgtcaatcggacctgggtgccgtacaaggtggtcggcaagtaccccaacgtcaaaaagcagttcctgccccgtttgtgcaaccactgcgaggatcctccgtgcgtgcgcaattgcccggtcgaggccacctttgtggttgaggatggcggctttgttcttcagcgctacgagcgttgcatagggtgccgtagctgcatggcagcctgcccgtacaacgcccgtttcatgctgccgtcacatcggacctacacgccgatcaccaacgtcgtcgacaagtgcaccttctgtttccaccgcgtcacccagaatctggtgcccgcctgcgtccagacctgcatcggccgctcccgcgtcttcggcgatctcaacgatccgaacagcgaggtttcctacctggtggcaaagaacgcgacccaggtactgcgcccggaagaaggcaccaagccgcacgtgttctacatcggggcagaccgcaacgccaccgagttcggtcgcgacgcctaccaaaagcgcgaagtgatggagccggaacgctccgccttcaagaaccacttcaagatctaa

SEQ ID NO: 67740 - protein, 231 aa, Dechloromonas aromatica RCB
MSEGSKVSTGGGKKRYAMVVDTRRCIGCMACQVACKAEYDTPLGVNRTWVPYKVVGKYPNVKKQFLPRLCNHCEDPPCVRNCPVEATFVVEDGGFVLQRYERCIGCRSCMAACPYNARFMLPSHRTYTPITNVVDKCTFCFHRVTQNLVPACVQTCIGRSRVFGDLNDPNSEVSYLVAKNATQVLRPEEGTKPHVFYIGADRNATEFGRDAYQKREVMEPERSAFKNHFKI

SEQ ID NO: 67741 - DNA, 1056 bp, Dechloromonas aromatica RCB
  CDS (1)..(1056): transl_table=11
atgaccacaagacgtgattttttgcgtggttgcctggccagcggcgcagcggcggcttcggccgttctgcccgagacagcctgcgcccgcgataccctgaaacgcccgccggaaggccttggtctgctctacgacgcgaccctgtgcgtcggctgccaggcctgcgtggctgcctgcaagcaggtcaatgaaaacccggccgaattcacggccatggacaagttgtgggatacgccgctcgatacgaccggccacaccttcaacctgatcaagatgtaccgcaacggtacgatggaaaccaaggacagcgagctgaacggcttctccttcatgaagacctcgtgcatgcattgcgccgacccgtcctgcgtctcggcctgcccggtgtcggcgatgaccaagaatcttgaaaccggcatcgtcggctacgacccggacgcctgtatcggctgccgttactgcgtcgccgcctgcccgttcggtattccgaaataccagtacgactcgccgaccggcaagatcggcaagtgcgagctgtgccggcatcgccacaaggacggccattactcggcctgcgccgaggtttgtccgaccggcgcgaccttgtttggtcggaccgaggacctgctggccgaagccaagcgtcgtctggccctgaagccgggtgaatggacgacgattccgcgcggccgcctgcgccccgcccaggagaaggtgctggctggcggcgaggatggcaagggccagaagcatcgtcatggctggcgcgacgaaccggaccagagctatcaggcccaagtcggtaactacctgcagcacgtctatggcgagaccgaatacggcggcacgcaggtactcaagctgtcggccgtcaatttccagaaagtcggcctgcccgacctgccgccgaaatcctcggccgccacctcggaaaccatccagcacacgctgtacggcggactgatcatgccgattgccgtacttgccggcctgacctgggttgccaagcgcaatgtcgtgccggaagacgatgaccagaagggaggcaagtcatga

SEQ ID NO: 67742 - protein, 351 aa, Dechloromonas aromatica RCB
MTTRRDFLRGCLASGAAAASAVLPETACARDTLKRPPEGLGLLYDATLCVGCQACVAACKQVNENPAEFTAMDKLWDTPLDTTGHTFNLIKMYRNGTMETKDSELNGFSFMKTSCMHCADPSCVSACPVSAMTKNLETGIVGYDPDACIGCRYCVAACPFGIPKYQYDSPTGKIGKCELCRHRHKDGHYSACAEVCPTGATLFGRTEDLLAEAKRRLALKPGEWTTIPRGRLRPAQEKVLAGGEDGKGQKHRHGWRDEPDQSYQAQVGNYLQHVYGETEYGGTQVLKLSAVNFQKVGLPDLPPKSSAATSETIQHTLYGGLIMPIAVLAGLTWVAKRNVVPEDDDQKGGKS

SEQ ID NO: 67743 - DNA, 714 bp, Ralstonia eutropha JMP134
  CDS (1)..(714): transl_table=11
atggcccgcatgaaatttatctgtgacgccgagcgctgcatcgaatgcaacagctgcgtcaccgcctgcaagaacgagcatgaggtgccatggggcgtgaaccggcgccgcgtggtcactgtcaacgacggcgtggtcggcgccgagaaatcgatctcggtcgcctgcatgcactgttcggacgcgccgtgcatggcggtctgcccggtcgactgcttctaccgcaccgaagacggcgtggtgctgcacgacaaggatgtgtgcatcggctgcggctactgctcgtacgcatgcccgttcggtgcgccgcagttcccgtccacgggcaccttcggcgtgcgcggcaagatggataaatgcacattctgcgcgggtgggcccgagaagaacggctcggaggccgagttcgagaagtacggccgcaaccgcctggccgaaggcaagctgccgctgtgcgcggaaatgtgctcgaccaaggcgctgctcggcggcgatggcgacgtgattgccgacatcctgcgcaatcgagtgatcaagcgcggcaaagggggcgatgtgttcggctggggtaccgcatacggcacgaagggcggtgcgcaacaggcgccggccgcgcccgctgcacctgccgctcccgcaccgggtaatgcgagcggaagcgcgaacgggagcgcaaccgggagcgcaaccgcgaatggggggcaaccatcatga

SEQ ID NO: 67744 - protein, 237 aa, Ralstonia eutropha JMP134
MARMKFICDAERCIECNSCVTACKNEHEVPWGVNRRRVVTVNDGVVGAEKSISVACMHCSDAPCMAVCPVDCFYRTEDGVVLHDKDVCIGCGYCSYACPFGAPQFPSTGTFGVRGKMDKCTFCAGGPEKNGSEAEFEKYGRNRLAEGKLPLCAEMCSTKALLGGDGDVIADILRNRVIKRGKGGDVFGWGTAYGTKGGAQQAPAAPAAPAAPAPGNASGSANGSATGSATANGGQPS

SEQ ID NO: 67745 - DNA, 804 bp, Dehalococcoides sp. CBDB1
  CDS (1)..(804): transl_table=11
atgcctaatggaatgctgattgataccactagatgtactggttgtcgaggctgccaggtggcctgtaagcagtggaatgaaaatcctgctgtcaagacaactttcagtcctgaagtgaccaatcccttggaacaaaacgcattcaactacaacctgctggagtgcagggaaattgaagaagatggaaaacttcaatggatcttcgctcataagagatgtttgcactgctatgaaccggcctgtgtttcggtatgtccggtcggtgccctccacaaacggcctaacggcgcagtagtctgggatcaggataaatgcttcggctgccgttattgtcagaacgcctgcccctttgaaatccccaagtttgagtgggatgacaactgggctaaaatcaccaaatgcaccatgtgctggaacagggtagacgaaggtatggaaccggcttgtgccgctacctgccccaccggcgctatcaaatttggcgaacgggctgacctgctggcagaggcctatgaaagactttcaaacaaccctgacaaatactacccctatgtttacggtgaaaaagaagctggcggtactcatgttttgtacctaagcagcgttcaccctgaaaagcttggctttgacatgcacgagcatgagttcttccccagctttaccagagaattccttggcaatatacccttggaaatctctatagtagcttcgctgatggttggtgtatggtacttccgcggccgcagaattcaggcacaggcacacgatgctgagcatgctgaaaacaaggctggcaagcactag

SEQ ID NO: 67746 - protein, 267 aa, Dehalococcoides sp. CBDB1
MPNGMLIDTTRCTGCRGCQVACKQWNENPAVKTTFSPEVTNPLEQNAFNYNLLECREIEEDGKLQWIFAHKRCLHCYEPACVSVCPVGALHKRPNGAVVWDQDKCFGCRYCQNACPFEIPKFEWDDNWAKITKCTMCWNRVDEGMEPACAATCPTGAIKFGERADLLAEAYERLSNNPDKYYPYVYGEKEAGGTHVLYLSSVHPEKLGFDMHEHEFFPSFTREFLGNIPLEISIVASLMVGVWYFRGRRIQAQAHDAEHAENKAGKH

SEQ ID NO: 67747 - DNA, 432 bp, Dehalococcoides sp. CBDB1
  CDS (1)..(432): transl_table=11
atgaaaagggtacagattaaagaagaactgtgtatgggctgcggcctgtgtcgcgtagcctgccagaccgaacactcggtctctcatgacgttattaaggccgtcaaaaaggaaaatcagaagcccagaatacgggtggaacgcaagggagagataagtttctctgtaccctgccgccactgtgacgaaccatggtgcgcttattcctgtatcagcggtgctatgacccgtgaccccataactggaattgtttccagtgatcctgaaagatgtatcggctgttggacatgcattgtggcctgcccgaacagcgcccttataaaagacaaggcaaaccatgtgattctcaagtgcgatctgtgcggcggtaaagaaatacctgcctgcgtggctaactgcccgaatgaagccttggaactgattgacggctaa

SEQ ID NO: 67748 - protein, 143 aa, Dehalococcoides sp. CBDB1
MKRVQIKEELCMGCGLCRVACQTEHSVSHDVIKAVKKENQKPRIRVERKGEISFSVPCRHCDEPWCAYSCISGAMTRDPITGIVSSDPERCIGCWTCIVACPNSALIKDKANHVILKCDLCGGKEIPACVANCPNEALELIDG

SEQ ID NO: 67749 - DNA, 618 bp, Shigella sonnei Ss046
  CDS (1)..(618): transl_table=11
atgacaacccagtatggattttttattgattccagccgttgcaccggttgcaaaacctgcgagctggcttgtaaagactacaaagatttgacgccagaagtcagcttccgccgcatttatgaatatgctggcggcgactggcaggaagataacggtgtctggcaccagaacgtgtttgcctactatctgtcgatttcgtgcaaccactgcgaagatccggcttgtactaaagtctgcccgagcggtgcgatgcataaacgtgaagatggttttgttgtggtcgatgaagatgtgtgcattggctgccgctactgccatatggcttgcccgtatggcgcaccgcaatataacgaaacgaaaggccatatgaccaaatgcgatggttgttatgaccgtgttgcggagggtaaaaagccgatctgtgttgaatcttgtccgctgcgggcgctggatttcggccctatcgacgagctgcgtaaaaaacatggcgatctggcggccgttgcgccgttgccgcgagctcactttaccaaaccgaatattgtgatcaaacccaatgccaatagccgcccgaccggggataccactggctatctggcaaacccgaaggaggtgtga

SEQ ID NO: 67750 - protein, 205 aa, Shigella sonnei Ss046
MTTQYGFFIDSSRCTGCKTCELACKDYKDLTPEVSFRRIYEYAGGDWQEDNGVWHQNVFAYYLSISCNHCEDPACTKVCPSGAMHKREDGFVVVDEDVCIGCRYCHMACPYGAPQYNETKGHMTKCDGCYDRVAEGKKPICVESCPLRALDFGPIDELRKKHGDLAAVAPLPRAHFTKPNIVIKPNANSRPTGDTTGYLANPKEV

SEQ ID NO: 67751 - DNA, 720 bp, Shigella sonnei Ss046
  CDS (1)..(720): transl_table=11
atgtcatggatagggtggacagttgcagccactgcattaggggataatcagatgtccttcactcgacgcaaatttgttctggggatgggaacagtaatcttttttactggttctgcgtcttctctgttagcgaacacgaggcaagaaaaggaagttcggtatgccatgattcatgacgagtcacggtgcaatggctgtaatatttgcgcccgcgcatgccgtaaaactaaccacgtccccgctcagggaagccgtttatcgatagcacacattccagtcaccgataacgacaacgaaacgcagtatcacttttttcgccagtcatgtcagcactgcgaagatgctccgtgcatcgacgtatgcccgacaggggcgtcgtggcgtgatgagcaggggatcgtgcgggtagaaaaatcgcagtgcatcggctgcagttattgcattggcgcttgtccgtaccaggttcgctaccttaaccctgtcactaaagtggcagataaatgtgatttctgcgctgagtcccgactggcaaaaggctttccgcccatttgcgtcagcgcctgtccggaacacgcattgatctttggtcgcgaagatagcccagaaattcaggcgtggttgcaggaaaataaatactatcaatatcagctacttggtgccgggaaaccgcatctgtatcgccggttcggtcaacatttgattaaaaaggaaaatgtatga

SEQ ID NO: 67752 - protein, 239 aa, Shigella sonnei Ss046
MSWIGWTVAATALGDNQMSFTRRKFVLGMGTVIFFTGSASSLLANTRQEKEVRYAMIHDESRCNGCNICARACRKTNHVPAQGSRLSIAHIPVTDNDNETQYHFFRQSCQHCEDAPCIDVCPTGASWRDEQGIVRVEKSQCIGCSYCIGACPYQVRYLNPVTKVADKCDFCAESRLAKGFPPICVSACPEHALIFGREDSPEIQAWLQENKYYQYQLLGAGKPHLYRRFGQHLIKKENV

SEQ ID NO: 67753 - DNA, 618 bp, Shigella sonnei Ss046
  CDS (1)..(618): transl_table=11
gtgaccacacaatatggattttttatcgattccagccgctgtactggctgtaaaacctgcgaactggcgtgcaaagattttaaagatcttggcccggaagtcagtttccgccgtatttatgaatatgctggcggcgactggcaggaagataatggcgtctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcgccacagtacaatgctgaaaaagggcacatgacgaagtgcgatggttgttattcgcgcgtcgccgaggggaaacaacccatatgtgtcgaatcctgcccgctgcgtgcacttgagttcggtccaattgaagagctgcgccagaagcacggcactctggctgccgtcgcgccactgccgcgcgcgcatttcacaaaacccaatatcgttatcaaacctaacgccaacagccgcccgaccagcgataccactggttatctggctaatccggaggaagtgtaa

SEQ ID NO: 67754 - protein, 205 aa, Shigella sonnei Ss046
MTTQYGFFIDSSRCTGCKTCELACKDFKDLGPEVSFRRIYEYAGGDWQEDNGVWHQNVFAYYLSISCNHCDDPACTKVCPSGAMHKREDGFVVVDEDVCIGCRYCHMACPYGAPQYNAEKGHMTKCDGCYSRVAEGKQPICVESCPLRALEFGPIEELRQKHGTLAAVAPLPRAHFTKPNIVIKPNANSRPTSDTTGYLANPEEV

SEQ ID NO: 67755 - DNA, 696 bp, Thiobacillus denitrificans ATCC 25259
  CDS (1)..(696): transl_table=11
atgagacttggattggtcatcgaccttgacgtgtgcgtgggctgtcatgcctgcgccatcgcctgcaaggagtggaacgcctccggcaccatcggcccgttgtcggattaccagccctacggcgccgagccgtcgggcgtctggttcaaccggatccgccattacgagatggacgagtatccgaacaacaagaccgtcaacttcccgatgtcgtgcatgcactgcgaggacgccgactgcgtcacggtgtgcccgaccggcgcgtcgtacaagcgtgccgaggacggcatcgtgctgatcgaccaggataagtgcatgggctgcaactactgctcctgggcctgcccctacggcgcgcgcgaactcgaccgatcgagcggcacgatgaagaaatgcacgctgtgcgtcgaccgtatctacgacgagaacctgccggtcgaggagcgccaaccctcgtgcgtgctgacctgcccggcgcacgcgcgcatgttcggcgacttcgacgatcccgattcggcggtgtcgcgcgtggtgcgcgagcgcggcgggtatccgctgatgcccgagctcaactacaacccgacgaacacctatctgccgatccgtcgcaagccggtgatcggggtggaaaccaaaccgaagggcggcttgaaggaaagcatcaagcagttcgccaacaggctggtgcgccgttga

SEQ ID NO: 67756 - protein, 231 aa, Thiobacillus denitrificans ATCC 25259
MRLGLVIDLDVCVGCHACAIACKEWNASGTIGPLSDYQPYGAEPSGVWFNRIRHYEMDEYPNNKTVNFPMSCMHCEDADCVTVCPTGASYKRAEDGIVLIDQDKCMGCNYCSWACPYGARELDRSSGTMKKCTLCVDRIYDENLPVEERQPSCVLTCPAHARMFGDFDDPDSAVSRVVRERGGYPLMPELNYNPTNTYLPIRRKPVIGVETKPKGGLKESIKQFANRLVRR

SEQ ID NO: 67757 - DNA, 738 bp, Thiobacillus denitrificans ATCC 25259
  CDS (1)..(738): transl_table=11
atgtccgacaacccttccccctcccgccgcgccttcctgcaggcgatcccggcgatcaccgcgggtctcgcgctgccggcgaccgcacgcgcggcgccccacaaacaccactgggcgatgctggtcgacgtccgcaagtgtatcggctgtcaggcctgcaccgtcgcgtgcatcatggaaaacgcgctaccggaaaacagtttccgcacgctcgcctccacctacgtcgtgcagcaggagaccgagggccggaccacggccggcacctacatgctgccgcgcctgtgcaaccactgcgagaatccgccctgcgtgccggtctgcccggtcggcgcgacgttcaagcgtgacgacggcatcgtcgtcgtcgacggcgaccgctgcgtcggctgcgcctactgcgtccaggcctgcccctacgacgcgcgcttcatcaaccacgaaacgaacaaggccgacaagtgcaccttctgtgcgcaccgggtcgacgcgggcctgctgccggcctgcgtcgaaacctgcgtcggcggcgcccgcgtcttcggcgatctgaacgacgccaagggcgaattgcggcgcagcctcaacgcggcgaagaagaacggcgacgccatcaaggtgctcaagcccgaagccggcacccgccccaatgttttctacgtcggtctcgacgaccggttccagggacgcgtcgagggcgaggcagccctctggcaacccactgcccacggagtctga

SEQ ID NO: 67758 - protein, 245 aa, Thiobacillus denitrificans ATCC 25259
MSDNPSPSRRAFLQAIPAITAGLALPATARAAPHKHHWAMLVDVRKCIGCQACTVACIMENALPENSFRTLASTYVVQQETEGRTTAGTYMLPRLCNHCENPPCVPVCPVGATFKRDDGIVVVDGDRCVGCAYCVQACPYDARFINHETNKADKCTFCAHRVDAGLLPACVETCVGGARVFGDLNDAKGELRRSLNAAKKNGDAIKVLKPEAGTRPNVFYVGLDDRFQGRVEGEAALWQPTAHGV

SEQ ID NO: 67759 - DNA, 780 bp, Thiobacillus denitrificans ATCC 25259
  CDS (1)..(780): transl_table=11
atgagcgaattgaaaccgatgtctgacaacacgcccgagtcggcggagcgccgccgggtgatcggcgggctcgccgccgccgcggccggtcttgccatcgcgccggggatcaagctgatcgaggtcgcacaggcacgtccggaggagcagggcgcgagcagcgccgtgcgctggggcatgctggtcgacgcgaccaagtgtgcgaccggctgtgatgactgcgtgtccgcgtgcagcaccgaaaacggctggacgccggtcgccgagagcgccaagccgcggcaggcgcctcagtggatacgcaagctcgagctgcaggatccgctgacgcagatggaaaccaatctgccgatgatgtgccagcattgcgccgagccgccgtgcgtcgacgtctgcccgaccggcgcgtcgttcaagcgtgccgacggcatcgtgctcgtcaaccgccacacctgtatcggctgccgctactgcatgatggcgtgtccttacaaggcacgctccctcgtgcacgagcccctcaacgacacgcagaaggccgacgtaccgcgcggcgtcggttgcgtcgagtcctgctcactgtgcgtgcagaaggtcgatcgcggcgacggcaccacggcgtgcgccgaagcctgctccgcggccggtcataacgcgatcgtcttcggcgacctgaacgaccccgatagcgagatctcgaagcgtttgcgcgaactgcccaccaagcaggtgcgtgccgacctcaagctcaataccggcgttcgctatcacggaatctaa

SEQ ID NO: 67760 - protein, 259 aa, Thiobacillus denitrificans ATCC 25259
MSELKPMSDNTPESAERRRVIGGLAAAAAGLAIAPGIKLIEVAQARPEEQGASSAVRWGMLVDATKCATGCDDCVSACSTENGWTPVAESAKPRQAPQWIRKLELQDPLTQMETNLPMMCQHCAEPPCVDVCPTGASFKRADGIVLVNRHTCIGCRYCMMACPYKARSLVHEPLNDTQKADVPRGVGCVESCSLCVQKVDRGDGTTACAEACSAAGHNAIVFGDLNDPDSEISKRLRELPTKQVRADLKLNTGVRYHGI

SEQ ID NO: 67761 - DNA, 1446 bp, Natronomonas pharaonis DSM 2160
  CDS (1)..(1446): transl_table=11
atgaacagtgacgactcatcctgcgaccgcgacagttgcggttgcgggagcaacgacgaaccaacggacgaatcgttccatcccatgggtgaagaatgggaagaggagatgcgagagaagctcgaggagaccgaatacgatgcggacctcggcatggagatggcggaagacgccatgcggctcattcagggcgaactctctgaagccgagttccacgaccgatacaacgacgcggtcgtcgaggagttcgatgtcgacgaccgcccgactgccgaggcctacgaggaagagatggagtccgacgacggaggtctcttccagcggctcactggcgaggacggtactgtcgggaagctgtccgacttcgaccccgacactgaccagacccgtcgagacacgatgaagaagatgggtgccggtgctgcggcgctcggcttcagcggtgtcgcgagcgccgccagcccgaccgacgacgagtacggtgacaaccccgtatcggacacgggcgacgacgacgatgtccagatggggatggtcattgacctcgaacgctgtgacggctgtctggagtgtgtcacgggttgtatcgaggagaaccagacctcggagggtgcaaactggatgtacgtcctcacctacgaggacgagcagacagaacaggagaacttcctcgttcggccctgccagcactgttcgaacgcgccgtgtgagaaggtctgtccggttcgggcccgacacacccgcgacaaggacggtctcgtgttgacgaactacgaggtctgtatcggctgccgatactgtcaggtcgcctgtccgtacggtgtcaactacttccagtggggcgaacccgacgttccatacgaggacctccccggctccgaaaacgactacgacgagctcaaggagatgccgtatgaggaacgacaggaacacctcaaagagactgacgaccacctccacgacgagcgcggccagtggaacgacatgcggccagcgcagggtaccatgggcaagtgtaccttctgtccgtcccggcaggatggtcaccaaggcgaagagaaggtcggtaccgtcgcctgtatggaggcctgcgacacggccggcatgagcgccattcacttcggcgacgtcaacgaccccgacagccggcccaaccagttcctcgagcagcgcgccgaggaagccctcgaaaacgaagacggcgagaccaacaacgtcgacatcgacgaagactggggcgaatccaacacgccgtggggcggcaagctctcggcgttcaagctgctcgatgacctcggcacccagccgaacgtcacgtacctcggcaacgagcccggccccgaagccgagcaggttgagggcccggtcacctacgagcagatcggcgttcaggacgaccgcaaagagcacctcgaccagctgaccttcgggacgggtgatgactga

SEQ ID NO: 67762 - protein, 481 aa, Natronomonas pharaonis DSM 2160
MNSDDSSCDRDSCGCGSNDEPTDESFHPMGEEWEEEMREKLEETEYDADLGMEMAEDAMRLIQGELSEAEFHDRYNDAVVEEFDVDDRPTAEAYEEEMESDDGGLFQRLTGEDGTVGKLSDFDPDTDQTRRDTMKKMGAGAAALGFSGVASAASPTDDEYGDNPVSDTGDDDDVQMGMVIDLERCDGCLECVTGCIEENQTSEGANWMYVLTYEDEQTEQENFLVRPCQHCSNAPCEKVCPVRARHTRDKDGLVLTNYEVCIGCRYCQVACPYGVNYFQWGEPDVPYEDLPGSENDYDELKEMPYEERQEHLKETDDHLHDERGQWNDMRPAQGTMGKCTFCPSRQDGHQGEEKVGTVACMEACDTAGMSAIHFGDVNDPDSRPNQFLEQRAEEALENEDGETNNVDIDEDWGESNTPWGGKLSAFKLLDDLGTQPNVTYLGNEPGPEAEQVEGPVTYEQIGVQDDRKEHLDQLTFGTGDD

SEQ ID NO: 67763 - DNA, 600 bp, Natronomonas pharaonis DSM 2160
  CDS (1)..(600): transl_table=11
atgagcaccaaccaatccaacgacacggcccgagtcatccccaactgggagtcctgtatcgactgcggcgcctgcgaggtcgcctgccagcgaacgtgggacctcccgccggagacgaaccgcatcgaggtcgtcgccctcgaacatggcaccgaagacgaggcccaaaagccgatgcagtgttacaactgcgccgaggccccttgtgtcgatgtctgtccgaccgacgccctcctgttccgcgacgacggcaccgtgcgggtatcgggcgacctctgtatcggctgccactactgcggcgtcggctgtccgttcggcgcgccgcagtaccccgacgccgaggtcccggaagccgacgagatgaaccccctcggcgcacggggcaacgggctgatggacaagtgtactacctgcgagccccgacaggaagaagacctcgaaccggcctgctcctcggagtgtccgaccgacgcgctgcttttcggcacgccggatgaactctccgagaagctcgacgaagagggcacctcgacgccgttcgaaccggaggccgcccgcatcgtcttcggggacgacgccgacagcgtgatatcggagtga

SEQ ID NO: 67764 - protein, 199 aa, Natronomonas pharaonis DSM 2160
MSTNQSNDTARVIPNWESCIDCGACEVACQRTWDLPPETNRIEVVALEHGTEDEAQKPMQCYNCAEAPCVDVCPTDALLFRDDGTVRVSGDLCIGCHYCGVGCPFGAPQYPDAEVPEADEMNPLGARGNGLMDKCTTCEPRQEEDLEPACSSECPTDALLFGTPDELSEKLDEEGTSTPFEPEAARIVFGDDADSVISE

SEQ ID NO: 67765 - DNA, 798 bp, Burkholderia pseudomallei 1710b
  CDS (1)..(798): transl_table=11
atgacgcaaatggcgctcgtgatcgatctgaacgtgtgcgtggggtgccacgcgtgcgtgacgagctgcaaggaatggaacacgtcgggcgacgcgggcgcgctgtctgacttgcgcccatatgacgccgatccgtccggcaccttcttcaaccgcgtgcagacgttcgaggcgggcgaatttccgctcgccgacacgatccacttcccgaagtcgtgcctgcattgcgaagacccgccgtgcgtgccggtctgcccgacgggcgcgagctacaagcgcgaggaagacgggctcgtgctcgtcgattacgacaagtgcatcggctgcaagtactgcacgtgggcgtgcccatatggcgcgcgcgagctcgacgaagtgcgcaaggagatgacgaagtgcacgctttgcgcggaccgcattcacgacgagacgctgcccgagcgcgatcgcaagcccgcgtgcgtgctcgcgtgcccgacgtcggcgcgcctgttcggcgacatccacgatccgaattcgaccgtgtcgcaggcaatccgcgagcgcggcggctatcagttgatgccggaatggggaacgcggcccgcgaatcattacctgccgcgccgcacgacgaccgcgtgcgggagcgggggcggcggtggtaacgacgggagcggaggcggcggttgcggtagcggcgccgcgtgcgcgtgccggccggcggacgcgaagcccgcgcccgtctcggccggcgacgcgctcgcgcacgggcagccgaatctcgccgcgctcgcgaagcgcatccgatctgaatga

SEQ ID NO: 67766 - protein, 265 aa, Burkholderia pseudomallei 1710b
MTQMALVIDLNVCVGCHACVTSCKEWNTSGDAGALSDLRPYDADPSGTFFNRVQTFEAGEFPLADTIHFPKSCLHCEDPPCVPVCPTGASYKREEDGLVLVDYDKCIGCKYCTWACPYGARELDEVRKEMTKCTLCADRIHDETLPERDRKPACVLACPTSARLFGDIHDPNSTVSQAIRERGGYQLMPEWGTRPANHYLPRRTTTACGSGGGGGNDGSGGGGCGSGAACACRPADAKPAPVSAGDALAHGQPNLAALAKRIRSE

SEQ ID NO: 67767 - DNA, 936 bp, Pseudomonas fluorescens PfO-1
  CDS (1)..(936): transl_table=11
atggccagccaagacatcattgcccgctcggccaccaccacgccggcgccttcgatacgcggccaggaacaggtggccaagctgatcgacaccaccaaatgcatcggctgcaaggcctgccaggtcgcgtgctcggaatggaacgagctgcgcgacgaggtcggccacaaccacggcacctacgacaacccgcaggatttgagcgccgattcatggacgctgatgcgcttcaccgagcatgaaaccgacgccggtaacctcgagtggctgatccgcaaggacggctgcatgcactgcgccgaacccggttgcctggcagcgtgccccagccccggcgcgatcatcaagcacgccaacggcatcgtcgatttcgatcaggatcactgcatcggctgcggttattgcatcaccggttgcccgttcaacatcccgcgcatttcgcagaaggatcacaaggcctacaaatgcacgctgtgttcggaccgtgtggcggtggggctggagccggcctgcgtgaaaacctgcccgaccggggccatcgtgtttggcaccaaggacgacatgaagacccacgccgccgaacgcatcgtcgacctgaaaagccgtggcttcgacaacgccggcctgtatgacccgcaaggcgtcggcggcacccacgtcatgtacgtgctgcaccacgccgacaccccgaaaatctacgccggcctgccggacaaccccgagatcagtccgctggtgggtttgtggaaaggcatcagcaagccgttgggtctgctggccatgggcgcggcggtgctggccgggttcttccattacgtgcggatcggcccgaaccgggtcgaggaagatgaacatcccgatccgcccgacacctcggtgcacgtcgtcgatccggcagtgcacaccttcgacccacgcggggagggccggccatga

SEQ ID NO: 67768 - protein, 311 aa, Pseudomonas fluorescens PfO-1
MASQDIIARSATTTPAPSIRGQEQVAKLIDTTKCIGCKACQVACSEWNELRDEVGHNHGTYDNPQDLSADSWTLMRFTEHETDAGNLEWLIRKDGCMHCAEPGCLAACPSPGAIIKHANGIVDFDQDHCIGCGYCITGCPFNIPRISQKDHKAYKCTLCSDRVAVGLEPACVKTCPTGAIVFGTKDDMKTHAAERIVDLKSRGFDNAGLYDPQGVGGTHVMYVLHHADTPKIYAGLPDNPEISPLVGLWKGISKPLGLLAMGAAVLAGFFHYVRIGPNRVEEDEHPDPPDTSVHVVDPAVHTFDPRGEGRP

SEQ ID NO: 67769 - DNA, 597 bp, Pelobacter carbinolicus DSM 2380
  CDS (1)..(597): transl_table=11
atgaaaaagatctttgtcgattaccgcaaatgcgtagcctgcaaggcgtgcgaaacggcctgtgcggtggctcatcatcccagcggcagccttttcggattggtgggcgatgctcgcacccaggtgaatatacgcgtgctgggagtggagcatgaggcgtttccggtttcctgccgtcattgcgatccggccgcctgcttgagtgcctgtccggcgggagccatcacccgcgatccggagaccgacgcggtggtacagaacccggaaaaatgccaggcttgtgccatgtgcgccatggtctgccccttcgacgccatttccttcaagcatacccatcgtgctttgccgggccgtgaggtggcctacaaatgcgatctgtgtcacgagcgactggcgcaaggcgaagagccggcctgcgtgcaggcatgccattccggtgcgctggtgttccaggacagtgagccgcagcgccaaagccgggccgtcgccagcctcaaggtgtacctgcttggggaaggcgaggagccgcccctgttttcgatgtaccgggagttgcgccgtaaaacatttgcccggcgcaggatggaaaaatcatga

SEQ ID NO: 67770 - protein, 198 aa, Pelobacter carbinolicus DSM 2380
MKKIFVDYRKCVACKACETACAVAHHPSGSLFGLVGDARTQVNIRVLGVEHEAFPVSCRHCDPAACLSACPAGAITRDPETDAVVQNPEKCQACAMCAMVCPFDAISFKHTHRALPGREVAYKCDLCHERLAQGEEPACVQACHSGALVFQDSEPQRQSRAVASLKVYLLGEGEEPPLFSMYRELRRKTFARRRMEKS

SEQ ID NO: 67771 - DNA, 2763 bp, Pelobacter carbinolicus DSM 2380
  CDS (1)..(2763): transl_table=11
atggatcgaaggaaattcctacagatcatgggcctggtatcaggcgccaccctgctgtcatcctgcggctcggaccgcaaccagaaagagttgatttcctatctggtgccgcccgaagatggcgtgcgccccggaacctccgcctggcgcgtctccacctgcagcgaatgtccggcccattgcggcatcatgatacgcctgcgggaaaaacgtgccgtcaaactcgagggtctccccgatcatcccatcaaccgcggcgcactgtgcatgcggggacaggcagccttatggcggctgtatcatcccgagcgcctgcgcacgccgctgctacgcaaaggaaacgattatcaggccgttagctgggaggtcgccctggagcacatagtccaggccatgtcggaccggcagcggagccatatgctgctgagcggtgcgacgaccggtagcctggccgccttgcaggaacagtttgtcgccgcctgtaaggtcacgcgcctgccggaattcgaactcttcagtcacgccgccctgcgccaggcctatcaactattgtatgggcgttccaccctgccgtattttcgcatcgaggatgcggacctgctgctcagcgtcggcgcggacctgctggaaaccttcagcagcccggcgggttatgcgcaaaagttatccgaagcgcgacgcgaccatgacctgcactggtgccacatcgaacctcatctgtccctcacaggggccaacgccgatcaacgcctgagcatcaaacccgccggcgaaccggccctgttgctgtggttgctgcagaccctggtcgacaaccggcatatgcctgcggcaatccgcgcggccctgccaaaaatatccctgagccaagcgggccacgccacaggcctgccgccctccaggctgacccggcttgccgaatcgctgaaaaaagcccgcaggcccctgcttattgtcggcggcatcgccaccggccaccaggctggtcagcagacggccctgttcggttgcctgctgcaacggttgctggctgaaccctggcggggcatcgacttcgcgcgagcggataaaccagaccgaaccggcgatctgcgcgacctgcagaccttgaaccaggccctgcaacgggacgaagtcggcatgctgttaatcagccgggccgatcccctgcgccatgcgccacccgattggcaactggccgacaacctgcgtcgtgcaagattgagcgtggcgatggccgatatgcacgatgccaccacccgcgccgtcgatctgatcctgccgttgacccacagttttgaacgctgggatgatgccgagccgcgcaacggcgtgtacagcctcatccaaccgggcatgacgcccctctacgatacgcgcaccgaaggcgatatcctgttgcaattgcagcgccgcctgaccggtcaaagcgccaccgacagctacgagtcttttttgcagcaacgctggcgcgagcagttctcaaccgccgaactgcgcagttttttgcgacagggcttcgtaaccacagacacctcacgtacctccacccctttgcgcatcgagcgcaccgtcgccgctctgcgaaacagcaccttgcccgagacgctgccgactccggcgctcgtcatcacgggctccatccgcagcttcgacggccgcagcgccgcgttgtccctgcttaacgaaatacccgatcctctcaccaccgtcacccacggcacatgggtcgccctgtcgccccgctgtgcacaaaagtacggcgttgccgatggcgaccagctgcgcctgacacacggcgattttcacctgacgcttccggcccgactgcagcagggattgccggacgacgtgttcagcctgcccgtcgattgcctgccggccggtttaccggattttgatccggccaccggcgaggccctgcggaccatcggcccggtaaaggctcggcgggtcggcaaaaaaatccccctgccgattctaagcggatctccttcccagcaagggcgcggcatcatccccaggccgatccatcacgacaaaggtcatcacgccgaacaccgttccctctacccggaaccggcctaccgcgaataccgctgggcgatggccatcgatctgcgacaatgcatcggatgcggagcctgtgtcgcctcctgctatgtggaaaacagcgtaccggtggtcggccgcaaggatcatctcaaagggcgggagatgtcatggttgcgcgtcgagccattttacagcgaccagggacagatctcctttatccccatgctctgccagcactgcgactatgcgccctgcgagcccgtatgtccggtatatgcgtcctatcacaaccccgaaggactcaacgtgcaggtttacaatcgctgcgtcggcacccgctactgcagcaacaactgcccctacaaggtgcgacgcttcaactggtgggagcatatatgggctccgcccctggaaaaaatgcacaaccccgatctggcgccacgcaccaggggcatgatggaaaaatgcactttttgcatccagcgcatccgagccgcccacgaaattgccggcaaggaaaaccgccgcatccgcgacggcgaggtgaccccggcctgcgcccagagctgcccgaccgccgccatcaccttcggcaaccgcctcgaccccggatccgccgtggcccgcatgatcgaaagcccccgcgcctatcaggtattcgaggggctcggcaccaagcccgcggtctattatttgcgtcccgattaa

SEQ ID NO: 67772 - protein, 920 aa, Pelobacter carbinolicus DSM 2380
MDRRKFLQIMGLVSGATLLSSCGSDRNQKELISYLVPPEDGVRPGTSAWRVSTCSECPAHCGIMIRLREKRAVKLEGLPDHPINRGALCMRGQAALWRLYHPERLRTPLLRKGNDYQAVSWEVALEHIVQAMSDRQRSHMLLSGATTGSLAALQEQFVAACKVTRLPEFELFSHAALRQAYQLLYGRSTLPYFRIEDADLLLSVGADLLETFSSPAGYAQKLSEARRDHDLHWCHIEPHLSLTGANADQRLSIKPAGEPALLLWLLQTLVDNRHMPAAIRAALPKISLSQAGHATGLPPSRLTRLAESLKKARRPLLIVGGIATGHQAGQQTALFGCLLQRLLAEPWRGIDFARADKPDRTGDLRDLQTLNQALQRDEVGMLLISRADPLRHAPPDWQLADNLRRARLSVAMADMHDATTRAVDLILPLTHSFERWDDAEPRNGVYSLIQPGMTPLYDTRTEGDILLQLQRRLTGQSATDSYESFLQQRWREQFSTAELRSFLRQGFVTTDTSRTSTPLRIERTVAALRNSTLPETLPTPALVITGSIRSFDGRSAALSLLNEIPDPLTTVTHGTWVALSPRCAQKYGVADGDQLRLTHGDFHLTLPARLQQGLPDDVFSLPVDCLPAGLPDFDPATGEALRTIGPVKARRVGKKIPLPILSGSPSQQGRGIIPRPIHHDKGHHAEHRSLYPEPAYREYRWAMAIDLRQCIGCGACVASCYVENSVPVVGRKDHLKGREMSWLRVEPFYSDQGQISFIPMLCQHCDYAPCEPVCPVYASYHNPEGLNVQVYNRCVGTRYCSNNCPYKVRRFNWWEHIWAPPLEKMHNPDLAPRTRGMMEKCTFCIQRIRAAHEIAGKENRRIRDGEVTPACAQSCPTAAITFGNRLDPGSAVARMIESPRAYQVFEGLGTKPAVYYLRPD

SEQ ID NO: 67773 - DNA, 597 bp, Carboxydothermus hydrogenoformans Z-2901
  CDS (1)..(597): transl_table=11
atggcacgctacggaatggtaattgaccttcgaacctgcgtcggctgtcaggcctgcagtgctgcctgtgccaccgaaaatcagacgccatactggtccgataagtggcgcacccgggtgctggatatcgaaaaaggtgaatatcccaataccggccggcattttgtaccaacaatttgtatgcactgcgaagaaccggcttgtttaaccatctgtccatctcaggcaactttccgggatgaaaacggcagcattctggtaaattatgatacctgtcttggttgtaaagcctgcatggcggcctgcccctatggggccaggtatgtttacgataagaacgatgttgccaaaaaccgggaaattcacggggaactttcacaacataaagtggtgcatattgacaagtgtactttttgctttgaccgggtagaaagaggcctggaaccggcttgcgtgtcaacctgtccggctcatgctaggattttcggggacttagatgacccgcatagtgaagttgccagactggtggcatcaggaattgccaagcctttaagaccggatttaaataccaaacccaaggtcttttacatttactaa

SEQ ID NO: 67774 - protein, 198 aa, Carboxydothermus hydrogenoformans Z-2901
MARYGMVIDLRTCVGCQACSAACATENQTPYWSDKWRTRVLDIEKGEYPNTGRHFVPTICMHCEEPACLTICPSQATFRDENGSILVNYDTCLGCKACMAACPYGARYVYDKNDVAKNREIHGELSQHKVVHIDKCTFCFDRVERGLEPACVSTCPAHARIFGDLDDPHSEVARLVASGIAKPLRPDLNTKPKVFYIY

SEQ ID NO: 67775 - DNA, 612 bp, Carboxydothermus hydrogenoformans Z-2901
  CDS (1)..(612): transl_table=11
atggcacgttacggaatggttattgacctgcgtaaatgccgggggtgccgcggttgtaccgcggtttgtgccgtggaaaataatgttccggtagatagaaccggtgaagaggccggtgagcagttagcccggtgggcagccggggagcttgattattacaacatgcgggtattaaccgcaacggtatatggtcaaattcgctccatacccatgccgtgcatgcactgcgacaacgcaccctgtatcgccgtttgtcctgtaaaagcaagttacaaaagaaaagacgggatagtagtcatcgataaatataaatgtatcggctgccgtctttgcttaaaggcctgtccctatcaggcccggtatatacgcaaagtgccggtaaagggtgaacccaagggagtagctggaaaatgcgagttttgcgcccatttggtagataaaggggaaaaaaccatgtgcagtagaagttgtcactccggggcgataaaatttggcgacttagatgatcccaatagtgaagtaagccagcttttaaagcaaaacgctaaaaaggtaaagaggcttaaaccagaatataaaacgtcacccagagtttattacattaccttttag

SEQ ID NO: 67776 - protein, 203 aa, Carboxydothermus hydrogenoformans Z-2901
MARYGMVIDLRKCRGCRGCTAVCAVENNVPVDRTGEEAGEQLARWAAGELDYYNMRVLTATVYGQIRSIPMPCMHCDNAPCIAVCPVKASYKRKDGIVVIDKYKCIGCRLCLKACPYQARYIRKVPVKGEPKGVAGKCEFCAHLVDKGEKTMCSRSCHSGAIKFGDLDDPNSEVSQLLKQNAKKVKRLKPEYKTSPRVYYITF

SEQ ID NO: 67777 - DNA, 783 bp, Carboxydothermus hydrogenoformans Z-2901
  CDS (1)..(783): transl_table=11
atgaacggcatgtttattgatacatccctttgtgttggctgccggggctgcatgactgcctgcaaaagctggaacgaattacccggagaaaaaacgacttttaccggaagtttacagagtatgcccgatactacccctaaaacttatacattgattaaattttatgaacgtgaagaaaacgggcggattcgttttgacttttttaaacagcagtgttttcactgcggtgatgcggcttgtgaaaaagcttgtccggaagatgcaatctatcataccaaagaaggggcggtagtgcgggattacgaccggtgtataggctgtgattactgccagagggcgtgcccctttaatatcccgcggattgacactcaaaacaagaaaatgcataaatgcaccttgtgttttgaccggttagaaaacggagaaattccggcttgtgccctgacttgttctccgggagctattaaatacggcaaccgggatgagctgtgggaggcagcccaaaagcggctggcggaggttaaaaaagagtatcccaaggctaatctttatccttccgataaaaatgctttgggaggaaccggggtattttatcttttaattaacgagccggagttctacggtcttccggccgaggcaaaattaaaaactaccttttccctctggcatgacgtggtgagacctttagggaaaattgtgccagggatagcgcttggggctactgttatagcggcggtagctaattcggtaaaaaaacaacgggaggagggacacggtgagtaa

SEQ ID NO: 67778 - protein, 260 aa, Carboxydothermus hydrogenoformans Z-2901
MNGMFIDTSLCVGCRGCMTACKSWNELPGEKTTFTGSLQSMPDTTPKTYTLIKFYEREENGRIRFDFFKQQCFHCGDAACEKACPEDAIYHTKEGAVVRDYDRCIGCDYCQRACPFNIPRIDTQNKKMHKCTLCFDRLENGEIPACALTCSPGAIKYGNRDELWEAAQKRLAEVKKEYPKANLYPSDKNALGGTGVFYLLINEPEFYGLPAEAKLKTTFSLWHDVVRPLGKIVPGIALGATVIAAVANSVKKQREEGHGE

SEQ ID NO: 67779 - DNA, 687 bp, Carboxydothermus hydrogenoformans Z-2901
  CDS (1)..(687): transl_table=11
atgcgttacggtatggtcatagaccttgataaatgcattggctgccggacctgtgcggtgatttgtaaagaacataattcccagcctccggggacctggtggaaccgggtttttaccccggggagcgaagaacaccaaacggcggtggaaaaagacgggcatttgcagatgtattttttgccggtagcctgccagatgtgtgaaaatgctccctgtgtcaaagtttgtcctgtaggggccacttataccgacgataaggggcgggtactggtagattatgagcgttgcataggctgtcgctactgtatgactgcttgtccctatggtgttcgccagtttaactgggaagacccgaaaaaagctaaagaccgggttggatacatgaaggggtacagctacggttatccctttgaccaccgggacaaggatgaccgactggtttatacccaaaaccgtccaaaaggcgtagtagagaaatgcactttttgcgtccagtataccgataaaggagaacttccggcttgtgttcaggcttgcccggcccatgccagaatatttggtgaccttgacgacaaagattccgaaattagtaaattagtccatgaaagacaggtcgttcaattaaaagaacatttaggaactaaacccaaagtctattatctggcgccaactaagggaagacggtaa

SEQ ID NO: 67780 - protein, 228 aa, Carboxydothermus hydrogenoformans Z-2901
MRYGMVIDLDKCIGCRTCAVICKEHNSQPPGTWWNRVFTPGSEEHQTAVEKDGHLQMYFLPVACQMCENAPCVKVCPVGATYTDDKGRVLVDYERCIGCRYCMTACPYGVRQFNWEDPKKAKDRVGYMKGYSYGYPFDHRDKDDRLVYTQNRPKGVVEKCTFCVQYTDKGELPACVQACPAHARIFGDLDDKDSEISKLVHERQVVQLKEHLGTKPKVYYLAPTKGRR

SEQ ID NO: 67781 - DNA, 540 bp, Carboxydothermus hydrogenoformans Z-2901
  CDS (1)..(540): transl_table=11
atgcctaagtatgctatggtaattgacatgaccaaatgcgctgcctgtcaggcgtgcaccgttgcctgtgaagcggaatgggggctaccccccggggaaaaatttacccggctggaagaacgggaaacgggcagttttcccaatgttcggcgggagtttttattaattcaatgccagcattgcgacaatgccccctgtattgaagtttgccctaccggagcgacatataaaagggaggacggcatagtgctggtagatgataagcgctgtgccggctgcaaatactgcatggtggcctgtccttaccaggcccgggtcataaatcacgaaaaaggtgtgccggaaaagtgccggttttgctatcaccgggtagagcaggggaaaaagccggcctgcgtctctacctgtattggcgaagcccggtattttggggacttagatgatcccaacgacgaaattcaccggattattcagcaaaaacaggcaaaacccttgcggggggatttgggcaccaaaccctccatctactacgtacgctaa

SEQ ID NO: 67782 - protein, 179 aa, Carboxydothermus hydrogenoformans Z-2901
MPKYAMVIDMTKCAACQACTVACEAEWGLPPGEKFTRLEERETGSFPNVRREFLLIQCQHCDNAPCIEVCPTGATYKREDGIVLVDDKRCAGCKYCMVACPYQARVINHEKGVPEKCRFCYHRVEQGKKPACVSTCIGEARYFGDLDDPNDEIHRIIQQKQAKPLRGDLGTKPSIYYVR

SEQ ID NO: 67783 - DNA, 747 bp, Burkholderia sp. 383
  CDS (1)..(747): transl_table=11
atgacccagatggccctcgtcatcgacctgaacgtgtgcgtcggctgccatgcctgcgtgacgagctgcaaggaatggaacacgtcgggcgaagccggcagtctcgcggacatgcgcccgtacgacgacgacccgtccggcacgttcttcaaccgtgtgcagacctacgaagcgggcgtgttcccgatgaccgacacgatccacttcccgaagtcgtgcctgcactgcgaggatccgccgtgcgtgcccgtctgtccgaccggcgcgagctacaagcgcaagtcggacgggatcgtgctggtcgactacgacaagtgcatcggctgcaagtactgcgcgtgggcgtgcccgtacggcgctcgcgagctcgacgaaggccgcaaggagatgacgaagtgcacgctgtgcgcggaccgcatcgacaaccaggcgttgcccgaacgcgaccggaagccggcttgcgtgctcgcgtgcccgacgtcggcgcggctgttcggcgacgtgcacgatccggagtcggaggtgtcgcgcgcgatccgcgaacgcggcggctatcagctgatgccggaatgggacacgcggccgtcgaaccattacctgccgcgcgtgaagaccgaatcgtcgtgcgggtgcgggagtagcggcgggtgcggcagcgggtcgaacggccgcgacgaggacgcgtcgttcgaggcccgcgcggcgcgcggcgacatcgatctcgtgtcgctcgcgacgcagcgctga

SEQ ID NO: 67784 - protein, 248 aa, Burkholderia sp. 383
MTQMALVIDLNVCVGCHACVTSCKEWNTSGEAGSLADMRPYDDDPSGTFFNRVQTYEAGVFPMTDTIHFPKSCLHCEDPPCVPVCPTGASYKRKSDGIVLVDYDKCIGCKYCAWACPYGARELDEGRKEMTKCTLCADRIDNQALPERDRKPACVLACPTSARLFGDVHDPESEVSRAIRERGGYQLMPEWDTRPSNHYLPRVKTESSCGCGSSGGCGSGSNGRDEDASFEARAARGDIDLVSLATQR

SEQ ID NO: 67785 - DNA, 915 bp, Burkholderia sp. 383
  CDS (1)..(915): transl_table=11
atggcattgcaatcgctggatatcaagcgcgtctcggccaccacgacgccaccgcccacggtgcgcgaaccggtgaccgggagtgtcgcgaagctgatcgacgtatcgaagtgcatcggctgcaaggcatgccagacggcgtgcatggagtggaacgacctgcgcgacgaagtcggtaccaacgtcggcgtgtacgacaacccggccgacctgaccgagcattcgtggacggtcatgcggttctccgaatacgagaacccggcgggcgacctcgagtggctgatccgcaaggacggctgcatgcactgcgaggatccgggctgcctgaaggcgtgtccgtcgccgggcgcgatcgtgcagtacaacaacgggatcgtcgatttccacgaggagaactgcatcggttgcggctattgcgtgaccggttgcccgttcaacgttccgcggatctcgaagaaggatcatcgcgcgtacaagtgcacgctctgttccgaccgcgtcgcggtcggccaggaaccggcctgcgtgaagacctgcccgacgggcgcgatcgtgttcggcaccaaggaggacatgaagcagcacgcggccgagcggatcgaggacctgaaggagcgcggcttcgagcatgcggggttgtacgacccgcaaggcgtcggcggcacgcacgtgatgtacgtgctgcaccacgccgataagccgtcgctgtaccacgggctgcccgacaatccgtcgatcagcccgatggtgaagctgtggaagggcatcgcgaaaccgctcgcggtggccggcatcgcgctgaccgcgcttgccgggttcttccactatgtgcgggtcggtccgaacgaggtgagcgacgaagaggaacaagccgcgcgcgacgaggcgcgacgcatcaaggaggacgcgaaatga

SEQ ID NO: 67786 - protein, 304 aa, Burkholderia sp. 383
MALQSLDIKRVSATTTPPPTVREPVTGSVAKLIDVSKCIGCKACQTACMEWNDLRDEVGTNVGVYDNPADLTEHSWTVMRFSEYENPAGDLEWLIRKDGCMHCEDPGCLKACPSPGAIVQYNNGIVDFHEENCIGCGYCVTGCPFNVPRISKKDHRAYKCTLCSDRVAVGQEPACVKTCPTGAIVFGTKEDMKQHAAERIEDLKERGFEHAGLYDPQGVGGTHVMYVLHHADKPSLYHGLPDNPSISPMVKLWKGIAKPLAVAGIALTALAGFFHYVRVGPNEVSDEEEQAARDEARRIKEDAK

SEQ ID NO: 67787 - DNA, 1572 bp, Pelodictyon luteolum DSM 273
  CDS (1)..(1572): transl_table=11
atgaattacggttttgtcattgacgcccgcaagtgcatcggatgccatgcatgctccgttgcctgcaaatcagaaaaccaggttccgctaggcgtgaacaggacctgggtgaagtatgtggagaaggggaccttccctgatacccgccgctactttaccgtgctgcgctgcaaccactgcgaggaacccccctgcgtggatatctgccctgtcgaagcactgcataagcggcctgacgggattgtggatttcgactcccgccgctgcatcggctgcaaggcctgtgctcaggcatgcccctacaactccgtgtacatcgatcccgagactcagaccacggccaagtgcagctactgctcgcacagggtcgagattggcctgaagcccgcctgtactgtgatctgccctcagcaggcgatcatttcgggagatcttgatgaccctcagagtgaaatctccaaactggtggcaaacgagcgcactgttgtccgcaagccggaaaaagggacaggcccgaatgtcttctacatcaacggcgacggcgcttcgcttgatccgttccaggcacccgaagaggacgcctatatgtggagcgcccagtcgcgcggcgtcggccacttcgccaagcatgcggtgcacggtgaaggccacggtgttcccgatcggtctgcagtcggttcgcacggcgcgaaaccgaaagccggagctccccgcagggtatacgatgctccctcaaagggctccgtctggggctgggaggttcctgcatatgtatggtcgaaggccgtgtctgcaggtgcattccttcttctttttgccttcgctctcatgccggacgctgcgctttctcccgccatgcagtgggggctctgggcgatctcgctagtgttcctcgccctgaccggcgccttcctcgtgaaggatctcgaccgtcctgaccgctttacctcggtcatgctccgccctcagttcggttcgtggctcgtccggggcggcctcaccatcaccggctacggagcattcctcgccctctggggagccggcacctggcttgcgcttccgatgcttgcttctgctggtctctggggcggtgccgccatggcgctgctgactgcggtatatactgcattcctctttggatctgccaagggccgcgacttctggcagagcccgatgctgtcgttgcacatgctcctgaactcggtgattgccggaggcgcagccatggcgcttctctctctcttcaccgggatcgatgagggtgctgccgggcagctcagaatggtgctcaccggcgccttcgttcttcatctcctcgttatggcaacggagctttacggccgccacccgtccgtcggtgccgaacgtgccgccgaggcgatcaggagcggaagcctgaagaacgatttctggttcggaagtgtcctgttgggcaacctgctgcctcttctcgcagtccttgtgccgaccggctcactgaccctcgccgtggcttccatcttcgccctcgccggcgttttctacaccgaaaaagtatgggtcaaggccccgcagacaatctcattaagttaa

SEQ ID NO: 67788 - protein, 523 aa, Pelodictyon luteolum DSM 273
MNYGFVIDARKCIGCHACSVACKSENQVPLGVNRTWVKYVEKGTFPDTRRYFTVLRCNHCEEPPCVDICPVEALHKRPDGIVDFDSRRCIGCKACAQACPYNSVYIDPETQTTAKCSYCSHRVEIGLKPACTVICPQQAIISGDLDDPQSEISKLVANERTVVRKPEKGTGPNVFYINGDGASLDPFQAPEEDAYMWSAQSRGVGHFAKHAVHGEGHGVPDRSAVGSHGAKPKAGAPRRVYDAPSKGSVWGWEVPAYVWSKAVSAGAFLLLFAFALMPDAALSPAMQWGLWAISLVFLALTGAFLVKDLDRPDRFTSVMLRPQFGSWLVRGGLTITGYGAFLALWGAGTWLALPMLASAGLWGGAAMALLTAVYTAFLFGSAKGRDFWQSPMLSLHMLLNSVIAGGAAMALLSLFTGIDEGAAGQLRMVLTGAFVLHLLVMATELYGRHPSVGAERAAEAIRSGSLKNDFWFGSVLLGNLLPLLAVLVPTGSLTLAVASIFALAGVFYTEKVWVKAPQTISLS

SEQ ID NO: 67789 - DNA, 732 bp, Pelodictyon luteolum DSM 273
  CDS (1)..(732): transl_table=11
atgaggaaagcgggcctcggcctcatcgccgggctgggagccgcttcgggtatcatcggcaacccgctctttgagcgcgtatcggcttccgcgtgggcttcctcccccaaacagccgggccggcgctggggcatgctgatcgacacgcgcctttgccctgcaggctgcactgcctgcgtcgacgcatgccgtctcacccacaacgtccccacattcagcgacccccgccggagggtggagtggatccataaggaagaggggcgcgcgctcctcggtaccgcatgcgccacgaagcagacgatgccggctctctgcaaccactgtgccgagccgagttgcgtgcgtgcatgccctacggactccattttccggagaaaggacggcatcgttgccatcgactaccaccgctgcatcggttgccgttcatgcatgcttgcctgcccgtacggggaggtcagcttcaactggagcgatccccgtccggccatcaaggaaccgacccctgactacccgacgaggcagcagggtgtcgtcgagaagtgcaacttctgctccgaccgcctgaaaaaaggacttgagccgtcatgctccagccggtgtccggaaggggcgatgacatttggtgacctcaacgacccgaaatccgccatacgccggctgcttcaggcaaacgagaccatgcggcgcaaggcagagctcggcaccgaaccgtcggtattctacatcatttaa

SEQ ID NO: 67790 - protein, 243 aa, Pelodictyon luteolum DSM 273
MRKAGLGLIAGLGAASGIIGNPLFERVSASAWASSPKQPGRRWGMLIDTRLCPAGCTACVDACRLTHNVPTFSDPRRRVEWIHKEEGRALLGTACATKQTMPALCNHCAEPSCVRACPTDSIFRRKDGIVAIDYHRCIGCRSCMLACPYGEVSFNWSDPRPAIKEPTPDYPTRQQGVVEKCNFCSDRLKKGLEPSCSSRCPEGAMTFGDLNDPKSAIRRLLQANETMRRKAELGTEPSVFYII

SEQ ID NO: 67791 - DNA, 600 bp, Pelodictyon luteolum DSM 273
  CDS (1)..(600): transl_table=11
atggcgcgatatggaatggtaatggacatgcggacctgcgtcggatgccaggcctgcatggctgcatgcacggcggagaaccagacgccgttctggaacgggaagttccggacgcatgtcgaagacaaagcacagggcacatttcccgatgtacggcgggtgctgcttccgaggctctgcatgcactgcgaaaacaccccctgcctgtcagcatgcccgacaggggcaacattcatgacggaggacggcatcgtcaaggtcaactacgaccgctgcatcggctgctacgcatgctgcatcgcatgcccgtacgatgcccgctacgcttacgaccgcgaggatgtcaataaggaggaggagctctacggaaagttcacgagccacaagcagccgcatgtcgacaaatgcacattctgcgaccaccgggtttcggaagggcgtgagccggcctgcgtcagcacctgccctaccaatacaaggatcttcggagatctcgacgaccccaacagcgaggtgcacaagctggcaacaagcggaaaagcccaggcgctgaaccagtcgctcggcacgtccccgaaagtatattacatcccatcatag

SEQ ID NO: 67792 - protein, 199 aa, Pelodictyon luteolum DSM 273
MARYGMVMDMRTCVGCQACMAACTAENQTPFWNGKFRTHVEDKAQGTFPDVRRVLLPRLCMHCENTPCLSACPTGATFMTEDGIVKVNYDRCIGCYACCIACPYDARYAYDREDVNKEEELYGKFTSHKQPHVDKCTFCDHRVSEGREPACVSTCPTNTRIFGDLDDPNSEVHKLATSGKAQALNQSLGTSPKVYYIPS

SEQ ID NO: 67793 - DNA, 543 bp, Chlorobium chlorochromatii CaD3
  CDS (1)..(543): transl_table=11
atgattattgatacccgcgtttgcgttggctgttcagcctgtgtttacgcttgtaaatcggaaaacgaagtgcccgttggctactgccgcgattgggttgtgcaagaaaccaacggcaacttccccaaactcagcatggaaaaccgctcagaacgctgccaacattgtgataacgccccatgcgttacctactgcccaacaggcgcttcgcattacgacgagtttggcacggtgcaaattaaccgttcgcgctgcacgggatgtaaagcctgcatggcagcctgcccttatgatgcacgctacgttcaccctgatggttttgttgacaaatgtaccctttgccaccaccgccttgagaagggaatgaaaaccgcatgtgtttccatttgcccaacaggtagcttgcatttggtcaattttgcaaaccttaccgctgacgacaaagctatgatggcaggtaaagaggtttatcgccaaaaagcacatgctggcacagagccacgactttactggatttccgcaagtaataaacccggagcgtaa

SEQ ID NO: 67794 - protein, 180 aa, Chlorobium chlorochromatii CaD3
MIIDTRVCVGCSACVYACKSENEVPVGYCRDWVVQETNGNFPKLSMENRSERCQHCDNAPCVTYCPTGASHYDEFGTVQINRSRCTGCKACMAACPYDARYVHPDGFVDKCTLCHHRLEKGMKTACVSICPTGSLHLVNFANLTADDKAMMAGKEVYRQKAHAGTEPRLYWISASNKPGA

SEQ ID NO: 67795 - DNA, 762 bp, Chlorobium chlorochromatii CaD3
  CDS (1)..(762): transl_table=11
atgaacgaacaacgcagagaatttatccgattggctggcatgggatttcttgccagtgttggtgccacttgtgggcttatgtcgagcgctccattagaagccaccgatctaacagtgtttgctgatagcggcaatggcgctgttcgctggggtatgcttgtagatacgcgcaaatgccgcgaagggtgcaacaagtgtattgaaagctgccatacggtgcataatgtgcctgattttgcttcagcaaaagagcgtgtgcagtggattgaaaagcgtccagttgcttcacttttttcagagagaaaagcacttccagctcaaagtgcaaccttacctgcattgtgtaaccattgtgcgaaagcgccgtgtgttacagcctgccccacctctgcaatattccgccgatatgacggtattgttgggcttgattttcaccgttgcattggttgccgtgcttgcatgacggcttgcccttatagcgctattagttttaattggaaagcaccacgtccagctattaagtcgttaagtgatggttatcccacacgcgagcaaggtatggtggaaaaatgcaatttctgctcggagcgccttgctaaaggcttaatgcctgcatgtgcggaaagttgccctgaacatgcgcttgtatttggtaatcttaatgatcctgcttctgaaattcgcacgttgcttgcctcaagccgcacgttacagcgtaaagcggagcaaggcacaaaaccttcagttttctatataatttaa

SEQ ID NO: 67796 - protein, 253 aa, Chlorobium chlorochromatii CaD3
MNEQRREFIRLAGMGFLASVGATCGLMSSAPLEATDLTVFADSGNGAVRWGMLVDTRKCREGCNKCIESCHTVHNVPDFASAKERVQWIEKRPVASLFSERKALPAQSATLPALCNHCAKAPCVTACPTSAIFRRYDGIVGLDFHRCIGCRACMTACPYSAISFNWKAPRPAIKSLSDGYPTREQGMVEKCNFCSERLAKGLMPACAESCPEHALVFGNLNDPASEIRTLLASSRTLQRKAEQGTKPSVFYII

SEQ ID NO: 67797 - DNA, 783 bp, Geobacter metallireducens GS-15
  CDS (1)..(783): transl_table=11
atgaacaggcgagactttctcaagaatagcatcacggtcatcgcggggctggcggtgcccctctcggccctggaactcatcagcccgaggaagctcctggctcaaaagggagacgaatcgccggtccggtgggcctttctggtggacacccaggcctgcgtcgggtgcggcttctgcgtcaaggcgtgcaagacggagaacgagatcccccacgagaccaacatcacccgcacctgggtggaacggtacgtggtgacccggaaggggaagacctacgtggattctccccggggagcccgggacggcttcaccacggaccggatcgatcagggcgaggaagggtatcgcgaggtcaaggcgaaggatgtcgagaaggcgttcttcgtccccaagctctgcaaccagtgcgataaccccgcctgcgtccaggtctgccccgtgggagccacctaccagacccccgacggcgtggtgctggtggaccggaagcactgcatcggctgcgcctactgcatcatggcgtgcccctacggggtccgctccttcaatccggcctacaagacggcggagaagtgcaccttctgctatcaccggatcagtaaggggatgaagacggcctgcgtggacgcctgccccttcggtgcccggaagatcggcaacctgcgggatcccgacgatcccgtgacgaagaccatcatgtcgggacgggtcggcgtcctgaaggagcagtacggcaccaagccgcaggtctactatctcgctctttcccgggaggtgaaatag

SEQ ID NO: 67798 - protein, 260 aa, Geobacter metallireducens GS-15
MNRRDFLKNSITVIAGLAVPLSALELISPRKLLAQKGDESPVRWAFLVDTQACVGCGFCVKACKTENEIPHETNITRTWVERYVVTRKGKTYVDSPRGARDGFTTDRIDQGEEGYREVKAKDVEKAFFVPKLCNQCDNPACVQVCPVGATYQTPDGVVLVDRKHCIGCAYCIMACPYGVRSFNPAYKTAEKCTFCYHRISKGMKTACVDACPFGARKIGNLRDPDDPVTKTIMSGRVGVLKEQYGTKPQVYYLALSREVK

SEQ ID NO: 67799 - DNA, 834 bp, Geobacter metallireducens GS-15
  CDS (1)..(834): transl_table=11
atgagctcctcgaccatcgactacggcaagaccaagacgttcctcatcgacaccaccaagtgcaccggctgccgcggctgccaggttgcctgcaagcagtggaaccagctgaagggtgagaagaccacgttcttcaccggcgaagggtaccagaacccgccccagatgtccgaattcaccttcacccgggtgaagttcaaggactacgagaagcacgggcagaacgagttcgccttctacaaggagatgtgcatgcactgcaacgaccccgcatgcgcctccgtctgtcccgtcggcgccttccacaaaacgccggaagggcctgtcatctacaacgccaagaagtgcatcggctgccgcttttgcatggtggcctgccccttcggcgttcccaagtacgagtggagcaaggcgtttcccttggtgaagaagtgcaccggctgctacagccgggttaagaacggccttcaccccgcctgcgccaccgcctgccccaccgccatcacctacggcagccgggacgagatgctgaaagaggcggagaagcggatggccgccaagcccgaccgctacttcaaggtggtctacggcaaggaggaggccggcggcaccagcgtcctctatctgacccagcagcccctggacgaactgggcttccggccggtcaccaagcggccgctcccttcctacacctggcaggccctgcggttcgtgccggggatcttcctcaccgttggcggcaccctgtcgctggtcacctggttccagcaccgcaaggaccgggtgaggcgcgaggaagaggaacggaacagccggaaggaggggaaccaatga

SEQ ID NO: 67800 - protein, 277 aa, Geobacter metallireducens GS-15
MSSSTIDYGKTKTFLIDTTKCTGCRGCQVACKQWNQLKGEKTTFFTGEGYQNPPQMSEFTFTRVKFKDYEKHGQNEFAFYKEMCMHCNDPACASVCPVGAFHKTPEGPVIYNAKKCIGCRFCMVACPFGVPKYEWSKAFPLVKKCTGCYSRVKNGLHPACATACPTAITYGSRDEMLKEAEKRMAAKPDRYFKVVYGKEEAGGTSVLYLTQQPLDELGFRPVTKRPLPSYTWQALRFVPGIFLTVGGTLSLVTWFQHRKDRVRREEEERNSRKEGNQ

SEQ ID NO: 67801 - DNA, 714 bp, Geobacter metallireducens GS-15
  CDS (1)..(714): transl_table=11
atggaaacaatgacgagtcagtacagatgggggatggttgtcgaccttgatcggtgcaccggctgcggcgcttgcgttgttgcctgtcaggcggagaacaacgtggccatctgcggcaagaaggagatatccgaaggacgcaacatgcactggttacgcatcgagcggttctgggtgggacagtatccggacgtgcgggcgcgctttctcccggtactctgtcagcactgtcatgacgccccctgtgagccggtctgcccggtttatgccagctaccacaaccccgacggtcttaatgggcaggtgtacaaccgctgcgtcggcaccaggtactgcggtaataactgcccctatgccgtaagagtcttcaacttctacaaccacgaatggcccaaccccctcgataatcaactttctccggacatgaccgtgcgtacccggggagtgatggaaaaatgcactttctgcatccagcgcatccgaagggccaaggaagatgccaagtccgaaaatcgcaccattcgtgacggagagatacaaccggcctgcgcccagacctgtccaaccgacgctctggtgttcgggaacatggccgaccctcggagccgggtcgccatcctttcccgcagccccaggcgcttccggctgctggagcatctgggcacccacccctcgatttgctatctcaagggaggaggacgcgagcatgtctga

SEQ ID NO: 67802 - protein, 237 aa, Geobacter metallireducens GS-15
METMTSQYRWGMVVDLDRCTGCGACVVACQAENNVAICGKKEISEGRNMHWLRIERFWVGQYPDVRARFLPVLCQHCHDAPCEPVCPVYASYHNPDGLNGQVYNRCVGTRYCGNNCPYAVRVFNFYNHEWPNPLDNQLSPDMTVRTRGVMEKCTFCIQRIRRAKEDAKSENRTIRDGEIQPACAQTCPTDALVFGNMADPRSRVAILSRSPRRFRLLEHLGTHPSICYLKGGGREHV

SEQ ID NO: 67803 - DNA, 774 bp, Geobacter metallireducens GS-15
  CDS (1)..(774): transl_table=11
atgaatagacgcgagtttctcaagcggagcatggttgtcgtggccggcatggcggtgccggcggcggccctacacctcatcgacccgaaacagcttctggcagcaaagccggaactccgctgggccttcctggtggatgcctacaagtgcgtcggctgcggattctgcgtcaaggcgtgcaaactggagaacgaggtaccctatgaggccaatgtttcccgcacctgggtggagcgctatgtggtgaagaaggacggtgaagtcctgatagactcccccaaggcggcccgggatgggttcaccacgaagaaaatcgaggtgggagaagggaagttccgggaggtgaaggacgaggagatcgagaaggccttctttgtgccgaaactctgcaaccagtgcgagaatcccccctgcgttcaggtctgtcccgtgggggccacctacgccacggcggacggggtggtgctcgtggaccggaagtggtgcatcggctgcggttactgcatcatggggtgcccctacggggtccgcttcttccacccggtccacaagacggcggagaaatgcaacttctgctaccaccggatcaccaaggggatgaagtcggcctgcgtcgacgcctgccccttcggggcccggcagatcggcaacctccgggaccccgacgacccggtcaccaaggtgatcatgaccgagcgggtcggcatcctcaaggaggagtacggaaccaagccccaggtctactacatcggcctgtccaaggaggtacgctag

SEQ ID NO: 67804 - protein, 257 aa, Geobacter metallireducens GS-15
MNRREFLKRSMVVVAGMAVPAAALHLIDPKQLLAAKPELRWAFLVDAYKCVGCGFCVKACKLENEVPYEANVSRTWVERYVVKKDGEVLIDSPKAARDGFTTKKIEVGEGKFREVKDEEIEKAFFVPKLCNQCENPPCVQVCPVGATYATADGVVLVDRKWCIGCGYCIMGCPYGVRFFHPVHKTAEKCNFCYHRITKGMKSACVDACPFGARQIGNLRDPDDPVTKVIMTERVGILKEEYGTKPQVYYIGLSKEVR

SEQ ID NO: 67805 - DNA, 1104 bp, Desulfovibrio desulfuricans G20
  CDS (1)..(1104): transl_table=11
atgcgtcgaagaacctttctgagcctgctcggtgctgccggactttcggtggcagcgggcaagcccgccgccgcggggggcaatcacagcttttccggctaccccgacagctacggcgttctgcatgattccacccgctgcatcggctgccgcaaatgcgaggaagcgtgccagcaggtgaacaatctgcccatgcccgaaaagccgtttgacgacctttcggtgcttgaaaccaagcgcagaacagatgacgccacctatacagtggtcaacaaatacaacgtggccggccttgaacaccctgtgttccgcaaacagcagtgcaaccactgtctggaacccgcctgcgcctcggcctgctttgtaaaggcgtttaccaaaaaccccgacggctcggttacatacaaccccaagctgtgcgtgggctgccggtactgcatgatcgcctgcccgttcaacgtgcccgcgtttgaatacggtgaagcatatgatccgctgattaccaagtgcaccatgtgtcacccccgcctgcaggaaggcaagctgccgggatgcgttgaaaaatgccccaaggaagctctgactttcggcaagcgcgaagacctgctgcgcatcgcgcgcgacagaatccgcaaaaaccctgaacgctatcaggaccacatctacggcgaacacgaaatgggcggcaccaactggctgtaccttgccggtgtacccttcggcgaactgggtcaggatgaacatctgggcaccaagcccgcgcaggaacataccgccggcgcactgggttccgtgcccatggttgtaggcatctggcccgtgctgcttacgggtgcgtacgccatttccaaacgcaaagataaaatagcgcaggaagaacaggccgccgccgtacgccatgccgtgggcgaaacgcaggccgaagcggacgccaagctgcaggccgccatggaaaaggccgccaaggaaaaagaagccgccattgcccgcgaagtgaaaaaggcaaaggaagaggctgaaaaagagttcgaagcgcgccttgccgctcaaaacgaacccgaatccgccgaatccgggacggaaaagcccgaggaggacgcataa

SEQ ID NO: 67806 - protein, 367 aa, Desulfovibrio desulfuricans G20
MRRRTFLSLLGAAGLSVAAGKPAAAGGNHSFSGYPDSYGVLHDSTRCIGCRKCEEACQQVNNLPMPEKPFDDLSVLETKRRTDDATYTVVNKYNVAGLEHPVFRKQQCNHCLEPACASACFVKAFTKNPDGSVTYNPKLCVGCRYCMIACPFNVPAFEYGEAYDPLITKCTMCHPRLQEGKLPGCVEKCPKEALTFGKREDLLRIARDRIRKNPERYQDHIYGEHEMGGTNWLYLAGVPFGELGQDEHLGTKPAQEHTAGALGSVPMVVGIWPVLLTGAYAISKRKDKIAQEEQAAAVRHAVGETQAEADAKLQAAMEKAAKEKEAAIAREVKKAKEEAEKEFEARLAAQNEPESAESGTEKPEEDA

SEQ ID NO: 67807 - DNA, 858 bp, Desulfovibrio desulfuricans G20
  CDS (1)..(858): transl_table=11
atgacccagcagttcgccatggttatcgattccgccagatgcatcgactgcaaagcgtgcgtggtttcctgcaaagtggcaaacaatgttccggcaggattctcacgcaactggatcaaagcagacggaccggtggtcaaggcgggaaaagggcctttcgggcatttccagccgggcgcgtgcatgcactgcgaatctcccacctgcgtggaagcctgccccacaggcgccacatggaaagacagggagaccggcatagtggaaatagaccccgcactgtgcatcggctgcggcaactgcattcctgcatgcccgtacggggcgcgcttccgtaatccgcaaaggcgcattgccgacaagtgcaactactgccccgaacgccgtgccgccggactgccccccgcatgtgtggacacatgccccaccaaggcgcgggtgttcggcgatattctgaaccccgaaacagaagccgcacggctgcttacccgcaacagcggccatgtgacgcagctgatacacgaaaaaagcaacacggcaccgcacatgtactatgtcggcggcaccgcacccgcaggctggatgcatgaagcaaaggctccggcatccatgcgcgcgcttaccggtgttgtggcaccgggagtcaagggactggtggcgctttcgggcctgggcgtactggttatgctgggcaggcagctgctggacagcagaaaatcaggcgacggaggccacgaccggccacacgcgtccggcagtaatgcgtccggcagcagtgcttccggcagcaatgcttccggcagcaatacatccggcacacaacactctgcgccggcagacaccgaagacagcagggagtag

SEQ ID NO: 67808 - protein, 285 aa, Desulfovibrio desulfuricans G20
MTQQFAMVIDSARCIDCKACVVSCKVANNVPAGFSRNWIKADGPVVKAGKGPFGHFQPGACMHCESPTCVEACPTGATWKDRETGIVEIDPALCIGCGNCIPACPYGARFRNPQRRIADKCNYCPERRAAGLPPACVDTCPTKARVFGDILNPETEAARLLTRNSGHVTQLIHEKSNTAPHMYYVGGTAPAGWMHEAKAPASMRALTGVVAPGVKGLVALSGLGVLVMLGRQLLDSRKSGDGGHDRPHASGSNASGSSASGSNASGSNTSGTQHSAPADTEDSRE

SEQ ID NO: 67809 - DNA, 447 bp, Desulfovibrio desulfuricans G20
  CDS (1)..(447): transl_table=11
atgagcagatacagactgaaactgaacaaaaaacgttgcatccactgcaaggcatgtgaagtgcattgcaaagcgaaaaacaacactccggcaggcatcaagctgggcgtgcacacatcttccgaaccggtgatggtggacggcgtaccccgcatgaaagctgcctatcagtgctgctaccactgcgaaacgcccgaatgcgtggacgtatgccccaccggcgccatgatacggcgcgaatctgacggtatagtatatgttgatcaggaaacttgcatcggatgcgaagcctgcatcgatgcctgcccatggcatattcccgtcttcaacgccgccacagccactgtactcaaatgcgacttctgcatggaccgcgttgacgagggcaagctgcccgcctgtgtcaccgcctgcaccacgcacgcactgagcttcacccgcaaatag

SEQ ID NO: 67810 - protein, 148 aa, Desulfovibrio desulfuricans G20
MSRYRLKLNKKRCIHCKACEVHCKAKNNTPAGIKLGVHTSSEPVMVDGVPRMKAAYQCCYHCETPECVDVCPTGAMIRRESDGIVYVDQETCIGCEACIDACPWHIPVFNAATATVLKCDFCMDRVDEGKLPACVTACTTHALSFTRK

SEQ ID NO: 67811 - DNA, 777 bp, Desulfovibrio desulfuricans G20
  CDS (1)..(777): transl_table=11
atgttcgacagaagaagattcctcaagattgctggtctgtcggccctcggtcttggcgctggttccgcgattggagtggcagaagcgctggctgcgcctaaaaaggatccttacagcgccaatgcccatgcgctgcatgccggtcgctgggccatggttatcgatacccgcaagttcgagactcccgaagacttccagaagctcatcacggcctgccacaagcagcacaatgtgcccgacattcccaatgatcagcacattatgtggctgtggacggacaagtacgagcacaccttccccgaacaggctaacaaccatctgtccgatgaagtgaaggagcgggactttctgctgctgtgcaaccactgcgaaaacccgccgtgcgtccgtgtgtgccccacaaaggccacttacaaacgccccgacggcattgttgccatggactaccaccgctgcatcggctgccggttctgcatggcaggctgcccctacggcgcgcgtagcttcaactacggcaaccccagagaatacctgaaggatatcaccaaccccgctttccccacacgtatgcgcggcgttgttgaaaaatgcaacttctgcgtcgaacgtctggctcaggggctgatgccctcctgcgttgaagcgtctgaaggtgccattgtctttggcgatctgaacgatccggattccgaagtgcgtcaggttctggccgaaaacttcaccatccgccgtaaaccatctctgggcacgcagcccggtgtatactacatcatctaa

SEQ ID NO: 67812 - protein, 258 aa, Desulfovibrio desulfuricans G20
MFDRRRFLKIAGLSALGLGAGSAIGVAEALAAPKKDPYSANAHALHAGRWAMVIDTRKFETPEDFQKLITACHKQHNVPDIPNDQHIMWLWTDKYEHTFPEQANNHLSDEVKERDFLLLCNHCENPPCVRVCPTKATYKRPDGIVAMDYHRCIGCRFCMAGCPYGARSFNYGNPREYLKDITNPAFPTRMRGVVEKCNFCVERLAQGLMPSCVEASEGAIVFGDLNDPDSEVRQVLAENFTIRRKPSLGTQPGVYYII

SEQ ID NO: 67813 - DNA, 768 bp, Desulfovibrio desulfuricans G20
  CDS (1)..(768): transl_table=11
atgtcctctaaaaaggaattcaaaatcaaatggggtatggcaatagacctcgataaatgcacgggctgcggcgcgtgcatggtcgcctgccaggcagaaaacaacattgcccctgctccggacgcaaccaacaagctgaaaacgctcaactggcttgtggtgtacgagctgtccaacaagaaaccgtttcccgaccacgatgtggcatacctgccgcggccctgccagcagtgcggcaacccgccctgcgtttcggtatgtcctgttatcgccaccgacaaaaacgaagaaggcggcatagtcagtcaggtaaccccccgctgtatcggctgccggtactgcatggccgcctgcccctaccatgcccgctacttcaactggtacgatcccatctggccggaaggcatggaaaaaacactgacgcccgatgtgtctgtaagaccccgcggcgtagtggaaaaatgcaccttctgccatcatcgcatgatggctgccagagacaaggcaagagtggaagggcgtgatcccgatgcactggaagatggcgaatacatcacctcgtgcaccgaggcatgccccaacggtgccatagtgttcggcgatctgctgaaccctgaccacaaggtgtatgaactgtcgcgcagcaagtacgccttccggctgcttgaacgtctgggtgccgacacgcaggtgtactacctcagccgtcgcgaatgggtccgccgtcttggcgacaactatcttgaacacgaaaaggtcaaggggtag

SEQ ID NO: 67814 - protein, 255 aa, Desulfovibrio desulfuricans G20
MSSKKEFKIKWGMAIDLDKCTGCGACMVACQAENNIAPAPDATNKLKTLNWLVVYELSNKKPFPDHDVAYLPRPCQQCGNPPCVSVCPVIATDKNEEGGIVSQVTPRCIGCRYCMAACPYHARYFNWYDPIWPEGMEKTLTPDVSVRPRGVVEKCTFCHHRMMAARDKARVEGRDPDALEDGEYITSCTEACPNGAIVFGDLLNPDHKVYELSRSKYAFRLLERLGADTQVYYLSRREWVRRLGDNYLEHEKVKG

SEQ ID NO: 67815 - DNA, 591 bp, Thiomicrospira denitrificans ATCC 33889
  CDS (1)..(591): transl_table=11
atgagcaagccagaatatgcaagaatgaaattttattgtgatgaggatctttgtatcgactgcaatggttgtgttgtagcttgtaaagaagcacacgaagttcctgttggaataaatagaagaaaagttgtaactatcaatgagggtattgtaggtaaagagatgtctatgtctatggcgtgtatgcattgtactgatgcaccatgccaacaagtctgcccagttgactgtttttatataagagccgatggtatagttcttcatgacaaagataagtgtatcggttgtggatactgtctatttgcttgtccttttggagcgccacagttccctcaagatggagcatttggtacaaaaggaaaaatggataagtgtactatgtgtgctggtggtccagaagagactaactcacatgaagagtttgaaaaatatggacaaaatagaatctcagagggcaaagttccaatgtgtgcttctatgtgttcaacaaaggctctcttagtaggtgatgcaaacgaagtagcagctattaaaacacatagagcagtagctcatggaaaaggcatatcaactcagtcttatggttggtag

SEQ ID NO: 67816 - protein, 196 aa, Thiomicrospira denitrificans ATCC 33889
MSKPEYARMKFYCDEDLCIDCNGCVVACKEAHEVPVGINRRKVVTINEGIVGKEMSMSMACMHCTDAPCQQVCPVDCFYIRADGIVLHDKDKCIGCGYCLFACPFGAPQFPQDGAFGTKGKMDKCTMCAGGPEETNSHEEFEKYGQNRISEGKVPMCASMCSTKALLVGDANEVAAIKTHRAVAHGKGISTQSYGW

SEQ ID NO: 67817 - DNA, 654 bp, Magnetospirillum magnetotacticum MS-1
  CDS (1)..(654)
atgaccaaatgggccatcgtcgccgatctgggccgctgcgtcggctgccagacctgcaccacggcgtgccgtcacgccaatgccacgccgcccggcgtgcagtaccgcaaggtgctggacatggaggtgggcaccttccccgatgtgcgccgcgtcttcgttcccgtcggctgcatgcattgcgacgagccgccgtgccgcgacgtctgtcccaccacggcgaccaccaagcgcgccgatggcatggtgatgatcgactacgatatctgcatcggctgcggctattgcatcgtcgcctgcccctatcaggcccgctacaaggtttccaagcccaccttcgccttcaaggatcaagagacgcaaaatgagcgggcgcgcttcgacgaacgcttgcttggcgtcgcgcagaagtgcaccttctgcgtcgaccgggtcgattacgggctggccaacgggttgacccccggcgtggcaccggaagcgactcccgcctgcgtcaattcctgtctgtccaaggcgttgacgttcggcgacaccgataatcctgacagcaacgtcagcaagctgctgaagcggtacaaatcgttccgcatgcacgaggaactcgggaccggtcccaacattcactatttgtgggagaccgaggacgaatga

SEQ ID NO: 67818 - protein, 217 aa, Magnetospirillum magnetotacticum MS-1
MTKWAIVADLGRCVGCQTCTTACRHANATPPGVQYRKVLDMEVGTFPDVRRVFVPVGCMHCDEPPCRDVCPTTATTKRADGMVMIDYDICIGCGYCIVACPYQARYKVSKPTFAFKDQETQNERARFDERLLGVAQKCTFCVDRVDYGLANGLTPGVAPEATPACVNSCLSKALTFGDTDNPDSNVSKLLKRYKSFRMHEELGTGPNIHYLWETEDE

SEQ ID NO: 67819 - DNA, 744 bp, Magnetospirillum magnetotacticum MS-1
  CDS (1)..(744)
atggtcatcgacctggaaaagtgcaccggctgccaagcctgcaccaccgcctgtcaggtggaaaataaccggctgcccggtgagaactggcaggacgtcctgttctacgccgagggtgaatatccctcgggcaagttcagctggctgccgcgtccctgcatgcactgcgagaacccgtcctgccgcgaggtctgcccgaccggggcgaccttcaaggacaaggacggctttgtcctggtggattgggagaaatgcatcggctgcaaatactgcatggtcgcctgcccctacggcgtgcgcttctatgccgaggaaaagcagccggttcagcccgacatccgttcggtgttcccaggcgacggcgacaagatgtggaacccgccgtggcagatgcccgaggcgcggcgcgatcccaagcacggcgtcggcatccagcccaccaacgtggtctccaaatgcaccttctgctatcaccgggtttccaaggctccggcgggaaccgtggatctcgatcccagcaatccggctttgcgcgatttcgtcccggcctgcgtcgtcacctgcgcgccctcggcccgctatttcggcgacctcgacacgcccaccagcgaggttcgccgtctcatcgccgagaagcggggtacccgcctgaaggaggaaaccggcaaccggccccaggtctactacctggccggtgagcaatcctccatccctgaaacccgctccacgcgcatcaaatcgtaa

SEQ ID NO: 67820 - protein, 247 aa, Magnetospirillum magnetotacticum MS-1
MVIDLEKCTGCQACTTACQVENNRLPGENWQDVLFYAEGEYPSGKFSWLPRPCMHCENPSCREVCPTGATFKDKDGFVLVDWEKCIGCKYCMVACPYGVRFYAEEKQPVQPDIRSVFPGDGDKMWNPPWQMPEARRDPKHGVGIQPTNVVSKCTFCYHRVSKAPAGTVDLDPSNPALRDFVPACVVTCAPSARYFGDLDTPTSEVRRLIAEKRGTRLKEETGNRPQVYYLAGEQSSIPETRSTRIKS

SEQ ID NO: 67821 - DNA, 1020 bp, Magnetospirillum magnetotacticum MS-1
  CDS (1)..(1020)
atgaccatcaccagacgcaattttctggcgacggcggcggcgggtggaacagcggcagccgccgcctgcgccaccctcgccccctccggcgcccaggcgcgggaaagccatcaggttcccgagaacgccgtcggcctgctttacgacgccaccttgtgcatcggctgcaaggcctgcatgtcggcgtgcaaggaggccaacagcctgccgctggaagacaatatcggcgagaagctgtgggacacgccgctggagctttccggcaagacctacaacgtcatcaagatctatcagtccggcaccatggaaaataaggacaaggccgagaacggctttgcccatatcaagcgctcctgcctgcactgcgccgatccgtcctgcgtgtcggcctgccccgtctcggccatgcagaagcggcctaccgacggtgtcgtgacctataacaaggacgcctgcatcggctgccgctactgcgtcgccgcctgccccttcggcgttccccagttccagtacgacacacccacgccgcagatcgccaagtgccagctgtgcaagcacaggatggaacagggcaagtatgccgcctgcgcggaaagctgccccaccggcgccaccattttcggctcctacaaggcgctttcggaagagatcgagcggcgccgggccatgaagccgggcgagcccaatctgttcccccgccgcacccccgattcgggcgacacgcacgaaaaggccgcgccggaatatgtggactatgtctacggccagaaggacgcggggggcacccaggtgcgctacctgtccggggtcgccttcgacaagctggccctgcccatgggcctgcccgaacggtcctacgccgcagattccgagacccttcagcacaccctctatggcgggatgatcctgccggtggtggcgctggccggtctggtcaccgctgcctggaagggctcgaaggaccaccacgacgacgatgatttcgacatgttcgatcatccggaaggggggcacaagtaa

SEQ ID NO: 67822 - protein, 339 aa, Magnetospirillum magnetotacticum MS-1
MTITRRNFLATAAAGGTAAAAACATLAPSGAQARESHQVPENAVGLLYDATLCIGCKACMSACKEANSLPLEDNIGEKLWDTPLELSGKTYNVIKIYQSGTMENKDKAENGFAHIKRSCLHCADPSCVSACPVSAMQKRPTDGVVTYNKDACIGCRYCVAACPFGVPQFQYDTPTPQIAKCQLCKHRMEQGKYAACAESCPTGATIFGSYKALSEEIERRRAMKPGEPNLFPRRTPDSGDTHEKAAPEYVDYVYGQKDAGGTQVRYLSGVAFDKLALPMGLPERSYAADSETLQHTLYGGMILPVVALAGLVTAAWKGSKDHHDDDDFDMFDHPEGGHK

SEQ ID NO: 67823 - DNA, 678 bp, Actinobacillus pleuropneumoniae serovar 1 str. 4074
  CDS (1)..(678)
atgacttgcacccgtagagacttcgtctcaggggcaggtgctatcgctgtcgtagcaagcactgggcttgctacctcagtaactcttgctactgagaaagaagagaaaaaaattcgctatgcgatggtgcacgatgaaacctcttgtatcggttgtaccgcttgtatggacgcatgtcgtacgacaaacaaagtaccggaaggcgtttcacgtttagaaattatccgtagcgagccttatggcgaattccctaatgtcgagtatgaatttttccgtcaatcttgccaacactgtacgaatgctccgtgcgtagcggtatgtccgactggcgcttcattcgtagatccggaaaccggcattgttgatgtacattcagacttatgtgtcggttgccaatactgtatcgcagtttgcccgtaccgtgtacgttttatccatccggagaaaaaatccgcagacaaatgtaacttctgtcgtgatactaaccttgcggaaggtaaacaaccggcttgtgtagaagcatgcccgactaaagcattaacctttggcgatatgaacgatcacaatagcgaagtgtacaaaaaagtgcgtgaaaatcctgtgtatcgtactaaagttgcgttaggtaccgagcctaacttataccacattccatttggcaagggggagcatagataa

SEQ ID NO: 67824 - protein, 225 aa, Actinobacillus pleuropneumoniae serovar 1 str. 4074
MTCTRRDFVSGAGAIAVVASTGLATSVTLATEKEEKKIRYAMVHDETSCIGCTACMDACRTTNKVPEGVSRLEIIRSEPYGEFPNVEYEFFRQSCQHCTNAPCVAVCPTGASFVDPETGIVDVHSDLCVGCQYCIAVCPYRVRFIHPEKKSADKCNFCRDTNLAEGKQPACVEACPTKALTFGDMNDHNSEVYKKVRENPVYRTKVALGTEPNLYHIPFGKGEHR

SEQ ID NO: 67825 - DNA, 678 bp, Haemophilus influenzae R2846
  CDS (1)..(678)
atgacagtctgctcacgccgaaactttgtttctggcatgggggcagtgatccttatgacgggaacatctttaccttcttttgcaaaagaagacaaggcggataaacctaaacgttacgcaatgatacatgatgaaaatgcgtgtatcggttgtacagcctgtatggacgcatgtcgtgatgtaaaccaagtgccagaaggcgtttctcgcttagagattctacgtagtgaaccttatggggaatttccaaatcaagaatacgagttctttcgtcaatcttgccaacattgtacaaatgcaccttgtgtagcagtttgtccaactggtgcatcttttattgataaagagactggcattgtagatgtacataaagatttatgcataggctgccaatactgtatagcagtttgcccatatcgtgtacgttttattcatccaatacatcgtaccgcagataaatgtaacttctgccgcgatacaaatttagccaatggtaaacaacctgcttgtgtagaggcttgcccaaccaaagcattaacctttggggatatgaatgatccaacaagtgcagtttcacgtaaagtgaaagaaaaaccggtttatcgcactaaagtggaattaggtacacaaccaaacttatatcacattccattccaacatggggagcctagaagatga

SEQ ID NO: 67826 - protein, 225 aa, Haemophilus influenzae R2846
MTVCSRRNFVSGMGAVILMTGTSLPSFAKEDKADKPKRYAMIHDENACIGCTACMDACRDVNQVPEGVSRLEILRSEPYGEFPNQEYEFFRQSCQHCTNAPCVAVCPTGASFIDKETGIVDVHKDLCIGCQYCIAVCPYRVRFIHPIHRTADKCNFCRDTNLANGKQPACVEACPTKALTFGDMNDPTSAVSRKVKEKPVYRTKVELGTQPNLYHIPFQHGEPRR

SEQ ID NO: 67827 - DNA, 684 bp, Thiobacillus denitrificans ATCC 25259
  CDS (1)..(684)
ttggtcatcgaccttgacgtgtgcgtgggctgtcatgcctgcgccatcgcctgcaaggagtggaacgcctccggcaccatcggcccgttgtcggattaccagccctacggcgccgagccgtcgggcgtctggttcaaccggatccgccattacgagatggacgagtatccgaacaacaagaccgtcaacttcccgatgtcgtgcatgcactgcgaggacgccgactgcgtcacggtgtgcccgaccggcgcgtcgtacaagcgtgccgaggacggcatcgtgctgatcgaccaggataagtgcatgggctgcaactactgctcctgggcctgcccctacggcgcgcgcgaactcgaccgatcgagcggcacgatgaagaaatgcacgctgtgcgtcgaccgtatctacgacgagaacctgccggtcgaggagcgccaaccctcgtgcgtgctgacctgcccggcgcacgcgcgcatgttcggcgacttcgacgatcccgattcggcggtgtcgcgcgtggtgcgcgagcgcggcgggtatccgctgatgcccgagctcaactacaacccgacgaacacctatctgccgatccgtcgcaagccggtgatcggggtggaaaccaaaccgaagggcggcttgaaggaaagcatcaagcagttcgccaacaggctggtgcgccgttga

SEQ ID NO: 67828 - protein, 227 aa, Thiobacillus denitrificans ATCC 25259
MVIDLDVCVGCHACAIACKEWNASGTIGPLSDYQPYGAEPSGVWFNRIRHYEMDEYPNNKTVNFPMSCMHCEDADCVTVCPTGASYKRAEDGIVLIDQDKCMGCNYCSWACPYGARELDRSSGTMKKCTLCVDRIYDENLPVEERQPSCVLTCPAHARMFGDFDDPDSAVSRVVRERGGYPLMPELNYNPTNTYLPIRRKPVIGVETKPKGGLKESIKQFANRLVRR

SEQ ID NO: 67829 - DNA, 831 bp, Burkholderia mallei 10229
  CDS (1)..(831)
atgcggcgaaacgccgttgacgaggaggatgcgatgacgcaaatggcgctcgtgatcgatctgaacgtgtgcgtggggtgccacgcgtgcgtaacgagttgcaaggaatggaacacgtcgggcgacgcgggcgcgctgtctgacttgcgcccatatgacgccgatccgtccggcaccttcttcaaccgcgtgcagacgttcgaggcgggcgaatttccgctcgccgacacgatccacttcccgaagtcgtgcctgcattgcgaagacccgccgtgcgtgccggtctgcccgacgggcgcgagctacaagcgcgaggaaaacgggctcgtgctcgtcgattacgacaagtgcatcggctgcaagtactgcacgtgggcgtgcccgtatggcgcgcgcgagctcgacgaagtgcgcaaggagatgacgaagtgcacgctttgcgcggaccgcattcacgacgagacgctgcccgagcgcgatcgcaagcccgcgtgcgtgctcgcgtgcccgacgtcggcgcgcctgttcggcgacatccacgatccgaattcgaccgtgtcgcaggcaatccgcgagcgcggcggctatcagttgatgccggaatggggaacgcggcccgcgaatcattacctgccgcgccgcacgacgaccgcgtgcgggagcgggggcggcggtggtaacgacgggagcggaggcggcggttgcggtagcggcgccgcgtgcgcgtgccggccggcggacgcgaagcccgcgcccgtctcggccggcgacgcgctcgcgcacgggcagccgaatctcgccgcgctcgcgaagcgcatccgatctgaatga

SEQ ID NO: 67830 - protein, 276 aa, Burkholderia mallei 10229
MRRNAVDEEDAMTQMALVIDLNVCVGCHACVTSCKEWNTSGDAGALSDLRPYDADPSGTFFNRVQTFEAGEFPLADTIHFPKSCLHCEDPPCVPVCPTGASYKREENGLVLVDYDKCIGCKYCTWACPYGARELDEVRKEMTKCTLCADRIHDETLPERDRKPACVLACPTSARLFGDIHDPNSTVSQAIRERGGYQLMPEWGTRPANHYLPRRTTTACGSGGGGGNDGSGGGGCGSGAACACRPADAKPAPVSAGDALAHGQPNLAALAKRIRSE

SEQ ID NO: 67831 - DNA, 831 bp, Burkholderia mallei 10399
  CDS (1)..(831)
atgcggcgaaacgccgttgacgaggaggatgcgatgacgcaaatggcgctcgtgatcgatctgaacgtgtgcgtggggtgccacgcgtgcgtaacgagttgcaaggaatggaacacgtcgggcgacgcgggcgcgctgtctgacttgcgcccatatgacgccgatccgtccggcaccttcttcaaccgcgtgcagacgttcgaggcgggcgaatttccgctcgccgacacgatccacttcccgaagtcgtgcctgcattgcgaagacccgccgtgcgtgccggtctgcccgacgggcgcgagctacaagcgcgaggaagacgggctcgtgctcgtcgattacgacaagtgcatcggctgcaagtactgcacgtgggcgtgcccgtatggcgcgcgcgagctcgacgaagtgcgcaaggagatgacgaagtgcacgctttgcgcggaccgcattcacgacgagacgctgcccgagcgcgatcgcaagcccgcgtgcgtgctcgcgtgcccgacgtcggcgcgcctgttcggcgacatccacgatccgaattcgaccgtgtcgcaggcaatccgcgagcgcggcggctatcagttgatgccggaatggggaacgcggcccgcgaatcattacctgccgcgccgcacgacgaccgcgtgcgggagcgggggcggcggtggtaacgacgggagcggaggcggcggttgcggtagcggcgccgcgtgcgcgtgccggccggcggacgcgaagcccgcgcccgtctcggccggcgacgcgctcgcgcacgggcagccgaatctcgccgcgctcgcgaagcgcatccgatctgaatga

SEQ ID NO: 67832 - protein, 276 aa, Burkholderia mallei 10399
MRRNAVDEEDAMTQMALVIDLNVCVGCHACVTSCKEWNTSGDAGALSDLRPYDADPSGTFFNRVQTFEAGEFPLADTIHFPKSCLHCEDPPCVPVCPTGASYKREEDGLVLVDYDKCIGCKYCTWACPYGARELDEVRKEMTKCTLCADRIHDETLPERDRKPACVLACPTSARLFGDIHDPNSTVSQAIRERGGYQLMPEWGTRPANHYLPRRTTTACGSGGGGGNDGSGGGGCGSGAACACRPADAKPAPVSAGDALAHGQPNLAALAKRIRSE

SEQ ID NO: 67833 - DNA, 831 bp, Burkholderia pseudomallei Pasteur
  CDS (1)..(831)
atgcggcgaaacgccgttgacgaggaggatgcgatgacgcaaatggcgctcgtgatcgatctgaacgtgtgcgtggggtgccacgcgtgcgtgacgagctgcaaggaatggaacacgtcgggcgacgcgggcgcgctgtctgacttgcgcccatatgacgccgatccgtccggcaccttcttcaaccgcgtgcagacgttcgaggcgggcgaatttccgctcgccgacacgatccacttcccgaagtcgtgcctgcattgcgaagacccgccgtgcgtgccggtctgcccgacgggcgcgagctacaagcgcgaggaagacgggctcgtgctcgtcgattacgacaagtgcatcggctgcaagtactgcacgtgggcgtgcccatatggcgcgcgcgagctcgacgaagtgcgcaaggagatgacgaagtgcacgctttgcgcggaccgcattcacgacgagacgctgcccgagcgcgatcgcaagcccgcgtgcgtgctcgcgtgcccgacgtcggcgcgcctgttcggcgacatccacgatccgaattcgaccgtgtcacaggcaatccgcgagcgcggcggctatcagttgatgccggaatggggaacgcggcccgcgaatcattacctgccgcgccgcacgacgaccgcgtgcgggagcgggggcggcggtggtaacgacgggagcggaggcggcggttgcggtagcggcgccgcgtgcgcgtgccggccggcggacgcgaagcccgcgcccgtctcggccggcgacacgctcgcgcacgggcagccgaatctcgccgcgctcgcgaagcgcatccgatctgaatga

SEQ ID NO: 67834 - protein, 276 aa, Burkholderia pseudomallei Pasteur
MRRNAVDEEDAMTQMALVIDLNVCVGCHACVTSCKEWNTSGDAGALSDLRPYDADPSGTFFNRVQTFEAGEFPLADTIHFPKSCLHCEDPPCVPVCPTGASYKREEDGLVLVDYDKCIGCKYCTWACPYGARELDEVRKEMTKCTLCADRIHDETLPERDRKPACVLACPTSARLFGDIHDPNSTVSQAIRERGGYQLMPEWGTRPANHYLPRRTTTACGSGGGGGNDGSGGGGCGSGAACACRPADAKPAPVSAGDTLAHGQPNLAALAKRIRSE

SEQ ID NO: 67835 - DNA, 567 bp, Chlorobium limicola DSM 245
  CDS (1)..(567): transl_table=11
gtgagcaacaagaaaaattatggaatggttatcgacaccagggtctgtgtcggctgttcggcctgtgtctatacctgcaagcaggaaaacaatgtccctgaagggtactgccgcgactgggttgtgcaggagtcgggaggagagtatccgaaactgaccatggagaaccgatcggagcgctgccagcactgcgaaaacgcgccctgcgtcacctactgcccgacaagggcctcgcactacgccgaagacggcaccgtgcagatcaaccgttcgctctgcaccggctgcaaggcctgcatggccgcctgcccctatgatgcccggtacgtgcatcccgaagggtatgttgataaatgctcgctctgcaagcaccggatcgaacagggccttgaaaccgcctgtgtttcgatctgccctaccggcagcctgaaccttgtcgatttcaacaacatggatgagaagacaaaagagctgttgaaaggtaaaatcgtttaccgccagaaagaacatgcaggaacggagccgagcctgcagtggatttccgcaagcaataaacccggagcgtaa

SEQ ID NO: 67836 - protein, 188 aa, Chlorobium limicola DSM 245
MSNKKNYGMVIDTRVCVGCSACVYTCKQENNVPEGYCRDWVVQESGGEYPKLTMENRSERCQHCENAPCVTYCPTRASHYAEDGTVQINRSLCTGCKACMAACPYDARYVHPEGYVDKCSLCKHRIEQGLETACVSICPTGSLNLVDFNNMDEKTKELLKGKIVYRQKEHAGTEPSLQWISASNKPGA

SEQ ID NO: 67837 - DNA, 1554 bp, Chlorobium limicola DSM 245
  CDS (1)..(1554): transl_table=11
atgaactacggttttgttatcgatgcccggaagtgtatcggatgccatgcatgcacggttgcctgcaagtccgaaaaccaggttcctctcggagtgaaccgtacctgggtgaaatatgtcgaaaaaggcacttttcccgatacacggcgctactttaccgttctgcgctgcaaccactgcgccgaacctccctgcgtcgatatctgcccggtagaggcgctgcagaagcgtccggacggcattgtggatttcgacagccgccgctgcatcggctgtaaggcctgtgcccaggcatgcccttacaatgcgctttacattgaccccgatacgcatacgtcggcgaagtgcaactattgcgcgcatcgcaaggaggtcggtctccagccggcatgcgtggccatttgtccgcagcaggcaatcgtttcgggcgatctcgacgatccgggcagcaaaatcgccgctctggttgccggagagcggaccgtcgtgcgcaagcccgaaaaaggcactctgccgaaactgttctatatcaacggagacggcccgtcgctcgatcctatggcggcaccgctgctggaggagtatcactggagcgctcagtcaagaggtgtcgggcattttgccgaaaaaggaaaaggcgcaccgggaatcgaaaagcgcacccatgcggcgccttcgaccggtccgaaaacccgacgggtctacgacattccgtcgaaaggcgccgtctggggatgggaggtgccggcctatgtgacggccaaggcagtctcgtccggagtctttcttgtattttttgcgctgcttgtggtttttcagctgcaactttccgattcgcttcagtgggctgcgtgggcggtttcgtttatatttctcgctcttacgggcggatttcttatcaaggatctcgatcgtcccgatcgtttttcatcggtcatgctgcgtccgcaattcggctcatggcttgtccgcggcggtcttaccataaccggctacggagcctttctcgccttgtggggcggggccaggcttctgcggattcccgtgcttgaaaccgccgcgctctggggcggcgccctgtttgcgatcgtgacggcaatttacaccgcgtttcttttcggcgccgcgaaagggcgcgacttctggcagagtccgatgctgcttctgcatatgtttctgaactccctgctcgccggcggctcggccatgctgctgctcgggcttggcaccggaagctcgtcggaacttctcgggctgctccgtcagcttctgacggcaggtttcgggctgcatatggcaatcatgctgatcgagctctatggaaagcatccctctgtaggggctgaacgtgcggctgaaattatccgtgagggcagcctgaaaaaccagttctggagcggaagttttctcggaggaaacctgctgcctcttctcgttacgctgttttctccggatccgctgatgcttgccgctgcgtcccttctcggactgtgcggcgtgttcttcacagaaaaagtctgggttcaggccccgcagagaatacctttaagttaa

SEQ ID NO: 67838 - protein, 517 aa, Chlorobium limicola DSM 245
MNYGFVIDARKCIGCHACTVACKSENQVPLGVNRTWVKYVEKGTFPDTRRYFTVLRCNHCAEPPCVDICPVEALQKRPDGIVDFDSRRCIGCKACAQACPYNALYIDPDTHTSAKCNYCAHRKEVGLQPACVAICPQQAIVSGDLDDPGSKIAALVAGERTVVRKPEKGTLPKLFYINGDGPSLDPMAAPLLEEYHWSAQSRGVGHFAEKGKGAPGIEKRTHAAPSTGPKTRRVYDIPSKGAVWGWEVPAYVTAKAVSSGVFLVFFALLVVFQLQLSDSLQWAAWAVSFIFLALTGGFLIKDLDRPDRFSSVMLRPQFGSWLVRGGLTITGYGAFLALWGGARLLRIPVLETAALWGGALFAIVTAIYTAFLFGAAKGRDFWQSPMLLLHMFLNSLLAGGSAMLLLGLGTGSSSELLGLLRQLLTAGFGLHMAIMLIELYGKHPSVGAERAAEIIREGSLKNQFWSGSFLGGNLLPLLVTLFSPDPLMLAAASLLGLCGVFFTEKVWVQAPQRIPLS

SEQ ID NO: 67839 - DNA, 777 bp, Chlorobium limicola DSM 245
  CDS (1)..(777): transl_table=11
atgaacgaagatcgcagatcatttatcaagaaagccggtatcggcattcttgccggcataggatcggcagccggcctgtttccggcgctttcgctcgaaaaaaccgtgcttccggcatgggacgagaagcccgagcccggcaaacatcgctggggcatgcttatcgatacccgcaagtgctccggcaactgcagtgagtgcgttgccgcctgccacttcacgcacaacgtgcctgatttcggcaatcgcaaggacgaggtgaagtggatatggaaaagctcctatgaaaacgtgtttcctacggcgagccagcagtttcagagtcccggggtgaccgaaaggccctaccttgccctctgcaaccactgcgccgagcctccctgcacaaaagcttgtccgaccgaagccaccttcaggcggtgggacggcatcgtctccatggactaccaccgctgcatcggctgtcgcttctgcatggctgcctgtccctacggttcacgcagcttcaactggcgcgatccgagagagggtatcaagcttgcgagtaccgggtatccgacccgcatgcagggtgtggtggagaaatgcaacttctgttccgaacggctggtgaaaggactcgatccggcctgcgtagaagcatgtccggagcaggcgctggtgttcggcgacctgaacgatcccggttcggagatccgcaagctgcttgaatccaccgaaaccatgcagcgcaaacccgaactcggcacgaaaccttcggtcttttatatcatttaa

SEQ ID NO: 67840 - protein, 258 aa, Chlorobium limicola DSM 245
MNEDRRSFIKKAGIGILAGIGSAAGLFPALSLEKTVLPAWDEKPEPGKHRWGMLIDTRKCSGNCSECVAACHFTHNVPDFGNRKDEVKWIWKSSYENVFPTASQQFQSPGVTERPYLALCNHCAEPPCTKACPTEATFRRWDGIVSMDYHRCIGCRFCMAACPYGSRSFNWRDPREGIKLASTGYPTRMQGVVEKCNFCSERLVKGLDPACVEACPEQALVFGDLNDPGSEIRKLLESTETMQRKPELGTKPSVFYII

SEQ ID NO: 67841 - DNA, 792 bp, Solibacter usitatus Ellin6076
  CDS (1)..(792): transl_table=11
gtgcggccccgccgcgcgcgcaaaggtggtgagcgcatgagtaccgaaacccgcaagaaggccgccggccgctacggcatgacgatcgatatcgaccgctgcaatggatgcggttcctgcatggttgcctgcgcggtggaaaataacgttgcccccgccgaaagcggcgctaccgatcgcaccggcatcacctggattcgcgtttttcagatcgataacggcggtgagggcgcggacaagcgctccgcttttatccccatgctgtgccagcactgcggcgatgctccgtgcgtcagcgtctgcccgcagcaggcgatcgacgtcaaccccgtcaccgggatcgtcgaacagatgccggagcgctgcctcggctgccgctactgcatggtcgcctgcccctatcatgcgcgctatttcaactggtgggatccggcgtggccccccggcatggagaagacgttgaatcccgacgtcgcgccgcgtatgcgcggagtggtcgagaagtgcaacttctgccacggccgctggcacgccgccaaacaagcagcgaccggcgatggccttcccgggtacacaccggcctgcgcggaggcctgccccacgcaagccatccgtttcggcaacctcgacgagcccgctgccgaagttgcgcgcggatcgcaggatcccaacagcttccgtctgctggaatccatcgacaccgatcccaagatctactaccgctctaagaagaagtgggtccgcgaagccgccaaggcgcctcgccccggaaaggagaatctccgtggttaa

SEQ ID NO: 67842 - protein, 263 aa, Solibacter usitatus Ellin6076
MRPRRARKGGERMSTETRKKAAGRYGMTIDIDRCNGCGSCMVACAVENNVAPAESGATDRTGITWIRVFQIDNGGEGADKRSAFIPMLCQHCGDAPCVSVCPQQAIDVNPVTGIVEQMPERCLGCRYCMVACPYHARYFNWWDPAWPPGMEKTLNPDVAPRMRGVVEKCNFCHGRWHAAKQAATGDGLPGYTPACAEACPTQAIRFGNLDEPAAEVARGSQDPNSFRLLESIDTDPKIYYRSKKKWVREAAKAPRPGKENLRG

SEQ ID NO: 67843 - DNA, 567 bp, Chlorobium phaeobacteroides DSM 266
  CDS (1)..(567): transl_table=11
gtgagcaacaaaaaaagctatggaatggtcatcgacaccagggtctgcgtcgcctgctcagcctgtgtctatgcatgtaaatcagaaaacggcatacccgaagggtactgccgcgactgggtagtccaggaaaccgaagggacgctgcccaaactcaccatggaaaaccgctcggagcgctgccagcactgcgacaacgccccctgcgtcacctactgtccaaccagagcgtcgcactatgccgaagacgggacggtgcagatcaaccggtcgcgctgcacaggatgcaaagcctgccttgccgcatgcccctacgatgcacgatacgtccatcccgaaggctttgtcgacaaatgctcgctctgtcagcaccgacttgaaaaagggctcaaaaccgcatgtgtctcgatctgtcccacaggcagtctgaatctggtcgatttcaacgatcccgaacaggaagcccaacaactcatgaacggcaaactcgtctaccggcaaaaagagcacgccggcacggaaccaagcctctactggatttctgcaagcaataaacccggagcgtaa

SEQ ID NO: 67844 - protein, 188 aa, Chlorobium phaeobacteroides DSM 266
MSNKKSYGMVIDTRVCVACSACVYACKSENGIPEGYCRDWVVQETEGTLPKLTMENRSERCQHCDNAPCVTYCPTRASHYAEDGTVQINRSRCTGCKACLAACPYDARYVHPEGFVDKCSLCQHRLEKGLKTACVSICPTGSLNLVDFNDPEQEAQQLMNGKLVYRQKEHAGTEPSLYWISASNKPGA

SEQ ID NO: 67845 - DNA, 600 bp, Chlorobium phaeobacteroides BS1
  CDS (1)..(600): transl_table=11
atggcacgttatggaatggtaatggacatgcgactttgcgtcggttgtcaggcatgcatggcagcatgttcaatggaaaatcagaccccctactggaacggcaaattccgcacccacgtagaagatattgagcacgggagctatcctgacgtacgcagggagtttctgccaagactctgcatgcattgtgaaaataccccgtgtctttcagcctgcccttcaggcgccacgtacaagaccgaagacggcattatacggataaactatgaccgttgcatgggatgttacgcctgttcgatcgcgtgcccatacgacgcccgatatccttatgaccggaacgatgtctcaactgctgaaacactctatggggacgatctctcgcaccgtgcgccacatgtcgacaagtgcagtttttgcgaacacagggttcaggaaggactgaaacccggatgcgccggcacctgcccgaccaatgcacgaatattcggcgatcttgatgatccgcaaagcgaggttcataaactgtcaaaaaccggaaaggccaaaccgctccggcctgaactcggaaccgcacccaaagttttttacataccgtcctga

SEQ ID NO: 67846 - protein, 199 aa, Chlorobium phaeobacteroides BS1
MARYGMVMDMRLCVGCQACMAACSMENQTPYWNGKFRTHVEDIEHGSYPDVRREFLPRLCMHCENTPCLSACPSGATYKTEDGIIRINYDRCMGCYACSIACPYDARYPYDRNDVSTAETLYGDDLSHRAPHVDKCSFCEHRVQEGLKPGCAGTCPTNARIFGDLDDPQSEVHKLSKTGKAKPLRPELGTAPKVFYIPS

SEQ ID NO: 67847 - DNA, 816 bp, Geobacter metallireducens GS-15
  CDS (1)..(816): transl_table=11
atggggaactggttacggcaggacatccccagggaagcctccggagcgagttggtcgagatatagggaagccgcgcaagcggtcatcgggattgagtcgattatggaaacaatgacgagtcagtacagatgggggatggttgtcgaccttgatcggtgcaccggctgcggcgcttgcgttgttgcctgtcaggcggagaacaacgtggccatctgcggcaagaaggagatatccgaaggacgcaacatgcactggttacgcatcgagcggttctgggtgggacagtatccggacgtgcgggcgcgctttctcccggtactctgtcagcactgtcatgacgccccctgtgagccggtctgcccggtttatgccagctaccacaaccccgacggtcttaatgggcaggtgtacaaccgctgcgtcggcaccaggtactgcggtaataactgcccctatgccgtaagagtcttcaacttctacaaccacgaatggcccaaccccctcgataatcaactttctccggacatgaccgtgcgtacccggggagtgatggaaaaatgcactttctgcatccagcgcatccgaagggccaaggaagatgccaagtccgaaaatcgcaccattcgtgacggagagatacaaccggcctgcgcccagacctgtccaaccgacgctctggtgttcgggaacatggccgaccctcggagccgggtcgccatcctttcccgcagccccaggcgcttccggctgctggagcatctgggcacccacccctcgatttgctatctcaagggaggaggacgcgagcatgtctga

SEQ ID NO: 67848 - protein, 271 aa, Geobacter metallireducens GS-15
MGNWLRQDIPREASGASWSRYREAAQAVIGIESIMETMTSQYRWGMVVDLDRCTGCGACVVACQAENNVAICGKKEISEGRNMHWLRIERFWVGQYPDVRARFLPVLCQHCHDAPCEPVCPVYASYHNPDGLNGQVYNRCVGTRYCGNNCPYAVRVFNFYNHEWPNPLDNQLSPDMTVRTRGVMEKCTFCIQRIRRAKEDAKSENRTIRDGEIQPACAQTCPTDALVFGNMADPRSRVAILSRSPRRFRLLEHLGTHPSICYLKGGGREHV

SEQ ID NO: 67849 - DNA, 543 bp, Desulfuromonas acetoxidans DSM 684
  CDS (1)..(543): transl_table=11
atggctcgctatgcaatggtgatggacaccaggaaatgcatcggctgtcattcctgtacagtcgcttgcaaagttcgtaatgaactcccgacagatatgatctacaacccggtgaccacagatggtccacacggcaaatttcccaacctgagcatgcgctttttgcctttgctctgcatgcactgcgacaattctccctgtgttgatgcctgcccgaccggcgcttcaattcaggccgaaaacggcattgtccacgttgaggataagaaatgtgtcggctgcctgtcctgtatcatggcctgcccttatggcgcacgctaccacaatcatgagaccggggccgtcaacaagtgtaatttctgccttgatcgggttgaagaaggtctattcccacactgcgtcgaaacatgtcaccaaaatgcccgtattttcggcgacttggatgacgagaacagtgaggtcagcaagctgatcaacgagaatccttcggttcagttgctgcccgaactgaacaccgacccctgtgtcttttacatctactga

SEQ ID NO: 67850 - protein, 180 aa, Desulfuromonas acetoxidans DSM 684
MARYAMVMDTRKCIGCHSCTVACKVRNELPTDMIYNPVTTDGPHGKFPNLSMRFLPLLCMHCDNSPCVDACPTGASIQAENGIVHVEDKKCVGCLSCIMACPYGARYHNHETGAVNKCNFCLDRVEEGLFPHCVETCHQNARIFGDLDDENSEVSKLINENPSVQLLPELNTDPCVFYIY

SEQ ID NO: 67851 - DNA, 621 bp, Desulfitobacterium hafniense DCB-2
  CDS (1)..(621): transl_table=11
atgtccaagaaattaggaatggtgattgatttaaagcgttgtacaggatgcaccacgtgcgccaatgcgtgcaagatgcagaataatgtccccatgggcatgttatggaaccgtgtgctcacggaaggcggggaagagtatgatacggccgcaggggtctacccccatgtgcaaaggcgtttcctgccggttgcctgccagcattgcgaaaatgccgcctgtgttaaggtctgcccggtaggtgctacctataaagatgagtcgggcagggtagtgattaattacgacagatgcattggctgccgcttctgcatggccgcctgcccctataatgcccgggtatttaactgggaggaaccggtgcgtgatcctggctttaactatggggataaagatgtgccccttcgcaaagtgggtgtcgtggaaaaatgctcaatgtgcaaggagcgcaccgacactgacttagaaccgatgtgtgtaaagtgttgcccggccaaagcccggaaattcggtgatttgaatgatccggatagtgaagtttcccgcttgattcgggagaggcatggcgagcagcttttagcggaaaaagggacgaagccgcaagtatattatttggattag

SEQ ID NO: 67852 - protein, 206 aa, Desulfitobacterium hafniense DCB-2
MSKKLGMVIDLKRCTGCTTCANACKMQNNVPMGMLWNRVLTEGGEEYDTAAGVYPHVQRRFLPVACQHCENAACVKVCPVGATYKDESGRVVINYDRCIGCRFCMAACPYNARVFNWEEPVRDPGFNYGDKDVPLRKVGVVEKCSMCKERTDTDLEPMCVKCCPAKARKFGDLNDPDSEVSRLIRERHGEQLLAEKGTKPQVYYLD

SEQ ID NO: 67853 - DNA, 606 bp, Desulfitobacterium hafniense DCB-2
  CDS (1)..(606): transl_table=11
gtgactgaacaatcgattcgttacggcatggtcatcgacttgcgaaaatgtgtgggctgcaacgcctgcactgtttcctgcaaaatcgagaacaatgtgccggatggaaaataccgtacttgggtcaaggaaatggaaaagggaacctatccgcaagtgtcccgtcatcgcttgccccgcttatgcaaccattgtgataatgccccctgtgagtcggcctgccctgtccgggccacttaccggacggaagacggcactattctgatcgattatgaccgctgtattggctgtaaatactgtatggcggcctgtccttatgatgcccgctttgttaacccggtgcgcagaacggcggagaaatgcaccttctgctatcacagagtacaaatgggactgctgccggcctgtgttaccacctgtgtaggaggagcccgaatttttggggatctgcatgatcccaacagtctcgtttcccgactgatagccaacaaccctgtgcagattctcaagccggagatgaatacccaaccgatgatctactacattggtgccgaccaggctgtgctgggagcggactatacagatttagagaagggggggaaataa

SEQ ID NO: 67854 - protein, 201 aa, Desulfitobacterium hafniense DCB-2
MTEQSIRYGMVIDLRKCVGCNACTVSCKIENNVPDGKYRTWVKEMEKGTYPQVSRHRLPRLCNHCDNAPCESACPVRATYRTEDGTILIDYDRCIGCKYCMAACPYDARFVNPVRRTAEKCTFCYHRVQMGLLPACVTTCVGGARIFGDLHDPNSLVSRLIANNPVQILKPEMNTQPMIYYIGADQAVLGADYTDLEKGGK

SEQ ID NO: 67855 - DNA, 594 bp, Desulfitobacterium hafniense DCB-2
  CDS (1)..(594): transl_table=11
atgggaaaacggtatgccatggtgattgacctgcgcaaatgtgtaggctgtcacgcttgccaagtggcttgtaaaagtgaaaacaatgtgcctcttggtgttttccgcaactgggttgatgagcttgagaccggaaagttccccaatgtttcccgccagcggttgccgcgtctttgcaaccactgtgagaatccatcatgtgtcaaagtatgtccggttaaagccacaactcaaaaagaagacggtacggtggtcattgactatgatctctgtatagggtgcaaatactgtattgccgcctgtccttacgatgctcggtttattaaccccgaaagaagaactgcggaaaagtgtgactactgttatgccagggtcgaagcgggattacaaccagcctgtgtgaatacttgtatcggtggggctcgcatcttcggagatttaaatgatcccacaagcgaagttgctaaatttgtggcaaccaatccagtcaaagtatctaagccggaaacgaacaacggaccgcagacctactacattggcgcagatgaaaaaacccttcgccctaattttgaaatagtgggggggaataaataa

SEQ ID NO: 67856 - protein, 197 aa, Desulfitobacterium hafniense DCB-2
MGKRYAMVIDLRKCVGCHACQVACKSENNVPLGVFRNWVDELETGKFPNVSRQRLPRLCNHCENPSCVKVCPVKATTQKEDGTVVIDYDLCIGCKYCIAACPYDARFINPERRTAEKCDYCYARVEAGLQPACVNTCIGGARIFGDLNDPTSEVAKFVATNPVKVSKPETNNGPQTYYIGADEKTLRPNFEIVGGNK

SEQ ID NO: 67857 - DNA, 582 bp, Desulfitobacterium hafniense DCB-2
  CDS (1)..(582): transl_table=11
atgccccaagataacaaacaaaaaaaatatggcatggtgattgatctaaggaaatgcgtaggatgcatgtcatgctcagtatcctgcaaaatggaaaatggagttgcctttggtgttttcagatcatgggtgaacatgactgaaaaaggtgatttcccaacggtcaagagatattatcaaccaagactttgcaatcattgcgagaatgctccctgtgtagaggtctgtcccgttaaagcttcttataagcgtgaagatggtatggtattgcttgataagaagaagtgtattggctgtggctactgtgtagcttcatgcccttataatgctcgttatatgagcaaaacccaaaaagttgcagataaatgtaccttctgtgatcatcgtgtagataacggcggtgaaccagcctgtgtaaaaaactgtatgggcaaagctcggatttttggagatctaaatgatcccagcagcgaagtctctcagcttatttctcgaaatgctgttcaagtgattaagccggaaaaaggaacaaaacctcaagtattctatatatcggctgactttaatcaacagcccaagtaa

SEQ ID NO: 67858 - protein, 193 aa, Desulfitobacterium hafniense DCB-2
MPQDNKQKKYGMVIDLRKCVGCMSCSVSCKMENGVAFGVFRSWVNMTEKGDFPTVKRYYQPRLCNHCENAPCVEVCPVKASYKREDGMVLLDKKKCIGCGYCVASCPYNARYMSKTQKVADKCTFCDHRVDNGGEPACVKNCMGKARIFGDLNDPSSEVSQLISRNAVQVIKPEKGTKPQVFYISADFNQQPK

SEQ ID NO: 67859 - DNA, 795 bp, Desulfitobacterium hafniense DCB-2
  CDS (1)..(795): transl_table=11
atgagcatcaatcgaagagagtttttgaaaaaagctggagtcattgctgccttagggctggggggagcagttaccctcgatgcctttgaacttttggaaccccttaaagcagcggactttaccagcgaaaacaaattagcagctcagcgctgggccatggtcatcgatatgagcaagctcagccaggcggatatcgatgaaattattaaaggctgtcacgagcttcataacgtccctgatatggggaatgaaaaagatgaaatcaagtggatctggacagatacctatgaacatgttttccctggggatgaaaaccattacctggatgagaaaaccaagaccatgcctttcctgaccctatgcaatcactgtgaccatccgccttgtgtccgggtctgtcctacccaggctaccttcagaagagaagatggggttgtaggaatggatatgcaccgctgtatcggctgccggttctgcatggccgcctgtccctatggagcacgcagtttcaactactgggatcccaaacctcatcttgccaagatcaatccggaatatcctcaccgctccaaaggggtcgtagaaaaatgtaccttctgtatggatcgtctggatcaagggctggcgcctgtctgtgtggagaagtccaaaggagcgattgtctatggcgacctggaggatcccaattccgcagtgagaaaagtattaagcacccattactccattcggcgtaagcctgaattgggctcacagcccagtgtctattatctgatcgggggtgaggagcgtgcttga

SEQ ID NO: 67860 - protein, 264 aa, Desulfitobacterium hafniense DCB-2
MSINRREFLKKAGVIAALGLGGAVTLDAFELLEPLKAADFTSENKLAAQRWAMVIDMSKLSQADIDEIIKGCHELHNVPDMGNEKDEIKWIWTDTYEHVFPGDENHYLDEKTKTMPFLTLCNHCDHPPCVRVCPTQATFRREDGVVGMDMHRCIGCRFCMAACPYGARSFNYWDPKPHLAKINPEYPHRSKGVVEKCTFCMDRLDQGLAPVCVEKSKGAIVYGDLEDPNSAVRKVLSTHYSIRRKPELGSQPSVYYLIGGEERA

SEQ ID NO: 67861 - DNA, 687 bp, Shewanella baltica OS155
  CDS (1)..(687): transl_table=11
atggaaaattcaaaaagaagatttctaaaaggcacatgtgccttatttgctggcgctacgggcgcatcactgctcgccacagtgaatgccgctgaaggtgctaaagcagagtcagatattaaatatgcgatgattcatgatgaaactaagtgtattggttgccgcgcatgtgaagtggcatgtcgtgaaaccaatcaagtgccagaaggggtttctcgggtcaggattgaacaaactggaccgttcggtgagtatccgaatgagtattatcacttcagccgtatctcttgtcagcattgtgaagacgcaccttgtgtcaacgtctgcccaacgggcgcagcctttattgataaagaaaccggcatagtgtcagtcaatgcgtggaaatgtgtcggctgccaatattgtattgcggcttgcccttataaaattcgctttattaacccagtcacccacgcggcggataagtgtgatttctgccgtgagacgaatctcgctcaaggaaaacagcctgcctgcgttgaggcttgtccaactaaggcgttagtgttcggtaatttaaaagatccgacgtctgagttagtacaagtgctgcgcgctaatccaactcaacgcgcgaaagtcgccctcggaacgcgacctaagttgttccgtatcctggcgaaatctggggaggtgatactatga

SEQ ID NO: 67862 - protein, 228 aa, Shewanella baltica OS155
MENSKRRFLKGTCALFAGATGASLLATVNAAEGAKAESDIKYAMIHDETKCIGCRACEVACRETNQVPEGVSRVRIEQTGPFGEYPNEYYHFSRISCQHCEDAPCVNVCPTGAAFIDKETGIVSVNAWKCVGCQYCIAACPYKIRFINPVTHAADKCDFCRETNLAQGKQPACVEACPTKALVFGNLKDPTSELVQVLRANPTQRAKVALGTRPKLFRILAKSGEVIL

SEQ ID NO: 67863 - DNA, 693 bp, Shewanella amazonensis SB2B
  CDS (1)..(693): transl_table=11
atgctagtttccaaacgccagtttctcaagggggttggggcgctgctgaccggtgtctctgtgtatggagccacccgcacgctccaggccgattccctgctgcaacccgaggcggaaagcgaaaccaaatatgccatggtgcacgatgaaaatgcctgcatcggctgtaatgcctgtgtccaggcgtgccgtgagaccaatcagatccccgagggtgtcacccgggtgaagatagagcgcaggggcccctttggtgagtatcctaaccagagctaccgcttcagccgtgtctcctgtcagcattgcgaagccgcgccctgtgtgcgggtctgccccacaggcgctgcctatatcgacaaagagaccggcattgtggcggtcaacagcgaccgctgcgtgggttgccagtattgcattgccgcctgcccctatcaggtcaggtatatccaccccgagacccgcaccgccgacaaatgcgatttctgtcagaagagtcgcctggctcaggggctgcaacctgcctgtgtcgaagcctgccccaccaaggcactgaccttcggcaatctcaaggatcccgagtcggaattggtcaagttgcttaaagccaagcccagctaccgcgccaaggtggacctggggacccggcccaagctgttccatattcaaaccatagatggggagataatgctatga

SEQ ID NO: 67864 - protein, 230 aa, Shewanella amazonensis SB2B
MLVSKRQFLKGVGALLTGVSVYGATRTLQADSLLQPEAESETKYAMVHDENACIGCNACVQACRETNQIPEGVTRVKIERRGPFGEYPNQSYRFSRVSCQHCEAAPCVRVCPTGAAYIDKETGIVAVNSDRCVGCQYCIAACPYQVRYIHPETRTADKCDFCQKSRLAQGLQPACVEACPTKALTFGNLKDPESELVKLLKAKPSYRAKVDLGTRPKLFHIQTIDGEIML

SEQ ID NO: 67865 - DNA, 543 bp, Prosthecochloris aestuarii DSM 271
  CDS (1)..(543): transl_table=11
atggttatcgatacacgggtctgcgtaggatgctccgcgtgtgtctatatctgcaagtccgaaaacagcgtccctgaaggctactgccgcgactgggtcgttcaggacaccgaaggaacatatccgaaactgcgcatggaaaaccgctcggaacgctgtcagcattgcgaaaacgccccatgcgttacctactgccctacaggggcttcacactatgccgaagacggcaccgtacaggtcaaccgcagccgttgtaccggctgtaaggcttgtctggctgcatgcccgtatgatgcgcgctacgtccatcctgaaggctttgttgataaatgctcgctctgcaagcatcgtcttgaccagggccttgaaacggcatgcgtatcggtctgcccgacaaaaagcctcaatctggtcgattacaacgacccggaacagaaggctcagcacatgatgaatggtaaagtggtttaccggcagaaggaacatgccggaaccaatccgagcctctactggatttcagcaagtaataaacccggagcctaa

SEQ ID NO: 67866 - protein, 180 aa, Prosthecochloris aestuarii DSM 271
MVIDTRVCVGCSACVYICKSENSVPEGYCRDWVVQDTEGTYPKLRMENRSERCQHCENAPCVTYCPTGASHYAEDGTVQVNRSRCTGCKACLAACPYDARYVHPEGFVDKCSLCKHRLDQGLETACVSVCPTKSLNLVDYNDPEQKAQHMMNGKVVYRQKEHAGTNPSLYWISASNKPGA

SEQ ID NO: 67867 - DNA, 1596 bp, Rubrobacter xylanophilus DSM 9941
  CDS (1)..(1596): transl_table=11
atggcgaactacggcttcatcatagacaaccggaagtgcatcggttgccacgcgtgcacggtggcctgcaaggccgagcacgaggtgccgctgggcgtgaaccgcacctgggtgaagtacatcgagaagggagagttccccgacacccagagggcgtttcacgtgatgcggtgcaaccactgtgaggatgccccgtgcgtggaggcctgtccggttacggcgctctacgtgcgcgaggatgggatcgtggatttcaactgggaccgctgcatcggctgtaaggcctgcacgcaggcctgcccctacgatgccctgtacatagaccccgagagccacactgcggcgaagtgcaactactgcgcgcaccgggtggacatggggcttgagccggcgtgcgtcaacgtgtgtcctgagcaagccatcatcagcggggacatggacgatccggcgagcgagatcagccggctgctcgcccgcgagaaggtgaccgttcgccgccctgagaaagggacgaagccgaagctcttctatataaacggcgatgaggcggcgctcacgccggaggacgcgcccgtgcggtcggactacatgtggtccaaccagcgccgcggggtggggcaccacgctccgagcgggcgcgatgggaacgcctcggtggctcagggcgtcatccccctgggcacgaagcccggcagggagcagcccgcgccgcagccggagcgggcccggcgcacctacgacgagcccaacaagggcgtaatgtggggcaaggaggtgcctgggtacgtcttcaccaaggccttggcctccggcgcggtcgcgataccgtttctggcggccgggctcgggctcgaggtggcggcgtctgcgctgcgggccggggccgtcctggggctcgtgttcatggcgctgacgggcatcctgctcataatggatctggaccgcccggaccgcttccactacgtgctcctgcgcccgcagtggaggagctggctggtgaggggggcgtacataatcaccgggttcggcgggctcataacgctgtggctggcgctggagcttctcggggccggcggcatcgcgacggcggttctgagctggccgctcgtggtgctggcggccgccacggcggtgtacacggcgttcctgttcgcgcaggccaggggccgcagcttctggcagagcccggcgctgccggtgcacatgggcgctcatacggcggtggccggcgcggcggtgctctacctcgcctcgtttttcgtttcggggctgcagccgctgcgggcggcgctggagccgacgctggtgctggggctcctgggtggactcttcgtactctgggccgagctgggctcgaggcacccggaccgcgacgcagagcgggcggcgaagatgatctacgggggccgatacaggcggctcttctggggcggctctgtggcgctgggttcccttttgccgctggccctcaccgtagcgggcatcctgctggccgctcctgtggcggtagccgttgccggggctctggcgctccttgggatcctgattaccgaacacgtgtgggttgaggcgccgcagctcattccgctggcctag

SEQ ID NO: 67868 - protein, 531 aa, Rubrobacter xylanophilus DSM 9941
MANYGFIIDNRKCIGCHACTVACKAEHEVPLGVNRTWVKYIEKGEFPDTQRAFHVMRCNHCEDAPCVEACPVTALYVREDGIVDFNWDRCIGCKACTQACPYDALYIDPESHTAAKCNYCAHRVDMGLEPACVNVCPEQAIISGDMDDPASEISRLLAREKVTVRRPEKGTKPKLFYINGDEAALTPEDAPVRSDYMWSNQRRGVGHHAPSGRDGNASVAQGVIPLGTKPGREQPAPQPERARRTYDEPNKGVMWGKEVPGYVFTKALASGAVAIPFLAAGLGLEVAASALRAGAVLGLVFMALTGILLIMDLDRPDRFHYVLLRPQWRSWLVRGAYIITGFGGLITLWLALELLGAGGIATAVLSWPLVVLAAATAVYTAFLFAQARGRSFWQSPALPVHMGAHTAVAGAAVLYLASFFVSGLQPLRAALEPTLVLGLLGGLFVLWAELGSRHPDRDAERAAKMIYGGRYRRLFWGGSVALGSLLPLALTVAGILLAAPVAVAVAGALALLGILITEHVWVEAPQLIPLA

SEQ ID NO: 67869 - DNA, 1023 bp, Magnetococcus sp. MC-1
  CDS (1)..(1023): transl_table=11
atgcaacgcagagcgtttttaaaggccgcagtgggtagtgtcgccgccgtaacatgcggtggcgtggcggcatcggcgcaagcccgtgaaaatttgcaacccgcccccgaagcggtgggcatgctctacgatgccaccctctgtgtggggtgtaaggcgtgcgtgagcaagtgtaaagaggtcaatggtctgccgccggtgcaggatgggaccaaccaaacctgggattctgctcgtgatctgtcgggacaaacccacaatgttatcaaggtgtttaaatcgggaagtggtcaaaacaaggaccaactcaaggatggttacgcctttgaaaagcgtagctgtatgcactgcgtggatcctggctgcgtctccgcctgtccggtaacggccatgcgccgcaacagcttaaccgggattgtcacccaccatgctgatgcttgcattgggtgccgcacctgcatgaccggttgcccctataatgtgcctcaatttgaatatgataaaccctttggtcagattcaaaaatgccaaatgtgcaatcaggctggggtatcgcgcatcgacaacgggcagatgaccggctgtgcggaggtgtgccccactggggccacgctgtttggcaagcgtagcgatctgctggccgaagccaaacggcgcatggccttgcagcccggtacaacctatgcctatccccggggtgatctggccaaccccagccaaccccacgaaaaggcggtgcctcactatcaaccccacgtgtggggtgaaaaagaggcgggcgggaccaatgtcctgcacatctcggccattccctttgacaaattgggcatgccgccgctgggtgagcgctcttacgccgccatctccgaaggggtgcagcatgggctctatcgctacatggcactgcctgcggtggccttggctgggttaaccgccattgtgcggcgcaataccctggcccagggggatgaatcgggcatggacaccgatattgagcatgcagataagggggggcaatcatga

SEQ ID NO: 67870 - protein, 340 aa, Magnetococcus sp. MC-1
MQRRAFLKAAVGSVAAVTCGGVAASAQARENLQPAPEAVGMLYDATLCVGCKACVSKCKEVNGLPPVQDGTNQTWDSARDLSGQTHNVIKVFKSGSGQNKDQLKDGYAFEKRSCMHCVDPGCVSACPVTAMRRNSLTGIVTHHADACIGCRTCMTGCPYNVPQFEYDKPFGQIQKCQMCNQAGVSRIDNGQMTGCAEVCPTGATLFGKRSDLLAEAKRRMALQPGTTYAYPRGDLANPSQPHEKAVPHYQPHVWGEKEAGGTNVLHISAIPFDKLGMPPLGERSYAAISEGVQHGLYRYMALPAVALAGLTAIVRRNTLAQGDESGMDTDIEHADKGGQS

SEQ ID NO: 67871 - DNA, 687 bp, Shewanella frigidimarina NCIMB 400
  CDS (1)..(687): transl_table=11
atggaaaactcaagaagacatttccttaaaagcacctgtgcattggttgccggcgtgtcggtatatccactcagtcgcgatcaagccaatgccgatacgggcataagaataaacaatttaaaatacgccatgctacatgacgaaaccaaatgtattggttgtaacgcttgtgttgaagcgtgtcgagaagtgaatcatgttcccgaaggtgtcaccaggctgagcattgaacagtcgggcccttatggcaagtatccaaatcagtattaccactttagccgccactcctgccaacattgtgaagatgcgccttgcgttaatgtatgcccgactggagccgcctttatcgataaagaaagcggcattgtctcggttaatgcagataaatgtgttggttgccaatactgtattttagcctgcccttacgatgtacgttttattaatcctgtgactaaggcagccgacaaatgtgacttttgcagggaaactaatctcaaacaagataaacaacctgcctgtgtagaagcttgtccaaccaaagcattggtgtttggtaatcttaaagatcctgagtctgaactggttatgctgttaaaagctaatccaacacaacggaccaagttagatttaggtacccggcccaaactgtttcgtattacagccaaacaaggggagattatattatga

SEQ ID NO: 67872 - protein, 228 aa, Shewanella frigidimarina NCIMB 400
MENSRRHFLKSTCALVAGVSVYPLSRDQANADTGIRINNLKYAMLHDETKCIGCNACVEACREVNHVPEGVTRLSIEQSGPYGKYPNQYYHFSRHSCQHCEDAPCVNVCPTGAAFIDKESGIVSVNADKCVGCQYCILACPYDVRFINPVTKAADKCDFCRETNLKQDKQPACVEACPTKALVFGNLKDPESELVMLLKANPTQRTKLDLGTRPKLFRITAKQGEIIL

SEQ ID NO: 67873 - DNA, 600 bp, Prosthecochloris vibrioformis DSM 265
  CDS (1)..(600): transl_table=11
atggcgcgatatggaatggtaatggacatgcgaacctgcgttggatgccaggcctgtatggctgcgtgcacggcggaaaaccagaccccgttctggaacgaaaagttccgcacgcatgtcgaagacaaggctgaaggcatcttccctgatgtacgaagagttctgctgccgaggctctgcatgcactgtgaaaacacaccatgcctcacagcctgcccgaccggggccacatacatgactgaggatggcattgtcaaggtcaactacgaccgatgcatcggctgctacgcctgctgcattgcatgcccctacgatgcacggtacgcctacgacggtgaggatgtgaaaaaggaagaagaggtatacggcaaattcaccagccacgatcagccgcatgttgacaaatgcacattctgcgaccacagggtttcagaggggcgcgaacccgcatgcgtcagcacctgcccgacccatacaaggattttcggcgacctcgacgatcccgaaagcgaagtacacaaactggcaacgagcggcaaagcccaggcattgaacccgcagctcggaacatccccgaaagtattttacatcccatcatag

SEQ ID NO: 67874 - protein, 199 aa, Prosthecochloris vibrioformis DSM 265
MARYGMVMDMRTCVGCQACMAACTAENQTPFWNEKFRTHVEDKAEGIFPDVRRVLLPRLCMHCENTPCLTACPTGATYMTEDGIVKVNYDRCIGCYACCIACPYDARYAYDGEDVKKEEEVYGKFTSHDQPHVDKCTFCDHRVSEGREPACVSTCPTHTRIFGDLDDPESEVHKLATSGKAQALNPQLGTSPKVFYIPS

SEQ ID NO: 67875 - DNA, 1632 bp, Prosthecochloris vibrioformis DSM 265
  CDS (1)..(1632): transl_table=11
atgtatgttctccggtcccgacggcgggaaggcgccttatcaatcattagaacatcgcagttcatgaattacggatttgttattgacggacgcaaatgtatcggatgccacgcatgctcagttgcctgcaagtccgaaaaccaggtgccgcttggcgtcaaccgcacctgggtaaaatatgttgaaaaggggtcattccctgatacccggcggtattttaccgtcctgcggtgcaatcactgcgaggagcctccctgtgtggatatctgtccggttgaggcattgcacaagcgcgatgatggtattgtggatttcgattcccgccgctgcatcggctgcaaggcctgtgctcaggcctgcccctataacgcagtctacattgatcccgaaagcggcacaactgccaagtgcagctactgctcgcaccgggttgagattggcatgaagccggcatgtgccgtcatctgccctcagcaggcgattgtgtcgggcgatctggatgatccgcatagtgaaatttccgtgctgcttgccaaagagcgtaccgtggtccgcaagcctgagaaagggaccagtcccaatgttttctacatcaacggtgacggcgcttcgctcgaccccctgcaggcgtctgaatctgaaagctatatgtggagcgcccagtcgcgcggggtaggccattttgcaaagcacgcagttgagggtggtcactttcattcccccgagcccgcagtagagcatcatggaggaaaggcgcctgcagccacagctcgccgtgtgtatgacgctccatcgaagggatcggtctggggttgggaggttccggcctatgtctggtcgaaggcggtctctgcgggtgccttccttatgctttttgtcttctcgcttctgccgggcatgatgctgccggaaccgatgcagtgggctctctgggcggtttcgctgctcttcctctcgctgactggcggctttctggtcaaggatcttgaccgccccgaccggtttgtctcagtcatgctccgtccgcagttcagctcctggctggttcgcggcgggttgaccattacggcttatggcgcgtttctggcgctctgggcagcgggaatgtatctgcagctttctttgcttgttatggcagggctttggggcggggcggcgcttgcgcttcttaccgcggtctacactgcattcctgttcggttcggccaaagggcgcgacttctggcagagcccgatgctctcactgcacatgcttctcaattcggtgattgcgggtggttcagcaatggctttgctctcagccttcataggtcttgatgcagcatctctctccctcttgcgcattgtgctcacagtagcattcagccttcatcttcttgtcatgtggactgaactctacggccgccacccctcactcaatgctgagaggtcggctgaagccataacgcagggggcactgaaaggtcagttctggctcggcagcgtggttctcggtaacctgcttccccttctggtgctcattgtttcaccaggtcctctcctgataggcgcagccgcaatcggcgctcttgcaggagtgttctatacagaaaaagtatgggttcaggccccacagtcaatctcattaagttaa

SEQ ID NO: 67876 - protein, 543 aa, Prosthecochloris vibrioformis DSM 265
MYVLRSRRREGALSIIRTSQFMNYGFVIDGRKCIGCHACSVACKSENQVPLGVNRTWVKYVEKGSFPDTRRYFTVLRCNHCEEPPCVDICPVEALHKRDDGIVDFDSRRCIGCKACAQACPYNAVYIDPESGTTAKCSYCSHRVEIGMKPACAVICPQQAIVSGDLDDPHSEISVLLAKERTVVRKPEKGTSPNVFYINGDGASLDPLQASESESYMWSAQSRGVGHFAKHAVEGGHFHSPEPAVEHHGGKAPAATARRVYDAPSKGSVWGWEVPAYVWSKAVSAGAFLMLFVFSLLPGMMLPEPMQWALWAVSLLFLSLTGGFLVKDLDRPDRFVSVMLRPQFSSWLVRGGLTITAYGAFLALWAAGMYLQLSLLVMAGLWGGAALALLTAVYTAFLFGSAKGRDFWQSPMLSLHMLLNSVIAGGSAMALLSAFIGLDAASLSLLRIVLTVAFSLHLLVMWTELYGRHPSLNAERSAEAITQGALKGQFWLGSVVLGNLLPLLVLIVSPGPLLIGAAAIGALAGVFYTEKVWVQAPQSISLS

SEQ ID NO: 67877 - DNA, 759 bp, Syntrophobacter fumaroxidans MPOB
  CDS (1)..(759): transl_table=11
gtgagcgatacaggacattcggaaggcaagcttcgttacggcatggtgatcgacctcgacaagtgcaccggctgcatggcatgcagcgtggcctgtcaggcggaaaacaatatttcgtttcgcgccgacgagtcgaataagctccgttcgatcacatggatggagatttaccatctgaacaacggcaaggggtatcccgactaccagttcgcttacctgcccaggccttgcatgcactgtgatgcgccgcaccattccccgtgcaccttcgtgtgcccggtgaatgccaccacgcgggatgagcgcaacggcctcgtgacgcacatctatccgcgctgcatcggctgccggtactgtatggtggcgtgcccctaccatgcccgcgacttcaactggtgggatccggcatggccgaaacccatggaatcgatgctcagcccggaggtcagcccccggatgcgcggcgtggtcgagaagtgtaccttctgcagccaccgcatgatgaaggcaaggtccaaggcatacctcgacaaggcggacctcgaagccgtcgaatatacgccggcgtgcgccgaagcctgcccgacgaaggccatcaccttcggaaacatcagggatgccaacagcgaagtgggaaagctcatcaaggatcccagggctttcaggattctggccaagctgcacaccgaacccaaggtctactatctgagcgggcacgaatgggttcgcaaacaagcggacaatgtggtgaagggttga

SEQ ID NO: 67878 - protein, 252 aa, Syntrophobacter fumaroxidans MPOB
MSDTGHSEGKLRYGMVIDLDKCTGCMACSVACQAENNISFRADESNKLRSITWMEIYHLNNGKGYPDYQFAYLPRPCMHCDAPHHSPCTFVCPVNATTRDERNGLVTHIYPRCIGCRYCMVACPYHARDFNWWDPAWPKPMESMLSPEVSPRMRGVVEKCTFCSHRMMKARSKAYLDKADLEAVEYTPACAEACPTKAITFGNIRDANSEVGKLIKDPRAFRILAKLHTEPKVYYLSGHEWVRKQADNVVKG

SEQ ID NO: 67879 - DNA, 681 bp, Actinobacillus succinogenes 130Z
  CDS (1)..(681): transl_table=11
atgacaacttgctcacgccgaaactttgtttctggaatgggggcattaatccttacgacgggaacaacagttagtttaacggcacaaggtgaaagcgaaaagcaagaaaaaccaaaacgctatgcaatggtgcatgacgaatcagtctgtatcggttgtacggcgtgtatggaagcttgtcgtgaaaccaatcaagtgccagaaggtgtttctcgtttggaaattatccgtagcgagcctatcggcgaatttccgaatcaggaatatgaatttttccgccagtcttgtcagcattgtactaatgcaccttgtgtagcggtatgccctacaggcgcatcttacattgatccgacaaccggtattgttgatgtaaatcgtgatctttgcgtcggttgccagtattgtgtagcggtttgtccgtatcgtgtccgtttcattcatcctgttcataaaacagcggataaatgtaacttctgccgcgataccaatctggcaaaaggcaagcaaccggcttgcgtagaagcttgtccgaccaaagcgttaacattcggcgatatgaacgacagtaatagtgccgttgcacgtaaagttcgtgaaaatccggtatatcgtaccaaagtacaattaggtaccgaaccgaatttgtatcatattccatttggcaagggggaacatagataa

SEQ ID NO: 67880 - protein, 226 aa, Actinobacillus succinogenes 130Z
MTTCSRRNFVSGMGALILTTGTTVSLTAQGESEKQEKPKRYAMVHDESVCIGCTACMEACRETNQVPEGVSRLEIIRSEPIGEFPNQEYEFFRQSCQHCTNAPCVAVCPTGASYIDPTTGIVDVNRDLCVGCQYCVAVCPYRVRFIHPVHKTADKCNFCRDTNLAKGKQPACVEACPTKALTFGDMNDSNSAVARKVRENPVYRTKVQLGTEPNLYHIPFGKGEHR

SEQ ID NO: 67881 - DNA, 687 bp, Vibrio sp. Ex25
  CDS (1)..(687)
atgaaatgttcgagaagaaactttttagctagcagcggtgcgttgattttaactacaggcgttgcgggcacttccgttgttagctcctctctttatgccagcaacagtgaacaagcgaagcgcatgggtatggttcatgatgaaaatgcctgcattggctgtaccgcttgtaccgatgcttgtcgcgaagtaaataaagtccctgaaggcgtgacgcgacttaaaattcatcgcagtgaaccgattggcgaattcccagatgtggaataccagtttactcgcgaatcctgtcagcactgtgataatccaccatgtgtctatgtgtgcccaacaggcgcagcatacaaagatgaagcgacgggcattgtggatgtacacaaagagaaatgtgtcggatgtggttattgccttgctgcttgtccttaccaagtgcgcttctttaatccagtcgatcactctgcggataaatgcaacttctgccgcgataccaacctggcgcaaggtaagcagccagcttgcgtggaatcttgcccaacaaaagcactcatctttggtgatttaaatgacccagctagcgaggtgagcaaagctatcgaaagccatgttgtctatcgcgataaatcgcatttaggtacgcagcctaaactgtacaaaattccgcatagtaaaggggaggtgtcatcatga

SEQ ID NO: 67882 - protein, 228 aa, Vibrio sp. Ex25
MKCSRRNFLASSGALILTTGVAGTSVVSSSLYASNSEQAKRMGMVHDENACIGCTACTDACREVNKVPEGVTRLKIHRSEPIGEFPDVEYQFTRESCQHCDNPPCVYVCPTGAAYKDEATGIVDVHKEKCVGCGYCLAACPYQVRFFNPVDHSADKCNFCRDTNLAQGKQPACVESCPTKALIFGDLNDPASEVSKAIESHVVYRDKSHLGTQPKLYKIPHSKGEVSS

SEQ ID NO: 67883 - DNA, 768 bp, Vibrio sp. Ex25
  CDS (1)..(768)
atggattccaccaaacgtcgctttctcagcgcggtcacagctggagccgcgttaattccagtcgcgggtattggcacggcaaccgcgggaaacattattcgcaataaccagtccgccgatcgaaaaggacaagtggggaaacgttatgccatggtggtggatttacgaaagtgcgtcggatgccaggcttgcaccgtgggttgcagcattgaaaaccaagcacctatcggtcagttccgaaccacagtaaagcagtacgaagtcacgctggatgatggctctacaaccacacgagaagcgaaagcctttatgctgcctcgcctttgtaaccactgcgaaaacccaccctgcgtggctgtgtgtccggttcaagcgacctttcagcgcgaagatggcatcgtcatggtggataacagtcgctgtgtcgcctgcgcgtattgcgtacaagcctgcccttacgatgcgcgttttatcaatgaggacaccctcaccgcagataaatgtaccttctgtgctcaccgtctagaacaaggtctattgcctgcctgcgtggaaacctgtgttggcggtgcacgtgtaattggtgatttgaatgatccatcaagtgaagtccgccgcttaattgcgaagcaccaagacgacatcaaagtgctaaaacccaatgaagagaccaagccacacgtgttttacatcggcatggatgaacgcttcaccagccatatcgacgggcagccagctatttatgacccacaaggagagcacgcatga

SEQ ID NO: 67884 - protein, 255 aa, Vibrio sp. Ex25
MDSTKRRFLSAVTAGAALIPVAGIGTATAGNIIRNNQSADRKGQVGKRYAMVVDLRKCVGCQACTVGCSIENQAPIGQFRTTVKQYEVTLDDGSTTTREAKAFMLPRLCNHCENPPCVAVCPVQATFQREDGIVMVDNSRCVACAYCVQACPYDARFINEDTLTADKCTFCAHRLEQGLLPACVETCVGGARVIGDLNDPSSEVRRLIAKHQDDIKVLKPNEETKPHVFYIGMDERFTSHIDGQPAIYDPQGEHA

SEQ ID NO: 67885 - DNA, 1680 bp, Chloroflexus aurantiacus J-10-fl
  CDS (1)..(1680): transl_table=11
atgacaaactacggcttcctcatcgatcagcggaagtgcatcggttgccacgcatgcagtactgcctgcaagtcggagaatgaagttccacttggggtttaccgcacgtgggtgaagtatgtagagaccggcaccttccactccacccggcgccattttcaggtgacacgttgtaaccactgcgccaatccaccttgtgttcgcatttgtccggtcacagcaatgtatcagcgcaccgacgggattgtagagtttgatccgaaggtgtgcatcggctgcaaagcctgtttgcaggcctgtccttacgacgccatttacattgatccagagagccacaatgcggcgaagtgccacttctgtgcgcaccgtatcgatcaggggttgaaaccggcttgtgaaattgtctgtcccgaacaggcgatcatctctggcgatctcgatgatcccaatagtctgatcagccaattaattgcccgtgagccggtttcggtgcgcaagcctgaacagggcaccgcacccaagctgttttacattgatgctgaccaaaccacattgacgccaaccgcctcgacgaccagttctacctttatgtgggctgatgtggtgagcgagcaactggttggtcaccaccatacgaacggacgaaaacaacatgcccgtgaggtcattccgcttactgcggcttcgggagcaaagattcgcccgccgcgtgaacaggggctgggaagtggtcagagcgcgctgatgctgggtggccgggtggccggtcacatggtgcaaaccggctacaacgctcaacacaagattccgtggcactggccggtaccggcatatctggtgacaaaagggattgggagtggtgtctttctcgcagtggccgccgctgttggtcttggactggcgccgctgactgcaccactgctggcaattgcgctctttgtaagtctgctcttcattggtattacaaccgctctgctggtgtttgatctggaaaagccgcatctgttctttaccattctcacccgcccacaatggcggagctggctgacacgcggggcgtttatcctgattgcctttacgctggttggcgggctgtggttcctggctgaggccggcgctgccttgaatatctggccagaagccgctgtctcaggcttgcggccaatcctggcctggatcgggatgccgctggccgtgctggcagccatttacaccgcgttcctcttcgcgcaggccgaggggcgtgacctgtggcaaagtcccctcttgccggcccatctcctggtgcaggctgtgatggttggtgccggtacgctcttgctgctcgcaccgtttgtggctatgccggcagcatttctcaccctgctcggctggctctttgccggtagtttgctgatcgatctctttatgctcctggttggtgagttcggtatccctcatgccagtgaagttgctgcccgcgccgcgcacgatattagccacggccgctaccgcaaccacttctggcaaggagcgattgctctcggtcacgttctcccggtgctgtgcatcatcctggcgttcattgctccgaccctggcgatgccactcctggcagtagccggactggccgcaattgccgggttgtacgcctttgaatacgctttcgtcatggcgccgcaacacgtgccgaacagttaa

SEQ ID NO: 67886 - protein, 559 aa, Chloroflexus aurantiacus J-10-fl
MTNYGFLIDQRKCIGCHACSTACKSENEVPLGVYRTWVKYVETGTFHSTRRHFQVTRCNHCANPPCVRICPVTAMYQRTDGIVEFDPKVCIGCKACLQACPYDAIYIDPESHNAAKCHFCAHRIDQGLKPACEIVCPEQAIISGDLDDPNSLISQLIAREPVSVRKPEQGTAPKLFYIDADQTTLTPTASTTSSTFMWADVVSEQLVGHHHTNGRKQHAREVIPLTAASGAKIRPPREQGLGSGQSALMLGGRVAGHMVQTGYNAQHKIPWHWPVPAYLVTKGIGSGVFLAVAAAVGLGLAPLTAPLLAIALFVSLLFIGITTALLVFDLEKPHLFFTILTRPQWRSWLTRGAFILIAFTLVGGLWFLAEAGAALNIWPEAAVSGLRPILAWIGMPLAVLAAIYTAFLFAQAEGRDLWQSPLLPAHLLVQAVMVGAGTLLLLAPFVAMPAAFLTLLGWLFAGSLLIDLFMLLVGEFGIPHASEVAARAAHDISHGRYRNHFWQGAIALGHVLPVLCIILAFIAPTLAMPLLAVAGLAAIAGLYAFEYAFVMAPQHVPNS

SEQ ID NO: 67887 - DNA, 957 bp, Chloroflexus aurantiacus J-10-fl
  CDS (1)..(957): transl_table=11
atgacccggcaaccaactatccccttaaccccggtaagccgcagaggtttactcggtgcactggtagccggcgccggtgccctcgctgcggcttcagtacaggcaggtctccctgccagcaccggaaaatcagccgacactatcgatgtgctttcgcctgaagaagccctggccgcctacgaagccgagattgctcgcctccgtgcaaccaaagtgagcggtacacccctcgatcatctggagcggatgcgggccgaactgctgcgggcactcgccaaaccggtcgccgaacgccgttgggtgatggtgattgatctccgcgcctgcgtcggttgtcacggttgcaccatcgcctgcgtggccgagaacaaactgccacccggcgtggtctaccgaccggtgatcgacgaagagatcggtcgctaccccaatgtcacgcgccgcttcattccccgaccctgtatgcaatgcgacaatccgccctgcaccggggtttgcccggtctcggccaccttcaccaacgagcatggcgtcgtcgaagtagactacgagcagtgcattggctgccgtgcctgtatcgctgcgtgtccgtatggtgcgcgcaccttcgatttcggatacacctacaccgccgacaccaccgaccctggcgtcatgtttggcgccgatcaggcagcgacctacgagacggtcaccaccttcgagtacggcaaagcccacgcacggcgcaacctccacgactcgccggttgggaacgtgcgtaaatgccacttctgcatgcaccgggtactcaacggtcaactcccggcctgtgtcacgacctgcatcgggcgcgccaccttcttcggtgatgccaatgatcccgatagcctggttagcgaactgattgccaaacccaatgtcatgcggttgaaagaagacctcggcaccgagccgcgtgtctactatttgcagtga

SEQ ID NO: 67888 - protein, 318 aa, Chloroflexus aurantiacus J-10-fl
MTRQPTIPLTPVSRRGLLGALVAGAGALAAASVQAGLPASTGKSADTIDVLSPEEALAAYEAEIARLRATKVSGTPLDHLERMRAELLRALAKPVAERRWVMVIDLRACVGCHGCTIACVAENKLPPGVVYRPVIDEEIGRYPNVTRRFIPRPCMQCDNPPCTGVCPVSATFTNEHGVVEVDYEQCIGCRACIAACPYGARTFDFGYTYTADTTDPGVMFGADQAATYETVTTFEYGKAHARRNLHDSPVGNVRKCHFCMHRVLNGQLPACVTTCIGRATFFGDANDPDSLVSELIAKPNVMRLKEDLGTEPRVYYLQ

SEQ ID NO: 67889 - DNA, 705 bp, Shewanella putrefaciens CN-32
  CDS (1)..(705): transl_table=11
atgagattaggaatggtgattgacctacaaaaatgtgtagggtgtggcggctgtagcttagcctgtaaaacagaaaacaacacgaacgacggtattcactggtcgcatcatattgcgaccactgagggtacgttccctgacgttaaatacacatatataccgaccctgtgtaaccattgtgatgatgcaccatgtgttaaagtgtgtccgacaggagcgatgcacaaagataaacgcggtttaacgctgcaaaacaatgatgaatgcattggttgcaagaagtgtatgaatgcttgcccatacggcgtgattagttttaatgcggcaacaccgcaccgtcgttggcaggatgactcagaggtggtcgcgaacggaactgtatctccacttatgctactaaagcgtacaggggctacggcaacacctaatgaaaacccagagcggggtgatacctatccgatgatacggccaaagcgtactacagagaaatgtactttctgtgatcataggcttgataaggggttgaatcctgcctgtgttgacgcttgtccatctgaagcacgggtaattggtgatttagatgatccgcagagcaaggtatcccagttgattaaattgcataaacctatgcagttgaaacctgaagcgggaacgggaccaagggtattttatattcgcagttttggtgttaaaaccgcttattaa

SEQ ID NO: 67890 - protein, 234 aa, Shewanella putrefaciens CN-32
MRLGMVIDLQKCVGCGGCSLACKTENNTNDGIHWSHHIATTEGTFPDVKYTYIPTLCNHCDDAPCVKVCPTGAMHKDKRGLTLQNNDECIGCKKCMNACPYGVISFNAATPHRRWQDDSEVVANGTVSPLMLLKRTGATATPNENPERGDTYPMIRPKRTTEKCTFCDHRLDKGLNPACVDACPSEARVIGDLDDPQSKVSQLIKLHKPMQLKPEAGTGPRVFYIRSFGVKTAY

SEQ ID NO: 67891 - DNA, 687 bp, Shewanella putrefaciens CN-32
  CDS (1)..(687): transl_table=11
atggaaaattcaaaaagaagatttcttaaaggtacctgtgctttattagcgggtgcatctggcgcctcacttctcgccactgtgaatgcatcaggcagtgttaaagctgaagctgatgtgaaatatgcacttatccatgatgaaactaagtgcattggctgccaagcatgtgaagtggcctgccgtgaagtgaataatgtgcctgaaggtgtttctaggattgaaataaaaagagaaggtccttttggcgaataccctaatcagttttatcactttagccgcaagtcttgtcaacattgtgaagatgcaccctgtgtgaatgtttgcccaacgggagcagcgtttattgataaagaaacgggcattgtttctgttgatgcttggaagtgcgtaggttgccaatattgtattgcggcttgtccttatcaagtgcgttttatccatcctgtcacccgtgctgcggataagtgtgatttctgccgtgaaacgaacttggctcaaggtaaacagcctgcttgtgttgctgcttgtccaacaaaagcactcgtgttcggtaatttaaaagatccgacgtcagaggttgttcaagtgctgcggtctaatccaacccaacgcgctaaggttgatctcggaacgcgacctaaactgttccgtatcgttgcaaaatcaggggaggtgacattatga

SEQ ID NO: 67892 - protein, 228 aa, Shewanella putrefaciens CN-32
MENSKRRFLKGTCALLAGASGASLLATVNASGSVKAEADVKYALIHDETKCIGCQACEVACREVNNVPEGVSRIEIKREGPFGEYPNQFYHFSRKSCQHCEDAPCVNVCPTGAAFIDKETGIVSVDAWKCVGCQYCIAACPYQVRFIHPVTRAADKCDFCRETNLAQGKQPACVAACPTKALVFGNLKDPTSEVVQVLRSNPTQRAKVDLGTRPKLFRIVAKSGEVTL

SEQ ID NO: 67893 - DNA, 672 bp, Yersinia bercovieri ATCC 43970
  CDS (1)..(672)
atgaatagccatcgtcgtcactttcttatcagtatgggggcgctgatctttatcaccggctccaccagaggttcgctggcatttagcggcactatcgacggcgttcgctacgggatgctacatgatgagactcgctgtatcggctgtaccgcctgtatggatgcttgccgcgcagtgaatcaggttccggctggggtttcgcggctcactatcattcgcagccagcccatcggggagtttccggcggtgaaatatcagttttatcgtcactcctgccaacattgtgataaagccccttgcgtggatgtttgcccgaccggcgcatcctatcgcgataaggcgaccggcattgtcgatgtcaatcctgacctctgtgtcggctgccagtactgcatcgccgcgtgcccctaccgggtgcgctttattcatccggtcacaaaaactgcggacaagtgcgatttttgccgcaagaccaatctaaagcaggggaagcagccggcctgtgtgctgtcatgccccaccaaagcactggtatttggcaatctggacgacgccaatagtgagctggtgaagctactgcatcagcgcacggtgtatcgcgccaaactacatctggggacacagccgaagctgtaccgtgtgccttttcagtatggggagattaccggatga

SEQ ID NO: 67894 - protein, 223 aa, Yersinia bercovieri ATCC 43970
MNSHRRHFLISMGALIFITGSTRGSLAFSGTIDGVRYGMLHDETRCIGCTACMDACRAVNQVPAGVSRLTIIRSQPIGEFPAVKYQFYRHSCQHCDKAPCVDVCPTGASYRDKATGIVDVNPDLCVGCQYCIAACPYRVRFIHPVTKTADKCDFCRKTNLKQGKQPACVLSCPTKALVFGNLDDANSELVKLLHQRTVYRAKLHLGTQPKLYRVPFQYGEITG

SEQ ID NO: 67895 - DNA, 735 bp, Yersinia bercovieri ATCC 43970
  CDS (1)..(735)
atggatcacgggaagagagcatttttacagcggttgggggtgctaaccgccggagccgcactggtgccgttggcgcaggcgggctggcagatggagccggcgcgcaaacagggtgatatcaaacggcgctatgccatgttgattgatttgcgccgctgcatcggctgccaagcttgcactgttagctgtgctatcgaaaaccaactgccgcaggggcagtttcgcaccacggtcaatcagtatcagatagcactgtcgggggcggagagtgtcaccaacgtcttgttgccacggctgtgtaaccactgcgataacccaccctgtgtgccggtttgcccggtgcaggccacctatcagcggcaagatggcattgtggttatcgacaatacccgctgcgtcggttgcgcctattgtgtgcaggcttgcccctacgaggcccgatttatcaatcacagcacccaaaccgccgataagtgtactttttgtgtgcatcgactggacgccgggctactgcctgcttgtgttgagtcttgtgtcggcggggcgcgcatcattggcgatctgcgcgatggcgatagcaaattacgccaaatgttgctggaacatgcgacggatatcaaagtgttgaagccagaacagggcactcatccgcaggtgttttaccttggcttaaatgagctatttacccgcccattacagggccagcccgcattgtggcaggagatacatccatga

SEQ ID NO: 67896 - protein, 244 aa, Yersinia bercovieri ATCC 43970
MDHGKRAFLQRLGVLTAGAALVPLAQAGWQMEPARKQGDIKRRYAMLIDLRRCIGCQACTVSCAIENQLPQGQFRTTVNQYQIALSGAESVTNVLLPRLCNHCDNPPCVPVCPVQATYQRQDGIVVIDNTRCVGCAYCVQACPYEARFINHSTQTADKCTFCVHRLDAGLLPACVESCVGGARIIGDLRDGDSKLRQMLLEHATDIKVLKPEQGTHPQVFYLGLNELFTRPLQGQPALWQEIHP

SEQ ID NO: 67897 - DNA, 672 bp, Yersinia mollaretii ATCC 43969
  CDS (1)..(672)
atgaagaccaatcgtcgtcactttctggtcggcatgggggcgctgatctttatgaccgggtcaacggggcgttcgttggcacttagcggcacagtcgacggcgttcgctacgggatgctgcatgatgagactcgctgcattggctgcaccgcctgtatggatgcttgccgtgaagtgaaccatgtcccggcgggcgtctcgcgcctcagtatcattcgcagtcaacccatcggggagtttccggcggtgaagtatcagttttatcgtcactcctgccagcattgtgaccacgctccttgtgtggatgtctgcccgacgggcgcatcctatcgcgataaggcgacaggcattattgatgtcaatcctgatctctgtgtcggctgccaatattgcatcgcggcgtgcccctatcgggtacggtttatccatccggtcaccaaaaccgccgacaagtgcgatttttgccgcaaaaccaaccttaagcaggggaaacagcccgcctgtgtgctctcatgccccactaaagcactggtgtttggcaatctggacgatcccaacagtgagctggtgaagctgttgcatcagcgcacagtgtatcgcgccaagttacatctggggacacagccgaagctgtaccgtgtgccttttcagtatggggagataaccggatga

SEQ ID NO: 67898 - protein, 223 aa, Yersinia mollaretii ATCC 43969
MKTNRRHFLVGMGALIFMTGSTGRSLALSGTVDGVRYGMLHDETRCIGCTACMDACREVNHVPAGVSRLSIIRSQPIGEFPAVKYQFYRHSCQHCDHAPCVDVCPTGASYRDKATGIIDVNPDLCVGCQYCIAACPYRVRFIHPVTKTADKCDFCRKTNLKQGKQPACVLSCPTKALVFGNLDDPNSELVKLLHQRTVYRAKLHLGTQPKLYRVPFQYGEITG

SEQ ID NO: 67899 - DNA, 672 bp, Yersinia frederiksenii ATCC 33641
  CDS (1)..(672)
atgaataccaatcgtcgtcactttatcgtcagtatgggggcactgattttcatgaccggttcaaccgggcgttcactggcacttagcggcactgtcgatggcgttcgttacggcatgttgcatgatgaaacccgctgtattgggtgtaccgcctgtatggacgcctgtcgagaagtcaatcatgtgcccgagggtgtctcgcggttaaatattatccggagtcagccaattggcgagtttccatcggtgaaatatcagttttaccgtcattcttgccagcactgtgataaggccccttgtgtggatgtctgcccaacgggtgcctcttatcgagataaaaaaaccgggattgttgatgttgatcctgacctttgtgtcgggtgccaatattgcattgcagcttgtccgtatcgggtgcgttttattcatccggtgacgaaaactgccgacaaatgcgatttttgccggaaaaccaatctcaaacaggggaaacaaccggcttgcgtgctgtcgtgcccaactaaagcgctgacctttggcaatctggacgatcctgatagtgaactggtgaagctgttgcatcagcgcacggtatatcgcgccaagttacatctgggaacacaaccaaaactgtatcgtgttcctttccagtatggggagataaccggatga

SEQ ID NO: 67900 - protein, 223 aa, Yersinia frederiksenii ATCC 33641
MNTNRRHFIVSMGALIFMTGSTGRSLALSGTVDGVRYGMLHDETRCIGCTACMDACREVNHVPEGVSRLNIIRSQPIGEFPSVKYQFYRHSCQHCDKAPCVDVCPTGASYRDKKTGIVDVDPDLCVGCQYCIAACPYRVRFIHPVTKTADKCDFCRKTNLKQGKQPACVLSCPTKALTFGNLDDPDSELVKLLHQRTVYRAKLHLGTQPKLYRVPFQYGEITG

SEQ ID NO: 67901 - DNA, 546 bp, Shewanella sp. PV-4
  CDS (1)..(546): transl_table=11
atgtcgttaaataagaaagtgggctttgtgttcagacaagagaactgtgtcggttgcggtgcctgtaccgttgcctgccagatccacaatgaactgcccgagaaccatagattccgtaaagtcgatcgctatgaagtgaagcgtgacgatggcgctatcgatgtctggttgtcccactcatgcatgcactgcgaaaaccccgcttgtctcatggtctgcccggcgaaagcctaccatgtgcgcgatgacggtatcgtggtgctggaccgtgagaagtgtaccggttgtggcctgtgtgccagcgcctgtccttacgcggccgtcagcatccgcgaggacgacggcaaggcagacaagtgcaacatgtgtgtggagctgctggaccgcggcatgaaacccgcgtgtgtgagtggctgcccggtagagtgcctggatgtcggcaatctgcaagaggtgctcaagcgtccatcggcaagcaaacaaggcataggctatggcgattgcatcaccaaacctaacctagtgatcattaaggaacgcgcataa

SEQ ID NO: 67902 - protein, 181 aa, Shewanella sp. PV-4
MSLNKKVGFVFRQENCVGCGACTVACQIHNELPENHRFRKVDRYEVKRDDGAIDVWLSHSCMHCENPACLMVCPAKAYHVRDDGIVVLDREKCTGCGLCASACPYAAVSIREDDGKADKCNMCVELLDRGMKPACVSGCPVECLDVGNLQEVLKRPSASKQGIGYGDCITKPNLVIIKERA

SEQ ID NO: 67903 - DNA, 693 bp, Shewanella sp. PV-4
  CDS (1)..(693): transl_table=11
atgcaagtttctaaacgccaatttctcaagggggttggggccctactggccggtgtctctgtgtatggtgccacccgcacgccccaggccgattccctactccagcccgagcaggaaagcgagatcaaatacgccatggtgcatgatgagaatgcctgtatcggctgtaacgcctgcgtccaggcctgccgtgaggtcaatcatattcccgagggcgtcacccgggtgaagatagaacgtaaggggcccttcggcgagtacccagatcagagctaccgcttcagccgtgtctcctgtcagcactgcgaagccgcgccctgtgtaagggtctgccccacaggcgccgcctatattgacaaagagacgggcatagtcgcggtcaatagcgaccgctgcgtgggctgccagtattgcatcgccgcctgcccctatcaggtcaggtatatccaccccgagacccgcaccgccgacaagtgcgatttctgtcagaagagtcgcctggctcaggggcttcagcctgcctgtgtcgaggcctgccctaccaaggcactgaccttcggcaacctcaaggatcccgagtcggatctggtcaagctgcttaagcgcaagcccagctaccgcgccaaggtggacctgggcacccggcctaagctgttccatattcaaaccatagatggggagataatgctatga

SEQ ID NO: 67904 - protein, 230 aa, Shewanella sp. PV-4
MQVSKRQFLKGVGALLAGVSVYGATRTPQADSLLQPEQESEIKYAMVHDENACIGCNACVQACREVNHIPEGVTRVKIERKGPFGEYPDQSYRFSRVSCQHCEAAPCVRVCPTGAAYIDKETGIVAVNSDRCVGCQYCIAACPYQVRYIHPETRTADKCDFCQKSRLAQGLQPACVEACPTKALTFGNLKDPESDLVKLLKRKPSYRAKVDLGTRPKLFHIQTIDGEIML

SEQ ID NO: 67905 - DNA, 717 bp, Shewanella sp. PV-4
  CDS (1)..(717): transl_table=11
atgttagatagaagaagaacactcaaactcctggctggcggcgccatcgcaaccacaggcatgatgtttatccccgccgatcctgtgatcgccgatattcgtcgtcagggtaagaagcgtctggccatggtgatcgatctcggtcgctgcaacggttgcaaggcctgtgtggtctcctgtggtatagagaacggcaacctgcctgacgagcatagaacccaggtgccgcaacacagcgtggatctgaatggcaagcagtatgtgtttaacatgccgatcctctgcaacaactgcgacaggccctcctgcgtgtctgtctgcccgacgggcgccaccttcaagcgcgagcaggacggcatagtggtggtggactcagagctgtgtatcggttgtaactactgcatccaggcttgcccctacgatggggtgcgtttcacccattcagccacgggcaccgtggataaatgtaacttctgtattcagcgaaccagccgcggcttgctgcctgcctgtgtcgagacctgtaccggtggtgcccgtgtctttggtgacattaacgaccccgagagcgaggtctccaggctgatacgtcagcacaggccgctggtgttgcaggccggtaagcaaacctcccccaatgtgttctatatcggcttgacccaagacgagagcgacagggcatacagtatcaattctccccaaacctggcagaggtag

SEQ ID NO: 67906 - protein, 238 aa, Shewanella sp. PV-4
MLDRRRTLKLLAGGAIATTGMMFIPADPVIADIRRQGKKRLAMVIDLGRCNGCKACVVSCGIENGNLPDEHRTQVPQHSVDLNGKQYVFNMPILCNNCDRPSCVSVCPTGATFKREQDGIVVVDSELCIGCNYCIQACPYDGVRFTHSATGTVDKCNFCIQRTSRGLLPACVETCTGGARVFGDINDPESEVSRLIRQHRPLVLQAGKQTSPNVFYIGLTQDESDRAYSINSPQTWQR

SEQ ID NO: 67907 - DNA, 573 bp, Shewanella sp. PV-4
  CDS (1)..(573): transl_table=11
atgagtaaaagatatgtaatggtgcacgacgagaaccgctgcatcggctgtcaggcctgtagcgtcgcctgtcgcagcgaaaatggcgtccccgagggagtcacccgcttgcaagtgcgcgtagaaggccccttcggcgatgcgccgcacctgcactttaaatataaccgcgtctcctgccagcagtgtgagaacgccccctgcgtcaccgtctgtccgacgggtgcggcctatgtgggcgacgatggcctggtctccatcaaggaagataaatgcgtcggctgtatgtactgtgtggcggcctgcccctacaaggtgcgtttcatcaaccctgaaaccaaggcggccgacaagtgtaacttctgtaaggacacccgcctggcccgcggcgagctgcccgcctgtgtgaccgtgtgtcccacagatgcactgacctttggcgatgccaatgacccgagcagcgaggtagccaaactcatcaacaccaaagcgacctatcaggagaagacccatctggggaccaagcctagggtctatcgcattccaacgaaacgtggggggatacagtcatga

SEQ ID NO: 67908 - protein, 190 aa, Shewanella sp. PV-4
MSKRYVMVHDENRCIGCQACSVACRSENGVPEGVTRLQVRVEGPFGDAPHLHFKYNRVSCQQCENAPCVTVCPTGAAYVGDDGLVSIKEDKCVGCMYCVAACPYKVRFINPETKAADKCNFCKDTRLARGELPACVTVCPTDALTFGDANDPSSEVAKLINTKATYQEKTHLGTKPRVYRIPTKRGGIQS

SEQ ID NO: 67909 - DNA, 786 bp, Alkalilimnicola ehrlichei MLHE-1
  CDS (1)..(786): transl_table=11
atgagcagtgatccgcgcgaacagggctgcgcccgcaacgggggagacaccccgtgcaacccgacgcgccgccgtatgctcgctgccggcgccgggctgctgggcctgtcggtggcaccgggggtattcctgatgcaggccggcgccacatcggacgccggcaccgccaccggggcctccccccgggtccgctggggactgctgatcgacaccacccgctgcgccgagggctgtgacgcctgcgtgcgcgcctgccgggaggaaaacggctgggcccatctgggccaggcaccgaccgatgcccagtggatccgcaaggtgacggtcagcgatccggacaccggccacagccagagcctgccggtgatgtgccagcactgcgcccatccgccctgcgtccaggtctgccccaccggcgcgtccatgcagcgggccgacggcatcgtccaggtggacaagcacctctgcatcggttgccgctattgcatgatggcctgcccctataaggcgcgctccttcgttcatgagccggtcaccgagttctcccccaacagcccccggggcaagggcacggtggagtcctgccacctgtgcgtgcaccggatcgaccggggccagttgcccgcctgcgtgacccgctgcgcctcagaagggggcggggctatggtcttcggcgatctcaacgatccggacagcgacatctcgcaggccctgagccgccacggcggccgggccatccgccaggacctggggctgaaccccggcgtgcggtaccagggcatctga

SEQ ID NO: 67910 - protein, 261 aa, Alkalilimnicola ehrlichei MLHE-1
MSSDPREQGCARNGGDTPCNPTRRRMLAAGAGLLGLSVAPGVFLMQAGATSDAGTATGASPRVRWGLLIDTTRCAEGCDACVRACREENGWAHLGQAPTDAQWIRKVTVSDPDTGHSQSLPVMCQHCAHPPCVQVCPTGASMQRADGIVQVDKHLCIGCRYCMMACPYKARSFVHEPVTEFSPNSPRGKGTVESCHLCVHRIDRGQLPACVTRCASEGGGAMVFGDLNDPDSDISQALSRHGGRAIRQDLGLNPGVRYQGI

SEQ ID NO: 67911 - DNA, 687 bp, Shewanella sp. MR-4
  CDS (1)..(687): transl_table=11
atggaaaattcaaaaagaagatttctcaaagggacatgcgccctgttggccggcgcttcgggagcgaccctactcgcgactgtcagtgcttcgaatgaggcgaaggccgaacccagcgtgaagtatgcgctgatccacgatgagactaagtgcataggttgcaaggcctgtgaggttgcatgccgtgaaaccaaccaggtgcccgagggcgtggcgcggctgaagatagaacaaaccggaccttacggagaatatccaaaccagttttatcacttcagtcgtaagtcttgccagcactgtgaagatgccccctgtgtcaatgtctgcccgaccggtgccgcttttatcgataaagagacgggaatcgtgtcggtggatgcgtggaagtgtgtgggctgtcagtattgtatcgcggcttgtccctacaaaattcgctttatcaatcccgttacccatgccgcggacaagtgtgatttttgccgtgagactaatctggcccaaggtaaacagcccgcctgcgtcgcggcttgtccaactaaggccttagtgtttggcaacttaaaggatccgagttcacaggtggtacaagtgctgaaggctaacccgacccaaagggctaaggttgacctaggaacgcggccaaaactgttccgcattgtggccaaatcaggggaggttgcaatatga

SEQ ID NO: 67912 - protein, 228 aa, Shewanella sp. MR-4
MENSKRRFLKGTCALLAGASGATLLATVSASNEAKAEPSVKYALIHDETKCIGCKACEVACRETNQVPEGVARLKIEQTGPYGEYPNQFYHFSRKSCQHCEDAPCVNVCPTGAAFIDKETGIVSVDAWKCVGCQYCIAACPYKIRFINPVTHAADKCDFCRETNLAQGKQPACVAACPTKALVFGNLKDPSSQVVQVLKANPTQRAKVDLGTRPKLFRIVAKSGEVAI

SEQ ID NO: 67913 - DNA, 987 bp, Shigella dysenteriae Sd197
  CDS (1)..(987): transl_table=11
gtgaacagacgtaattttattaaagcagcctcctgcggggcattgctgacgggcgcgctgccgtctgtcagtcatgcggctgctgaaaaccgaccgccaattccgggatcgctggggatgttgtacgactcgaccttgtgcgtaggctgccaggcttgcgtcaccaagtgtcaggatatcaacttccctgaacgtaacccgcaaggggaacagacctggtcgaacaacgacaaactgtcgccgtataccaataacatcattcaggtgtggaccagcggcacaggggtcaacaaagaccaggaggagaacggctacgcgtacattaagaaacagtgtatgcactgcgtcgatccgaactgtgtctctgtgtgcccggtctctgcactgaaaaaagatccgaaaaccggcattgtccattacgacaaagacgtgtgcaccggctgccgttactgcatggtcgcctgtccgtacaacgtgccgaagtacgactacaacaacccgtttggtgcgctgcataagtgcgagctgtgcaaccagaaaggtgtggaacgtctcgataaaggcggtctgcctggctgcgtagaagtgtgcccggcgggcgcggtgatttttggtacgcgtgaagagctgatggcggaggcgaaaaaacgtctggcgctgaagcctggcagcgaataccactatccgcgtcagacgctgaaatctggcgacacttacctgcatacggtgccgaaatattatccgcatctgtacggcgggaaagagggcggcggtactcaggttctggtactgacgggtgtgccttatgaaaatctcgacctgccgaaactggacgatctttctaccggtgcgcgttccgaaaatattcaacacaccctgtataaaggcatgatgctaccactggctgtgctggcgggcttaaccgtgctggttcgtcgcaacaccaaaaacgaccatcacgacggaggagacgatcatgagtcatga

SEQ ID NO: 67914 - protein, 328 aa, Shigella dysenteriae Sd197
MNRRNFIKAASCGALLTGALPSVSHAAAENRPPIPGSLGMLYDSTLCVGCQACVTKCQDINFPERNPQGEQTWSNNDKLSPYTNNIIQVWTSGTGVNKDQEENGYAYIKKQCMHCVDPNCVSVCPVSALKKDPKTGIVHYDKDVCTGCRYCMVACPYNVPKYDYNNPFGALHKCELCNQKGVERLDKGGLPGCVEVCPAGAVIFGTREELMAEAKKRLALKPGSEYHYPRQTLKSGDTYLHTVPKYYPHLYGGKEGGGTQVLVLTGVPYENLDLPKLDDLSTGARSENIQHTLYKGMMLPLAVLAGLTVLVRRNTKNDHHDGGDDHES

SEQ ID NO: 67915 - DNA, 873 bp, uncultured bacterium BAC10
  CDS (1)..(873)
atgagcggcccaagccctcgagatccgggcgctcatcggctttccctgtggggagagaagactggcatacggcgcctgcccgtcgtgtcgaagtacatcgacacgacgacctgcatcggctgcaaggcgtgtgaggtggcctgccaggagtggaacgacctccaggtcgtgcccaccaagcagacgggaagctaccagacgctgccgacactcgacgcggagttctggaacctcatcaaattcagcgagcgtgaaacctcagagggcgccctggcgtggctgatgcgcaaggaccagtgcctgcactgcgaggatcccgggtgcctcgccgcctgccccgcgccgggcgcgatcgtgcagtacgagaacgggatcgtggacgtggacccccagaagtgcatcggctgccaactttgcctcacgggctgtcccttcaacgttccgcgcttccacaagaagaccgggaagatggccaagtgcacgctctgcgtggaccgggtgcatgtcggactcgagcccgcctgcgtcaaggcctgcccgaccggctgtctgcacttcgggaccaagctggacatgctggccaagggccaggcacgggtggaacaactcaaggagaatggcttcgatcgtgcggcgctctacgaccctccgggcgtcggcggcacgggtgtcgtgaccgtgctcgcccacggcgaccatcccgagtggtacgacctgcctcgcgatccccatgtcccgctgaccgtgcggctctggaagggcgtgctcaggcctttcggaatgctagccatcttcgcggcgatcctggcggccctcgcgcacttcatgaccttcggaccgaagcggcccgggaccggcgaggagggtgcgtga

SEQ ID NO: 67916 - protein, 290 aa, uncultured bacterium BAC10
MSGPSPRDPGAHRLSLWGEKTGIRRLPVVSKYIDTTTCIGCKACEVACQEWNDLQVVPTKQTGSYQTLPTLDAEFWNLIKFSERETSEGALAWLMRKDQCLHCEDPGCLAACPAPGAIVQYENGIVDVDPQKCIGCQLCLTGCPFNVPRFHKKTGKMAKCTLCVDRVHVGLEPACVKACPTGCLHFGTKLDMLAKGQARVEQLKENGFDRAALYDPPGVGGTGVVTVLAHGDHPEWYDLPRDPHVPLTVRLWKGVLRPFGMLAIFAAILAALAHFMTFGPKRPGTGEEGA

SEQ ID NO: 67917 - DNA, 597 bp, Methylobacterium extorquens
  CDS (1)..(597): transl_table=11
atggcccggatgaagttcctctgcgacgcggatcgctgcattgagtgcaacgcctgcgtcacggcctgcaagaacgagcacgaggtgccctggggcatcaatcgccgccgcgtcgtcaccctcaatgacggcaagcccggcgagcgctcggtctcgatggcctgcatgcactgcaccgacgcgccctgcgcggcggtgtgccccgtgaactgcttctacaccacggccgatgccgtggtgctgcactccaaggacatctgcatcggctgcggctactgcttctacgcctgccccttcggcgcgccgcagtatccgcgggtcgggaacttcggttcgcgcggcaagatggacaagtgcacctactgctcgggcggccccgagcccgacttctcgaccgccgagtacgagaagtacggctcgaaccgtctcgcggaaggcaagctgccgctctgcgccgagatgtgctcgaccaaggcgctgctcgcgggcgacggcgagatgatcgccgagatctacaagcagcgggtgatcaagcgcggctacggctcgggcgcctggggctggaagacggcctaccgcgagaccgtcgcaatctga

SEQ ID NO: 67918 - protein, 198 aa, Methylobacterium extorquens
MARMKFLCDADRCIECNACVTACKNEHEVPWGINRRRVVTLNDGKPGERSVSMACMHCTDAPCAAVCPVNCFYTTADAVVLHSKDICIGCGYCFYACPFGAPQYPRVGNFGSRGKMDKCTYCSGGPEPDFSTAEYEKYGSNRLAEGKLPLCAEMCSTKALLAGDGEMIAEIYKQRVIKRGYGSGAWGWKTAYRETVAI

SEQ ID NO: 67919 - DNA, 717 bp, Azoarcus evansii
  CDS (1)..(717): transl_table=11
atgcaaccggctctggctccgacatcgtgcgggtggcggtgcgcaaggtcgcgcgcgaggagaccgcacaatgaccgctacgcgatgaccatcgacctgcgccgctgcgtgggttgccagacctgtaccgccgcttgcaagaacgccaacgcaacgccgccgggtgtgcagtggcggcgggtgctggatctcgagacgggcgaattcccggacgtgcgccgcagcttcgtgccggtcgcgtgcatgcactgcgacgaacctccgtgtgaggaagtgtgcccgaccaaggcgacgaccaagcggcccgacggcctggtcgccatcgactacgacacctgtatcggctgtgcgaactgcgtgatggcttgtccctacgaggcgcgctccatcgtgcatgaggcgaagttcgcctacggcgacaagccgatcaagtcggaagaggtgcgcttcgacccgtcgcgcatctcggtgtcgatgaaatgcaccttctgcatcgaccgtatcgacctcgcggcaaagaccggacaggtgccgggacgcgatccggacgttacgccggcctgcgtcaattcctgcatctccggcgcgatggctttcggcgacctcgacgaccccaacagcaaggtcagccgcctgatcgccgagaacaagactttccgcatgcacgaggagctcggcaccgggccgggcgtgtattacatctgggacaaggggtaa

SEQ ID NO: 67920 - protein, 238 aa, Azoarcus evansii
MQPALAPTSCGWRCARSRARRPHNDRYAMTIDLRRCVGCQTCTAACKNANATPPGVQWRRVLDLETGEFPDVRRSFVPVACMHCDEPPCEEVCPTKATTKRPDGLVAIDYDTCIGCANCVMACPYEARSIVHEAKFAYGDKPIKSEEVRFDPSRISVSMKCTFCIDRIDLAAKTGQVPGRDPDVTPACVNSCISGAMAFGDLDDPNSKVSRLIAENKTFRMHEELGTGPGVYYIWDKG

SEQ ID NO: 67921 - DNA, 684 bp, Acidianus ambivalens
  CDS (1)..(684): transl_table=11
atgactgacaatccttatttggcttttggaaataataggtcatgcaaaaactggggattcgtagtaagagtagaccagtgcttaggttgtatggcatgcatggctgcatgtgctgtagaaaatcaaacaccgttctgggaagaattatggagaactcatgtcgaagacctagaagtaggagaattccctaactctcaaaggatgttcatacctagactatgtatgcaatgcgaaaacccaccgtgctattacgtctgtccaaccggtgctactcaaattgttgatggaggcatagtcgttgttgatgaatacaaatgcatgggttgcctatactgcgttgaagcatgcccatatggggctaggtatttctacacttatgacgacattcaaaaggccaaggaatactacggagataacttaattcacgtagttccacacgtagataagtgtacgttctgttatggcactgctcctgatggcacttatacaccagcatgtgtaaggacgtgtgtaggtggggcaagagttttcggttgcttagatgatcctaacagtgaagtttcagtactagtgaatactggacaagctgtagtccttaatcctcaacttaatgtacaacctaaggtattttatgtttttaataagcaatctggaagatatgctcaaggaggtgacaactcttga

SEQ ID NO: 67922 - protein, 227 aa, Acidianus ambivalens
MTDNPYLAFGNNRSCKNWGFVVRVDQCLGCMACMAACAVENQTPFWEELWRTHVEDLEVGEFPNSQRMFIPRLCMQCENPPCYYVCPTGATQIVDGGIVVVDEYKCMGCLYCVEACPYGARYFYTYDDIQKAKEYYGDNLIHVVPHVDKCTFCYGTAPDGTYTPACVRTCVGGARVFGCLDDPNSEVSVLVNTGQAVVLNPQLNVQPKVFYVFNKQSGRYAQGGDNS

SEQ ID NO: 67923 - DNA, 1119 bp, Desulfovibrio vulgaris
  CDS (1)..(1119): transl_table=11
atgaacaggagaagattcctgaccctgctgggcaccgccggtgtttccacggccatgagcgctgtaggcgcgaaaaaggccgtcgcggcgggcaaccagagcttcaagggctacaaggacagttacggggtgctgcacgacaccacccgttgcatcggctgccgcaagtgcgagcagggctgcaacgaggtgaacaagctgcccgcgcccaaggtgaagttcgacgacctgacggtgctggaaaaatcgcgccgtaccgattcgaacaactggacggtggtcaacaagtacaatgtggcagggctggaccatccggtgttccgcaagcagcagtgcaaccactgcctggaacccgcctgcgcctcggcctgcttcgtcaaggccttcaccaagaaccccgacggctccgtcacctacgacggcagcctgtgcgtgggctgccgctactgcatgatcgcgtgcccgttcaacgtgcccgccttccagtacgacgagcctttcgacccgctgatccagaagtgcaccatgtgccacccgcgcatccaggaaggcaagctgcccggctgtgtcgaggcctgccccaaggaggccctgaccttcggcaagcgcgaagacctcgtgcgcatcgcccatgaccgcatccgcagcaatcccggtcggtaccaggatcacgtctacggtgaactggaaatgggcggcaccgcgtggatgtacctggctggcgtgcccttcgaggccgtgggccagcaggaaatgggcaccaagtccgcgccggaatacacggcgggggcccttggttccgtgcccatggtggtgggcatctggccggtgctgctgaccggcgcctacgccatctccaagcgcaaggaaaaggttgcggcggaagagcgcgaagaagccgttcaggccgcgctggccaaggcccgcgacgatgcggccaaggccatggataccgccctggccaaggcggccaaggaaaaggacgccgccgtgacccgcgaggtcaagaaggccatggaacaggcggagcaggccttcgaagagaagttcgccgccctgcgtgccgaaggccagaccgccgaaaacggcgacgacggcgaaggcaaggaggatgcataa

SEQ ID NO: 67924 - protein, 372 aa, Desulfovibrio vulgaris
MNRRRFLTLLGTAGVSTAMSAVGAKKAVAAGNQSFKGYKDSYGVLHDTTRCIGCRKCEQGCNEVNKLPAPKVKFDDLTVLEKSRRTDSNNWTVVNKYNVAGLDHPVFRKQQCNHCLEPACASACFVKAFTKNPDGSVTYDGSLCVGCRYCMIACPFNVPAFQYDEPFDPLIQKCTMCHPRIQEGKLPGCVEACPKEALTFGKREDLVRIAHDRIRSNPGRYQDHVYGELEMGGTAWMYLAGVPFEAVGQQEMGTKSAPEYTAGALGSVPMVVGIWPVLLTGAYAISKRKEKVAAEEREEAVQAALAKARDDAAKAMDTALAKAAKEKDAAVTREVKKAMEQAEQAFEEKFAALRAEGQTAENGDDGEGKEDA

SEQ ID NO: 67925 - DNA, 1104 bp, Desulfovibrio desulfuricans
  CDS (1)..(1104): transl_table=11
atgaaacgcagaacatttctgaccattctgggaagcgcgggcgtggtctcggcccttggctcagccaaggtggcccaggccggcccccataccttcccatattacgcagacagttacggggtgctgcacgacaccacccgttgcatcggttgccgcaagtgtgaagaggcctgcaacaaggtcaaccacctgcccaaacccaaaaaacccttcagcgaccttacggtgtgcgacacgcaccgccgcacgggcgaatatgaatggaccgtggtgaacaagtacaaggtcaacggcaaggacgtattccgcaagctgcagtgctttcactgcaacgacccggcctgcgcttccgcctgctttgccaagtgctttaccaagcagcccaacggcgctgttcactacgaaggctcacagtgcgtgggctgccgttactgcatggtcgcctgccccttctatgttcccggcttccagtacgatgaggcctttgaccccctcgtgcaaaagtgcaccttctgcgagccgctgctcaaggaaggcaagctgcccggctgtgtgcaggcctgccccaaggacgccctcaccttcggccgccgcagcgacctgatccgagtggcccgcgcccgcattgccgataatcccggcaagtacgtcaactacctctatggcgagtttgacgcaggcggcactgcctggatggtgctcagccccgcagtgggacaggcagccgcggctgttccggcggatgatgctccgctggctggcgatgaactgaagcagctcggccttgatacccatctcggcaaccgccccatgggcgagctgacctacggcgctctgggcgcagtgcctatgatcgtggccttctggcccgtgctcttcggcggtgcttacgccatcagcaaacgtcgcgaagccatgtacaaggctgaaacggatggcaaggtcaaggaggcccgtgaagacgtggccgccgccgttgacgccgccgtacgcaaaattgaggaaacccaggggccgggcgctgccgatacggcccgccgcgccatgacagaggccctcaaggcccgcgaaacggcgtgcacggggcacggggaggataagtaa

SEQ ID NO: 67926 - protein, 367 aa, Desulfovibrio desulfuricans
MKRRTFLTILGSAGVVSALGSAKVAQAGPHTFPYYADSYGVLHDTTRCIGCRKCEEACNKVNHLPKPKKPFSDLTVCDTHRRTGEYEWTVVNKYKVNGKDVFRKLQCFHCNDPACASACFAKCFTKQPNGAVHYEGSQCVGCRYCMVACPFYVPGFQYDEAFDPLVQKCTFCEPLLKEGKLPGCVQACPKDALTFGRRSDLIRVARARIADNPGKYVNYLYGEFDAGGTAWMVLSPAVGQAAAAVPADDAPLAGDELKQLGLDTHLGNRPMGELTYGALGAVPMIVAFWPVLFGGAYAISKRREAMYKAETDGKVKEAREDVAAAVDAAVRKIEETQGPGAADTARRAMTEALKARETACTGHGEDK

SEQ ID NO: 67927 - DNA, 807 bp, Chromatium vinosum
  CDS (1)..(807): transl_table=11
atgaacgagaacacaaccaatatcgacgccaatgccaagactgaggcggtcgaggccatcgacgccggacgtcgcggcttcatcggcaccgccgccggattgagcgccgccgccctggtggcgccgggcgtttttctgcacagcgtcgcggccgcgccgcgtaccgagccggtcacgggcgatgtgcgctggggcctgctgatcgacacggccaagtgcgccgacggctgttcggcctgtgtcgacgcctgcgaccgtgaaaacggcctggatctccaggaaccgcacggctccgagtccaagtgggagcatcagaagtcggtctggatccgcaaggtcaagctccaggacaaccagaccgggcgcatcacccagctcccgctgatgtgtcagcactgcgagcatccgccctgtgtcgacgtctgcccgaccggcgcctccttcaaacgcgccgacggcatcgtcatggtcgaccgccatctgtgcatcggctgtcgttactgcatgatggcctgcccctacaaggcgcgcagcttcatccatcagccgacgaccggccagttgaccgccgtgccgcgcggcaagggctgtgtcgagagctgcaatctgtgcgtgcaccggcgtgacaacggcgaggaatcgaccgcgtgcgtcgatgcctgcgcgcaggaagggcacggggccatcgtcttcggcgatctcaaggatcccgacagcgccatcagccagcgtctgcgcgagatcccgagccggcagatccgcgaggatctggtgttgaacacgggcgtgcgttacgccggcgtctga

SEQ ID NO: 67928 - protein, 268 aa, Chromatium vinosum
MNENTTNIDANAKTEAVEAIDAGRRGFIGTAAGLSAAALVAPGVFLHSVAAAPRTEPVTGDVRWGLLIDTAKCADGCSACVDACDRENGLDLQEPHGSESKWEHQKSVWIRKVKLQDNQTGRITQLPLMCQHCEHPPCVDVCPTGASFKRADGIVMVDRHLCIGCRYCMMACPYKARSFIHQPTTGQLTAVPRGKGCVESCNLCVHRRDNGEESTACVDACAQEGHGAIVFGDLKDPDSAISQRLREIPSRQIREDLVLNTGVRYAGV

SEQ ID NO: 67929 - DNA, 966 bp, Rhodocyclus gelatinosus
  CDS (1)..(966): transl_table=11
atgagccgccagcccgattccgatccgccggatcgcgacggccaaggtttcaacaccttccgccgccgtttcctcgccggcgtcgccaccgccggcggcgccgtcgtcaccgcccacgccaccggcgcctggggcggccagacgctgcaggacgcgatgggcagcctgctgcaggaccactaccagcgcatgacgaaggacgagatccacgccgcgctggaacgcatcgagcgcaacgcccgccgccgctacggtgtcgacgcgcgctgcgaggacctgccgccgctgccgaacaccgtcttcggctacgcgctgaacatcagcaagtgcaagggctaccgcgactgcgtcgaggcctgcgtcaaggagaacaacctcggccgcgactcgcagatgcagtacatccgcgtgctgcagatgcccgacggcacgatggacctggagaaggccgagcactactacgacgccaagcaggtcccggtgcccggccactggtacctgccggtgcagtgcatgcagtgcgacaacccgccctgcgtgaaggcctgcccgacgaaagccacctggaaggagcccgacggcatcgtcgtcgtcgactacgactggtgcatcggctgccgctactgcatgacggcctgcccgtactgggcgcgccacttcaactggaccgagccgcagatcccggcggccgagttcaacccgaacctcaactacctgggcaaccggccgcgccccaagggcgtcgtcgagaagtgccacttctgcagccagcgcgcgcgcaagggccgccagcccgcctgccaggaagcctgcccgaccggcgcacgcgtcttcggcaacctgctcgacccgaaaagcgagatccgctgggtgctcgagaacaagaacgtcttccggctgaaggaggacctcggcaccgagccgaagttctggtacttcagcgacgaccgggtgagtcgggcatga

SEQ ID NO: 67930 - protein, 321 aa, Rhodocyclus gelatinosus
MSRQPDSDPPDRDGQGFNTFRRRFLAGVATAGGAVVTAHATGAWGGQTLQDAMGSLLQDHYQRMTKDEIHAALERIERNARRRYGVDARCEDLPPLPNTVFGYALNISKCKGYRDCVEACVKENNLGRDSQMQYIRVLQMPDGTMDLEKAEHYYDAKQVPVPGHWYLPVQCMQCDNPPCVKACPTKATWKEPDGIVVVDYDWCIGCRYCMTACPYWARHFNWTEPQIPAAEFNPNLNYLGNRPRPKGVVEKCHFCSQRARKGRQPACQEACPTGARVFGNLLDPKSEIRWVLENKNVFRLKEDLGTEPKFWYFSDDRVSRA

SEQ ID NO: 67931 - DNA, 618 bp, Escherichia coli; identical to SEQ ID NO: 67749
  CDS (1)..(618)

SEQ ID NO: 67932 - protein, 205 aa, Escherichia coli; identical to SEQ ID NO: 67750

SEQ ID NO: 67933 - DNA, 618 bp, Haemophilus influenzae
  CDS (1)..(618): transl_table=11
atggaacaatatggtttttattttgattctgaacgttgcacaggctgtaaaacttgtgaattagcctgtaaggattacaaagatcttggcacagaagtcaattttcgtcgtatttatgaatatacaggtggtcagtggaatcaacaagcagatggatgctggcatcaaaatatatttgcctattatatgtctatttcttgtaatcattgtgcagatcctgcttgtacaaaagtttgcccaactggtgcaatgcacaaaaatgcagatggtttcgtgatcgtcaatgaagaaatttgtatcggttgtcgttattgtcatatggcgtgtccttatgatgcaccgcaatatgatgcacaaaaaggtcatatgacaaaatgtgatggatgttattctcgcgtaaaatcaggtcaaaaaccgatttgtgttgatgcctgcccactacgagcattggatttcgctcctattgatgaacttcgaacaaaatatggcacacaagcctccatcgcaccactaccaccgactgatatcactcaaccaaatttagtggtaaaacccaataaatacgctcgtttaagtggcgatacaagtgggttcttaggaaacccaagagaggtgtaa

SEQ ID NO: 67934 - protein, 205 aa, Haemophilus influenzae
MEQYGFYFDSERCTGCKTCELACKDYKDLGTEVNFRRIYEYTGGQWNQQADGCWHQNIFAYYMSISCNHCADPACTKVCPTGAMHKNADGFVIVNEEICIGCRYCHMACPYDAPQYDAQKGHMTKCDGCYSRVKSGQKPICVDACPLRALDFAPIDELRTKYGTQASIAPLPPTDITQPNLVVKPNKYARLSGDTSGFLGNPREV

SEQ ID NO: 67935 - DNA, 618 bp, Shigella flexneri; identical to SEQ ID NO: 67547
  CDS (1)..(618)

SEQ ID NO: 67936 - protein, 205 aa, Shigella flexneri; identical to SEQ ID NO: 67548

SEQ ID NO: 67937 - DNA, 603 bp, Wolinella succinogenes
  CDS (1)..(603): transl_table=11
atggaaagtcaagctagagtcaagttctattgtgatgaggctagatgtattgattgtcatggatgtgatgtggcttgtaaagaggcccatcaccttcctgtgggagtcaaccgaagaagagtggtgaccctcaatgaaggtcttgtaggcaaagagaaatccctctctattgcctgcatgcactgctctgatgccccttgtgctcaggtctgcccagtggactgcttctatgttcgagccgatgggattgtattgcatgacaaagagaagtgcattggatgcggttactgcctctatgcctgcccctttggtgctcctcaattccccaagagtggaatctttggttcaagaggacctatggataagtgcaccttctgtgctggaggtcctgaagagactcacagcgagaaggagtataagctctatggacagaatcgtatcgctgagggcaaagtccctgtatgtgcagcgatgtgctccaccaaggcactcctagcaggagattctgatagcatctcgctcatcattcgtgagagagtgctcaagcgaggcagtggaacagccagtgttccttacacctggtcacaagcctacaaggattaa

SEQ ID NO: 67938 - protein, 200 aa, Wolinella succinogenes
MESQARVKFYCDEARCIDCHGCDVACKEAHHLPVGVNRRRVVTLNEGLVGKEKSLSIACMHCSDAPCAQVCPVDCFYVRADGIVLHDKEKCIGCGYCLYACPFGAPQFPKSGIFGSRGPMDKCTFCAGGPEETHSEKEYKLYGQNRIAEGKVPVCAAMCSTKALLAGDSDSISLIIRERVLKRGSGTASVPYTWSQAYKD

SEQ ID NO: 67939 - DNA, 939 bp, Haemophilus influenzae
  CDS (1)..(939): transl_table=11
atggctggaactgctcaaggcgttcaaacgcaagacgttattaaaatctccgcaacatctggtttaacaccagcaccacaagcgagagatcataaagttgaaatcgcaaaattaattgatgtttcaacttgtataggatgtaaagcctgtcaagtgggttgttcagagtggaatgatattcgctctgatatcaatgcacaatgtgttggggtttatgacaatccagttgatcttgatgcaaaagcatggacagtgatgcgttttaacgaagttgaagaaaacgatcgtttagaatggctgattcgtaaagatggctgtatgcactgcacagaacctggttgtttaaaggcttgtcctgcacccggtgcaatcattcaatatgctaacggtattgtagatttccaatccgataaatgtattggttgtggttattgtattgcaggctgtccattcaatattccacgaatgaatcctgaagacaatcgtgtatacaaatgtactctttgtgtagatcgtgtttctgtgggacaagagcccgcttgcgtgaaaacctgtccaacaggtgctattcgtttcggctctaaagaagaaatgaaaatttacgcagaacaacgcgtggcagatttaaaatcccgtggttatgaaaacgcaggactttacgatcctccaggtgtaggcggtacacacgtaatgtatgtgttgcatcacgcagataaacctgagctttacaatggtcttccaaaagatcctcaaattgatttgagtgtgaccttatggaaagatgtattgaaaccagtcgctgcagttgcaatgggtggtctagctctagcagaagttgcgcactacttaaccgttggcccaaatgtagaagaagatgtggaagatcatcatcacgaatttgaagaaaataaaccatctaagggggaaaataatgagtaa

SEQ ID NO: 67940 - protein, 312 aa, Haemophilus influenzae
MAGTAQGVQTQDVIKISATSGLTPAPQARDHKVEIAKLIDVSTCIGCKACQVGCSEWNDIRSDINAQCVGVYDNPVDLDAKAWTVMRFNEVEENDRLEWLIRKDGCMHCTEPGCLKACPAPGAIIQYANGIVDFQSDKCIGCGYCIAGCPFNIPRMNPEDNRVYKCTLCVDRVSVGQEPACVKTCPTGAIRFGSKEEMKIYAEQRVADLKSRGYENAGLYDPPGVGGTHVMYVLHHADKPELYNGLPKDPQIDLSVTLWKDVLKPVAAVAMGGLALAEVAHYLTVGPNVEEDVEDHHHEFEENKPSKGENNE

SEQ ID NO: 67941 - DNA, 1113 bp, Desulfovibrio vulgaris
  CDS (1)..(1113): transl_table=11
atggatcgcagaagattcctgaccctgctgggaagcgccggccttaccgccacagtggccacggcgggcacggccaaggccgcgtccacgggcaccttcccgggatacaaggacagctacggggtgctgcacgacaccacccgttgcatcggttgccgcaagtgcgagcaggcctgcaacgaagtgaacaagctccccgcccccaaggccaagttcgacgacctgacggttctcgaaaagacgcgtcgcaccgacgccgactcgtggaccgtggtcaacaggtacaacgctgccgggctcgaccatccggtcttccgcaagcagcagtgcaaccactgtctcgaaccggcctgcgcctcggcgtgtttcgtcaaggccttcaccaagaaccccgacggctccgtcacctatgacggcagcctctgcgtcggctgtcgctactgcatggtcgcctgcccgttcaacgtgccggccttccagtacgccgaagccttcgacccgctcatccagaagtgcaccatgtgccacccgcgtctggccgagggcaagctccccggctgcgtcgagatatgcccgaaggaggccctcaccttcggtcgccgcaaggacctcgtgcgcatcgcccatgaccgcatccgccagaaccccggtcgttacatcgaccacgtgtacggcgaacaggaaatgggcggcaccgcgtggatgtacctctcgggcgtgcccttctccgcgaccggcatgaacgaggaactcggcaccaagtcggcccctgaatacaccgcaggcgcactgggtgccgtgcccatggtcgttggcatctggcccatccttctgacgggtgcctatgccatcaccaagcgcaaggaaaagatcgccgccgaagagcaggccgaagccgtgaagcaggccgttgctgcaagccgcgccgaagccgacgacaagctcaaggctgcccttgccaaggccgacaaggacaaggaggccgccgtcacccgcgaggtgaagaaggccgtcgacgaagcgcgcaagaccttcgaggaggaactggcagcgaaagagcagcccgaagcccccgaaggcgacgacgccggcaagcccggggaggatgcgtag

SEQ ID NO: 67942 - protein, 370 aa, Desulfovibrio vulgaris
MDRRRFLTLLGSAGLTATVATAGTAKAASTGTFPGYKDSYGVLHDTTRCIGCRKCEQACNEVNKLPAPKAKFDDLTVLEKTRRTDADSWTVVNRYNAAGLDHPVFRKQQCNHCLEPACASACFVKAFTKNPDGSVTYDGSLCVGCRYCMVACPFNVPAFQYAEAFDPLIQKCTMCHPRLAEGKLPGCVEICPKEALTFGRRKDLVRIAHDRIRQNPGRYIDHVYGEQEMGGTAWMYLSGVPFSATGMNEELGTKSAPEYTAGALGAVPMVVGIWPILLTGAYAITKRKEKIAAEEQAEAVKQAVAASRAEADDKLKAALAKADKDKEAAVTREVKKAVDEARKTFEEELAAKEQPEAPEGDDAGKPGEDA

SEQ ID NO: 67943 - DNA, 810 bp, Archaeoglobus fulgidus
  CDS (1)..(810): transl_table=11
atgatgtcgagaagaaaatttctgttgctaacgggagcagcagcagcgggagctattttaactccgcaaatctcagcaaaaacacagttcatcgaatctcctgaggaggtcagagagaagagaagatgggccatggccgttgacgttgaaaggtgcacgcagtgcatggaggagcttatcgcaaaaactggcgacgagaagataaagccaccgtgcgttgttgcatgcgacaaagaaaacaacgttccagagtttgaggaagagagatttgaccctcagtggatgaggatagcgaaactgaagctcgataagcctgaagtgaatcctaaagagtactacatccctctgctctgcaaccactgcgagcacccaccatgtgttcaggtctgccttacaaaggcgagcttcaagagacccgatggcattgttgagatagacatgcaccgttgcatcggctgcagatactgcatgattgcctgtccctacggggcgagatgcttcaacttcattgatccaagagaggggctgaaggaggtaaatccgaacgtccagatgagaacagaaggtgtggtggagaagtgtactttctgcgtccacaggattgatgaggctgtgaagaagggtgaggagccgattccggcatgcgttgaggcctgccacaagtacgggaaaggagcgctggtgtttggaaatattaaagatccaaacagcgagatttcaaagattctcagggaaaatatcgtcgttcagctcagggcaaatcttggcacagatccgcacgttttctacgccaagctggggggtgagtaa

SEQ ID NO: 67944 - protein, 269 aa, Archaeoglobus fulgidus
MMSRRKFLLLTGAAAAGAILTPQISAKTQFIESPEEVREKRRWAMAVDVERCTQCMEELIAKTGDEKIKPPCVVACDKENNVPEFEEERFDPQWMRIAKLKLDKPEVNPKEYYIPLLCNHCEHPPCVQVCLTKASFKRPDGIVEIDMHRCIGCRYCMIACPYGARCFNFIDPREGLKEVNPNVQMRTEGVVEKCTFCVHRIDEAVKKGEEPIPACVEACHKYGKGALVFGNIKDPNSEISKILRENIVVQLRANLGTDPHVFYAKLGGE

SEQ ID NO: 67945 - DNA, 987 bp, Escherichia coli O157
  CDS (1)..(987)
atgaacagacgtaattttattaaagcagcctcctgcggggcattgctgacgggcgcgctgccgtctgtcagtcatgcggctgctgaaaaccgcccgccaattccgggatcgctggggatgttgtacgactcgaccttgtgcgtaggctgccaggcttgcgtcaccaagtgtcaggatatcaacttccctgaacgtaacccgcaaggggaacagacctggtcgaacaacgacaaactgtcgccgtataccaataacatcattcaggtgtggaccagcggcacaggggtcaacaaagaccaggaggagaacggctacgcgtacattaagaaacagtgtatgcactgcgtcgatccgaactgtgtctctgtgtgcccggtctctgcactgaaaaaagatccgaaaaccggcattgtccattacgacaaagacgtgtgcaccggttgccgttactgcatggtcgcctgtccgtacaacgtgccgaagtacgactacaacaacccgtttggtgcgctgcataagtgcgagctgtgcaaccagaaaggtgtggaacgtctcgataaaggcggtctgcctggctgcgtagaagtgtgcccggcgggcgcggtgattttcggtacgcgtgaagagctgatggcggaggcgaaaaaacgtctggcgctgaagcctggcagcgaataccactatccgcgtcagacgctgaaatctggcgacacttacctgcatacggtgccgaaatattatccgcatctgtacggcgagaaagagggcggcggtactcaggttctggtactgacgggtgtgccttatgaaaatctcgacctgccgaaactggacgatctttctaccggtgcgcgttccgaaaatattcaacacaccctgtataaaggcatgatgctaccactggctgtgctggcgggcttaaccgtgctggttcgtcgcaacaccaaaaacgaccatcacgacggaggagacgatcatgagtcatga

SEQ ID NO: 67946 - protein, 328 aa, Escherichia coli O157
MNRRNFIKAASCGALLTGALPSVSHAAAENRPPIPGSLGMLYDSTLCVGCQACVTKCQDINFPERNPQGEQTWSNNDKLSPYTNNIIQVWTSGTGVNKDQEENGYAYIKKQCMHCVDPNCVSVCPVSALKKDPKTGIVHYDKDVCTGCRYCMVACPYNVPKYDYNNPFGALHKCELCNQKGVERLDKGGLPGCVEVCPAGAVIFGTREELMAEAKKRLALKPGSEYHYPRQTLKSGDTYLHTVPKYYPHLYGEKEGGGTQVLVLTGVPYENLDLPKLDDLSTGARSENIQHTLYKGMMLPLAVLAGLTVLVRRNTKNDHHDGGDDHES

SEQ ID NO: 67947 - DNA, 678 bp, Haemophilus influenzae
  CDS (1)..(678): transl_table=11
atgacagtctgctcacgccgaaactttgtttctggcatgggggcagtgatccttatgacggggacatctttacctgcttttgcaaaagaaaacaaggcagataaacctaaacgttacgcaatgatacatgatgaaaatgcgtgtatcggttgtacagcctgtatggactcatgtcgtgatgtaaaccaagtgccagaaggcgtttctcgcttagagattctacgtagtgaaccttatggggaatttccaaatcaagaatacgagttctttcgtcaatcttgccaacattgtacaaatgcaccttgtgtagcagtttgtccaactggtgcatcttttattgataaagagactggcattgtagatgtacataaagatttatgcataggctgccaatactgtatagcagtttgcccatatcgtgtacgttttattcatccaatacatcgtaccgcagataaatgtaacttctgccgcgatacaaatttagccaatggtaaacaacctgcttgtgtagaggcttgcccaaccaaagcattaacctttggggatatgaatgatccaacaagtgcagtttcacgtaaagtgaaagaaaaaccggtttatcgcactaaagtggaattaggtacacaaccaaacttatatcacattccattccaacatggggagcctagaagatga

SEQ ID NO: 67948 - protein, 225 aa, Haemophilus influenzae
MTVCSRRNFVSGMGAVILMTGTSLPAFAKENKADKPKRYAMIHDENACIGCTACMDSCRDVNQVPEGVSRLEILRSEPYGEFPNQEYEFFRQSCQHCTNAPCVAVCPTGASFIDKETGIVDVHKDLCIGCQYCIAVCPYRVRFIHPIHRTADKCNFCRDTNLANGKQPACVEACPTKALTFGDMNDPTSAVSRKVKEKPVYRTKVELGTQPNLYHIPFQHGEPRR

SEQ ID NO: 67949 - DNA, 579 bp, Salmonella typhi
  CDS (1)..(579): transl_table=11
atgaatcatttaacgaatcagtacgtcatgctgcatgatgaaaaacgttgtatcggctgccaggcgtgtaccgttgcctgcaaagtgcttaatgacgtaccggagggatttagccgcgtacaggtacaaattcgcgcccctgaacaggcatccaacgcactaacccattttcaatttgtccgcgtctcctgtcagcactgtgaaaatgcgccatgtgtcagcgtttgtcctaccggagcgtcatatcgtgatgaaaacgggatcgtgcaggtggataaatcgcgctgtattggctgcgattattgtgttgccgcgtgtcctttccatgtgcgctatctgaatccgcaaaccggcgtcgccgacaagtgtaacttctgtgccgacacgcggttggcggctggccagtctccggcgtgcgtatccgtttgcccaacggacgcgctgaaattcggcagactggatgagagcgagatccagcgctgggtcggtcagaaagaggtctatcgccagcaggaagcgcgtagcggcgcggtcagtctgtaccgtcgtaaagaagtccatcaggagggtaaagcatga

SEQ ID NO: 67950 - protein, 192 aa, Salmonella typhi
MNHLTNQYVMLHDEKRCIGCQACTVACKVLNDVPEGFSRVQVQIRAPEQASNALTHFQFVRVSCQHCENAPCVSVCPTGASYRDENGIVQVDKSRCIGCDYCVAACPFHVRYLNPQTGVADKCNFCADTRLAAGQSPACVSVCPTDALKFGRLDESEIQRWVGQKEVYRQQEARSGAVSLYRRKEVHQEGKA

SEQ ID NO: 67951 - DNA, 576 bp, Wolinella succinogenes
  CDS (1)..(576): transl_table=11
atggcaaaaaaatatggaatgatccacgatgagaatctatgcatcggttgccaagcgtgcaatatcgcctgtcgatctgaaaacaagattcctgatagtgtttaccgattgcaagtctgggtgcagggccccaagaagctacctgatggaacactcagcttcaactatcaccgacaatcttgcgttcagtgtgaaaacaccccctgcgtgagtgtctgccccaccaaggcctcttacgtgaatgaagatgggattgtgagcgtcaatgtcgatctttgcgttggatgcctctattgcatcgcggcgtgtccctatcaggcgcgatatgtggatcctgtgaccaaggctcccgataagtgcaacttctgtaaagatacgcgtctagcgcgtggcgaagagcctgcgtgtgtgaccgtctgccctacagatgcgcttacttttggtgatatgagtgatcccaaaagcaaaatcaataaagtgttggcgtccaagccgacccttcgccccaaagaatccttgggaactaaacccaagctctttatcgtgcctaacaagagaggaggaatcgagtcatga

SEQ ID NO: 67952 - protein, 191 aa, Wolinella succinogenes
MAKKYGMIHDENLCIGCQACNIACRSENKIPDSVYRLQVWVQGPKKLPDGTLSFNYHRQSCVQCENTPCVSVCPTKASYVNEDGIVSVNVDLCVGCLYCIAACPYQARYVDPVTKAPDKCNFCKDTRLARGEEPACVTVCPTDALTFGDMSDPKSKINKVLASKPTLRPKESLGTKPKLFIVPNKRGGIES

SEQ ID NO: 67953 - DNA, 618 bp, Escherichia coli O6
  CDS (1)..(618)
atgaccacacaatatggattttttatcgattccagccgctgcactggctgtaaaacctgcgaactggcgtgcaaagattttaaagatcttggcccggaagtcagtttccgccgtatttatgaatatgctggcggcgactggcaggaagataatggcgtctggcaccagaacgtgttcgcttattatctctccatctcctgtaaccattgcgatgaccccgcatgtacaaaagtctgccccagcggcgcaatgcataagcgtgaagatggctttgtggtggttgatgaagatgtttgtatcggctgccgctactgccacatggcttgtccgtacggcgcgcctcagtacaatgctgaaaaaggacacatgacgaagtgcgatggttgttattcgcgcgtcgccgaggggaaacaacccatatgtgtcgaatcctgcccgctgcgtgcacttgagttcggtccaattgaagagctgcgccagaagcacggcactcttgctgccgtcgcgccactgccgcgcgcgcatttcacaaaacccaatatcgttatcaaacctaacgccaacagccgcccgaccggcgataccactggttatctggctaatccggaggaagtgtaa

SEQ ID NO: 67954 - protein, 205 aa, Escherichia coli O6; identical to SEQ ID NO: 67522

SEQ ID NO: 67955 - DNA, 19 bp, Artificial sequence
  (1)..(19): primer
atgacctggtctcgtcgcc

SEQ ID NO: 67956 - DNA, 25 bp, Artificial sequence
  (1)..(25): primer
ttattggctcacctccccgtattta

SEQ ID NO: 67957 - protein, 279 aa, Artificial sequence
  Variant (2)..(4): xaa in position 2 to 4 is any amino acid
  Variant (6)..(6): xaa in position 6 is any amino acid
  Variant (8)..(8): xaa in position 8 is any amino acid
  Variant (9)..(21): xaa in position 9 to 21 is any or no amino acid
  Variant (23)..(24): xaa in position 23 to 24 is any amino acid
  Variant (26)..(28): xaa in position 26 to 28 is any amino acid
  Variant (30)..(42): xaa in position 30 to 42 is any amino acid
  Variant (43)..(116): xaa in position 43 to 116 is any or no amino acid
  Variant (118)..(118): xaa in position 118 is any amino acid
  Variant (121)..(124): xaa in position 121 to 124 is any amino acid
  Variant (125)..(127): xaa in position 125 to 127 is any or no amino acid
  Variant (129)..(131): xaa in position 129 to 131 is any amino acid
  Variant (134)..(135): xaa in position 134 to 135 is any amino acid
  Variant (137)..(141): xaa in position 137 to 141 is any amino acid
  Variant (142)..(143): xaa in position 142 to 143 is any or no amino acid
  Variant (145)..(145): xaa in position 145 is any amino acid
  Variant (147)..(152): xaa in position 147 to 152 is any amino acid
  Variant (154)..(154): xaa in position 154 is any amino acid
  Variant (157)..(158): xaa in position 157 to 158 is any amino acid
  Variant (160)..(162): xaa in position 160 to 162 is any amino acid
  Variant (165)..(177): xaa in position 165 to 177 is any amino acid
  Variant (178)..(229): xaa in position 178 to 229 is any or no amino acid
  Variant (232)..(233): xaa in position 232 to 233 is any amino acid
  Variant (235)..(237): xaa in position 235 to 237 is any amino acid
  Variant (238)..(261): xaa in position 238 to 261 is any or no amino acid
  Variant (263)..(263): xaa in position 263 is any amino acid
  Variant (265)..(267): xaa in position 265 to 267 is any amino acid
  Variant (269)..(270): xaa in position 269 to 270 is any amino acid
  Variant (271)..(274): xaa in position 271 to 274 is any or no amino acid
  Variant (276)..(278): xaa in position 276 to 278 is any amino acid
DXXXCXGXXXXXXXXXXXXXXCXXCXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXCXHCXXXXXXXCXXXCPXXAXXXXXXXGXVXXXXXXCXGCXXCXXXCPXXXXXXXXXXXXXXXXXXXXXXXXXXXXXXXXXXXXXXXXXXXXXXXXXXXXXXXXXXXXXXXXXKCXXCXXXXXXXXXXXXXXXXXXXXXXXXXXXPXCXXXCXXXXXXAXXXG

SEQ ID NO: 67958 - protein, 47 aa, Artificial sequence
  Variant (2)..(2): xaa in position 2 is any amino acid
  Variant (5)..(6): xaa in position 5 to 6 is any amino acid
  Variant (7)..(7): xaa in position 7 is any or no amino acid
  Variant (9)..(9): xaa in position 9 is any or no amino acid
  Variant (11)..(13): xaa in position 11 to 13 is any amino acid
  Variant (16)..(24): xaa in position 16 to 24 is any amino acid
  Variant (25)..(25): xaa in position 25 is any or no amino acid
  Variant (27)..(34): xaa in position 27 to 34 is any amino acid
  Variant (36)..(36): xaa in position 36 is any amino acid
  Variant (38)..(38): xaa in position 38 is Cys or Thr
  Variant (39)..(40): xaa in position 39 to 40 is any amino acid
  Variant (42)..(43): xaa in position 42 to 43 is any amino acid
  Variant (44)..(44): xaa in position 44 is Ala, Gly, Asn, Ser or Val
  Variant (47)..(47): xaa in position 47 is Phe, Trp or Tyr
CXHCXXXPXCXXXCPXXXXXXXXXXGXXXXXXXXCXGXXXCXXXCPX

SEQ ID NO: 67959 - protein, 15 aa, Artificial sequence
  Variant (2)..(2): xaa in position 2 is any amino acid
  Variant (4)..(6): xaa in position 4 to 6 is any amino acid
  Variant (8)..(10): xaa in position 8 to 10 is any amino acid
  Variant (11)..(11): xaa in position 11 is Ala, Cys, Ser or Thr
  Variant (12)..(14): xaa in position 12 to 14 is any amino acid
PXCXXXCXXXXXXXG

SEQ ID NO: 67960 - DNA, 1659 bp, Escherichia coli
  CDS (1)..(1659)
atgttgaccccgttgacggccttcgcgggagtgcggttgcgctggcctgccatgatgcgactcacttgcatcggcattctggcgcagttcgcgctcctgctgctcgcctttggcgtactgacgtattgttttctcatcagcgatttctcggtcatttatgtcgcgcaacatagctatagcctgctgtcgtgggaactcaagctggcagcggtgtggggcggccatgaaggttcgctgctgctttgggtgctgctgctttccgcctggagcgcgctgtttgcctggcattatcggcagcaaaccgatccgctatttccgctgacgttagccgttttatctctcatgctcgccgcactgctactgtttgtggtgctgtggtccgatcccttcgtgcggatatttccaccagcaatcgaaggccgcgatctcaatccgatgctgcaacatcccggtcttatctttcatccaccgctgctttaccttggctatggcggtttgatggtagcggcgagcgtggcgctggcgagtctactgcgcggcgagtttgatggtgcctgcgcccgaatttgctggcgctgggcgttacctggctggagtgcattaacggcggggatcatcctcggttcctggtgggcctactgcgaactcggctggggcggctggtggttctgggatccggtggaaaacgcctctttattaccctggctttctgccactgcgctgctgcacagtttgtccctgacacgccagcgggggattttttgccactggtcgctgttgctggcgatagttactctgatgctgtcgctgctgggcaccttaattgtccgttctggcattctggtttcggttcatgcgttcgcgctggataacgtccgcgccgtgccgttgttcagcctgtttgcactgattagccttgcgtctctggctctgtatggctggcgagcgcgggacggtggcccggcggtgcatttttcggggttatcgcgggaaatgttaatcctcgctacgctgttgctgttttgcgcagtgctactgatcgtgctggtgggaacgctttatccgatgatttacggcctgctgggctggggacgcctctccgttggcgcgccgtattttaaccgcgcgacgttaccgtttggtctgttgatgctggtggtgattgtgctggcgacgtttgtctctggcaaacgcgtgcagcttccggcgctggtagctcatgcgggcgtgctgttatttgccgctggggtcgtggtctccagcgtcagccgtcaggagatcagcctgaatttacagccgggtcagcaggtgacgctggcaggatacaccttccgttttgagtgcctcgatctacaagccaaaggcaattacaccagcgaaaaagcgatagtggcactgtttgaccatcagcaacgcattggtgaactgacgccggagcggcgtttttatgaagcacgccgtcaacaaatgatggaaccgtcaattcgctggaacggcatccatgactggtatgcggtcatgggggagaaaactgggccggatcgttacgcttttcgtttgtatgtacaaagcggtgtgcgctggatctgggggggaggattgttgatgattgcgggcgcattgttaagcggatggcgggggaagaagcgcgatgaataa

SEQ ID NO: 67961 - protein, 552 aa, Escherichia coli
MLTPLTAFAGVRLRWPAMMRLTCIGILAQFALLLLAFGVLTYCFLISDFSVIYVAQHSYSLLSWELKLAAVWGGHEGSLLLWVLLLSAWSALFAWHYRQQTDPLFPLTLAVLSLMLAALLLFVVLWSDPFVRIFPPAIEGRDLNPMLQHPGLIFHPPLLYLGYGGLMVAASVALASLLRGEFDGACARICWRWALPGWSALTAGIILGSWWAYCELGWGGWWFWDPVENASLLPWLSATALLHSLSLTRQRGIFCHWSLLLAIVTLMLSLLGTLIVRSGILVSVHAFALDNVRAVPLFSLFALISLASLALYGWRARDGGPAVHFSGLSREMLILATLLLFCAVLLIVLVGTLYPMIYGLLGWGRLSVGAPYFNRATLPFGLLMLVVIVLATFVSGKRVQLPALVAHAGVLLFAAGVVVSSVSRQEISLNLQPGQQVTLAGYTFRFECLDLQAKGNYTSEKAIVALFDHQQRIGELTPERRFYEARRQQMMEPSIRWNGIHDWYAVMGEKTGPDRYAFRLYVQSGVRWIWGGGLLMIAGALLSGWRGKKRDE

SEQ ID NO: 67962 - DNA, 1980 bp, Gluconobacter oxydans 621H
  CDS (1)..(1980)
atgttcggacctgaacagggccatttcgccctggccctcgcctgcgtgctcgccctcgtgcagttcgccgtcccgctctggggcgcaaaccgccgcgatgcccgcctcgtggggctcgcgccctatctcgcggtctcgcagcttatcgcgctgggctattcgttcctgtgcctcgtgatgtgcgccgtcagcgacgatttctcggtccagaacgttgcagcaaactctgccgtctccaagccgctcctgtataaaatcacgggcgtctggggaaaccacgaaggctcggtcctgctctggacgctgatccttgccgtctgcggcggtgcggtctcgctgttcggccgtaacctgccagacatcctgcgcggacgcgttctggccattctcggcggtgtctccgccgggttccagatgttctgcctcctgacctccgatccgttcgaccgcgtcttcccggcaccgatggacggtcagggcatgaacccgctcctgcaggatccgggtctcgccttccacccccccattctctacaccggctatgtcggtttcgccgtccccttcgccttcgccgtcgcggctctgatcgaaggccgcgtcgatgccgcatggggccgctgggtccgtccctgggccgtggcggcctggtgcttcctgacctgcggcatcgcgctgggctcctggtggtcctattatgtgctgggctggggcgggtactggttctgggatccggtggaaaacgcctccctcattccctggctgacgggcacggccctcgtgcattccgccatcgtcgtggaaaagcgcgaaggcctgaaaatctggacggtcctgctggctatcgcgaccttctcgttctcactgtccggcaccttcctcgtccgctcgggcatcctgaactcggtccacgccttcgccaacgatcccgcacgcggcgtgttcatcctggccctgctcgccatcgtcatcggcggttcgcttgccctatttgcttggcgcgccccgtccctcacctcgaccggcctgttttcgccgatctcccgtgaaggctcgttggtcctgaacaacatcctgctgtgctcgatctgcgccgtggtcgtgacgggcacgatgtatccgcccttcatgcagcttctggccggccgtaccatttccgtcggcaagccgttctttgacgccgccacgatcccgctgaccctgccgctcctgctggccatgggtgttggcaccgccctgccgtggaaacgcgcacagctcgcccggaccttctcgcatctctatgccgccgccggcatcgccgcgatcgggctggtcctgtgcttctggaagctctccggtgtcctgcccatcgcctgcggcgcgctggccatctgggtcatcgcggcttccgcttccgacgtcctgcgccggatcggcattggccacacctccgcacagggcgtgtgggagcgcatgaagcacctgccgcgttcaagctggggcgcggctctcgcccatatcggcgcaggcatcaccgtgcttggtctgtgtggcatgtcgcaggcgcagcacgccatcgtcgaagtccatattggcgagacccgctcgctggccggcgacgactggaccctgctcgacgtgcacgactatatcggcccgaactacaaggccatgcaggctgacatcgccatccgccacaacggcaagctggtcaccatcctgcaccccgaaaagcgcgacttcacgacgcagagccagaccacgaccgaagtcgccatccacaccaatttcatcaccgatctgtacggcgtggtcggtgaccggcacggcacgggcaaggacacgacctatgtcctgcgcctgcaccgcaatccgctcgcaccctggatgtggctgggcggactggtcatggccatcggcggcgcgttctcgctgtctgaccgccggatgcgaattggcgcccccaagcgcgccgccgcccgcaacatggcgcgtgcctga

SEQ ID NO: 67963 - protein, 659 aa, Gluconobacter oxydans 621H
MFGPEQGHFALALACVLALVQFAVPLWGANRRDARLVGLAPYLAVSQLIALGYSFLCLVMCAVSDDFSVQNVAANSAVSKPLLYKITGVWGNHEGSVLLWTLILAVCGGAVSLFGRNLPDILRGRVLAILGGVSAGFQMFCLLTSDPFDRVFPAPMDGQGMNPLLQDPGLAFHPPILYTGYVGFAVPFAFAVAALIEGRVDAAWGRWVRPWAVAAWCFLTCGIALGSWWSYYVLGWGGYWFWDPVENASLIPWLTGTALVHSAIVVEKREGLKIWTVLLAIATFSFSLSGTFLVRSGILNSVHAFANDPARGVFILALLAIVIGGSLALFAWRAPSLTSTGLFSPISREGSLVLNNILLCSICAVVVTGTMYPPFMQLLAGRTISVGKPFFDAATIPLTLPLLLAMGVGTALPWKRAQLARTFSHLYAAAGIAAIGLVLCFWKLSGVLPIACGALAIWVIAASASDVLRRIGIGHTSAQGVWERMKHLPRSSWGAALAHIGAGITVLGLCGMSQAQHAIVEVHIGETRSLAGDDWTLLDVHDYIGPNYKAMQADIAIRHNGKLVTILHPEKRDFTTQSQTTTEVAIHTNFITDLYGVVGDRHGTGKDTTYVLRLHRNPLAPWMWLGGLVMAIGGAFSLSDRRMRIGAPKRAAARNMARA

SEQ ID NO: 67964 - DNA, 1989 bp, Wolbachia endosymbiont strain TRS of Brugia malayi
  CDS (1)..(1989)
atgcctgagcttgggaatatattactactgttgtcctgcttattgtccttaacatatctatttctaccgttcaattcttaccgattcattaccactgccatattcttctgtatatcagtatcaatggctattttgatctactgccacattataaacgatttctcactcgaaaacgtatattaccactctcatacgacaaaacctttgatctataaaatctgtggcgtttggggaaataaagaagggtctatgttgctttggaccttagtgcttactttttacctatttctaatggatatttttattggtgataacagtgaattaaagaaagtatccttgatcactcaaggcttaatctgcttttgtttttcgctgtttactttacttaagtccgatccttttactaaaatgccaagcatagaaacagatggccttggttttcatccgatattgcaggacataggccttgccattcatccaccaatattatatttggggtaccttggatttagcgttcccttttcgctctctatagctgggttaattataaacatcgaaggagacatttgggctaaaattgtcaggccatgggtacttgtttcttggtcgctacttaccttgggtattagccttggcagttggtgggcataccgcgaacttgggtggggtggattttggttttgggatccagtagaaaacgtttctttaatgccatggttaattgcagtagcactgacgcatctgttactcgtggtacgaaatttcaatattttaaggaactttgccattttgcttacgctcacaactttcatattgagtgtaactggaacatttttagtccgctctggaatactttcttcagttcacacgtttgcagatgatccaggatatgggctgtatatactggctttacttggtgtaattacagccagtagcttagcaatatttgtggcatttacgaaaaagagtggatctcttattacattaccatctatcatccaattagctgatattgggatccagggaaaaagtatgcagtcacatgctggcatgacaccaaagaatacaccaaagcaaaactttcctattttgtcccgctttacaatgatactgatgaacaatttattattaattactgcctttttcatcgtgtttattggcactttataccctacaatgcttaaatatttaaccggtgaactcatttcagttggagcaccgtactacaattccttatttaatcctattgcactggctactctagtgcttaccatggtaggacaatactgccgttggcaggggaatagcttgttaccaatattccatgaatatagactctcattctgtagtgctgcagccatcttaccgtttatctttcatatggagctaatgattgtgctatcaattacaatctccatggcactattagcctttgttttagaagcatatagcaaaagaattcgtttatttaaagtggcatttagtgaatcaatttcattagtaagaggagtttccaagtcttactatgctatgatgttagctcatgctggggtagcaattctagtacttggtatagcctattcagtcggttggcaagaaaaaaaagaaaattacctaaaaataggagatagcataacagtcaacaaattcaaagttactttacgaaatactgaatttataaaaaagaagaatttccatgcagtgagaggcacaatggatattagaaatttgttgaacaacaagatactaggtgaagtaacccctgaatatagattttatcttgtggagggtcagaaaaatattgaaagcagtatttaccacaatttattttctgatatttatattgtaattggcgagattgataaaaataaaaacaagatcgccactaaagtacactacaaacctggaatgcctataatctggtttggatcctgccttatcgcttttggttcgctccttgttgctttgcccttattgagaagattttga

SEQ ID NO: 67965 - protein, 662 aa, Wolbachia endosymbiont strain TRS of Brugia malayi
MPELGNILLLLSCLLSLTYLFLPFNSYRFITTAIFFCISVSMAILIYCHIINDFSLENVYYHSHTTKPLIYKICGVWGNKEGSMLLWTLVLTFYLFLMDIFIGDNSELKKVSLITQGLICFCFSLFTLLKSDPFTKMPSIETDGLGFHPILQDIGLAIHPPILYLGYLGFSVPFSLSIAGLIINIEGDIWAKIVRPWVLVSWSLLTLGISLGSWWAYRELGWGGFWFWDPVENVSLMPWLIAVALTHLLLVVRNFNILRNFAILLTLTTFILSVTGTFLVRSGILSSVHTFADDPGYGLYILALLGVITASSLAIFVAFTKKSGSLITLPSIIQLADIGIQGKSMQSHAGMTPKNTPKQNFPILSRFTMILMNNLLLITAFFIVFIGTLYPTMLKYLTGELISVGAPYYNSLFNPIALATLVLTMVGQYCRWQGNSLLPIFHEYRLSFCSAAAILPFIFHMELMIVLSITISMALLAFVLEAYSKRIRLFKVAFSESISLVRGVSKSYYAMMLAHAGVAILVLGIAYSVGWQEKKENYLKIGDSITVNKFKVTLRNTEFIKKKNFHAVRGTMDIRNLLNNKILGEVTPEYRFYLVEGQKNIESSIYHNLFSDIYIVIGEIDKNKNKIATKVHYKPGMPIIWFGSCLIAFGSLLVALPLLRRF

SEQ ID NO: 67966 - DNA, 1914 bp, Reclinomonas americana
  CDS (1)..(1914)
atgtcttctttttttggacattttttaataattatagctatttttttacttataattattttttttaaatcatttttttataacaaacaaaataaaattatatacaaaaatcaaatacaaatacttatctcaatatatttttttatcttaacattatcttttttttctttattagaatcacacttgttttctaatatttctattattaatattttaaatagtacacattcaaaacaaccacttatttataaaatttgtgcactttggagtaatcatgaaggatctatgttactttggtgctggattctttcaatatatacctacagtttactttttttaagaaaattaactattgatttttttcgtagtactattctaatacaatctttaattaatttattttttcttttttttattctttttacatcaaatccatttttacaaattattgaccgctttcttgatgggaaacaactaaatccaatacttcaagacattgttttatcaatacatccacctcttgtatatttaggatacttaggattttcaataccattttcactaactatcgcatatttatttaatcattctaaagaaacacaagcatggttattttatatacaaaaatataatctaatttcatggtgttttcttacatttggtatttttttaggaagttggtgggcttactatgaattgggatggggtggttggtggttttgggaccctgttgaaaatgcttctttaatgccttggattcttagtacagctcttttacattctattcttaatactaagaaatcaaataccttaactaaaacaacgatatatttatcttttttttgtttttattcaagtttattgggtactttttttgtacgttctggacttatcgattctgttcacagtttcgcatctgattctaatcgcggacaatttattttttgttttcttttctttttatttttaatctttatttatcttattttaaaatataataaatatattttttctaaagatattcgtaatcttttttcaaaagaaggtcttatttctttaaatcaatttttttttatttctttctatattattattttaattggtactttttatccaacaatacattattttttttttaaacaatccataaccattggaccttctttttacaatcaaatgataataccaattctcgtacctttttttatttttatgatttcttcattatattttcattgggaatctattaaaattaaaaaaatttttttttctactaaagaacttctttttattttttgtttttcaactgctattttcagttttcttttttttgaaaattatcaacgtttttatattttatatctttttataccatttttagtatggtctattttgaaacatttctattctttttttatttttaaaaaatataattctttttcaatgttaatttctcattttggtgttactatttttatactttctgttttattatggtattgtttttacaaagaaagtcatcaaattatgtatccaggagatagacattttttcaatcattatgaatatatttttaaaggtattaatcttattaaaggtcctaattacgatgctttttatggatcttttttaattcttaaaaataatacaattaatggaacattatttccagaaaaacgacattattatattcaagatttttatgcttctaaagttgatattcatagtaatttttttgatgatgtccatgctattattggagacggtaatttatatactggatggtcaacaagtttttatgtttatccatttttatcttggatatggtttgctggttttttacttgttttaggaggtcttgtttctatttttaaaaaaaaacaaagaatacatattttacaacaatctctataa

SEQ ID NO: 67967 - protein, 637 aa, Reclinomonas americana
MSSFFGHFLIIIAIFLLIIIFFKSFFYNKQNKIIYKNQIQILISIYFFILTLSFFSLLESHLFSNISIINILNSTHSKQPLIYKICALWSNHEGSMLLWCWILSIYTYSLLFLRKLTIDFFRSTILIQSLINLFFLFFILFTSNPFLQIIDRFLDGKQLNPILQDIVLSIHPPLVYLGYLGFSIPFSLTIAYLFNHSKETQAWLFYIQKYNLISWCFLTFGIFLGSWWAYYELGWGGWWFWDPVENASLMPWILSTALLHSILNTKKSNTLTKTTIYLSFFCFYSSLLGTFFVRSGLIDSVHSFASDSNRGQFIFCFLFFLFLIFIYLILKYNKYIFSKDIRNLFSKEGLISLNQFFFISFYIIILIGTFYPTIHYFFFKQSITIGPSFYNQMIIPILVPFFIFMISSLYFHWESIKIKKIFFSTKELLFIFCFSTAIFSFLFFENYQRFYILYLFIPFLVWSILKHFYSFFIFKKYNSFSMLISHFGVTIFILSVLLWYCFYKESHQIMYPGDRHFFNHYEYIFKGINLIKGPNYDAFYGSFLILKNNTINGTLFPEKRHYYIQDFYASKVDIHSNFFDDVHAIIGDGNLYTGWSTSFYVYPFLSWIWFAGFLLVLGGLVSIFKKKQRIHILQQSL

SEQ ID NO: 67968 - DNA, 1863 bp, Cyanidioschyzon merolae
  CDS (1)..(1863)
atgtttggttacgtattgcattttttattaatttttatctttatttattcatgtaactttttttttttagattcattttacaaatacaagaaagttactaccctattagaaatagtacatcattattatttttattttaattacatatacaatattattattatcattatttggttaattggtataatattactattgtcggatttttctatattgtttgtggtggaattatcttctgtaaaccaaccaagtctttataaattaataactttatggtccaataatgaaggatcattattcttaggatatttcttgcaattcattatttattttacttttatcaattattttattaacaaattaacactgattgttaaactaacttttttttataatgtctattttattctatttaatataagttttctaagtctaacattattgctaatatttttgcgctttgatttttttttcaatttcactgttttggaaggtaatgaactaaattttttattacaagatataaatatattaattcatccaccattaatatatataagttatgcttcgtactctattattttttctatttcttttaccattttaataataaaatgtaaattttatgtgctttatattttaagatttttaaatctaattggttggtttattgcatcttttagtattttattaggaagtagatgggcttatacagaattaggttggggtggtttctggttttgggattccgtagagattatttctctattaccatggttattaagccttgctttattacatagtttgttgctaaacttgaagttttgcattatccgtttagattctttatttctgggaatggctatctattttgttattattattggaataattctagttcgttccggtttgctgcaatcagtacatacttttgtcaattcgccaaattttttaataattttcttgtatttctttttggtattcatttttattctaatagttatacttttaaagaaatatacttattttactagtatttttgacttaaataatcattataattttgtttattatatatttttattagtaattttatatttcttatacttattatttgttttatatttcccttttttaattaaatgttataatgataatgcgttattatttagtttcggttttttcaataaaatattattattatttataggaattttattaacattaataattatatttttaataaattcttggaaattaatttttatttttctaggcattatcataataggcggaattaggggatttcctgaaatttttttagccttatatttttttatttatttattgttatttactctaattttaattataaaacaaaaattttcctttattgtttatcattttaacttttttttcataatgttaagtttattattaataacaatttatggagaagaatttattttaaatttttctattggtaaaacattgctattaaatgataattttatcataatttttcgtgatttaaatcacatatggtcgactaattatttatccacttacggaaacttcttaattacagattttcataatcctatgtgttatgaaaacattcagaacgtattattttctgaaaaacgtttttatttatatcaaagtttaataaatacaaaatcaattatttacacgaatttaatgagtgatgtatacatcttattgggtgatggaaattttgaaaatggttggtatagtagaattttatttatgccatttatatcctggttttggttaggtggaatattcttattagacagtattattttttctttatttcggtgtataaaaaattttcaataa

SEQ ID NO: 67969 - protein, 620 aa, Cyanidioschyzon merolae
MFGYVLHFLLIFIFIYSCNFFFLDSFYKYKKVTTLLEIVHHYYFYFNYIYNIIIIIIWLIGIILLLSDFSILFVVELSSVNQPSLYKLITLWSNNEGSLFLGYFLQFIIYFTFINYFINKLTLIVKLTFFYNVYFILFNISFLSLTLLLIFLRFDFFFNFTVLEGNELNFLLQDINILIHPPLIYISYASYSIIFSISFTILIIKCKFYVLYILRFLNLIGWFIASFSILLGSRWAYTELGWGGFWFWDSVEIISLLPWLLSLALLHSLLLNLKFCIIRLDSLFLGMAIYFVIIIGIILVRSGLLQSVHTFVNSPNFLIIFLYFFLVFIFILIVILLKKYTYFTSIFDLNNHYNFVYYIFLLVILYFLYLLFVLYFPFLIKCYNDNALLFSFGFFNKILLLFIGILLTLIIIFLINSWKLIFIFLGIIIIGGIRGFPEIFLALYFFIYLLLFTLILIIKQKFSFIVYHFNFFFIMLSLLLITIYGEEFILNFSIGKTLLLNDNFIIIFRDLNHIWSTNYLSTYGNFLITDFHNPMCYENIQNVLFSEKRFYLYQSLINTKSIIYTNLMSDVYILLGDGNFENGWYSRILFMPFISWFWLGGIFLLDSIIFSLFRCIKNFQ

SEQ ID NO: 67970 - DNA, 1851 bp, Malawimonas jakobiformis
  CDS (1)..(1851)
atgattgcgaatttaggacattattctttaatttttttattgatttttgctatttttcttctatttattaaaaaaagtattattagtaagaaaatacttataaatgttttttcaataaaaataatcttaataacaattgttttaactactttagaatattcatatataatttcagattttagtattctaaatattaaagaaaattctcacatttcattaccattattatataaaataactgcgttatggggtaaccatgaaggatcaatattactttggtcctttatattaattgttttaactttcctaataatttttattttcagaaatttatctattatttatttgtataaaacagtttatatccaaaacgtattcattatcttttttattatatatacaatatttacaagtaatccatttatatatacatatatatatagccttaatggttctgaactgaatccgatactacaagatactgttttagcaattcatccacctttaatatacattggatatattaatagttctattaatttatctttggtgtcaatcagtttgatagaaaagaattataatgaaatattaaaaaaatatcttaatatatcaggattaataacatggattttcttaacaataggtattttattaggaagttggtggtcatattatgaattaggttggggaggatggtggttttgggaccctgtcgaaaattctgcattattaccttggttattaacattaatactaattcattccattaaatatgaatatttaattcgatggactattttagttaatattagtattttcattttttcaattttaggcacattttttgtaagatcaggaatattggtatctgtacattcatttgctgttgattattcacgcggtattttgatctttgtgtttttaataattcttttaatattaacaggtattttatattttaaaaatataaagtatttatataaacatacgtattattcatataaagccatagataatataattacaataaataatattattattttaattatttttacaacaatattattaggaacagttcttcctacgatttactctatgtttctaaataaaaatatatccattggtatatcattttataataaaacgataatacctatgataattccgatattaataataatgtcaatgattacatatataaataagataaaagaaataaataattatattttttcgattggaactttattatttatattatttataatatttatttataaaattgacttctcttattaccacttaataatactaatgttattattatggctaataacatctttaatcaaatatgtatctctatataaaataataaatccaatgattcttgcacatttaggattctttgtttttattacaggtattataatatcaagtgtttctcaattggattctgtacaaatagtttttccgggagaagaaatcaatttagaaaatcatatttttaattttagggatattaattatattacaggattaaactattattctatttatggtaatattgccgtaattaataagggagattatataaatatactttttccagaaaaacgttactattttataaaaggaatctatattacaaaatcggttatatatagtaattattttgcagatatatatgcaataattggagatggtaattttaaatctggttggtatactaaatactattatcgacctctaatgtcatttatatggataggtcctatgttttttatttttagtgccttaatctcaataaaaaaaataattagtaaaaaaaaaataataaattggttataa

SEQ ID NO: 67971 - protein, 616 aa, Malawimonas jakobiformis
MIANLGHYSLIFLLIFAIFLLFIKKSIISKKILINVFSIKIILITIVLTTLEYSYIISDFSILNIKENSHISLPLLYKITALWGNHEGSILLWSFILIVLTFLIIFIFRNLSIIYLYKTVYIQNVFIIFFIIYTIFTSNPFIYTYIYSLNGSELNPILQDTVLAIHPPLIYIGYINSSINLSLVSISLIEKNYNEILKKYLNISGLITWIFLTIGILLGSWWSYYELGWGGWWFWDPVENSALLPWLLTLILIHSIKYEYLIRWTILVNISIFIFSILGTFFVRSGILVSVHSFAVDYSRGILIFVFLIILLILTGILYFKNIKYLYKHTYYSYKAIDNIITINNIIILIIFTTILLGTVLPTIYSMFLNKNISIGISFYNKTIIPMIIPILIIMSMITYINKIKEINNYIFSIGTLLFILFIIFIYKIDFSYYHLIILMLLLWLITSLIKYVSLYKIINPMILAHLGFFVFITGIIISSVSQLDSVQIVFPGEEINLENHIFNFRDINYITGLNYYSIYGNIAVINKGDYINILFPEKRYYFIKGIYITKSVIYSNYFADIYAIIGDGNFKSGWYTKYYYRPLMSFIWIGPMFFIFSALISIKKIISKKKIINWL

SEQ ID NO: 67972 - DNA, 1512 bp, Archaeoglobus fulgidus DSM 4304
  CDS (1)..(1512): transl_table=11
ttggagccaggcttcctgctgctggcaacttcttttgtagctacattttcggcattttcactgtttctcgcgaaaaaagaaagtctgggtgagttctcactttaccttgcaacctccacgacttttgctgccctgctgctgcttgtaaactactttgttaccgacacgttttcgatatggtacgtttatgctaactccaatgccgaaatgccgctggcctacaaaataagcgcggtttgggccgggaaggaaggcagcctcctcttgtgggttgtgctcaatctgatggtgacctcactctacattaactggggggttaaggacagaaagaaagccaaggtggctgctgtaatgactcttttcacgtcttacctcctccttaaccttttgattttctcaaatccctttacggtcttaccttacacacccccagatggagcaggactgaatcctctgctgagaactgtggagatgatactccaccctccagtggtattcctcgcctactcgcttgccgctctgctgtactccgtaatcgttgcaaattcggaaggggaaagaaccatcgcgaggctcacgtggttatccctaaccctcggcattcttatcggaagtttgtgggcatacaaaactcttggatggggaggtttctggggatgggatccggtggagaacgcttccctacttccgtggctaactcttacagcctacttccatctcactaggggcagagactttttcgcttatctcaccttctcactcgttctttttgcaaccctagtcacgagaagtggcattataagctcagtgcacagttttggaggggaggttagtgattacagctacgtaattccgattctggcctctttagctcctttagttgtcagggcgagacagttttcgatttcaagtctctgcaatcagaatttgccaatcctctttttgtcagcagttattgtggtttttctaggaacgattgccggcgtttctgttgaggtgagcagagaatactacttcgtcacgtttctgccggtcttcgccttaatagtgctgctggttgtgcttaaaataaaaaaagtctcgatgcccgcgacgctgcttcacctgggcgtaattttcctctttgtcggagcaacttccgtttggcttttcgaggaaagcaagaccatcactcttgactcagagggttacaagcttctcgatttaagcattagcgaggatgcggaaaagtacactctcacagcgatagtcaaaaccccggatggcgtaatagcaccgaaagtttacttttacaaagttgctgggaacaacagagtttcttcagttgagataattccgacagtattgtgggacaactattactcaatcaagagcttcgatttggacaacaacgttgtaacgcttgagtactaccgcgttccgctgataaacgccgtctggttgggctcagccctaatgcttcttggagctctcctcaggttctcaggtaaagtttttaaattgggaggctga

SEQ ID NO: 67973 - protein, 503 aa, Archaeoglobus fulgidus DSM 4304
MEPGFLLLATSFVATFSAFSLFLAKKESLGEFSLYLATSTTFAALLLLVNYFVTDTFSIWYVYANSNAEMPLAYKISAVWAGKEGSLLLWVVLNLMVTSLYINWGVKDRKKAKVAAVMTLFTSYLLLNLLIFSNPFTVLPYTPPDGAGLNPLLRTVEMILHPPVVFLAYSLAALLYSVIVANSEGERTIARLTWLSLTLGILIGSLWAYKTLGWGGFWGWDPVENASLLPWLTLTAYFHLTRGRDFFAYLTFSLVLFATLVTRSGIISSVHSFGGEVSDYSYVIPILASLAPLVVRARQFSISSLCNQNLPILFLSAVIVVFLGTIAGVSVEVSREYYFVTFLPVFALIVLLVVLKIKKVSMPATLLHLGVIFLFVGATSVWLFEESKTITLDSEGYKLLDLSISEDAEKYTLTAIVKTPDGVIAPKVYFYKVAGNNRVSSVEIIPTVLWDNYYSIKSFDLDNNVVTLEYYRVPLINAVWLGSALMLLGALLRFSGKVFKLGG

SEQ ID NO: 67974 - DNA, 1992 bp, Mesorhizobium loti MAFF303099
  CDS (1)..(1992): transl_table=11
atggttgaaaccggacatttcgccctggtcctggcgttcgcgctttcgctggtgcagacgatcgtgccgctgttcggcgcgcgcctcaacaaccagcgcctgatggctgtcggcggtcctgtcgcggtcaccggcttcgcgctgacggcgctgtccttcgtcgcgctggcgagcgcctatgcgaactctgatttctccgtggcgagcgtctgggagaactcgcattcgctgcagccgatgatctacaagatcaccggaacctggggcaatcacgaaggctcgatgctgctctgggtgctgatcctgacctttttcggtgctctcgttgcggctttcggttccaatttgccggcaactctgcgcgccaatgtactggccgtgcagggcgccatcggcgcggccttcttcctgttcatcctggcgacgtccaatccattcatccggctcaatccggcgccgatcgaaggccgcgacctcaacccggtcctgcaggatctcggcctcgccattcatccgccgctgctctatctcggctatgtcggcttctcgatctgcttttccttctcggtcgccgccttgatcgaggggcgcatcgacgcctcctgggcgcgctgggtgcggccatggacactggtcgcctggatgtttttgaccggcggcatcgccatgggatcgtactgggcctattacgagcttggctggggcggtttctggttctgggatccggtcgagaacgcctccttcatgccttggctggcgggcaccgcgctgctgcattcggccatcgtcatggaaaagcgctcggcgctgaagatctggacgctgctgctcgccatcctcaccttttcgctgtcgctgctcggcaccttcctggtgcgctcgggcgtgctcacctcggtccacgccttcgccaccgacccggcgcgcggcgtcttcatcctgtgcatcctgacgctgttcatcggcgggtcgctggcgctgtttgcgctgcgcgcctcgagattgacggccggcggcctgttccatccgatctcgcgtgaaggcgcgctcgtcctcaacaatctgttcctgaccacggcgaccgccacggtgctcgtcggcacgctctatccgctggcgctggaggcgctcaccggcgacaagatctcggtcggagcaccgttcttcgatctgactttcggccccttgatgttgccgcttctggtcctcgtgccgttcggcccgctgctggcctggaagcgcggcgacgtcatcgccgcgtcgcagcgcctgatggcggccttcgcgacggcgctggcggcaatgctcgttaccggcctgtttatcgacggcgcgtcggtgttcgccgccctcggcatcggccttgcggtctggctggtcgccggtgcgctcaccgaccttgccgtcaagtccggcgccggatcggttgcgccggccgtcatgctcaggcgctttgccggcctgccgcgctcggtcttcggcacggcattggcccatctcggcctcggcctgaccttgctcggcattgtcgccacgctctccttcggcaccgagaagatcctcaccatgcgcgccggcgagacggtggaactgtcaggtcatacgctgcgtttcgtcgggctttatccggcgcaggggccaaactacagcgaggaccgtggccgcttcgagctgatcggtgtcggcggcagtcctgtcggtgaaatgagttccgccaagcgtttctatccggtgcggcagacgacgacgactgagtccggcatcagaaccctcggtctttcccagctctacatctcgcttggcgacgaagccaaggacggctcggtcgtggtgcgcctgtggtggaaaccattggtgacgctgatctggggcggcggcctgatgatgatggcgggcgcggccatgtcgctgatggacaggcgcctgcgcgtcggcgcgccttcgcgccggcgcaagcaggcgagcgccgtgacgcccgcggtcctgccatga

SEQ ID NO: 67975 - protein, 663 aa, Mesorhizobium loti MAFF303099
MVETGHFALVLAFALSLVQTIVPLFGARLNNQRLMAVGGPVAVTGFALTALSFVALASAYANSDFSVASVWENSHSLQPMIYKITGTWGNHEGSMLLWVLILTFFGALVAAFGSNLPATLRANVLAVQGAIGAAFFLFILATSNPFIRLNPAPIEGRDLNPVLQDLGLAIHPPLLYLGYVGFSICFSFSVAALIEGRIDASWARWVRPWTLVAWMFLTGGIAMGSYWAYYELGWGGFWFWDPVENASFMPWLAGTALLHSAIVMEKRSALKIWTLLLAILTFSLSLLGTFLVRSGVLTSVHAFATDPARGVFILCILTLFIGGSLALFALRASRLTAGGLFHPISREGALVLNNLFLTTATATVLVGTLYPLALEALTGDKISVGAPFFDLTFGPLMLPLLVLVPFGPLLAWKRGDVIAASQRLMAAFATALAAMLVTGLFIDGASVFAALGIGLAVWLVAGALTDLAVKSGAGSVAPAVMLRRFAGLPRSVFGTALAHLGLGLTLLGIVATLSFGTEKILTMRAGETVELSGHTLRFVGLYPAQGPNYSEDRGRFELIGVGGSPVGEMSSAKRFYPVRQTTTTESGIRTLGLSQLYISLGDEAKDGSVVVRLWWKPLVTLIWGGGLMMMAGAAMSLMDRRLRVGAPSRRRKQASAVTPAVLP

SEQ ID NO: 67976 - DNA, 3000 bp, Aeropyrum pernix K1
  CDS (1)..(3000): transl_table=11
atgtctagcctagtcggtctgcactacgccacggttctaccgctggcagcttacctactactagccgttgttattctgcttctcgctatggggagagatggcgcggcgaggaaaacattcacagctagcttgcttatgatagtgcttggctggatcccctatattgctgcgttcctcctgctcgactatagtcttgatgaggttgcgaaaaacgcgtcagacgagttatcgccgtacctgcggatcggggctgcatggtccgggggcggcggtagcctttatctcttctccgctttcctatcactagcaatcctgcttcaaatgctgcttaacaagggcttgaataggcgtgccatggccgttttcacgcttctagtattaacttcgatgacttcagcaactctcatgggagctttcggaaccggaccgggagagcggggagggctaggcataaatcctgttctaaagaactactgggttgtaccccacccaactacaaccttcctgggctacagcttcatattagtagggtctgtagctctggtactaggttattatagaacaggccttccaattcagcttctgggcctcgcgtttctcaccttcggcctcgtcttcggcggcatgtggagctacgagacatttgggtggggaggctactgggcatgggaccctgtcgagacaagccagctcgcggtctggcttgcaacggtcgcctcgatacatatgataggcccccttaggagccttaaccgggggttcgctgcgtatgccgccagctccgtattcttagctctctatgttactaggagcggggttagccctctacacagctttgcggcagagagcttttccgcggttctactgttatcggcttcactggtaatgctggctctctcgatgctactattttcagagggtgtcggagagactctcgagaagtggaagagccgtcttcaggacgcgcgctggccccctagaattgcggagatgaatctctcgaacatacttctgacggttggctctgtgtctattgccctctcagcacttatagtctactcgtcgctgttaacaccatcagtgttaaagctagttggtctcgatactcagcctccatcgtttgagcagggggtgaggttctacaatagactactcatacctctagctcttgtctccctctatgcggtggccggttactacgtctctgttagggcaggggcgaaggcggcttacagtctattcgcaacactgactgttgttctagccataatgggcctggctacggtcaagaataccataattatatcccccctttccgacacgaccacaaacctagcctccgctaccctactagccgcgggctcgatatcgggatcagtgctactagctatgtcactctggatgttatatggcatggtaaagggtaaggtagcaaagagtgtacacacactcaggatagtgcttgagaagctagtgcacgccactatgattatgatacttgtttctgtggccatgagcggtagctatgcttacaaccagggatacagcgaagaggtcttagtaccgttaggcggagaagttagcgttatgggggtcaccatatcatacgagggctacgattatgaattacaccagggtacggtggatctaaagaataatctcgacccttcaagcgccattttgattacagccagggaagccctaaacatgatggatgaggatttatcttcgactatcagggaatataggcttgcatcagcggaatcccagtcagaccggactcttcagactcttctaaaggcttcagccagcaactccgaatataggggcgtcttcacctcaaccagaggtgtagctgatgctgcagttgtcgatgtgagaacaggagaaaatatatctaacattcaaacggctggagaaacggttcttcagcttgaagaccctacacttgaggtcacaatagatcccaagctcgacccggagactgggaggatagagggaggtgctctgagcgttgtcttctaccctgagaggcttgtggtgtatgggatcggcagccccgtgtcacttgatccttattcatacttatatgttcggttccgtgagccggtggagattaatttggacgatataactgtgaatatggaggaagtagtcgtttattctactggtggcagtagcatagagggtgtggtatcggggcaatctgtcctattcgagggtgtagccattagggtagtttcgggggagttatcgttcggttctatgaacatagagttgccgtaccagctggataggggtgaattcttctactttatggtttataagggtcaggctgaggttttagatgatatcttgtcttccagcatatccgaccttctagagtctggaatagcgggactggcagccggagaagatatggacgattttaatgtgcctaggagagccccggctggagtcagtcttagactgttcatggaggttaacggggagcctgtggaggctgatctacggttcgaggctaacggggaggctatagggatacatggccttgtgatagacacaataatattgaggagggggctaacgaatgtatacataacagtacaggcgcccctagtcagcggccacttcggggaatatcacgagctcatggtttattatttaaatgaagctatgaacaccctcaggccagaagagtacttggcccttgcttcggtgatggctgcaggctacaatatagcgagcatagtatcctcgcccagtaaagagagggccgcgctagaggtagagagagctacgatagacctgtacctgctctcggagaagttagatgagaagcgttcaagcgcggctgagggaatagttgttagtgtgaagatagttcctggggttccgctcctctggttaactggcgtgctagcaggggtcctcctgcttgctatggcttctatccacttctacctgggcttcaggcagggccgacttattgatacttag

SEQ ID NO: 67977 - protein, 999 aa, Aeropyrum pernix K1
MSSLVGLHYATVLPLAAYLLLAVVILLLAMGRDGAARKTFTASLLMIVLGWIPYIAAFLLLDYSLDEVAKNASDELSPYLRIGAAWSGGGGSLYLFSAFLSLAILLQMLLNKGLNRRAMAVFTLLVLTSMTSATLMGAFGTGPGERGGLGINPVLKNYWVVPHPTTTFLGYSFILVGSVALVLGYYRTGLPIQLLGLAFLTFGLVFGGMWSYETFGWGGYWAWDPVETSQLAVWLATVASIHMIGPLRSLNRGFAAYAASSVFLALYVTRSGVSPLHSFAAESFSAVLLLSASLVMLALSMLLFSEGVGETLEKWKSRLQDARWPPRIAEMNLSNILLTVGSVSIALSALIVYSSLLTPSVLKLVGLDTQPPSFEQGVRFYNRLLIPLALVSLYAVAGYYVSVRAGAKAAYSLFATLTVVLAIMGLATVKNTIIISPLSDTTTNLASATLLAAGSISGSVLLAMSLWMLYGMVKGKVAKSVHTLRIVLEKLVHATMIMILVSVAMSGSYAYNQGYSEEVLVPLGGEVSVMGVTISYEGYDYELHQGTVDLKNNLDPSSAILITAREALNMMDEDLSSTIREYRLASAESQSDRTLQTLLKASASNSEYRGVFTSTRGVADAAVVDVRTGENISNIQTAGETVLQLEDPTLEVTIDPKLDPETGRIEGGALSVVFYPERLVVYGIGSPVSLDPYSYLYVRFREPVEINLDDITVNMEEVVVYSTGGSSIEGVVSGQSVLFEGVAIRVVSGELSFGSMNIELPYQLDRGEFFYFMVYKGQAEVLDDILSSSISDLLESGIAGLAAGEDMDDFNVPRRAPAGVSLRLFMEVNGEPVEADLRFEANGEAIGIHGLVIDTIILRRGLTNVYITVQAPLVSGHFGEYHELMVYYLNEAMNTLRPEEYLALASVMAAGYNIASIVSSPSKERAALEVERATIDLYLLSEKLDEKRSSAAEGIVVSVKIVPGVPLLWLTGVLAGVLLLAMASIHFYLGFRQGRLIDT

SEQ ID NO: 67978 - DNA, 1956 bp, Vibrio cholerae O1 biovar eltor str. N16961
  CDS (1)..(1956): transl_table=11
atgattgctgaaattggccactttgcactgattgtatcgctcagcttagcgatattactcagtgtgctgccattagttggggcgtcacgcaacaacacactattgatgaacacggctcgccctttggcatggggtatgttctttttgctgtcgatctcgtttgcggttttgctgtgggcattctatatcaatgattttacagtgcaatatgtggcaagtaactccaatagtgagctgccttggtactatcgcctcactgctgtatggggcgcgcatgaaggttcattactgctttgggtgcttatccaagcggcttggactgtggctgtcgcgagttttagccgcggtatgccacaagaatcggtagcgcgtgtgcttgcggtgatggggatgattactgttgggttcttactcttcatcattctaacgtctaacccgtttttacgcaccttgccttattttccgattgacggccgtgatttaaatccgctgctgcaagaccccgggttaatcattcacccgcctatgttgtacatgggatatgtgggattctccgtggccttctcgtttgcgattgcttctttgatgacaggccgtctcgacacggcatgggcacgttggtcacgaccttggacaacggccgcttggctctttttgacgctgggtatcgtactgggttcatggtgggcttactacgaacttggctggggcggttggtggttctgggatccagtggaaaacgcctctttcatgccttggcttgccggaacagcgctgatgcactcattagcggtgactgaaaaacgcggcacgttcaaagcgtggacggtactgctggcgatttctgcattctcgttgagcctattgggcaccttcttagtgcgctcaggcatcttggtttcggtgcatgctttcgcctccgatccggcgcgcggtatgttcattctcggcttcttgattgcggtgattggtggttcactactgctatttgcgatcaaaggcgcttcagtacgagtgcgtggtaattttgagctggtatctcgtgaaaacagcttgttggtaaacaacgtgctgctgatgaccgcactcgcggtggtactgattggtaccttgttgcctttagtgcacaaacaactgggtcttggttccgtctctatcggtgcgcctttctttaacatgctgtttgcctggttgatgattccttttgcattttttatgggaattggtccactgatccgctggaagcgcgatcaaatctccacactctttaaacctatgctcatcacagcgatggcatcgttagtattggcagcgttgatgatgtggctgaatgctccgacgtttagcccaatggcttatcttggttgggtcatggcgtggtggatcttactgttacacgcttatgaactgcacacgcgagcgactcatcgtcaccgcttcatagttggggtgaagaaactgcaacgtagccactgggcgatgatgcttggtcatgttggtttagcggtgagcatcattggtattgctatggtgcaaaactacagcattgaacgtgatgtgcgtttggctccgggagataacttccaactcaatgagtacaacttttacttccaaggtgtgcgtgataaagatggaccgaactacgatggctacattgctgattttgaaatcactagccaaggccaatatgtcaatacattgcatgccgagaaacgtttctatcgcaccgcaaagtcaatgatgaccgaagcggcgatcgaccgtggcattacgcgtgacctttacattgcgatgggtgagcgtttggatgataaccgctcttgggctgtgcgtatttattacaaaccttatgtgcgctggatttgggcaggcggcttgctgatggccatcggtggtgccttagccatcagtgacaagcgttaccgctttagaaaaaacgcacatcaggaggcttaa

SEQ ID NO: 67979 - protein, 651 aa, Vibrio cholerae O1 biovar eltor str. N16961
MIAEIGHFALIVSLSLAILLSVLPLVGASRNNTLLMNTARPLAWGMFFLLSISFAVLLWAFYINDFTVQYVASNSNSELPWYYRLTAVWGAHEGSLLLWVLIQAAWTVAVASFSRGMPQESVARVLAVMGMITVGFLLFIILTSNPFLRTLPYFPIDGRDLNPLLQDPGLIIHPPMLYMGYVGFSVAFSFAIASLMTGRLDTAWARWSRPWTTAAWLFLTLGIVLGSWWAYYELGWGGWWFWDPVENASFMPWLAGTALMHSLAVTEKRGTFKAWTVLLAISAFSLSLLGTFLVRSGILVSVHAFASDPARGMFILGFLIAVIGGSLLLFAIKGASVRVRGNFELVSRENSLLVNNVLLMTALAVVLIGTLLPLVHKQLGLGSVSIGAPFFNMLFAWLMIPFAFFMGIGPLIRWKRDQISTLFKPMLITAMASLVLAALMMWLNAPTFSPMAYLGWVMAWWILLLHAYELHTRATHRHRFIVGVKKLQRSHWAMMLGHVGLAVSIIGIAMVQNYSIERDVRLAPGDNFQLNEYNFYFQGVRDKDGPNYDGYIADFEITSQGQYVNTLHAEKRFYRTAKSMMTEAAIDRGITRDLYIAMGERLDDNRSWAVRIYYKPYVRWIWAGGLLMAIGGALAISDKRYRFRKNAHQEA

SEQ ID NO: 67980 - DNA, 1926 bp, Pasteurella multocida subsp. multocida str. Pm70
  CDS (1)..(1926): transl_table=11
atgatcccagaacttggttttttggctttactgatcgcttctttgtgtgcgttcttgcttgcgctagtgccacaagtcggcatttttttgcgtaagccgtatatgattggtactgcgtggaatttgagttatctctttgggatatttacctgtatagcgttattctgccttgcctatgcctttgcactcgatgatttttctgtgcaatatgtggcacatcattctaattcacaactgccaattttctttaaagtgtctgctacttggggtggacatgaagggtcgatgctattttggttgtttgctttagcactctggttgatgctctttgcgttttccagtcgtcataaagatccgattatttgtgcgcgtgcactttcagtgcttgggctcatttgttttggtttttgtctctttattttatttttatcaaatccatttgaacgcagttttccacaagcatttgaagggcgtgatttaaatccgatgttgcaagatgtggggctgatttttcatccgcctttattgtatttgggctatgtgggctttgccgtcaattttgctattaccatttctgctttagtgagtgggcatttagatgccgccgtggctcgcatgatgcgcccttgggttttgctatcttggttatttttaactttagggattgtgttagggtcttggtgggcgtattacgaactaggctggggcggctggtggttttgggatccggtcgaaaacgcctcattgatgccttggttattaggtttggcattattacatagtctatctatcacagaacagcgtggcatttttagttactggacgctgctattttcacttttggcattttctttcagtttactgggtaccttcatcgtgcgctcgggcgtcttaacttctgtgcacgcgtttgcagtagatggtgatcggggaattgccttactgattttattctttttgttgactgtgagtgcattcactttatttgcattaaaggttaacttgccacaaagtgcggtacgtttccgtttaatttcgaaggaaaatgccctgttgcttctcaatattttattgacgattgccacggtcagtgtctttttaggcactttttatccgattgtctttaccgcattacaatggggatctatttcagtcggcgcgccgtattttaatacaatttttctgccactgtttgtgatggcaatgcttgctatgattttggtgttgtctttacgttggaaaacactgaataaaaaaccgtttattcaacgtacgttattgttatttcccgcgcttatattggcttatggattaatccgttattatgtagatcataaccaagggttgcctttcaatttcagcgcttatggcttgttaagcttgtcgatttggttaattctggcgacgttatggctcccatggacgcagctgaaactgaaacagctcgccatggtgatcgcgcatttaggtgtagcgataacggcaattggggcgatcatgagtagctattacagcagtgagattggcgtgcgcttggcaccgcaacaacgccaaaaactcggtgattacgagtttcactatcagggttttcagcatgtgttaggtccgaattacaccagtgaaaaagcccattttgtggtgacaaagcaaaaccaagcttatgctgagatttacccagaacgccgttattatgatgtgcgtactatgaacatgagcgaagttgggattgattggggatggcttggtgatgtctatattgtaatgggcgataaattgggacaaggcgaatttactttccgcttgcaatataaaccttttatccgttggttatggtttggcgggcttttaatggcactaggcgccttgcttgccatattttccttgcgcaatagcaataaactaaaaccacgtcgtcaatcagattga

SEQ ID NO: 67981 - protein, 641 aa, Pasteurella multocida subsp. multocida str. Pm70
MIPELGFLALLIASLCAFLLALVPQVGIFLRKPYMIGTAWNLSYLFGIFTCIALFCLAYAFALDDFSVQYVAHHSNSQLPIFFKVSATWGGHEGSMLFWLFALALWLMLFAFSSRHKDPIICARALSVLGLICFGFCLFILFLSNPFERSFPQAFEGRDLNPMLQDVGLIFHPPLLYLGYVGFAVNFAITISALVSGHLDAAVARMMRPWVLLSWLFLTLGIVLGSWWAYYELGWGGWWFWDPVENASLMPWLLGLALLHSLSITEQRGIFSYWTLLFSLLAFSFSLLGTFIVRSGVLTSVHAFAVDGDRGIALLILFFLLTVSAFTLFALKVNLPQSAVRFRLISKENALLLLNILLTIATVSVFLGTFYPIVFTALQWGSISVGAPYFNTIFLPLFVMAMLAMILVLSLRWKTLNKKPFIQRTLLLFPALILAYGLIRYYVDHNQGLPFNFSAYGLLSLSIWLILATLWLPWTQLKLKQLAMVIAHLGVAITAIGAIMSSYYSSEIGVRLAPQQRQKLGDYEFHYQGFQHVLGPNYTSEKAHFVVTKQNQAYAEIYPERRYYDVRTMNMSEVGIDWGWLGDVYIVMGDKLGQGEFTFRLQYKPFIRWLWFGGLLMALGALLAIFSLRNSNKLKPRRQSD

SEQ ID NO: 67982 - DNA, 1995 bp, Deinococcus radiodurans R1
  CDS (1)..(1995): transl_table=11
atgcttgatttcctcggatacaacttttcgccgctcggcgctgccgggtcgctctcgctgctgctcgcgctggggtttgcgctcgtcgcgctggtgtccggcgtgctggggggcgtgcggcgcgacgagcggctgaccggcatggcccggtatgcgctgtggggcaacttcggcttcatgaccgtcgccacccttctgctgcaatacgccatcctgaccgacgacttctcggtgcgctacgtggcgcagcactccatgaccgtctcgccgctgtgggtcaaatgggtcacgctgtgggcggcgctggaaggctcgattttgctgtgggcgtggattctgtcgctctacgccttcctggtcagcctgaccgcccggcgcgacgtgctgcggccctgggtgctggcgacgatggcgctctcggtggtgtttttcgtggggctgaacttgacggtcgccagtccctttaccccggtggtggacgtgccgctgcaaggacgggggcccaacccgctgctgcaaaaccactggatgatggccgtgcacccggtgctgatgtacctgggcttcgtcggcctgagcgtgcctttcgcctacgcggtggccgccatgatcaccgggcggctcggcgagtcgtggctggtgcagacccggcgctggacgctggtggcgtggggctttctctcggcggcgattgtggcgggcggctggtggagctacgagattctgggctggggcggctactgggcctgggacccggtggaaaacgccagcttcattccctggctgctggcgaccgccttcctgcacagcgtgcagattcaggagcggcggcggatgctcaagacctggaacatttacctcatcgtcttcgcctacgccgccaccgtgctcggcaccttcctgacgcgctcgggcgtggtggaaagcgtgcacgccttttccaacggccccatcggcccggtgttcctgggctttttcgtgctgctggtggcccttggcgtggggctggcgacgtggcggctgccgcagatccgcgacccgcacagcctcgacagcccgctgtcgcgtgaggggtctatgctcggcggcaacgtggtcttcgtggtgttcggactgctggtcgtgctcggcacgctgtttccggtgctggtggaggaggtgcgcggcatccgcaccagcgtgggcgagccgttctacaactacttcgccattccgctgggcctgctgctgctgctggtgatgggcgtcggcccggtgctgccctggcgcaaggccggcaacggcgacctgcggagcctgtgggcgctcacccgctggccggtggccgccgccgtggtcggcacggtgctcgccttcgcgctgggcgtccgcaacgtggggctggcactcacgctggggctgtgcgcgtacaacgtggtcgggctggggcagctcgtcgccggcagcgcccgcgcccgtggcggtctgggcgccctgccgggactggtgcgcgagtatccccggcgctacggggcgtatgtcgctcacctcggcatcgtgctcatcgccatcggcatcggcttttcgggcacctacaaggcgcggcaggaagtcaccctgcgccctaacgtgccgcaaaccgtgctcggcaagaccctgacgctgacgaacctgggcaccgagcagcgccccgaacgccagtccattgtggcgacggtgcaggcggggagtgaaacgctgatgcccaagctcaacacctacgtcaacatgccgcaacaggtcgccatgcccgccgtcaaatatcacctgatgggcgacacctacgtgacgctgctcagcggcgacgtgaaccagcagtgggcgacggtggccgtcatcgactcgccgctggtcggctggatctggtggggcggcctggtgctgctgctcggcacggcgctgagcgtgacggccccagtgcgcgagacggtggcggtccgtgccccggcacgggggctggaaggggtgacagcgtga

SEQ ID NO: 67983 - protein, 664 aa, Deinococcus radiodurans R1
MLDFLGYNFSPLGAAGSLSLLLALGFALVALVSGVLGGVRRDERLTGMARYALWGNFGFMTVATLLLQYAILTDDFSVRYVAQHSMTVSPLWVKWVTLWAALEGSILLWAWILSLYAFLVSLTARRDVLRPWVLATMALSVVFFVGLNLTVASPFTPVVDVPLQGRGPNPLLQNHWMMAVHPVLMYLGFVGLSVPFAYAVAAMITGRLGESWLVQTRRWTLVAWGFLSAAIVAGGWWSYEILGWGGYWAWDPVENASFIPWLLATAFLHSVQIQERRRMLKTWNIYLIVFAYAATVLGTFLTRSGVVESVHAFSNGPIGPVFLGFFVLLVALGVGLATWRLPQIRDPHSLDSPLSREGSMLGGNVVFVVFGLLVVLGTLFPVLVEEVRGIRTSVGEPFYNYFAIPLGLLLLLVMGVGPVLPWRKAGNGDLRSLWALTRWPVAAAVVGTVLAFALGVRNVGLALTLGLCAYNVVGLGQLVAGSARARGGLGALPGLVREYPRRYGAYVAHLGIVLIAIGIGFSGTYKARQEVTLRPNVPQTVLGKTLTLTNLGTEQRPERQSIVATVQAGSETLMPKLNTYVNMPQQVAMPAVKYHLMGDTYVTLLSGDVNQQWATVAVIDSPLVGWIWWGGLVLLLGTALSVTAPVRETVAVRAPARGLEGVTA

SEQ ID NO: 67984 - DNA, 1941 bp, Xylella fastidiosa 9a5c
  CDS (1)..(1941): transl_table=11
atgctgcctgagtttggccagatcctcctgatcctcgccctgctgacagcactgctgcagggactgcttcccctgattggcgcccagcgccgccgcacggcttggatggccgttgcacgcccagccgcctatgtgcaactgagcctgctcgctggcgcattcgcactgctcacctatgccttcctcggcaacgacttctccgtccaatacgtcgccgaaaactcccattcactgctacccaccctctaccgctctaccgccgtgtggggtgcccacgaaggatccctcttactctgggtattgctcctggcaggatggaccgctagcgtcgccttacgttcccacaccctcccagccaccctgagcgcacgcatccttggcgtcctgggcctgattgcactcggcttcctcgccctgatcctcttcacctccaacccattcgcacgtctcctgcctgccgtcccagaagggaacgacctcaacccgttgctgcaagatcccgggatgattgtgcatccccccctgttatatgccggctacatcggtttcgcagtgccattcgcctttgccgtcgcggtcctgctggaaggacgcatcgatccaacctggctacgctggagccgcccttggacccataccgcctgggcactgctgaccctgggtatcgcactgggcagctggtgggcctactacgaactcggctggggcggctggtggttctgggaccccgtggaaaacgccagcttcatgccgtggctcatcggtgtcgcactgattcattcccaagcgatcaccgacaaacgcggcagcttcacccactggacactcctgctcgcaatcaccgcctttgcactagcactgctgggcacattcctcgtccgctcaagcgtactgacctcagtccatgcctttgctgctgatccggtacgcggcgcgtttattctgctgctcatcttcacgttgattggcggcgcactgctgctgtatgcacggcgtgcaccgcagctcacccccgtcacaataaacatgcaacaacgctttacacccgtctcacgcgaaaccctattactgctcaacaacctattgctgacctgcgcctgtgcgatggtgctgctaggcaccctctatcccctgctggccgatgcactggcactgggtcaactttcagtcggcccaccctacttcggccccctattcaccctgctgatgacaccactaatcgtcttactgccattgggtccattcacccgatggcaacgcgaacacccctcaacacccctcgtactgctggccccttgggccgcactgagcctggctgtcgccgcactggctggcatcaccacaccacagcaccattggaaaaccatgctcagcgtggccgcggcagcatgggtactcctgggaaccctccgcttcctctggtggcactggcgcatcaccggatcccgtcccacccccagcaccctgggcatggtcctggcacacgccggaattggtgtcttcctcactggcgcgctgttagttgaaacactcagcctacaacgtgaaattgcactcagcccgggccagacactcaccctcggccccatcaccctgcactttgatgccctcctcgaacaccacggccccaactacgtggctgatcgtgcccgattcagcctattacgcaacacgcatcccctgggcaccctgacgacagaaaaacgccgctatgtcagtggcggccaagtcaccaccgaagccggcatccatcctggagcgctcggtgacatctacgtcgcattaggagaatccctgggcaatgggtcatgggcaattcaggcacactacaaacccttcgtccgctggatctggctgggcgcagcactaatggccctgggcgggctgatcgctgctgctgatcgccggttccgccaccacccggagtcatcgcatgtctga

SEQ ID NO: 67985 - protein, 646 aa, Xylella fastidiosa 9a5c
MLPEFGQILLILALLTALLQGLLPLIGAQRRRTAWMAVARPAAYVQLSLLAGAFALLTYAFLGNDFSVQYVAENSHSLLPTLYRSTAVWGAHEGSLLLWVLLLAGWTASVALRSHTLPATLSARILGVLGLIALGFLALILFTSNPFARLLPAVPEGNDLNPLLQDPGMIVHPPLLYAGYIGFAVPFAFAVAVLLEGRIDPTWLRWSRPWTHTAWALLTLGIALGSWWAYYELGWGGWWFWDPVENASFMPWLIGVALIHSQAITDKRGSFTHWTLLLAITAFALALLGTFLVRSSVLTSVHAFAADPVRGAFILLLIFTLIGGALLLYARRAPQLTPVTINMQQRFTPVSRETLLLLNNLLLTCACAMVLLGTLYPLLADALALGQLSVGPPYFGPLFTLLMTPLIVLLPLGPFTRWQREHPSTPLVLLAPWAALSLAVAALAGITTPQHHWKTMLSVAAAAWVLLGTLRFLWWHWRITGSRPTPSTLGMVLAHAGIGVFLTGALLVETLSLQREIALSPGQTLTLGPITLHFDALLEHHGPNYVADRARFSLLRNTHPLGTLTTEKRRYVSGGQVTTEAGIHPGALGDIYVALGESLGNGSWAIQAHYKPFVRWIWLGAALMALGGLIAAADRRFRHHPESSHV

SEQ ID NO: 67986 - DNA, 1989 bp, Rickettsia conorii str. Malish 7
  CDS (1)..(1989): transl_table=11
gtgagtgaaatcggtaattttttactactaacaacgatgtacttgtcggttatcggtttgtcttttgtcttttatgtcattcctgcgaaagcgggaatccataaaaaatctctactttatagactgaattgccgctttcgcgggaatgacaactacctcattacttgccccttctacatagctgcctcatgtactatacttgccttttttaccctagtctatgcctttattatctctgacttttcactacaaaatgttttcttaaattccagtactttaaaacctttaatatataaaatagccggtagttggtcgagccacgaaggctcaatgttattatggttttgtttattacaaatcgttagttgctgttatatatttttacttgaagataaccgtcttaaatttttatctattattattctatcagccatacaattattgtttagcagctttatttactttacctccaatccttttaacgtgttttctttcgttcctaaagaagggttaggcttaaacccgatgctacaagatattgctttgagcatccatcctcctctgctttatttaggctatgttagctatgtagtaccgtttactattgtttgtgcctctatgtcattctcatacccacttatgtcattcccgcgaaagcgggcatccattaatgacctaagacttctcaaaacattttccaatatcggtatcttatttactaccataggaattagccttggttcttggtgggcatatagagaactcggctggggcggattttggttttttgatccggtagaaaatatttcactatttccttggttatccggaattatgctccatcattctataattgtaacaacaaaaaccagacgtatgcaaaactggacagtaattttatccatcattacttttttattagtaatatttagtgcttttttagtacgttccggttttattacctcaattcactcttttgcattctcacctgagagaggaatatacttgcttgggatatttttgattatggggattggtagtattgggtggtatactaccacatcattgcgaggaaatgcattaacattgacgaagcaatctcaggaagctaaccaagattgctacagccacttttgtggcttcgcaatgacgcattgtggaaactccatactcctcggtaatatattcctccttcttagccttattgtgctaatagctgccacactttatccgccactttactctttattcgacgataaatctattattattagtgaaacattttttgttaataattttattatattcgttatccctattcttggtaccataggattatttactaccagaagctctattaaaaaacatattataattctaatattatctctaataattacttatttaatatcattaaaagtaacatttagtgttatatcgattttaactataatcgcatctatatttcttatgcttcataatattcattatcttttggttaaaactaattattgtagaaatagacttaaagcaagtaacgctagtatgatccttgggcattttggttttgcactaattagttttagtattactatgaatacattattacaaagtgaaatggattttaccggcagagtaggaacaagtaaaacatttaacgaatttaaagtaacattgcaaaatattaagtttgctcaaggtaaaaattattatagacaaatcgctgaattttggcttgaggataatagccgtaatataactatattaaagccggaaaatagactttatatagttgaaaagagtttatcgcaagaaagtgatatatactcttacttattatatgatctttacgcagttttaagtaatatagacggcgatataatccatgctaaaatatattacaagccaacgataagctttatttggcttggaattattcttaccgcgtccggtttttttattgcactaatcagaaaaaattctagctaa

SEQ ID NO: 67987 - protein, 662 aa, Rickettsia conorii str. Malish 7
MSEIGNFLLLTTMYLSVIGLSFVFYVIPAKAGIHKKSLLYRLNCRFRGNDNYLITCPFYIAASCTILAFFTLVYAFIISDFSLQNVFLNSSTLKPLIYKIAGSWSSHEGSMLLWFCLLQIVSCCYIFLLEDNRLKFLSIIILSAIQLLFSSFIYFTSNPFNVFSFVPKEGLGLNPMLQDIALSIHPPLLYLGYVSYVVPFTIVCASMSFSYPLMSFPRKRASINDLRLLKTFSNIGILFTTIGISLGSWWAYRELGWGGFWFFDPVENISLFPWLSGIMLHHSIIVTTKTRRMQNWTVILSIITFLLVIFSAFLVRSGFITSIHSFAFSPERGIYLLGIFLIMGIGSIGWYTTTSLRGNALTLTKQSQEANQDCYSHFCGFAMTHCGNSILLGNIFLLLSLIVLIAATLYPPLYSLFDDKSIIISETFFVNNFIIFVIPILGTIGLFTTRSSIKKHIIILILSLIITYLISLKVTFSVISILTIIASIFLMLHNIHYLLVKTNYCRNRLKASNASMILGHFGFALISFSITMNTLLQSEMDFTGRVGTSKTFNEFKVTLQNIKFAQGKNYYRQIAEFWLEDNSRNITILKPENRLYIVEKSLSQESDIYSYLLYDLYAVLSNIDGDIIHAKIYYKPTISFIWLGIILTASGFFIALIRKNSS

SEQ ID NO: 67988 - DNA, 1983 bp, Caulobacter crescentus CB15
  CDS (1)..(1983): transl_table=11
atgatcgtcgaactcggcgctttcgcgctcattctctctctgatgctgtcggtcgcccagaccggcctgtcggccgtgggcggcgcgcggcgctcgccggtgctggcgggcgcgggccagggcgcggcgatcgcgaccttcgtggccctgctggtctcgttcgcggcgctgatctacgccttcgtgacgtcggacttctcggtgaccaacgtcgccaccaactcccacaccgacaagccgatgctctacaaggtggccggcgcctggggcagccacgagggctcgatgctgctgtggtgcttggtgctgaccggctttggcgcggccatggccgtgttcggcgacagcctgccgccgcgcctgcgcgcctacgccatcgccgtgcagggcgggctgggcgtcatgttcctggcctacaccgtgttggcgtcgaacccgctggcgcggctgcttgaggcccccatcgagggcaagtcgctcaatccgctgctgcaggactgggccttggccttccacccgccgttcctctacgtcggctatgtcgggttctcggtagtctattcgctgtcgatggcggccctgatcgaaggccggatcgacgcggcctgggcgcgctggattcgcccctggaccctggcggcctggagcatgctgacggtcggcatcacgctgggcgccttctgggcctattacgaactgggctggggcggctggtggttctgggacccggtcgagaacgccagcttcatgccctggctgatcggggcggccctgctgcactcggccatcgtcaccgaaaggcgcggcgcgctgccgggctggacggcgttcctggccctggcggcctacaccttctcgatgctgggcgccttcctggtgcgctcgggcgtgctgacctccgtccacgccttcgcggtcgatccgacgcgcggcgtgctgctgctgatcatgatggccgtggccgccggcgcgggcttcctgctgtttggcctgcgcgcccccagcctgaaccgcggtggccagttccggccgatcagccgcgagagcgccatcgtgctcaacaacatcctgctgtcgacggcgacggcggtggtgctgctgggcaccctctatccgctgatccgcgaggccatggacggcgaggccgtgtcggtgggcgcgccgttcttcaacctgaccttcacgccgctgatgatcctggccttcgccgtgctgcccgccggaccactgttggcttggaagcgcggcgacgccaagggcgtggcgcgcaagctgtgggtcgtgctggccctggcggccctgctgggcctgatcgcctatgccgtggtgcagccgcgcaaggccctggccagcggcggcctggtggtcggcttctggctgatcggcggcgcgctgctcgagatcgccgagcgcctgaagctggcgcgcgcgcccttcgccgagagccttcgccgggcacacggcctgccgcgcggcgcctggggcacgaccctggcccatgcgggtctgggcgtgttcgtgctgggggcctcgttcgagaccgcctggcgcgtcgaggcggctcaggccctgagcctgaacggcagccagccgctgggcgcctataccgtaaccctgacggatgtggtgacgatcgaggggccgaactatctggccgagcgcggcatcatcaccgtcaccaacaaggccggcgccgaggtgtgccgcgcccagcctgagcgccgcttctatccgacgggggcccagaccacgtccgaggtcgccatctgcgccaagggcctggacgacatctatgtggtgatgggcgagcggcgggcaggcgagggcggcaagccggcctggctggtgcgggcctatgtgaacccgtgggtgcggctgatcttcctgggtccgctgctgatggccgtcggcgggatcgtctcgctgtcggaccgccgcgtgcgcctgggcgtgggacgacggaccggggaggtggtgtcgtga

SEQ ID NO: 67989 - protein, 660 aa, Caulobacter crescentus CB15
MIVELGAFALILSLMLSVAQTGLSAVGGARRSPVLAGAGQGAAIATFVALLVSFAALIYAFVTSDFSVTNVATNSHTDKPMLYKVAGAWGSHEGSMLLWCLVLTGFGAAMAVFGDSLPPRLRAYAIAVQGGLGVMFLAYTVLASNPLARLLEAPIEGKSLNPLLQDWALAFHPPFLYVGYVGFSVVYSLSMAALIEGRIDAAWARWIRPWTLAAWSMLTVGITLGAFWAYYELGWGGWWFWDPVENASFMPWLIGAALLHSAIVTERRGALPGWTAFLALAAYTFSMLGAFLVRSGVLTSVHAFAVDPTRGVLLLIMMAVAAGAGFLLFGLRAPSLNRGGQFRPISRESAIVLNNILLSTATAVVLLGTLYPLIREAMDGEAVSVGAPFFNLTFTPLMILAFAVLPAGPLLAWKRGDAKGVARKLWVVLALAALLGLIAYAVVQPRKALASGGLVVGFWLIGGALLEIAERLKLARAPFAESLRRAHGLPRGAWGTTLAHAGLGVFVLGASFETAWRVEAAQALSLNGSQPLGAYTVTLTDVVTIEGPNYLAERGIITVTNKAGAEVCRAQPERRFYPTGAQTTSEVAICAKGLDDIYVVMGERRAGEGGKPAWLVRAYVNPWVRLIFLGPLLMAVGGIVSLSDRRVRLGVGRRTGEVVS

SEQ ID NO: 67990 - DNA, 1932 bp, Salmonella typhimurium LT2
  CDS (1)..(1932): transl_table=11
atgatgcctgaatacggccacgcgctgctgtgcctggcgctcggcgtggcgctgctgctgtccgtttacccgctgtggggcgtggcgcgcggtgacgcgcggatgatggcgtcggccggggtgttcgcctggctgctgtttatctgcgtggcgggcgcgtttttcgtgctggtgcacgcctttgtggttaacgacttcaccgtggcctatgtcgccggcaactcgaacacgcagctgccggtgtggtaccgggtggccgccacctggggggcgcacgagggctcgctgctgctgtgggtgctgctgatgagcggctggaccctggcggtggcggtgttcagccggcaggtgccggcggatatcgtcgcccgggtgctggcggtgatggggatggtctgcgccggttttctggcgttcatcctgttcacctccggcccgttcgcccgcacgctgccggcctttccggtggaggggcgcgacctgaacccgctgctgcaggacccggggctgattttccacccgccgctgctgtacatgggctatgtcggcttctcggtggccttcgccttcgccatcgccgcgctgctgagcgggcgtctggacagcgcgttcacccgttttgcccgcccgtggacgctggcggcgtgggtgttcctgacgctgggcatcgtgctcggctcggcgtgggcctactacgagctgggctggggcggctggtggttctgggacccggtggagaacgcctcctttatgccgtggctggcgggcaccgccctgctgcactcgctggcggtcaccgaacagcgcgccggctttaaggcgtggacgctgctgctgtccatctgcgccttctcgctgtgcctgctgggcaccttcctggtgcgctccggggtgctggtgtcggtgcacgccttcgcctccgacccggcgcgcgggatgtttatcctcgcctttatggtgctggtcaccggcggctcgctgctgctgttcgccgtgcgcgggcacagggtgcgttcgcgggtgaacaacgcgctgtggtcgcgcgagtcgctgctgctcggcaacaacgtcctgctgatggccgccatgctggtggtgctgctgggcaccctgctgccgctggtgcacaaacagctggggctgggcagcatttcggtgggggagccgttctttaacaccatgttcacctggctgatggtcccctttgccctgctgctgggggtggggccgctggtgcgctggggccgggaccggccgcgtaacatcaggacgctgctgctcaccgccctggtctccaccctggtgctgtcggtacttttgccatggctgctggaagataaaatcatcgccatgacggcggtggggatggcgatggcctgctggattgcggtgctggcggtggccgaagccgtacagcgcgtgtcccgcggcacgaaaacctctctcagctactggggaatggtggcggcgcacctcgggctggcggtgacgattaccggcatcgccttcagccagaattacagcgtggagcgtgacgtgcggatgcgggcgggcgacagcgtgaccattcacgactaccgcttcaccttccgggaggtgcgggacatcaccgggcccaactaccgcggcggggtggccctcatcggggtgacgcgccacggcgagccggaggcggtgctgcacgcggagaaacggctctacaacaccagccggatggtgatgaccgaggcggcgattgacggcgggctgacccgcgacctgtacgccgcgctcggggaggagctggacaacggcgcgtgggccgtgcgcctgtactacaaaccgtttgtccgctggatatgggccgggggactgctgatggcgctgggcgggctgctgtgcctggcggacccgcgctaccgccgccgtaaaccattgccggaggccggatga

SEQ ID NO: 67991 - protein, 643 aa, Salmonella typhimurium LT2
MMPEYGHALLCLALGVALLLSVYPLWGVARGDARMMASAGVFAWLLFICVAGAFFVLVHAFVVNDFTVAYVAGNSNTQLPVWYRVAATWGAHEGSLLLWVLLMSGWTLAVAVFSRQVPADIVARVLAVMGMVCAGFLAFILFTSGPFARTLPAFPVEGRDLNPLLQDPGLIFHPPLLYMGYVGFSVAFAFAIAALLSGRLDSAFTRFARPWTLAAWVFLTLGIVLGSAWAYYELGWGGWWFWDPVENASFMPWLAGTALLHSLAVTEQRAGFKAWTLLLSICAFSLCLLGTFLVRSGVLVSVHAFASDPARGMFILAFMVLVTGGSLLLFAVRGHRVRSRVNNALWSRESLLLGNNVLLMAAMLVVLLGTLLPLVHKQLGLGSISVGEPFFNTMFTWLMVPFALLLGVGPLVRWGRDRPRNIRTLLLTALVSTLVLSVLLPWLLEDKIIAMTAVGMAMACWIAVLAVAEAVQRVSRGTKTSLSYWGMVAAHLGLAVTITGIAFSQNYSVERDVRMRAGDSVTIHDYRFTFREVRDITGPNYRGGVALIGVTRHGEPEAVLHAEKRLYNTSRMVMTEAAIDGGLTRDLYAALGEELDNGAWAVRLYYKPFVRWIWAGGLLMALGGLLCLADPRYRRRKPLPEAG

SEQ ID NO: 67992 - DNA, 2223 bp, Salmonella typhimurium LT2
  CDS (1)..(2223): transl_table=11
ttgcataatctggacatcttccttcctgaagccggatttctggcgctgttgttgagtctcggggtcaacgtgctgaccccgctggcgacgtggtgcgggatggggcagcactggcgcggcgtcatgcgcctgacgacctgcggcgcgtggacggcgttcacgctgctgctactggcgtttgcgattctggttagctgttttctgaccagcgatttttcggtcgtttatgttgcgcagcatagccatagtcagttgtcatggggactgaaactggcggcggtatggggcggtcatgaaggttcgctcctgctgtgggcgctgcttctttcggggtggacggcgctattcgcctggcgctcccggcatgaatctgacgcgctttttccgctgaccctgagcatcttgtccttcattatggcctcgctgctgctatttattgtgctgtggtccgatccgttcctgcgtattttccctcccgccatggaagggcgcgaccttaatcccatgctgcaacatctggggctgatcttacatccgccgctgctctatctgggttatggcggcctgatgaccgcggcgagcgtagcgctggcttcgctactgtgcggcggctttaacgccacaaccgcctgggtttgctggcgctgggcgttaccgggttggtgcgctctgacgctggggatcattctcggatcgtggtgggcatattgcgaactgggctggggcggctggtggttctgggacccggtggaaaatgcctcgttgttgccgtggcttgccgccagcgcgttgctgcacagtctgtatgtcagccgccagcgcgggagcttccgccactggtcgttgctgctggcgatactgacgctgatcctctcgttgctgggaacgctgattgtgcgttccggcattctgctctccgtccatgcttttgcgctggataacgtgcgcgcggtgccgctgtttatcctttttgccgcgttaagtctggcatcgcttgctctgtacggctggcgggcacgggagccgtatccggcgacgcgtttgggcggcggaaagtgcgaaacgctcattctgacgacgctgctgctctttagcgccgtcttgttgatcgtgctggtcgggacgctctaccccatgatttatggtttgatgggctggggaaggctttcggtgggcgcgccctattttaatcgcgtcacgctgccgtttggcctgctgatgctggtagttatcgtgctggcgacaatcagaagccgcaaagtctctgtgcgttgtcagcttccggcattgctggcgcatacgggcgtatttatcttcgccgccgggatcatggtttccagcggcagtcggcatgaaatcagccttaacctcagccccggtcagcaggtggtactggcgggctatacctttcgtttcgagcgtctggatctggaagccaaaggcaactacaccagtgaaaaagcgcggatcacgttgtggcggaatgaaaaacgcattggcagcctgcagcctgaaaggcgcttctatgccgcgcgtcgtcaacagatgatggagccggggattcactggaacctgctacatgactggtacgcggtgatgggcgaaaaaaccggaccggatcgttacgccatgcgcttatacgtgcagaccggcgtgcgctggatctggggtgggggattgttgatggtgtgtggagcgctgctgagcggatggcgggggaggaagcatcctgagttattgcctgatggcgctgcgcttatcaggcctacgagtgaaaagcatggtaggccggataaggcgttcacgccgccatccggcaaaacgatgttacttttggctttactgatttttctgccttttgccacccatgcccaggtggtggacacatggacgtttgccaacccgcagcagcaggagaaagcgctgtctattgccagtcagctgcgctgtccgcagtgtcagaaccagaacttgctggaatccaatgcgcccgtggcggtcagtatgcgccatcaggtttacagcatggttgccgaaggtaaaagcgaagcggaaatcaccgcctggatgaccgaccgctatggtgatttcgtgcgctacaacccgccgctgaatgagcaaacgctgctgttgtgggcgctgccgtacctgctgttattgctggtgggcgtggtggcctggcgggtgagaaagcgtcagcacgcaggagagggggaacaatga

SEQ ID NO: 67993 - protein, 740 aa, Salmonella typhimurium LT2
MHNLDIFLPEAGFLALLLSLGVNVLTPLATWCGMGQHWRGVMRLTTCGAWTAFTLLLLAFAILVSCFLTSDFSVVYVAQHSHSQLSWGLKLAAVWGGHEGSLLLWALLLSGWTALFAWRSRHESDALFPLTLSILSFIMASLLLFIVLWSDPFLRIFPPAMEGRDLNPMLQHLGLILHPPLLYLGYGGLMTAASVALASLLCGGFNATTAWVCWRWALPGWCALTLGIILGSWWAYCELGWGGWWFWDPVENASLLPWLAASALLHSLYVSRQRGSFRHWSLLLAILTLILSLLGTLIVRSGILLSVHAFALDNVRAVPLFILFAALSLASLALYGWRAREPYPATRLGGGKCETLILTTLLLFSAVLLIVLVGTLYPMIYGLMGWGRLSVGAPYFNRVTLPFGLLMLVVIVLATIRSRKVSVRCQLPALLAHTGVFIFAAGIMVSSGSRHEISLNLSPGQQVVLAGYTFRFERLDLEAKGNYTSEKARITLWRNEKRIGSLQPERRFYAARRQQMMEPGIHWNLLHDWYAVMGEKTGPDRYAMRLYVQTGVRWIWGGGLLMVCGALLSGWRGRKHPELLPDGAALIRPTSEKHGRPDKAFTPPSGKTMLLLALLIFLPFATHAQVVDTWTFANPQQQEKALSIASQLRCPQCQNQNLLESNAPVAVSMRHQVYSMVAEGKSEAEITAWMTDRYGDFVRYNPPLNEQTLLLWALPYLLLLLVGVVAWRVRKRQHAGEGEQ

SEQ ID NO: 67994 - DNA, 1992 bp, Agrobacterium tumefaciens str. C58
  CDS (1)..(1992): transl_table=11
atgatcaacgagatcggccattatgtcctggttttggcgctcggtgttgggctgatcgtctcgacgctgcctgttatcggcgcgcgccgcaacgatcgggcactgatggatgtcgcctcccttggctcggtcctgatgttcctgctggtggggttctccttcgcggcactgacacatgcctatgccgtctcggatttttccgtgcgcaacgtctgggaaaactcccattcgctgatgccgatgctctacaagctgaccggtgtttggggcaaccatgaaggctccatgctgttgtggctgctgatcctggtgtttttcagcgcgcttgtcgccgccttcggcggcaacctgccggaaacgctcaaagccaatgtgcttgcggtacaggcatggatttcggtcgccttcctgctgttcatcctgctcacctccaacccgttcctgcggctggagcgggtgccggccgaggggcaggacctcaatcccatccttcaggatttcggcctcgccatccatccgccgctgctctatctcggttatgtcggtttttccgtctgcttctcctttgccgtcgcagcacttctggaaggtcgtatcgacgccgcctgggcgcgctgggtaaggccgtggacgctcgccgcctggacgttcctgaccgcaggtatctccatgggctcctactgggcctattatgaactcggctggggcggctggtggttctgggatccggtggaaaacgcctccttcatgccctggcttgccggcacggcgctgctgcattcggcgctcgtcatggaaaaacgcgaggcgctgaaaatctggaccgtgcttctggcgatcatgaccttttcgctgtcgctgctcggcaccttcctcgtgcgctccggcgtgctgacctccgtgcatgctttcgccaccgatccgagccgcggcatcttcattctcggcattctgacgatcttcatcggtggcgcctttgcgctctttgcctggcgcgcgccgtcgctgaaggccggcggcctgttcgcgccgatctcgcgtgaaggcgcgctcgtcctcaacaaccttatcctgacggtttcgaccgccaccgtgctgatcggcacgctttacccgctcattctcgaaaccctgacgggcgaaaaaatctcggtcggtgcgccgttcttcaacctcaccttcggcctgctgatgatcccggtcctgatcgtcacacctttcgggccgatgctcgcctggaagcgcggcgatctcttgggtgccttccagcggctttatgtggccgcggctatcgcggctctggccgggctgaccctctggtatatcgaaaatggcggtccggtgctggcagcactcggtattgccgccggtttctggttgatcttcggggcgctcaccgatctctggtatcgcgccaatttcggcaaactggccttcggcattgcattccgccgcctgaaaggcctgccgcgttcggccttcggcacggcgctggcgcatatgggcctcggcatcaccgtgctcggcatcgtcatcgtcaccacctatgagaccgaaacggttctggaaatgaaacagggcacggtggcggaagcgggcggttacagcctgaccttcgacggcatccgccacgccgtcggcccgaatttcaccgaggatcgtggccatttcaccgtgcgcaaggcgggtgttgaggtggccgacgtctggtcgtccaagcggctttataccgcgcggcgcatgccgacgacggaagccggcatcctgaccttcggcctcagccagctttatgtctcgctgggcgatcccatggccgatggcggcatggtcgtgcgcatctggtggaaacccttcatcctctgcatctggggcggcacgctgttcatgatggcgggcggtttcatctcgctttccgacaggcggttgcgggtgggtgcgccgacccgcaaggcgaagcctgtacgggctgcaatgccggaggcggcggaatga

SEQ ID NO: 67995 - protein, 663 aa, Agrobacterium tumefaciens str. C58
MINEIGHYVLVLALGVGLIVSTLPVIGARRNDRALMDVASLGSVLMFLLVGFSFAALTHAYAVSDFSVRNVWENSHSLMPMLYKLTGVWGNHEGSMLLWLLILVFFSALVAAFGGNLPETLKANVLAVQAWISVAFLLFILLTSNPFLRLERVPAEGQDLNPILQDFGLAIHPPLLYLGYVGFSVCFSFAVAALLEGRIDAAWARWVRPWTLAAWTFLTAGISMGSYWAYYELGWGGWWFWDPVENASFMPWLAGTALLHSALVMEKREALKIWTVLLAIMTFSLSLLGTFLVRSGVLTSVHAFATDPSRGIFILGILTIFIGGAFALFAWRAPSLKAGGLFAPISREGALVLNNLILTVSTATVLIGTLYPLILETLTGEKISVGAPFFNLTFGLLMIPVLIVTPFGPMLAWKRGDLLGAFQRLYVAAAIAALAGLTLWYIENGGPVLAALGIAAGFWLIFGALTDLWYRANFGKLAFGIAFRRLKGLPRSAFGTALAHMGLGITVLGIVIVTTYETETVLEMKQGTVAEAGGYSLTFDGIRHAVGPNFTEDRGHFTVRKAGVEVADVWSSKRLYTARRMPTTEAGILTFGLSQLYVSLGDPMADGGMVVRIWWKPFILCIWGGTLFMMAGGFISLSDRRLRVGAPTRKAKPVRAAMPEAAE

SEQ ID NO: 67996 - DNA, 1992 bp, Brucella melitensis 16M
  CDS (1)..(1992)
atgagtgtcgagatcggccattttgctctggtgctggcgcttgcgctgtcgattgttcaatccatcgtgccggtggtcggcgcgcatcgccgtgatgcgcaactgatggcagtggccgtgccaacggcgcttgcagtcttcgctctgatcgttctggcatccgccgctctgatccacgcctatgtcgtttccgatttctcggtccttaacgtggtcgagaactcccattcgcaaaagccgcttctctacaagatcaccggtgtctggggcaatcatgaaggctccatgctgctctgggtgttcatcctcacccttttcagcgcgctggttgcagccttttccggcaatctgcctgaaacgctgcgtgccaatgttctggccgtgcagggctggattggcaccgcctttctcgcattcatcattttcacgtccaatcccttcacccgcattttcccggctcccatggaaggcggcgatctcaacccggtccttcaggatatcggcctcgccatccatccgccgcttctttatctgggctatgtcggcttttcggtctgtttctcctttgctgttgcggcgcttctcgaaggccgtctcgacgcggcatgggcgcgctgggtgcgcccatgggcgctcatggcgtggatgttcctcaccggcggtatcgcaatgggttcttactgggcctattatgaactgggttggggtggctggtggttctgggatccggttgaaaatgcatcgctcatgccatggctggtcgggacggcgctgcttcattccgccatcgtcatggagaagcgctcggcgctcaagatctggacggtgcttctcgccattctcaccttctcgctgtcattgctcggcactttccttgtgcgctccggcgtgctgacctccgtgcacagtttcgcgaccgatccggggcgcggcctgttcattctgggcattctcgcgctcttcattggcggctcgctgtcgctcttcgcgctgcgcgtccaaagcctgagcgcaggcggcattttccatccgatttcccgcgaaggcgcgctggtcttcaacaatctctttctgacgactgccgccgcaaccgttctcatcggaacactctatccgttgcttcttgaagttacgaccggcgaaaagatttccgttggcgcacccttcttcaacatgaccttcggcccgctgatggtgccgctcctgtttgccgtgcctttcggcccgctgctcgcatggaaacgcggtgatctttatggcgtcgggcagcgcctgatgacggctttcgcattgtcgctggccgttgtcggcatcatgctctggcgaacctccgcgcattcggtcctagctgctctcggcatcggtcttgcggcatggctcatcttcggcagcctgaccgatcttgttctcaaggctggtattggcaaggtgtcggccagcaaggcgtttgcgcgcttcaagggcctgccgcgctccgtcttcggaacgtcgcttgcgcatatcggacttggtctcacgcttctcggtattgtcagcgtcacgacattcggtaccgaaaacgtgctcgtcatgcagcccggcgggaccgccaaagtccagaattacacgctgcgttttgaaggactgcgccccatcacgggttccaacttcaccgagaacaggggcgccttcacgctgcttgattccagtggccgcgatctggccgtgatcgaaccgtccaagcggttcttccctgcgcgccagatgcccacgactgaatccggtatcaagacgctctggttcagccaggtctatgtcgcccttggtgacgagccgggcaatggcgcggtggtcgtgcgcatctggtggaagccgctggtcacgctcatctggtacggtgcgcttgtcatgatgctgggtggcttgttctcgctggccgaccgccgcctcagggttggtgcgccttccaaggtgcgcaggtccgcctcgaaggaagcggaagccgtcgcatga

SEQ ID NO: 67997 - protein, 663 aa, Brucella melitensis 16M
MSVEIGHFALVLALALSIVQSIVPVVGAHRRDAQLMAVAVPTALAVFALIVLASAALIHAYVVSDFSVLNVVENSHSQKPLLYKITGVWGNHEGSMLLWVFILTLFSALVAAFSGNLPETLRANVLAVQGWIGTAFLAFIIFTSNPFTRIFPAPMEGGDLNPVLQDIGLAIHPPLLYLGYVGFSVCFSFAVAALLEGRLDAAWARWVRPWALMAWMFLTGGIAMGSYWAYYELGWGGWWFWDPVENASLMPWLVGTALLHSAIVMEKRSALKIWTVLLAILTFSLSLLGTFLVRSGVLTSVHSFATDPGRGLFILGILALFIGGSLSLFALRVQSLSAGGIFHPISREGALVFNNLFLTTAAATVLIGTLYPLLLEVTTGEKISVGAPFFNMTFGPLMVPLLFAVPFGPLLAWKRGDLYGVGQRLMTAFALSLAVVGIMLWRTSAHSVLAALGIGLAAWLIFGSLTDLVLKAGIGKVSASKAFARFKGLPRSVFGTSLAHIGLGLTLLGIVSVTTFGTENVLVMQPGGTAKVQNYTLRFEGLRPITGSNFTENRGAFTLLDSSGRDLAVIEPSKRFFPARQMPTTESGIKTLWFSQVYVALGDEPGNGAVVVRIWWKPLVTLIWYGALVMMLGGLFSLADRRLRVGAPSKVRRSASKEAEAVA

SEQ ID NO: 67998 - DNA, 2109 bp, Pyrobaculum aerophilum str. IM2
  CDS (1)..(2109): transl_table=11
atggccagcctgcggcgaatactcgctaattatttccacctatccccggccgtttctctcgcccttttatttttttacatctctaggtttataacgctagacacctcctatttagacgtctacgccaacacctcatggggaatgccgctgtactaccggctggccgcctcgcttgtaaacgtgggggggattatgttgtacatcgccgcgattttaggcctaatggccgttgtggcaaaaagctggaggctcgccgcggcttcgcacgtatttctactcgccgcattttactggggggcttttgtcaaatggggaggcggggggccgggcattggcctaaaccccttgttgagaaacccctgggccctcccccacccgctaatggttattgcctcttacgccatggttttagccgcagtggcggagcccagagtcagggagagagcgggcgttttggcctgggttttctccacggccgggctggccgcgggcgggtattggtcttataccaccttcggctgggggggctactgggcgtgggaccccgtcgagacctctgtgtttattatgtggcttttcctaaccgcttggatacacggcagaggctccggggctttgtacgcggcgcttggggccgtcttcctcaccatggccgtcacgtacagcggggtgtcgccgttgcactccttcgcgggagtggcggccgcggggaagtggctcctcataacctctgtaattgccttaatctacggcctcataaaggcgagctgggagaggggatctgcgttctcctacctcccgcctctcgtcgccggggcgtatatctattggataatcgccggccccatggcggcgcagtcattaggcctccccgtggctattccctcaggggatagcgccgtggcgcttatccacccgctcttaatacccgcagtcttggcggcgttttttggaatggcgaaaagggcctttcccccgagggcagtggccctttacatgggggcgtcggcagttgcctcgctcgccctagtctctatgggcattctctggtcccccctgagcagcctctggacaaacgtggctatttacctcatagtcctaaccgctccgctgccaattgccgcgtcgcttttaaaaatacgtaaagacttggcagagctttcccacataggctttgccgttttagcagtgggggccgcgctgagcggcccgtatgcctatcacatgcagtacggcgtcgtggtgcccctcggcgtgggacagccggcgcttgtgcccctgcccagcccttacgggccggaggcggttagcattaaagttgtggagtggcgggcggcggggccgtgggagttagtgtcaatcccgccgtatctctcaaggctcgtctcgcccgatttggccggcttaatgggcgtgtggggcttggatttgaggtttgacagcgtcgtcctcaacggcactaaatacgtagtggcctttggcaattacacgcctggttttcacaggctgggtagctactggctatacgttaactccacagtagacaccccgaggggcaagcttttagtagccgccctgggcatcggggacagggcccttgtcttcagccctcagaaattcgacgtaatttcagcagtcgtcgcgtgtaagcccaacgccacttcattgaatttaatagaggagagagtcatcctggggatagacggcgcggctgttgaggctacaattagatacgaggcctcgggggagttcaaactcattaggggcttaatacacggaatagccacagtgcccagagggctagacgacgtttatatcgccgtgacccccgaggtggccgtggtgggcaacgtgagctatacccgcatcgccttagagctggcgaggcggaatttaaatgcgtgtctcccccttggcgcgtggatgttgctgtcggcatatagcggtaggccgctcagcggcggggaggtaaacgccttgttgaaaaacagcccccagggctacgtggcgtatgtaaagataatccccatggttcaattagtgtggataggggcggcgcttttagtagcaggaggccttgtaaaggctgttaggagacatgtggcttag

SEQ ID NO: 67999 - protein, 702 aa, Pyrobaculum aerophilum str. IM2
MASLRRILANYFHLSPAVSLALLFFYISRFITLDTSYLDVYANTSWGMPLYYRLAASLVNVGGIMLYIAAILGLMAVVAKSWRLAAASHVFLLAAFYWGAFVKWGGGGPGIGLNPLLRNPWALPHPLMVIASYAMVLAAVAEPRVRERAGVLAWVFSTAGLAAGGYWSYTTFGWGGYWAWDPVETSVFIMWLFLTAWIHGRGSGALYAALGAVFLTMAVTYSGVSPLHSFAGVAAAGKWLLITSVIALIYGLIKASWERGSAFSYLPPLVAGAYIYWIIAGPMAAQSLGLPVAIPSGDSAVALIHPLLIPAVLAAFFGMAKRAFPPRAVALYMGASAVASLALVSMGILWSPLSSLWTNVAIYLIVLTAPLPIAASLLKIRKDLAELSHIGFAVLAVGAALSGPYAYHMQYGVVVPLGVGQPALVPLPSPYGPEAVSIKVVEWRAAGPWELVSIPPYLSRLVSPDLAGLMGVWGLDLRFDSVVLNGTKYVVAFGNYTPGFHRLGSYWLYVNSTVDTPRGKLLVAALGIGDRALVFSPQKFDVISAVVACKPNATSLNLIEERVILGIDGAAVEATIRYEASGEFKLIRGLIHGIATVPRGLDDVYIAVTPEVAVVGNVSYTRIALELARRNLNACLPLGAWMLLSAYSGRPLSGGEVNALLKNSPQGYVAYVKIIPMVQLVWIGAALLVAGGLVKAVRRHVA

SEQ ID NO: 68000 - DNA, 1998 bp, Xanthomonas campestris pv. campestris str. ATCC 33913
  CDS (1)..(1998): transl_table=11
atgacgcctgaacttggccagatcgcgctgattttggcgttgctgttgtcgctgacgcagggcgtgttgccgctgatcggtgcctggcgcggcaacaccgcgctgatggcggttgcgcggcctgccgccgccggccaggcggtgttcgtgtggctggccttcggcctgttggcctggtcgctgctgtcgctggatttttcggtgcgctatgtcgccgacaacgccaacatcgccctgccctggtattaccgcatcgccgcggtgtggggcgcgcacgaaggttcgctgctgctgtggatcgcgatcctgtccacctggacggtgctgctggccgcctgcagccggcacttgccgcagcacttcgccgcacgcgtgctggcggtgctggggctggtatcggtgggctttctggccttcatcctgctgacctccaatccgtttgggcggctgtcgccgattccgctcgacggcagggaactcaatccggtgctgcaggacccgggcatgaccttccacccaccggtgctctacaccggttatgtcggcttctcggtggcattcgcgttcgcggtagccgccctgctgggcggcgaactcgaacaggcctgggtgcgctgggcgcggccatggaccaacgtcgcctgggcctgcctcaccgccggcatcgtggccggcagctggtgggcgtatgcggaactgggctggggcggctggtggttctgggacccggtggaaaacgccagtttcatgccgtggctggtgggcaccgcgctgattcatacccaggcagtgaccgaaaaacgcggcagcctgcgtgcctggaccatcctgctgtcgatcctggcattttcgttgtcgttgctgggtaccttcctggtgcgctcgggcgtgctcacctcggtgcatgcgtttgccgccgacccacggcgcggcctgtacatcctgattttcctggtggcggtggtgggcggctcgctgctgctgtatgcgctgcgcgcgcccaagatcgccaccggcaaaccgttcgcagcggcctcgcgcgagaccgcgatcctggtcggcaacctgctgctcaccgtggccgcggcgatggtgttgctgggcaccttgttcccgctggtggccgatgcgttcgggctgggcaaggtgtctgtgggcccgccctacttcggcctgctgtttccgttgctgatggcgccggtggtgctgttaatgccattcggcccgtacttgcgctggggcaaggccgagatggcaccgctgctgtcgctgggcgcgcgtgcgggcattgccgccatcgcctgcgcgctggtcgccagcgtgtttgccgagggccaggccaaggccattgccggcatcggtgcggccgcctgggtggctgccggcaccgcgttgtacatgcacaagcgctggcgcgagatgccgcgcggccggcgctttcctgccgagatggccggcatgttgttggcgcacgccggtgtggcggtgttcgtggccggcgtgctggtgtcggacagcctgtcggtggaacgcgacgtgcggctggcgcccggccagagcgcggagatcgccggctacagcttccgcttcgatggcgtgcagctggtggatgggcccaactggaaagccgaacaaggcagcgtgcaggtcagccgtgatggtgcgccggtggctaccttgcatccgcaaaaacgcctgtacagcagtgagcgcatccagaccgaatcggcgatcgacgccggcgccacccgcgacctctacgtggcgctgggcgagccgctggacgaccagcacatcgaaaacgactggacgctgcggctgtactacaaaccgttgatccgctggatctgggccggcgggctgttgatgatgctgggcgggttcgtcagcgcctgcgcgcggcgcttccgcgcaccggtacctgcggttgccgcggtgtcgtcgcctgctcccatcgcccccactcccctcgccgttgccggagagttgcacctgtga

SEQ ID NO: 68001 - protein, 665 aa, Xanthomonas campestris pv. campestris str. ATCC 33913
MTPELGQIALILALLLSLTQGVLPLIGAWRGNTALMAVARPAAAGQAVFVWLAFGLLAWSLLSLDFSVRYVADNANIALPWYYRIAAVWGAHEGSLLLWIAILSTWTVLLAACSRHLPQHFAARVLAVLGLVSVGFLAFILLTSNPFGRLSPIPLDGRELNPVLQDPGMTFHPPVLYTGYVGFSVAFAFAVAALLGGELEQAWVRWARPWTNVAWACLTAGIVAGSWWAYAELGWGGWWFWDPVENASFMPWLVGTALIHTQAVTEKRGSLRAWTILLSILAFSLSLLGTFLVRSGVLTSVHAFAADPRRGLYILIFLVAVVGGSLLLYALRAPKIATGKPFAAASRETAILVGNLLLTVAAAMVLLGTLFPLVADAFGLGKVSVGPPYFGLLFPLLMAPVVLLMPFGPYLRWGKAEMAPLLSLGARAGIAAIACALVASVFAEGQAKAIAGIGAAAWVAAGTALYMHKRWREMPRGRRFPAEMAGMLLAHAGVAVFVAGVLVSDSLSVERDVRLAPGQSAEIAGYSFRFDGVQLVDGPNWKAEQGSVQVSRDGAPVATLHPQKRLYSSERIQTESAIDAGATRDLYVALGEPLDDQHIENDWTLRLYYKPLIRWIWAGGLLMMLGGFVSACARRFRAPVPAVAAVSSPAPIAPTPLAVAGELHL

SEQ ID NO: 68002 - DNA, 1938 bp, Xanthomonas campestris pv. campestris str. ATCC 33913
  CDS (1)..(1938): transl_table=11
atgctgcctgaactcggtaccttcctgctggtgctggcgctgctggtggcgctggtgcaggccgtcgtgccgctggccggtgcgcagcgcgggcgcagtgcctggatggcggttgcccgccccgccgcattggtgcaactggcactgatcgctgcggcattcgcggtgttgacgcacgctttcctggtgcaggatttttcggtgcgatacgtggccgagaactccaactcgctgctgccgttgatctatcgctattcggcggtctggggcgcacacgaaggctcgttgctgctatggacgctggtgctggcgctatggacgggcgcggtggcgatctggtcgcggcagttgcccgcccaggtgatcgcacgcgtgctgggcgtgatggcgctggtgagcatcggcttcctggcgttcctgttgttcacctccaatccgttcgcgcggttgatgccggtgccgctggaaggcgccgacctcaatccgctgctgcaggacccgggcctgatcatccatccgccgatgctttattgcgggtatgtgggctttgcggtgccgttcgcgttcgccattgccgcgctgctggaaggccgcatggacgcacgctggctgcgctggacgcggccatggaccaacattgcctggtcgatgcttaccgtaggcatcgcgctgggcagctggtgggcgtattacgaactgggctggggtggctggtggttctgggacccggtggaaaatgccagcttcatgccctggctggtcggaactgcgctgctgcactcgcaggcggtcaccggaaaacgcggcagcttcgccagctggacgctgctgctggcaatcgccgccttcgcgctgtcgctgctggggaccttcctggtgcgttcgggtgtgctgaccagcgtgcattcgtttgcggccgatccctcgcgcggcgtgttcatcctggtgttcctgctgagcgtggtcggcggctcgttgctgctgtatgtgctgcgcgcgccgcggttgtcgcagggcgatgacccgcgccgggcctttgccggcagctcgcgcgaaacgctgttgctgttgaacaacctgctgctggcctgcgcctgcgcgatggtgctgctgggcacgctgtacccgctgctggccgatgcgctgggcctgggcaaactgtcggttggcccgccctacttcggcacgctgttcctggtgctgatggcgccgctggtggcgctgctgccgttcgggccgctgacccgctggcagcgcgaccaaccctcgcgtccgctggcgatgctcgcgccctgggccgcgctggccgtcgtgctcggggtgctggcctggttcgccgcaccgcagggccagctgaaaacggcactcggcgtggcgggagcggcctgggtggtgctgggcacgctgcgttttttgtggacgcgccgcgctgccaaggggcgcaagttcaccgccgagatgctcggcatggcgctggcgcatacgggcgttgctgtgttcctggccggtgccttgctggtggaatcgctcagcctgcagcgcgaagtcgcgctggcacccggccagcagatggagatcggcagctacgcactgcatttcgacgggctgaaagaagtgcgcgggccgaactacgtctccgaccgcgccaccttgcaggtgttcaaggacgacgcggcagtgggcacgctgcatgccgaaaaacgccgttacgccagtggcggccaaaccctgaccgaggcggcgatccgcccgggtccgtttggcgatctttacgtcgccctgggcgaaccgctgggcaatcaggcctgggcggtgcgtgtgcatctcaaaccgtttgtccgctggatctggctgggagcgctgctgatggcgctcggcggcctggtcaccgcggccgaccggcgtttccgtcgttctccggagtccctaaatgtctga

SEQ ID NO: 68003 - protein, 645 aa, Xanthomonas campestris pv. campestris str. ATCC 33913
MLPELGTFLLVLALLVALVQAVVPLAGAQRGRSAWMAVARPAALVQLALIAAAFAVLTHAFLVQDFSVRYVAENSNSLLPLIYRYSAVWGAHEGSLLLWTLVLALWTGAVAIWSRQLPAQVIARVLGVMALVSIGFLAFLLFTSNPFARLMPVPLEGADLNPLLQDPGLIIHPPMLYCGYVGFAVPFAFAIAALLEGRMDARWLRWTRPWTNIAWSMLTVGIALGSWWAYYELGWGGWWFWDPVENASFMPWLVGTALLHSQAVTGKRGSFASWTLLLAIAAFALSLLGTFLVRSGVLTSVHSFAADPSRGVFILVFLLSVVGGSLLLYVLRAPRLSQGDDPRRAFAGSSRETLLLLNNLLLACACAMVLLGTLYPLLADALGLGKLSVGPPYFGTLFLVLMAPLVALLPFGPLTRWQRDQPSRPLAMLAPWAALAVVLGVLAWFAAPQGQLKTALGVAGAAWVVLGTLRFLWTRRAAKGRKFTAEMLGMALAHTGVAVFLAGALLVESLSLQREVALAPGQQMEIGSYALHFDGLKEVRGPNYVSDRATLQVFKDDAAVGTLHAEKRRYASGGQTLTEAAIRPGPFGDLYVALGEPLGNQAWAVRVHLKPFVRWIWLGALLMALGGLVTAADRRFRRSPESLNV

SEQ ID NO: 68004 - DNA, 1938 bp, Xanthomonas axonopodis pv. citri str. 306
  CDS (1)..(1938): transl_table=11
atgcttcctgaactcgggacgttgctgctggtgctggccctgctggtggcgctggtgcaggccgtggtgccgctggccggcgcacagcgcggacgcagcagctggatggccgtggcgcgaccggcggcgctggtgcagctggcactgatcgcatcggccttcgccgtgttgacgcacgccttcttggtgcaggatttttcggtgcgctacgtcgccgagaattccaacagcctgctgccggtgatgtaccgctattcggcagtgtggggtgcgcacgaaggctcgctgctgctgtggacgctggtgctggggttgtggaccggcgcggtggcgatctggtcgcggcagctgccggcgcatgtgatcgcgcgcgtgctcggcgtcatggcgctggtcagcatcgggtttctggcgttcttgctgttcacctccaacccgtttgcgcggttgtttccggtgccgctggagggtggcgacctcaatccgctgctgcaggatccggggctgatcgtccatccgccgatgctgtattgcggctacgtcggctttgcggtgccgttcgcattcgccatcgccgcactgctggaaggccgcatggacgcgtgctggctgcgctggacgcggccgtggaccaatgtcgcctggtcgatgctcaccgtcggcatcgcgctcggtagctggtgggcgtattacgagctgggctggggtggctggtggttctgggacccggtggagaacgccagtttcatgccgtggctggtgggcaccgcactgttgcattcgcaggcggtgaccgaaaagcgcggcagcttcgccagctggaccttgttgctggcgatcgccgcctttgcgctgtcgctgctgggcacgtttctggtgcgctcgggcgtgctgaccagcgtgcattcgttcgccgccgacccgtcgcgcggactgttcattctggtattcctgctggccgtggtcggtggttcgttgctgctgtatgcgctgcgcgcgccgcttctgtcggtggcggacgatccgcgtcgcgcattcgccggcagttcgcgcgaaaccttgttgctgttgaacaacctgctgctcacctgcgcctgcgcaatggtgttgctgggcaccttgtatccgctgctcgccgatgccttggggctgggcaagctgtcggttggcccgccctacttcggcaccttgttcgtggtgttgatggcgccgctggtggcactgctgcccttcggcccgctcacccgctggcagcgcgaacaggcctcgcggccggtggcgctgctggcgccgtgggcagccctggcgttggctgccggcgtgctggcctggttcgccgcgccgcaggggcagttgaaagccgccttcggtgtcgccggtgcagcctgggtgttgctgggcaccgcgcggttcctgtggacgcggcgggcggccaaggggcgcaaattcaccgccgagatgctgggcatggtgctggcgcacctgggcgttgcggtgttcctgtccggtgccatgctggtggagggattgagcctgcagcgcgaagtggcgctggcgcccgggcaacaggtgcagatcggccgctatgcactgcatttcgacgggctggaagagctgcgcgggcccaattacgtgtccgaccgtgccaacctgcaggtgttcaaggacgatgcgccggcgggcatgctgcatgcggaaaagcgccgctacgccagtggcggccagacgttgaccgaggcggcgatccgccctggcccgtttggcgacctgtatgtcgcccttggcgaaccgctgggcaaccaggcctgggcggtacgtgtccacctcaaaccgttcgtccgctggatctggctgggagcgctgctgatggcgctcggcggcctggtgaccgcggccgaccggcgttttcgtcgttctccggagatccaagatggttga

SEQ ID NO: 68005 - protein, 645 aa, Xanthomonas axonopodis pv. citri str. 306
MLPELGTLLLVLALLVALVQAVVPLAGAQRGRSSWMAVARPAALVQLALIASAFAVLTHAFLVQDFSVRYVAENSNSLLPVMYRYSAVWGAHEGSLLLWTLVLGLWTGAVAIWSRQLPAHVIARVLGVMALVSIGFLAFLLFTSNPFARLFPVPLEGGDLNPLLQDPGLIVHPPMLYCGYVGFAVPFAFAIAALLEGRMDACWLRWTRPWTNVAWSMLTVGIALGSWWAYYELGWGGWWFWDPVENASFMPWLVGTALLHSQAVTEKRGSFASWTLLLAIAAFALSLLGTFLVRSGVLTSVHSFAADPSRGLFILVFLLAVVGGSLLLYALRAPLLSVADDPRRAFAGSSRETLLLLNNLLLTCACAMVLLGTLYPLLADALGLGKLSVGPPYFGTLFVVLMAPLVALLPFGPLTRWQREQASRPVALLAPWAALALAAGVLAWFAAPQGQLKAAFGVAGAAWVLLGTARFLWTRRAAKGRKFTAEMLGMVLAHLGVAVFLSGAMLVEGLSLQREVALAPGQQVQIGRYALHFDGLEELRGPNYVSDRANLQVFKDDAPAGMLHAEKRRYASGGQTLTEAAIRPGPFGDLYVALGEPLGNQAWAVRVHLKPFVRWIWLGALLMALGGLVTAADRRFRRSPEIQDG

SEQ ID NO: 68006 - DNA, 1971 bp, Yersinia pestis KIM
  CDS (1)..(1971): transl_table=11
atgatccctgaaattggcagttttttattatgtttggcgttggcgatttcactgctgctgagtctgtatccacaatggggagccgcgcgtcaggatgcccgtatgatggcggttggcaggccactgacttatggcatgtttgccgcgatcacgttgtcatttatctgtctgatatatgcatttgtggtaaatgattttaccgtctcctatgtcgcggcgaattccaactcatatttgccgatttattaccgtattgccgcgagttggggagcgcacgaaggctccttattattatgggtattgctgctcagttgttggtcattggcggtagcgctgtttagccgttcgatgccagaggatgcggtggcgcgggtgttatccgtgctgggaatgattaccggcggttttctgctatttattattctgacgtctaacccgttctctcgcacattacctgattttcctattgatggccgcgatctgaacccgctactacaagatgttgggttgattttccatcccccgctgctctacatggggtatgtcggtttctccgtcgcgtttgcttttgcaattgcatcattaatggccggtaggctcgacagtgcctgggcgcgttggtcacgtccatggactcaggccgcatggattttcctaacgcttggcatcgtacttggctcagcgtgggcttattatgaattggggtggggcggctggtggttctgggacccggtcgaaaatgcctcctttatgccgtggctggcaggtaccgcactgattcactcactggctgtcacggagaagcgcggtactttcaaagcgtggacggtattgttggcgatcaccgcgttctccttgtgtttgatggggacattcttagtccgctcaggcgtgctggtttcggtgcactcctttgcctctgatccggcccgtggcatgtttattctggcctatctggtgattgtgattggcggttccctgctgctgtatgcggtaaaaggcgcgcaggtgcgcagccggactcagcatgaagtcttttcccgcgagactttcctgctcggcaacaatgtgttgcttattgccgcaatgctcgtggtgttgctgggaacattactgccactggttcacaaacagttgggattgggcagtatctccattggtgaaccgttctttaatacgatgttcacttggttaatggctccgatggcattgctcatggggatagggccgctcgtgcgttggcgtcgtgatgaaccgagcaaactgtggaagcggttgagtgtggctctggtggtcactctgctgttatcgatatccgtaccgtggctgctgcaagatagtgtcgccggtatgacggtcgtcgggttgatgatggccatttgggtgatcatcctgacattaatggaattgcacgaacgggccacccatcgttatggcttctggcgtgggttgactcacctttcccgtagccactggggcatggtgttggggcatctcggggtggcggttacggtaattgggattgcgtttagccagaattacagtgtcgaacgcgatgtgcgcatgaaggccggtgatagtatcgatatccatgattatcacttcacttttcgcgatgtccacgatatcaaagggcctaactataccggcggcgttggcattattgatgtcacccgtaatggtaaattggaggccacattacatgcagaaaaacgctattacagtgtcgcccgctcaatgatgactgaagcagccattgatggggggctgacccgcgatctttatgccgccttgggtgaagagctgggcgatggctcatgggcggtccgcttgtattacaaaccttttgtgcgttggatatggtttggcgggatctttatggccgtcggcggcatcttctgtatgctcgatccgcgctatcggatgagtaaaaagctaaaacgcggtgcgataccggaggcagagtcatga

SEQ ID NO: 68007 - protein, 656 aa, Yersinia pestis KIM
MIPEIGSFLLCLALAISLLLSLYPQWGAARQDARMMAVGRPLTYGMFAAITLSFICLIYAFVVNDFTVSYVAANSNSYLPIYYRIAASWGAHEGSLLLWVLLLSCWSLAVALFSRSMPEDAVARVLSVLGMITGGFLLFIILTSNPFSRTLPDFPIDGRDLNPLLQDVGLIFHPPLLYMGYVGFSVAFAFAIASLMAGRLDSAWARWSRPWTQAAWIFLTLGIVLGSAWAYYELGWGGWWFWDPVENASFMPWLAGTALIHSLAVTEKRGTFKAWTVLLAITAFSLCLMGTFLVRSGVLVSVHSFASDPARGMFILAYLVIVIGGSLLLYAVKGAQVRSRTQHEVFSRETFLLGNNVLLIAAMLVVLLGTLLPLVHKQLGLGSISIGEPFFNTMFTWLMAPMALLMGIGPLVRWRRDEPSKLWKRLSVALVVTLLLSISVPWLLQDSVAGMTVVGLMMAIWVIILTLMELHERATHRYGFWRGLTHLSRSHWGMVLGHLGVAVTVIGIAFSQNYSVERDVRMKAGDSIDIHDYHFTFRDVHDIKGPNYTGGVGIIDVTRNGKLEATLHAEKRYYSVARSMMTEAAIDGGLTRDLYAALGEELGDGSWAVRLYYKPFVRWIWFGGIFMAVGGIFCMLDPRYRMSKKLKRGAIPEAES

SEQ ID NO: 68008 - DNA, 1980 bp, Shewanella oneidensis MR-1
  CDS (1)..(1980): transl_table=11
atgatcccagaacttggacacttttcgctgataataggagtggcttttgccttcttattaaccagcgttccccttataggtgttgcccgtaaagaccaatatctagtgaggtatgcttggccgttagcctacggaatgttcttttttatcgctttatccgtagtatcacttggttacagcttcgccgttgatgatttctccgtggcctatgtggcacatcactctaattctcagttacctatcttctttaagattgcggccgtatggggcggtcatgaagggtcgctgctattctgggtgttcgcgctatccacttgggctgcctctgttgctttattcagtaaaggcttagaagaagtcttcaccgctcgcgtgttagcggtattggcattgattgtgattggcttcagcttgtttatgttactcacttctagcccatttgaacgtatattcccaatgcctgctgaaggccgcgacttaaatccaatgctgcaggatgtgggcttaatcttccaccctccgatgttatatttgggttatgtgggtttctcagtcagttttgcatttgcgattgcagctttgatgagtggtcaccttgattctgcttgggctcgttggtcgcgtccttggaccttagccgcttgggttttcctcactggtggtattgcattaggttcttggtgggcgtattacgaattaggctggggtggatggtggttctgggatccagtagaaaacgcttcatttatgccttggctagtgggtacggctttagtgcattcactgatcgtgacggaaaagcgcggtgcattccgtaactggacggtattgctgtctatcttcgcattctcgctaagtttactcggtacctttatcgtacgctctggtgtgttgacttcagtgcattcatttgcagccgatccaagccgcggtatgtttattctattattgcttggtctcgctatcggtggttcgctcactttgtttgccttccgtgcaagtgaaatgagcagccctgcacgcttcgagctgaaatcaaaagaaaccatgctgttagtttgtaacgtgttactgacggttgcagcgggtactgttctgttaggcactttatacccactgctgatcgatgcgttaggcatgggtaagatttctgttggacctccatactttaacgctgtgtttgtacccatagtacttgtactgtttgcctttatgggcgtcggtccaatcattcgttggaaaaaatcgaaagctggtgaattgaagcgacagttactcgtacctgcattagtatctctggtgattggtattgtcacgccgtttatcgtcgatggggcctttaacgcttgggttgcttgcggtatcgccgctgcagcttggattattttggcaaccgcaaaagcagcttacagcatcgttaagcctaaagatggtgaagtaagcatcgcacgtatgggccgtagccaactcggtatgatcatcgcgcacttaggtattgctgtgtctgttattggtgccactatggtgtctaactactcagtggagaaaagtgtgcgtatggggcctggcgtaagccaagagctagcgggttacacctttaaatatctcgaaactaaaaacgttgttggtcctaattacactgcgcagcaaggtcaaattgagatttacaaaggcgataagttactgacactgctcaaacccgatcgtcgccaatacaatgtgcgtactatggatatgaccgaagccggtatcgattggggtctgttccgcgatctgtatgtgacgatgggcgatccgattagtagtactgaatttgctgtgcgtttgaactacaagccgtttgtgcgttggttatggttcggagcaatattcatgatggtcggcggtttctttgccgcatcggataaacgctatcgctcaaaagtcgcggctaccgttaaaccgcaagctgaaaaagcgaaattagctaccgctcaataa

SEQ ID NO: 68009 - protein, 659 aa, Shewanella oneidensis MR-1
MIPELGHFSLIIGVAFAFLLTSVPLIGVARKDQYLVRYAWPLAYGMFFFIALSVVSLGYSFAVDDFSVAYVAHHSNSQLPIFFKIAAVWGGHEGSLLFWVFALSTWAASVALFSKGLEEVFTARVLAVLALIVIGFSLFMLLTSSPFERIFPMPAEGRDLNPMLQDVGLIFHPPMLYLGYVGFSVSFAFAIAALMSGHLDSAWARWSRPWTLAAWVFLTGGIALGSWWAYYELGWGGWWFWDPVENASFMPWLVGTALVHSLIVTEKRGAFRNWTVLLSIFAFSLSLLGTFIVRSGVLTSVHSFAADPSRGMFILLLLGLAIGGSLTLFAFRASEMSSPARFELKSKETMLLVCNVLLTVAAGTVLLGTLYPLLIDALGMGKISVGPPYFNAVFVPIVLVLFAFMGVGPIIRWKKSKAGELKRQLLVPALVSLVIGIVTPFIVDGAFNAWVACGIAAAAWIILATAKAAYSIVKPKDGEVSIARMGRSQLGMIIAHLGIAVSVIGATMVSNYSVEKSVRMGPGVSQELAGYTFKYLETKNVVGPNYTAQQGQIEIYKGDKLLTLLKPDRRQYNVRTMDMTEAGIDWGLFRDLYVTMGDPISSTEFAVRLNYKPFVRWLWFGAIFMMVGGFFAASDKRYRSKVAATVKPQAEKAKLATAQ

SEQ ID NO: 68010 - DNA, 2058 bp, Shewanella oneidensis MR-1
  CDS (1)..(2058): transl_table=11
atgattccagaaatcgggcacatattgctgatcatgagtactgtgtttgcattattgtcggcggccagtcatttaatcggtagttaccagcgcaacctttatttaattgcatttggcaatagattattttacgcgttatttttcaccttattaaccgcgttatgtagcttagtttttagctttattgccgatgacttttcagtcgcctatgttgccaatcattccaacagccaactcgccctcggttataaagtcgctgcggtgtggggcagccatgaaggctcaatgctgttttgggtatttgccattgccctatggggtgcagtgatcaattggcgccaagcaacccatagcgccaaactcgatctggaaaacttacaagcagataaggcttactttggtcgggtactcgctattttggccttagtgatcctcggttttaatttgtttttactctttacttccaatccctttgctcgcttgctaccgaacattccagtcgaagggcgcgaccttaaccccatattgcaggacattggcttaatactgcatccacctatgctgtttttgggttatgtcgggctaacggtttgctttgccgcagcgctggcatcactgattgggggcaagttacctgctcgccacctcgattatttacgtccttgggtgctactggcgtggattttcctcacaggtggtaatgcctttggctcttggtgggcctacaacgaactgggttggggtggttggtggttttgggaccccgttgaaaacgcctcttttattccttggttggttgcaacagcgctggtgcattccttagtactcacccgaaaaacccagggatttaccctcaccaccctgtttttatgtttattggccttctccctcagtctgttaggcagctttttagtgcgttcaggcatagtgcaatcggtgcatgcctttgccgcagatccaacccgcggtatgtctattctcagtttgctggtgatttttgttggcgctgcattattaatttttgcgctcaaggccaatctattaaggcgtgaaatcgactttggtctgtacagtaaggaaacgctattactgctcgggatagtgattttagtggttgccgccttttcagtgttgcttggcactttttacccgctgatttatgaactcctcaacctaggtacactttcagtcggggcgccgtacttcaacgccatatttgtaccattgacctttttagtcgtactactgatggggattgcccccctcgtcgaatggcaaaatacctctaaggctcaagctatgccgatattgctgttcggctttggggtattggctatcgccttttgggtaagtctacaggcggcgtctggcagcaacttattcttactgcttggcacggcggcagccttatggcttatcgtgtgcttattactgacgctgttagtgagtcttagtgttcgcaaacgcgccagtacaaaccaaattacagccaacgcgcccgtaaaatcccgcacctcaaaacaacgctttatcggcatgatgctcgcccacctcggggttgccatcaccattattggtgcctcagcggtatccaattttgaagaagaagcactgctcagaatgggcccaggccaaggtaagccgttagcgggttatatcttagtgtatgaaagcactgagaatgtcgaaaccaatagctttacggcaatccaagccaatatcagtatccgcgatggcgcgaatgatgaagagatcctcggttatgtaaggccgcaacgacaaacttttaaaagcaacgcgatggaaatgtcccacgcggggatcgaccacggtttttggcgggatatttatgtctcaatgggcgtgcaattaagtgacagcgaatatctgatccgtattagctataaaccactggccacttggatttggctgggggcacttttcatgatgctcggcggcgccattgccgcgtggcccgtaaggcaagctcgccgcgtcgaacaatcagaacagctcagtacaagctcatcatctgcaagggagacggtaacccaatga

SEQ ID NO: 68011 - protein, 685 aa, Shewanella oneidensis MR-1
MIPEIGHILLIMSTVFALLSAASHLIGSYQRNLYLIAFGNRLFYALFFTLLTALCSLVFSFIADDFSVAYVANHSNSQLALGYKVAAVWGSHEGSMLFWVFAIALWGAVINWRQATHSAKLDLENLQADKAYFGRVLAILALVILGFNLFLLFTSNPFARLLPNIPVEGRDLNPILQDIGLILHPPMLFLGYVGLTVCFAAALASLIGGKLPARHLDYLRPWVLLAWIFLTGGNAFGSWWAYNELGWGGWWFWDPVENASFIPWLVATALVHSLVLTRKTQGFTLTTLFLCLLAFSLSLLGSFLVRSGIVQSVHAFAADPTRGMSILSLLVIFVGAALLIFALKANLLRREIDFGLYSKETLLLLGIVILVVAAFSVLLGTFYPLIYELLNLGTLSVGAPYFNAIFVPLTFLVVLLMGIAPLVEWQNTSKAQAMPILLFGFGVLAIAFWVSLQAASGSNLFLLLGTAAALWLIVCLLLTLLVSLSVRKRASTNQITANAPVKSRTSKQRFIGMMLAHLGVAITIIGASAVSNFEEEALLRMGPGQGKPLAGYILVYESTENVETNSFTAIQANISIRDGANDEEILGYVRPQRQTFKSNAMEMSHAGIDHGFWRDIYVSMGVQLSDSEYLIRISYKPLATWIWLGALFMMLGGAIAAWPVRQARRVEQSEQLSTSSSSARETVTQ

SEQ ID NO: 68012 - DNA, 1989 bp, Pseudomonas putida KT2440
  CDS (1)..(1989): transl_table=11
atgaacgcagcactggtagtccccgaactgggccagttggcgatgattctggccatctgctttgccgtcgtacaggccagtgtgccgttgcttggcgcgtggcgtggcgacagcctgtggatgagcctggcgcggccggcagcctgggggcagttcgccttcctggcgtttgcctttgcctgcctgacccatgccttcatgacagacaatttctcggtcgcctatgtggccagcaactccaacagcgccttgccctggtactacaagttcagtgcggtgtggggcgcccatgagggttcgttgctgctttgggcgctgatccttggcggctggacctttgccgtgtcggtgttctcccggcagttgccgcaggtgatgctggcccgcgtgctggcggtaatgggcatgatcagcgtgggcttcctgagcttcctgatcattacttccaacccgttccagcgcctgctgccgcaggtgccgaccgatggccgtgacctcaacccgctgttgcaggactttggcctgatcgttcacccacccatgctctacatgggctatgtgggcttctcggtggctttcgcgttcgccattgccgccttgctcggcggccggctggacgctgcctgggcgcgctggtcgcggccgtggaccatcgtcgcctgggctttcctgggtgttggcatcaccttggggtcgtggtgggcctactacgaactgggctggggtggctggtggttctgggacccggtggaaaacgcctcgttcatgccttggctggtgggcaccgcactgatccactcgctggcggtgaccgagaaacgcggggtgttcaagagctggaccgtgctgctggcaattgccgcattctccctgagcctgctgggtaccttcctggtgcgttccggagtgctgacctcggtgcacgcgtttgccgccgacccgtcgcggggtattttcatcctgtttttcctgctgttcgtggtcggcggctcgctcaccctgttcgccctgcgcgcaccggtggtcaagagccaggtcggtttcgccctgtggtcgcgtgaaacgctgctgctggccaacaacctggtgctggtggtcgcggcttcgatgattctgctcggtaccctgtacccattggtgctcgatgccctgaccggggccaagctgtcggtcggcccgccctatttcgacgccttgttcctgccactgatggcgctgctgatggtggtgctgagcgtgggcgtggtggtgcgctggaaggacaccccgggcaaatggttggtcagcatgatgaccccggtattgatcggcagtgccatccttgcaccggttgccggctttatcgtcgacgacttcgactggccgacgctgacggccttcgccctggccgcctgggtagtgcttggcgggctgcgtgacattttcgacaagacccgccacaagggcctggtcaaaggcctgccgggcctgggccgcagctactggggcatgcaactggcgcacctgggcctggcggtgtgtgcgctgggcgtggtgctgtccagcaacaacagcgccgagcgcgacctgcgcatggcgccgggcgaaagcgtggagctgggtggctaccacttcctgttccagggcgccaagcacttcgaggggccgaacttcatctctgacaagggcaccatcgtggtcagccgcgagggccgtgaagtgaccacactgtacccagagaagcgcctgtacaccgtgcaacagtcgatgatgaccgaagcgggcatcgacgccggctttacccgcgacctgtacgtcgcgcttggcgagccactggagaatggcgcctgggctgtgcgcgtacatattaagccttacgtccgctggatctggctgggcggtctgctgaccggcctgggcgggttgctggcggccctcgaccggcgctaccgcgtcaaggtcaagacccgggtgcgtgatgtcctgggcgtgtctggagcagctgcatga

SEQ ID NO: 68013 - protein, 662 aa, Pseudomonas putida KT2440
MNAALVVPELGQLAMILAICFAVVQASVPLLGAWRGDSLWMSLARPAAWGQFAFLAFAFACLTHAFMTDNFSVAYVASNSNSALPWYYKFSAVWGAHEGSLLLWALILGGWTFAVSVFSRQLPQVMLARVLAVMGMISVGFLSFLIITSNPFQRLLPQVPTDGRDLNPLLQDFGLIVHPPMLYMGYVGFSVAFAFAIAALLGGRLDAAWARWSRPWTIVAWAFLGVGITLGSWWAYYELGWGGWWFWDPVENASFMPWLVGTALIHSLAVTEKRGVFKSWTVLLAIAAFSLSLLGTFLVRSGVLTSVHAFAADPSRGIFILFFLLFVVGGSLTLFALRAPVVKSQVGFALWSRETLLLANNLVLVVAASMILLGTLYPLVLDALTGAKLSVGPPYFDALFLPLMALLMVVLSVGVVVRWKDTPGKWLVSMMTPVLIGSAILAPVAGFIVDDFDWPTLTAFALAAWVVLGGLRDIFDKTRHKGLVKGLPGLGRSYWGMQLAHLGLAVCALGVVLSSNNSAERDLRMAPGESVELGGYHFLFQGAKHFEGPNFISDKGTIVVSREGREVTTLYPEKRLYTVQQSMMTEAGIDAGFTRDLYVALGEPLENGAWAVRVHIKPYVRWIWLGGLLTGLGGLLAALDRRYRVKVKTRVRDVLGVSGAAA

SEQ ID NO: 68014 - DNA, 1683 bp, Escherichia coli CFT073
  CDS (1)..(1683): transl_table=11
ttgttgttaagtctcggggtcaacgtgttgaccccgttgacggccttcgcgggagtgcggttgcgctggcctgccatgatgcgactcacttgcatcggcattctggcgcagttcgcgctcctgctgctcgcctttggcgtactgacgtattgttttctcatcagcgatttctcggtcatttatgtcgcccaacatagctatagcctgctgtcgtgggaactcaaactggcggcggtgtggggcggtcatgaaggttcgctgctgctttgggtgctgctgctttccgcctggagcgcgctgtttgcctggcattatcgacagcaaaccgatccgctatttccgctgacgctagccgttttatctctcatgctcgccacactgctactgtttgtggtgctgtggtccgatcccttcgtgcggatatttccaccagcaatcgaaggccgcgatctcaatccgatgctgcaacatcccggtcttatctttcatccaccgctgctttatctcggctacggcggtttgatggtggcggcgagcgtggcactggcgagtttactgcgcggcgagcttgatggtgccagcgcccgaatttgctggcgttgggcactacctggctggagcgcattaacggcggggatcatcctcggttcctggtgggcctattgcgaactgggctggggcggctggtggttctgggatccggtggaaaacgcgtcgttattaccctggctttctgccacagcgctgctgcacagtttatccctgacacgccagcgggggattttccgccactggtcgctgttgctggcgatagtaactctgatgctgtcgctgctgggcaccttaattgtccgttctggcattctggtttcggttcatgcgttcgcgctggataacgtccgcgccgtgccgttgttcagcctgtttgcactgattagccttgcgtctctggctctgtatggctggcgagcgcgggacggtggcccggcggtgcgtttttcggggttatcgcgggaaatgttaatcctcgctacgctgttgctgttttgcgcagtgctactgatcgtgctggtgggaacgctttatccgatgatttacggcctgctgggctggggacgcctctccgttggcgcgccgtattttaaccgcgcgacgttaccgtttgctctgttgatgctggtggtgattgtgctggcgacgtttgtctctggcaaacgtgctcagcttccggcgctgctggcgcatgcgggcgtgctgttatttgccgcggggatcgtggtttccagcgtcagccgtcaggagatcagcctgaatttacagccgggtcagcaggtgacgctggcaggatacaccttccgttttgagcgcctcgatctgcaagccaaaggcaattacaccagcgaaaaagcgatagtggcactgtttgaccatcagcaacgcattggtgaattaacgccggagcggcgtttttacgaagcacgtcgtcagcaaatgatggaaccgtcaattcgctggaatggcatccatgactggtatgcggtcatgggcgagaaaaccggagcggatcgttacgcttttcgtttgtatgtacaaagcggtgtgcgctggatctgggggggaggattgttgatgattgcgggcgcattgttaagcggatggcggggaaggaagcgcgatgaataa

SEQ ID NO: 68015 - protein, 560 aa, Escherichia coli CFT073
MLLSLGVNVLTPLTAFAGVRLRWPAMMRLTCIGILAQFALLLLAFGVLTYCFLISDFSVIYVAQHSYSLLSWELKLAAVWGGHEGSLLLWVLLLSAWSALFAWHYRQQTDPLFPLTLAVLSLMLATLLLFVVLWSDPFVRIFPPAIEGRDLNPMLQHPGLIFHPPLLYLGYGGLMVAASVALASLLRGELDGASARICWRWALPGWSALTAGIILGSWWAYCELGWGGWWFWDPVENASLLPWLSATALLHSLSLTRQRGIFRHWSLLLAIVTLMLSLLGTLIVRSGILVSVHAFALDNVRAVPLFSLFALISLASLALYGWRARDGGPAVRFSGLSREMLILATLLLFCAVLLIVLVGTLYPMIYGLLGWGRLSVGAPYFNRATLPFALLMLVVIVLATFVSGKRAQLPALLAHAGVLLFAAGIVVSSVSRQEISLNLQPGQQVTLAGYTFRFERLDLQAKGNYTSEKAIVALFDHQQRIGELTPERRFYEARRQQMMEPSIRWNGIHDWYAVMGEKTGADRYAFRLYVQSGVRWIWGGGLLMIAGALLSGWRGRKRDE

SEQ ID NO: 68016 - DNA, 2052 bp, Nitrosomonas europaea ATCC 19718
  CDS (1)..(2052): transl_table=11
atgattccggaacttggtaactttgccctcatcctcgcaatgctgctggccctggtccagggaacactacccatcattggcgcggcacgtggtataccctcgtggattgctttggcgcgtccggtcacacagggacattttgtatttatcgcgattgctttcgggtgccttgcctattcgttcgtaaataatgatttctctgtattgaacgtggcatccaactcgaattctgatcttcctgtgcattttcgttttgctgcaacatggggatctcatgagggttcattattgctatgggtgaccatgcttgccggctggtctgtggctgtaagtgttttcagtcgtcagttgccggacgatatggtagctcgtgtcttgggtgtgctggggctggtcagtgctggttttctgctgtttcttttgtttacctccaaccctttcgacaggttgttgccggcagcaatcgaagggaatgacctcaatccactactgcaggatccgggaatggttatgcatccacccatgttgtatatggggtatgtaggtttttcagtggcatttgcatttgcaattgcagcactgcttaacggccagctggatgcagcctgggcgagatggtcacgtccatggaccgttgttgcctggattttcctgactattggcatcatgggcggcagctggtgggcatattatgagctggggtggggtggctggtggttctgggatccggttgaaaatgcatcattcatgccttggctggtaggtaccgcactgatacattcactggccgtgactgaaaaacgcggaagtttcaagagctggacggtgttactggcaattactgctttttcactgagtctgttggggactttcctggttcgttctggggttctgacttccgtacatgcttttgcaacagatccggcacgcgggatatttattctggtctatctctcgctggtcgtagggtgttcactgacactgtttgcatggcgagcatcgaaagtaggtcttggtggtaattttgaaattgtctcacgtgaaactactttgcttgccaataatgtattgctgctggtggctgcaggtagcgtattgctgggtacactttaccctctcctgatcgatgcattggatctggggaaaatttctgtaggccctccttattttgaggctgtttttgtgcctctgatggcaccggcaatctttctgatcgggttggggccgattgctcgctggaagaaagccagcctgccagccctggcggtgctgatgagatgggcattcgttgtgagtctggtggctgcagggatcatgccgttcatcatgggcgagtggaaacctatggtcagttttggattgcttctggctttctgggtcatcgccagtatatttgtcagcatcagccatcgactccggaacggtggtgaaggtggattgtttaccagactggcaaaacagccaaggggttattacggtatgcactgtgcacatttgggtattgcagtgttcatcatcggtgtgacgctggtcaatggttatgaaaccgagaaagatgtgcgaatggaagtcggcagtaccgtgacactcaaggaatataccttccagttcaatggaaccaagtcggttaccggccctaattacaatgcatctcagggacaggtcgaggtattcagggaaggtaaaaaagtcagtgagttgcagcctgaaaaaagaacctataccgcatcaggtatgcctatgactgaggcggcggttgacatggggctgttgcgtgatttgtatgttgcactgggtgagccgttggaaaacggtgcctggatagttcgtgtctatcacaaaccttttgttaactggatatggctgggttgtatgttgatggctttaggaggagcgctggctgccagtgatcgacgttatcgtctcgcaattggcaagaaatcgaggaataaggcagcttcaggaccagtagcaccggaaactgcagatataccggccgggagcatggttaccaattcagttatcctctcggaggaaggtggtaaggtatga

SEQ ID NO: 68017 - protein, 683 aa, Nitrosomonas europaea ATCC 19718
MIPELGNFALILAMLLALVQGTLPIIGAARGIPSWIALARPVTQGHFVFIAIAFGCLAYSFVNNDFSVLNVASNSNSDLPVHFRFAATWGSHEGSLLLWVTMLAGWSVAVSVFSRQLPDDMVARVLGVLGLVSAGFLLFLLFTSNPFDRLLPAAIEGNDLNPLLQDPGMVMHPPMLYMGYVGFSVAFAFAIAALLNGQLDAAWARWSRPWTVVAWIFLTIGIMGGSWWAYYELGWGGWWFWDPVENASFMPWLVGTALIHSLAVTEKRGSFKSWTVLLAITAFSLSLLGTFLVRSGVLTSVHAFATDPARGIFILVYLSLVVGCSLTLFAWRASKVGLGGNFEIVSRETTLLANNVLLLVAAGSVLLGTLYPLLIDALDLGKISVGPPYFEAVFVPLMAPAIFLIGLGPIARWKKASLPALAVLMRWAFVVSLVAAGIMPFIMGEWKPMVSFGLLLAFWVIASIFVSISHRLRNGGEGGLFTRLAKQPRGYYGMHCAHLGIAVFIIGVTLVNGYETEKDVRMEVGSTVTLKEYTFQFNGTKSVTGPNYNASQGQVEVFREGKKVSELQPEKRTYTASGMPMTEAAVDMGLLRDLYVALGEPLENGAWIVRVYHKPFVNWIWLGCMLMALGGALAASDRRYRLAIGKKSRNKAASGPVAPETADIPAGSMVTNSVILSEEGGKV

SEQ ID NO: 68018 - DNA, 1995 bp, Bordetella parapertussis 12822
  CDS (1)..(1995): transl_table=11
atgatcccggaaatcggcctgttcagcctcatcctggcgttgctggttgccatcgtgcagggcgtgctgccgctggtgggcgcatcgaccggctggcaggccggcctgcgggtggcgcggccggccgccgtcacccaattctgcctggtcaccgtggccatgggctgcctggcgtggtcgttcctggacaacgatttctcggtgctgtatgtggcgggcaactcgcacgccgacctgcccgccgcctaccgcttcgcggcgctatggggcggccacgagggatcgctgctgctgtggctgtacctgctgaccgcctggacgctggcggtggcgctgcacagccgcgcgctgccgccggccttcgcggcgcgcgtgctggccgtcatggcctggatcagcatcggcttcctgctgttcctgctgttcctgtccaatccgttcgagcgcctgatgccgccggcgcaggccggacgcgacttgaaccccttgctgcaggatccgggcatgatcgtgcatccgcccatgctgtacatgggctatgtgggcttttcggtggcgttcgccttcgccatcgccgcgctgctgtcgggcgagctggacgccatctgggcgcgctgggtgcggccctggaccttgctggcctggatgttcctgaccatcggcatcctgctgggcagcgcctgggcctactacgtcctgggctggggcggctggtggttctgggatccggtcgagaacgcctcgttcatgccgtggctggccggcacggcgctgatccattccctgatcgtcacggagcggcgcggcgccttccgcagctggacggtgctgctggccatcgcggcgttctcgctgagcatactgggtactttcctggtgcgctccggcgtgctgacctcggtgcacgccttcgcggtcgatcccggccgcgggctgtacatcctgggcttcatgacgctgatcgtgggcggctcgctggccctgtacgcctggcgcgcgcccaccgtaggccttggcgggggcttcgccctgctgtcgcgcgaatcgctgctgctcagcaacaacgtggtgctggccgcggctaccggcgcggtgctgctgggcacgctgtacccggtggcgctggacgtgctggactggggcaagatctcgatcggcccgccctacttcgaggcggtgttcgtgccgctgatgacgccggcgatcttcctgatgggcgtgggaccgatggcgcgctggaagcacagcgccgtgccggacctggcgcagcgcctgcgcattgccttcggcgtgagcctggccaccgcgctgacggtgccgctggcctggcccggcgcgcgcgcctggccaggctcgccgctgatcgtattgggcctgtggctggcggcctggtcggtcgccagcgccgccgcgcatgcctggcagcgcctggccgacggcgaaggctcgtgggcgcggcgcctgcgccgccagccgcgcgcctggtacggcatgctgctggcgcacgccggcgtgggcgtgttcatcgccggcgtgacgctggccaatggctatgaggacaagcaggaattgcgcatggacatcggcgccacgcaggccgccggcggctaccagttcaccttcgccggtatcgcgccggccgccggccccaactaccaggccgaacgcgcccgcttcgtggtcacgcgcgacggccggccggtggtcacgctgcatcccgagaaacgccactacacggtgcagggcatgccgctcagccatgccgccatcgacacccgctttacccgtgacctgttcgtggcgctgggcgagccggtcggccagcgggcctggacggtgcggctgcaggtcaagcccttcatggcctggatctggtcgggttgcgtgctgatggcgctgggcggcctgatggcggcaaccgaccggcgctaccgccagtggcgcgccgccgaagcgcgccaagcggtgacggcggtggcgcgggaggccggctga

SEQ ID NO: 68019 - protein, 664 aa, Bordetella parapertussis 12822
MIPEIGLFSLILALLVAIVQGVLPLVGASTGWQAGLRVARPAAVTQFCLVTVAMGCLAWSFLDNDFSVLYVAGNSHADLPAAYRFAALWGGHEGSLLLWLYLLTAWTLAVALHSRALPPAFAARVLAVMAWISIGFLLFLLFLSNPFERLMPPAQAGRDLNPLLQDPGMIVHPPMLYMGYVGFSVAFAFAIAALLSGELDAIWARWVRPWTLLAWMFLTIGILLGSAWAYYVLGWGGWWFWDPVENASFMPWLAGTALIHSLIVTERRGAFRSWTVLLAIAAFSLSILGTFLVRSGVLTSVHAFAVDPGRGLYILGFMTLIVGGSLALYAWRAPTVGLGGGFALLSRESLLLSNNVVLAAATGAVLLGTLYPVALDVLDWGKISIGPPYFEAVFVPLMTPAIFLMGVGPMARWKHSAVPDLAQRLRIAFGVSLATALTVPLAWPGARAWPGSPLIVLGLWLAAWSVASAAAHAWQRLADGEGSWARRLRRQPRAWYGMLLAHAGVGVFIAGVTLANGYEDKQELRMDIGATQAAGGYQFTFAGIAPAAGPNYQAERARFVVTRDGRPVVTLHPEKRHYTVQGMPLSHAAIDTRFTRDLFVALGEPVGQRAWTVRLQVKPFMAWIWSGCVLMALGGLMAATDRRYRQWRAAEARQAVTAVAREAG

SEQ ID NO: 68020 - DNA, 2016 bp, Cupriavidus necator
  CDS (1)..(2016): transl_table=11
atgaatgccgaactcggccatttcgcgctgatcgtggccctgctggtcgcgatagtgcaggccgcattgccgctggccggcgccgcgcacggcaacatcgcgtggatggccgtggcccgtcccgccgcgcgcgtgcagtgcgtgctggtggcgctggccttcggctcgctgacatgggccttcgtcagcaatgacttcagcgtgcgctacgtggcggcgaatgccaacaccgccctgccgctgacctaccgcattgcggccgtatggggcgggcacgaaggttcgatgctgctgtggacgctgatgctcgggctgtggtcgacggcagtttccttctgcagccggcagcggccactcgccgtcgtggcgcgtgtgctgggtgtgatgggcaccatcagcgccggcttcctgctgttcctgctgttcgcgtccaatccgttcctccgcctgctgccgcccgcgatggaaggccgcgacctcaacccgctgctgcaggacccgggcatggtgtttcatccgccgctactctatatgggctatgtcggcttctcggtcaccttcgccttcgccgtggccgcgctgctggcaggccgggccgacgccgcttgggcacgctggtcgcgcccgtggaccacggtggcgtgggcactgctgacgctgggcatcatgctcggcagtgcctgggcgtactacgaactcggctggggcggctggtggttctgggatccggtcgagaacgcctccttcatgccctggctcgcgggcaccgcgctgatgcactcgctcgcggtcacagagaaacgcggcgcgttccgcgcctggacggtgctgctcgccatctttaccttctcgctgagcctgctcggcactttcctggtccgctccggcgtgctcacctcggtgcacgcgtttgcggtcgacccgaagcgcggcatcttcatcctggcgctgctgggactggtcaccggactgtcgctgacgctctatggatggcgcgcgccgcggcttgcacggcgcgtcgaattttccgtggcagcgcgggaatccctgctgctcgccaacaatgtgctgctggccgtcgccgctgccaccgtgttgctcggcacgctctacccattgctgctggacgtgctcgggctgggcaagatctcggtcggcccggcgtacttcgagcaggtattcgtgccgctgatggcgcccgccgtgctgctgatgggcgccgcgccgctggcgcgctggcggcacggcggcctgcccgacatggcgcgacggctgcgctgggcggcggcggccagcatcgtcgtcggactcggcctgttgctggttcagcgcaacgcgtcggcgctcgcagggctggggctggtgctggcggcctggtgcgggctcagcgccgtggccagcctgtctacgcgcctgcggaaccagcaaggccggcgcctggccgccttgcgccagctgcccgcgagctattggggcatgctgctgtcgcacgcgggcgtgggcgtcttcatcgccggcgtgacgctggtgtcgagccaggagagcctgcgcgaactgcccatgcgcgtgggccacaacatcagcgttggcggctatagcttccgcttcgacggcgtgacgcaggcggcgggccccaactacgatgcgctgcgcggaacgctgtccgtgtcccgccacggcaagatcgtcgccgtcctcgccccggaacgccgcatctaccgcagccaggacatgcccaccaccgaagccgccatcgacagcggcctgacccgcgatctctacgtcgcgctgggcgagggcgtgggcgatggcggctgggcggtgcgcatccacgtcaagccgttcgtcgactggatctgggccgggtgcatcctgatggcgctgggcggcttgcttgccgtctgcgacaaacgctaccgcctgcgtcggcgcgccccggctccacaggccgaaacagtcgatgcgccgaaggcaccggcactggcgctttccaccgccgaggagacgcgggcatga

SEQ ID NO: 68021 - protein, 671 aa, Cupriavidus necator
MNAELGHFALIVALLVAIVQAALPLAGAAHGNIAWMAVARPAARVQCVLVALAFGSLTWAFVSNDFSVRYVAANANTALPLTYRIAAVWGGHEGSMLLWTLMLGLWSTAVSFCSRQRPLAVVARVLGVMGTISAGFLLFLLFASNPFLRLLPPAMEGRDLNPLLQDPGMVFHPPLLYMGYVGFSVTFAFAVAALLAGRADAAWARWSRPWTTVAWALLTLGIMLGSAWAYYELGWGGWWFWDPVENASFMPWLAGTALMHSLAVTEKRGAFRAWTVLLAIFTFSLSLLGTFLVRSGVLTSVHAFAVDPKRGIFILALLGLVTGLSLTLYGWRAPRLARRVEFSVAARESLLLANNVLLAVAAATVLLGTLYPLLLDVLGLGKISVGPAYFEQVFVPLMAPAVLLMGAAPLARWRHGGLPDMARRLRWAAAASIVVGLGLLLVQRNASALAGLGLVLAAWCGLSAVASLSTRLRNQQGRRLAALRQLPASYWGMLLSHAGVGVFIAGVTLVSSQESLRELPMRVGHNISVGGYSFRFDGVTQAAGPNYDALRGTLSVSRHGKIVAVLAPERRIYRSQDMPTTEAAIDSGLTRDLYVALGEGVGDGGWAVRIHVKPFVDWIWAGCILMALGGLLAVCDKRYRLRRRAPAPQAETVDAPKAPALALSTAEETRA

SEQ ID NO: 68022 - DNA, 2001 bp, Chara vulgaris
  CDS (1)..(2001)
atgtatgttgaaataggtcattattttttcattcttagcatttttgttgcattagcctacaaaaaaaagaatctatctttttttttttcactttactttctcgttttaaccatctgtttttttagctttttgttttgttatgtttcttctgatttctctatttatagcgtttttacaaattcaaataatcaattaccattgttttataaagtttctggaacttggtcgaatcatgaaggtagtctcttattatggtgttggatcctgagtctttatggttttttcttttgttttcgaactcgcaacgaagttgccttgactggtgcccctcttatgattcacaaatggattgctttatttttctctgtttttttatgtttaacctccaatccttttcttcgaatttcctttttaagcactgattcgggaaaagaattcaaccctgtactacaagaccccgtattggctatacatcctccttgtatttatgcaggatacgttgccagtactattggtttttgtttatgtgtatccggaactcaacaaaaaaaacacactgcgcgtgaaatcaatgaaagtgggaagctgaaagatcactgtggaaaaagaaaggcagtgatcttacgttctgtgcttcgcaccataacgcgacctcttggaagtgcctattggaaactgatacgaatttggattttaacgtgctggtgttttttaactgtaggaatactactgggaagttggtgggcttatcatgagctaggttggggcggttggtggttttgggatcccgtagaaaatgcatctttgatgccttgggtattagctacagcttgtattcattcagtcatttcatttcggttgaattcttggaccttctttctaaacattgttacttttttattcagtcttttaggtactttttttgttcgttcgggattacttgcatctgttcatagctttgccacagattcgcaacgaggaatctttttattaagttttttttttatggcaagcctatctcttttaaaaaagaatagaacgactggcgcctacgatcacctatctgaaatcgaacagattctcaaactacagctaacgctcctttgtataatttgtttggttgttctctgtggtaccgcggcacctgtgctttttcatctattagctcaaagagaagtttccactggtgctcctttctttaatggtactataatacctatttttatttgtttactacttgttttagtttatatacattacagaagtgcacagcaagcgcacagcaatcacagtgtgtttttgtgtgttttatttattattcatgtaattttcatcaagttaattgcagatttgtcgtatctagagtctttctgctgtgctctttgtttttctctctttttcagtttctttttgttcaaaccttctgcaccaatgaatatgattttgtcacatggaggagtttgtattttgattacaggtgttatcttatccaatacaaaaaagatacaaattactcaaatcatgcactttggttttgaacaaaatataggcaacggaaggttgtgttgtttacgaagtattgatcaattacatggacctacttttcaatccatttgtggaaacatagcatgtgtttctaatcatgacaccaaggctgcgatagcagcgcatcattactttgaaaaagtgatctcttgcgtgcaaagcactgatttagcaagtgatttgacgcgtagtgttgatagctttgttatgtttccagaaaaaagattctgtttttcgaatccagaaaccagtactactaaagtggctatacataccaactttttcacagatctctatgctttgataggaactggaagttttgaaactggttggtatactaccataatgaagttacctttcattttttgtatttggataggttttgttttggcttcttttggaggtttccgaagtttaatacgtcagctttcaaaacaaaaactgaattggaattaa

SEQ ID NO: 68023 - protein, 666 aa, Chara vulgaris
MYVEIGHYFFILSIFVALAYKKKNLSFFFSLYFLVLTICFFSFLFCYVSSDFSIYSVFTNSNNQLPLFYKVSGTWSNHEGSLLLWCWILSLYGFFFCFRTRNEVALTGAPLMIHKWIALFFSVFLCLTSNPFLRISFLSTDSGKEFNPVLQDPVLAIHPPCIYAGYVASTIGFCLCVSGTQQKKHTAREINESGKLKDHCGKRKAVILRSVLRTITRPLGSAYWKLIRIWILTCWCFLTVGILLGSWWAYHELGWGGWWFWDPVENASLMPWVLATACIHSVISFRLNSWTFFLNIVTFLFSLLGTFFVRSGLLASVHSFATDSQRGIFLLSFFFMASLSLLKKNRTTGAYDHLSEIEQILKLQLTLLCIICLVVLCGTAAPVLFHLLAQREVSTGAPFFNGTIIPIFICLLLVLVYIHYRSAQQAHSNHSVFLCVLFIIHVIFIKLIADLSYLESFCCALCFSLFFSFFLFKPSAPMNMILSHGGVCILITGVILSNTKKIQITQIMHFGFEQNIGNGRLCCLRSIDQLHGPTFQSICGNIACVSNHDTKAAIAAHHYFEKVISCVQSTDLASDLTRSVDSFVMFPEKRFCFSNPETSTTKVAIHTNFFTDLYALIGTGSFETGWYTTIMKLPFIFCIWIGFVLASFGGFRSLIRQLSKQKLNWN

SEQ ID NO: 68024 - DNA, 1983 bp, Rhodopseudomonas palustris CGA009
  CDS (1)..(1983): transl_table=11
atgatcgccgaggccgggcactacgcactggttctggcgctggctctggcgctgatccagtccaccgttccgctgctcggcgcccggctcaatgacggcgcgctgatgaatgtggcgcgctcgaccgcgctggtgcagctgttgttcgccggcctgtcgttcaccgcgctggtgtggctgcacgtcacctccgacttctcggtggtgaacgtgtacgagaactcccactcgatgaagccgctgctctacaagatcaccggcgtgtgggggaaccacgaaggctcgatgctgctgtgggtcgcgatcctggcgctgttcggcggcctggtcgcggcgttcggcaacaatttgccgctgtcgctgcgcgcccacgtgttggctgttcagggctgggtcgcaaccgcgttctatctgttcatcctgatcacctcgaacccgttcgcgcggattgccaatgcgccggccgagggccgcgatctcaacccggtgctgcaggatatcggtctcgcggtgcatccgccgatgctgtacctcggctatgtcgggttctcgatttcgttctcgttcgccgccgctgcgctgatggaaggccggctcgacgccgcctgggctcgctgggtgcggccgtggacactggtcgcctggatcttcctcaccctcggcatcgcgatgggctcgtattgggcctactacgaactcggctggggtggctggtggttctgggacccggtcgagaacgcctcgctgatgccgtggctcgccggcaccgcgctcttgcactcggcgctggtgatggagaagcgcaacgcgctgaaggtctggaccatcctgctgtcgatcctgaccttctcgctgtcgctgctcggcaccttcctggtgcgctccggcgtgctcacctcggtgcacgccttcgccaccgatccgtcgcgcggcgtgttcatcctgatcatcctgtgcgtgttcatcggcggcagcctgacgctgtttgcctggcgggcctcgtcgctgaagcagggcggcctgttcgcgccgatctcgcgcgaaggctcgctggtgctgaacaatctgttcctcaccaccgcctgcgccaccgtgttcgtcggcacgctgtatccgctggcgctggaagtgctgaccggcgacaagatctcggtcggcgcgccgttcttcaatctcaccttcggcccgctgatggtgccgctgctggtcgcggtgccgttcggcccgctgttggcctggaagcgcggcgatctggtcggcgccgcgcagcggctgatcgccgccggcgtggtggcgctgctggcggtcgccttcgtatatgcctgggtccatggcggcgcggtgctggcaccgctggcgatcgggcttgcggtgttcgtcatcatcggcgcgctggttgacatcgccgagcgcattgcgctgttccgcggtccgctgtcgatctcgctgcgccgcgcctccggcctgccgcgctcggcctggggcacgatgttcgcccatgcggcgctcggcgtgacgctgatcggcatcgtctgcgagaccacctggaacagcgagtacatcgccgcgatgaagccgggcgacagcaccaagctcgccggctacgagttcaagttcgaaggcgccaatcagcgccagggaccgaactatcgcgagttgctgacgcagttcacggtgaccgagaacggccggctggtcggcggcatggcgccgtcgaagcgcagcttcatcacccgcggctcctccaccaccgaggcggcgctgctgacccgcggcttcagccagctctacatctcgctcggcgatctcaacgaccagggcgcggtgacggtgcggatctatcacaagccgatggtgctgctgatctggttcggcccgatcctgatggcgctcggcggcctgctgtcgctgtccgatcgccgcttgcgggtcggcgcgccgaagcccgccaaggcgccgcgcgtgctgcagccggccgagtag

SEQ ID NO: 68025 - protein, 660 aa, Rhodopseudomonas palustris CGA009
MIAEAGHYALVLALALALIQSTVPLLGARLNDGALMNVARSTALVQLLFAGLSFTALVWLHVTSDFSVVNVYENSHSMKPLLYKITGVWGNHEGSMLLWVAILALFGGLVAAFGNNLPLSLRAHVLAVQGWVATAFYLFILITSNPFARIANAPAEGRDLNPVLQDIGLAVHPPMLYLGYVGFSISFSFAAAALMEGRLDAAWARWVRPWTLVAWIFLTLGIAMGSYWAYYELGWGGWWFWDPVENASLMPWLAGTALLHSALVMEKRNALKVWTILLSILTFSLSLLGTFLVRSGVLTSVHAFATDPSRGVFILIILCVFIGGSLTLFAWRASSLKQGGLFAPISREGSLVLNNLFLTTACATVFVGTLYPLALEVLTGDKISVGAPFFNLTFGPLMVPLLVAVPFGPLLAWKRGDLVGAAQRLIAAGVVALLAVAFVYAWVHGGAVLAPLAIGLAVFVIIGALVDIAERIALFRGPLSISLRRASGLPRSAWGTMFAHAALGVTLIGIVCETTWNSEYIAAMKPGDSTKLAGYEFKFEGANQRQGPNYRELLTQFTVTENGRLVGGMAPSKRSFITRGSSTTEAALLTRGFSQLYISLGDLNDQGAVTVRIYHKPMVLLIWFGPILMALGGLLSLSDRRLRVGAPKPAKAPRVLQPAE

SEQ ID NO: 68026 - DNA, 2190 bp, Leptospira interrogans serovar Copenhageni str. Fiocruz L1-130
  CDS (1)..(2190): transl_table=11
atgaatgatttcggcgctctttgcatcataacgtcttttgcgatccttatattttcgatcgtacaaacttcttacggaatttggaaacaagacaaacaggtaatcgaactcggtagatatactttgatggcaaattccgccatcatccttttagcttttatcgtcttactcgttcaacttttcagaaccgatctttctaattactatgtggtaatgcattccaacgaacacttacctttattttatagacttaccggaatttggtccggttcctccggttccttacttttttggaatcttttactttcactttttacattcatcgttctttggcaaacaaaggatctaacccaagatagaattcctgtcttaaatttaacgttagccgtcatatctgcttttttttcttatcttgctgtattttatccggatgcccaaccatttcgagaatttcaaccggcggcagttgccggcagaggattaaatcctcttttacaacactgggccatggtcatccatcctccgattctttatgtgggttacgtaagttttgcgattccttttgcaattgcagcctcggctttaatcacaggacatctttccgaaaattggtttcgttttgttagaaggtggactatcttttcttggttttttttaggaaccggaattctactcggttccaaatgggcttacgaagaattaggttggggaggttactgggcctgggatcccgtagaaaacgcttctcttatgccctggcttttatccactgcatttcttcattctatgatcatccaagaaagaagaggtatgttaaagttttggaatatgcttttgatcatactcgcttttcatttttgtttattaggaacttggatcacccgaagtggagtactcgaaggtcctcatagtttttccaagtccacaatcggcaccccgttcatcatctacatcggaattagttttttcttctttttaggatttttaatctaccgcagaaattctctaaaacccgagcgcaatctggaggcaatgacctctaaagaaggcagttttctttttaataacttcctacttgtaatcgctactcttgcgattcttttaggagttttttctcctcttctttatggaagagaatttaaagctccttggttcaactcttggggagttccagtgggaatccttttgatccttttgatgggttcggcaccacttctcgcttggagaaaaagcgcggacaaaatttttttctcgaccctcctcaaaccgttgttagtcggaattgcaggagctggaatgtacattttattttatactaaaaactttacgattagcgaatacagtttaggcgacgtattaggggaaatttattcagtgatcgcggttggtctcggaatttttacgactgccggaattgtacaggaatatcatagagggatcatcgccagaaaaactgcgtatccaaacgagaattattttttttccggatttaggatgcttttaaaaaataaaagaagatacggaggttacctagttcacttggcgatggtgatactttttataggttatgcagggaacgcgtttaaacaaaacacatccattaagtttttctacttcttgaacgcacccgaaaaaaacgaaatcgtctattcgagtcaggatacgggagttctcggaaactatcagatctcggcaaacactctgaagatcaaacctctcgtcaacggagacgcaaagaacggactcaacattcaaaacgtgatcgtttctcacgaagcaacctttcaagtaaaacggaatctaaaagaattttctacaatggttacagaaagaagattttatccacaaatctctcacttaagcggagactttgaaactcatatccctacaagcgaacccgcaatttcttccactcctaaagaagacttatacattcaactcggggctatcgaacattccgatctttccgatgaaaatccagaccttcctatactttttatgaattatctttttacaaatgagaatcagccagttcgtaaattggaaaacttcaatcgatttccaagacaactcgtagccaacttagaagtctgggtaaaccctctggtaaaatttatttgggtgggttcattgttatttttcttttcggggctattaattcttctcccgatcggagaatccagatcatga

SEQ ID NO: 68027 - protein, 729 aa, Leptospira interrogans serovar Copenhageni str. Fiocruz L1-130
MNDFGALCIITSFAILIFSIVQTSYGIWKQDKQVIELGRYTLMANSAIILLAFIVLLVQLFRTDLSNYYVVMHSNEHLPLFYRLTGIWSGSSGSLLFWNLLLSLFTFIVLWQTKDLTQDRIPVLNLTLAVISAFFSYLAVFYPDAQPFREFQPAAVAGRGLNPLLQHWAMVIHPPILYVGYVSFAIPFAIAASALITGHLSENWFRFVRRWTIFSWFFLGTGILLGSKWAYEELGWGGYWAWDPVENASLMPWLLSTAFLHSMIIQERRGMLKFWNMLLIILAFHFCLLGTWITRSGVLEGPHSFSKSTIGTPFIIYIGISFFFFLGFLIYRRNSLKPERNLEAMTSKEGSFLFNNFLLVIATLAILLGVFSPLLYGREFKAPWFNSWGVPVGILLILLMGSAPLLAWRKSADKIFFSTLLKPLLVGIAGAGMYILFYTKNFTISEYSLGDVLGEIYSVIAVGLGIFTTAGIVQEYHRGIIARKTAYPNENYFFSGFRMLLKNKRRYGGYLVHLAMVILFIGYAGNAFKQNTSIKFFYFLNAPEKNEIVYSSQDTGVLGNYQISANTLKIKPLVNGDAKNGLNIQNVIVSHEATFQVKRNLKEFSTMVTERRFYPQISHLSGDFETHIPTSEPAISSTPKEDLYIQLGAIEHSDLSDENPDLPILFMNYLFTNENQPVRKLENFNRFPRQLVANLEVWVNPLVKFIWVGSLLFFFSGLLILLPIGESRS

SEQ ID NO: 68028 - DNA, 1932 bp, Thermus thermophilus HB27
  CDS (1)..(1932): transl_table=11
atgaccccggcccttctcggcaacctcggcgtgagcctggccctggcctttagcctcctgggcctgggcctcgccctcctcgcctacctccagggggacgggcgcttcctaaggggggcgcgggccctcgtgtttcctgccttcctcgctgcgcttgccgccttcctcgccttggagtgggccctcctcgtccacgacttcagcctggcctacgtggcgaggaaccactccaccaaggaccccctctgggtgaccctggtgaccccgtgggcggccctcgagggcagcatcctcctctggggcctcctccagaccctctacaccctgctcgcaagccgcaaacccttggacccctggcgggcctccctggtcctcgccgtgctcttcggcatccaggtcttcttcttcggagtcatggccaccatcgcgagcccctttgagaccctgcccgacccgcctcccgacggcgtgggcccgaaccccctcctccagaaccactggatgatggccgtccaccccgtcctcatgtacctgggtttcgtgggcctgagcgtgccctacgcctacgcggtggcggccatggccacccggcgctaccagacctgggtggaggagaccaggtggtggaccctcatcgcctggggcttcctcaccgcggggaaggtggcggggatgtggtggagctacgaggtcctgggctggggcgggtactgggcctgggaccctgtggaaaacgccagcttcatcccctggctcctcgccacggccttcctccacacggccttcgtccagcagacccggggggccttcaagacctggaacttcgccttcgtgaccctggccttcgccgccacccttctcggcaccttcctcacccgaagcgggatcatccagtcggtccacgccttcgccgagggccccgtggggcccgccttcctcggcttcttcctctttgccacgggccttggcctcggcctcctctcccgggtctcccgggaggtgcgggacgccgcccttttccaccctctctcccgggagggggcgcttctcctcggggccttcttcttcgcgggctgggccctcgtggtcgtcctcggcaccttctacccccttcttgtggaggccttcaccggggccaaggtgagcgtgggggcccccttcttcaaccaggtttccgcccccctgggggcggggatcctcctcctcatgggggtggggcccctcctcccctggcgcagggcccggggggaggtcttgcggaacctcctcgtccttctcctcgccctcgccttggggaccctattcggcctcctccggggctacaccttgggggcctccttcgccttggggctcttcctctacaacgccgccgccatctacctcctggcccgggagggggttttggcccgggtgcgggcggggctttccccctggggcttcttggcgaaccgcaggcgggtgggaagcctcgtggtccacttcgccgtggccctcatggggcttgccatcgccttcagccagacctaccgcctggagagcgagaagaccctctaccggggagaggcctgggaggtggggggcgtgcgcatgaccttccagggggtgcgggccttggacgaggggcggcgcttcgccgtggaggcccttctaaagaccgaccgcttcggggaggtcaggcccaggctccacttctacccccagatgaatagcccccttcccgcccccaaggtcatttacaccccggggaacgactactacttcctcctcatggactttgaccgggaaaagggggagtgggcctccctaaggctcatcgtcacccccttggtcttctggatgtgggtggcgggggggcttatggccctgggcaccctttacatcctctggcccgcggcgaggccggaggaagctaggggggtgagcccggcgtga

SEQ ID NO: 68029 - protein, 643 aa, Thermus thermophilus HB27
MTPALLGNLGVSLALAFSLLGLGLALLAYLQGDGRFLRGARALVFPAFLAALAAFLALEWALLVHDFSLAYVARNHSTKDPLWVTLVTPWAALEGSILLWGLLQTLYTLLASRKPLDPWRASLVLAVLFGIQVFFFGVMATIASPFETLPDPPPDGVGPNPLLQNHWMMAVHPVLMYLGFVGLSVPYAYAVAAMATRRYQTWVEETRWWTLIAWGFLTAGKVAGMWWSYEVLGWGGYWAWDPVENASFIPWLLATAFLHTAFVQQTRGAFKTWNFAFVTLAFAATLLGTFLTRSGIIQSVHAFAEGPVGPAFLGFFLFATGLGLGLLSRVSREVRDAALFHPLSREGALLLGAFFFAGWALVVVLGTFYPLLVEAFTGAKVSVGAPFFNQVSAPLGAGILLLMGVGPLLPWRRARGEVLRNLLVLLLALALGTLFGLLRGYTLGASFALGLFLYNAAAIYLLAREGVLARVRAGLSPWGFLANRRRVGSLVVHFAVALMGLAIAFSQTYRLESEKTLYRGEAWEVGGVRMTFQGVRALDEGRRFAVEALLKTDRFGEVRPRLHFYPQMNSPLPAPKVIYTPGNDYYFLLMDFDREKGEWASLRLIVTPLVFWMWVAGGLMALGTLYILWPAARPEEARGVSPA

SEQ ID NO: 68030 - DNA, 1896 bp, Desulfovibrio vulgaris subsp. vulgaris str. Hildenborough
  CDS (1)..(1896): transl_table=11
atgcacctttccgcctacctgcttctcgtagcctcgctgctgttcgcgctcttctttgcgggcacggcggccatacagatatggcagggcagaaccacggcgctgccgtggatggagaaggggcacctcatgctcaccgcgttcatgtcggtggcatcagccgtgcttcttcatgcccttgcgaacttcgacttctcgctggtgtacgtcgccagctacaccgacagggcattgcccctgttctaccgtctcaccgcattctgggctgggcaggccgggtccatgctcttctggggctggtcggtcgcgctgttcggtgtgttcttcctcttctcccccgtctatcggcgtgtgagcgaaccgacccgcatgtggttctggttgctctttctcgccatgatgggcttcttcctgctggttctcacctgctggagcaaccccttcaccgtggtcgaccccgccccggcggacggcaacggcctgaacccgctgctgcagaaccccggcatgatcttccacccgccgctgctcttcctcggctacggcggcttcgccattcccggctgtcttgcgctggcacagtcgctgagcggcatgcgtctctccgaaggcgcatgggcggaccatgcacgtcccttcacccttgttgcgtggctcttcctcaccgccggcatcgtgcttggcggctggtgggcctacatggaactcggctggggcggctactgggcatgggacccggtcgagaacgcatcgctcatcccgtggctcatcgcctccgcgtacctgcatacggccgtcatcgaggcccgacgcaacaagctgcaccgtgtgaacaccttcctgatggccctgacgaccatctccgccttcttcgcgacctatctggtcagaagcggcgtggtcgaatcgctgcacgccttcggcgacggcggcgtgggcactcccctgctcatcttcatcatcgtcttcaccgcggtcgccctcggtggctccatcctgtggaaacacccggatgccaagcccctttcgggtgtcgaaagccgcgagggctttctcgtgatggtcgcgtgggtgctgcttgccctcggtgccatcatcctcgtcgccaccatgtggcccgtgttcagcaagttctgggtcgacaagcccgtggggctggaaccggcgttctacaaccgtgtgtgcctcccgctcttcgccgtgctggtcgtcatgctcgccatatgcccttggcttggctggaagggcggcctgcgcaacaaggtgggtgccgtcacggcactgggtctcttcgtcggggccgctggcggcatatgggccgctggctacaccatccccaccgcagtcctcggtgcagccggtgccatcgcggcccttggcggcattgtcatgctgctggcgaccgaaccgcacctgaggcgctcgccgcagtctctggccgcctacggcgtccacatcggccttgcgctcaccgcccttggcgtggccttctccggcccgtacaagaccgagcatgaggtcatcatgcagcagggcgacaccgtgcaggtggccggatacgacgtgaccttcaaggcgttgtacgagggcgaaggccccggctacatcttcatcgaggccgaactcgacgtgaagaagaacggctccgatgtgggcatggcccagccgcaacgccgcatctactccaagttcggcaagcaggcgttcgccgaggcgtcgaccattccgggtctcggcaacgaattctatgccgtactgcttggcgtcgaccgcgaaggcaaggccaccctgcacctcaacgtcaccccgctgatcaactgggtctggataggcagcatcatcatgtgcctgttccccttcatcgggatgcgtcgccggaagacagcggaggcgtga

SEQ ID NO: 68031 - protein, 631 aa, Desulfovibrio vulgaris subsp. vulgaris str. Hildenborough
MHLSAYLLLVASLLFALFFAGTAAIQIWQGRTTALPWMEKGHLMLTAFMSVASAVLLHALANFDFSLVYVASYTDRALPLFYRLTAFWAGQAGSMLFWGWSVALFGVFFLFSPVYRRVSEPTRMWFWLLFLAMMGFFLLVLTCWSNPFTVVDPAPADGNGLNPLLQNPGMIFHPPLLFLGYGGFAIPGCLALAQSLSGMRLSEGAWADHARPFTLVAWLFLTAGIVLGGWWAYMELGWGGYWAWDPVENASLIPWLIASAYLHTAVIEARRNKLHRVNTFLMALTTISAFFATYLVRSGVVESLHAFGDGGVGTPLLIFIIVFTAVALGGSILWKHPDAKPLSGVESREGFLVMVAWVLLALGAIILVATMWPVFSKFWVDKPVGLEPAFYNRVCLPLFAVLVVMLAICPWLGWKGGLRNKVGAVTALGLFVGAAGGIWAAGYTIPTAVLGAAGAIAALGGIVMLLATEPHLRRSPQSLAAYGVHIGLALTALGVAFSGPYKTEHEVIMQQGDTVQVAGYDVTFKALYEGEGPGYIFIEAELDVKKNGSDVGMAQPQRRIYSKFGKQAFAEASTIPGLGNEFYAVLLGVDREGKATLHLNVTPLINWVWIGSIIMCLFPFIGMRRRKTAEA

SEQ ID NO: 68032 - DNA, 1989 bp, Bartonella quintana str. Toulouse
  CDS (1)..(1989): transl_table=11
gtgcttgttgaactgggtcatatttttttagccgcagcgtttgcagtgagtttaatgcaggcatttttacctgctttgggtgtttggtgggaggatcattcattgatgcgaacagcagttcccttcacctatattacttttacattattgctcttatcttttttgattattgttcatgcccatatggtatctgatttttctgttttaaatgttgttgagaatagccattctgaaaaaccaatgctttataagatcactggtgtttggggaaatcacgaaggatccatgttgttatgggttttaagtcttgcttttttcagtacattgatggcattatttagccaacatttaccagaacagtttaagacattaattttggtttgccaaagttggattataagtgcctttcttgtatttgttctttttttatcgaatccatttttacgtattaatccaccggcattgcagggaaatgatctcaatcctcttttgcaagatatcgctttagcaattcatccaccacttctttatttaggctctgtcggtttttctctttgtttttcttttgcagtagctgcattggttatgggacatgtcgatgggcgttgggcgcattgggttcgtccttggcttcttcttgcttggtgttttttgacactaggcattatggttgggtcctattgggcttattatgagttaggatggggtggttattggttttgggatccagttgaaaatgcttcgtttatgccctggctttcaggaacagcttttttgcattctgctcttgttctggaaaagcgggaaacattaaaaagttggactttatttttggcacttcttactttttctctttctcttatgggaacttttcttgttcgttcaggtcttttagtatctgttcacagttttgccattgatccagcacgtgggcgggcaattcttgcacttttattctttttcaccggaggagctttttttctctttgctttgcgcgtacccgttttaaaagcaggtagattatttcggccaatttcacgtgaaggttttattgttttaaataatctcttgcttacaacaataacagcgacagtattgattggtacgctctatccttattttattgaggcattgactggaaaaaaaatttctgtaggtgccgctttttttaacattacctgtggtcctttaatgatattattgttgttgttggttccgtttggatcaatgatggtatggaaaagcggtgattttcttgcggtttttgaacggttgtggtttgtttgcgtattagcctgtgtagcctgttttataacgttttatgcaacatctttgcgtgatatttttgcagctttaggagtaggactttcagtttttgtttttttaggcagtttagctgatctttggaagaaaagtggacatcacaagttagctttgtcggtgcggtttaagagatttattggattgccatggtcagtttttggtgcagcaatggcacatatgggattagctgttacattgtttggtattgtctgtgttgcgacttttgctcaagagcgtattttaaccatgcacataggagatagggttacaatagcgggtaaaactatttgctttgacaaagtgcatgaaagcgccggtccgaattattctgcaatggagtttaattttacagtctatgaaaacaaacatgcagtccgcaacgtaatagcatcaaaacgtttctattcaagccagaacatatcaacaacagaagttggtattcaaaatcatggcttattatcccaattatatattgcaccgggccatatagatgatcaagggcttgttgtgcatctatggtggaagccttacgtgatttgtgtatggttaggggcaataatgatggctatgggggggtgtttttctctttttggttattggtttcgcattgggttgcatcgacggatagcttcccgcttcaagttttctgaaaaggctttgagatga

SEQ ID NO: 68033 - protein, 662 aa, Bartonella quintana str. Toulouse
MLVELGHIFLAAAFAVSLMQAFLPALGVWWEDHSLMRTAVPFTYITFTLLLLSFLIIVHAHMVSDFSVLNVVENSHSEKPMLYKITGVWGNHEGSMLLWVLSLAFFSTLMALFSQHLPEQFKTLILVCQSWIISAFLVFVLFLSNPFLRINPPALQGNDLNPLLQDIALAIHPPLLYLGSVGFSLCFSFAVAALVMGHVDGRWAHWVRPWLLLAWCFLTLGIMVGSYWAYYELGWGGYWFWDPVENASFMPWLSGTAFLHSALVLEKRETLKSWTLFLALLTFSLSLMGTFLVRSGLLVSVHSFAIDPARGRAILALLFFFTGGAFFLFALRVPVLKAGRLFRPISREGFIVLNNLLLTTITATVLIGTLYPYFIEALTGKKISVGAAFFNITCGPLMILLLLLVPFGSMMVWKSGDFLAVFERLWFVCVLACVACFITFYATSLRDIFAALGVGLSVFVFLGSLADLWKKSGHHKLALSVRFKRFIGLPWSVFGAAMAHMGLAVTLFGIVCVATFAQERILTMHIGDRVTIAGKTICFDKVHESAGPNYSAMEFNFTVYENKHAVRNVIASKRFYSSQNISTTEVGIQNHGLLSQLYIAPGHIDDQGLVVHLWWKPYVICVWLGAIMMAMGGCFSLFGYWFRIGLHRRIASRFKFSEKALR

SEQ ID NO: 68034 - DNA, 1986 bp, Bartonella henselae str. Houston-1
  CDS (1)..(1986): transl_table=11
gtgcttatcgaactggggcatctttttttatccgcagcttttgcagtgagtttattaggggcttttttacccgttttagtttttttgtggggagagcgttcattaatgcaaacagctgttcccctaacatatattacttttacattattattcttatcttttttgattattgttcatgcccatattgtttctgatttttctgttttgaatgtggttgagaactctcattcagaaaagccaatgctgtataaaattattggtgtttggggaaatcacgaaggatctatgttgttatgggttttaagtctcgctttttttagtacattggtggcgttgtttagccagcatttgccagaacagcttaaggcacttattttagtatgccaaagttggatgacaagcgcttttcttttatttattctttttatgtccaatccatttttacgtgttaatccacccgccttgcaaggaaaagatctcaatcctcttttacaggatatcgcgttagcaatacatccaccacttctttatttaggttatgttggtttttcactttgtttttcttttgcagtagctgcattgattatgggatatgtcgatagactttgggcgcgttgggttcgtccttggcttctacttgcttggtgttttttgacattgggtattatggttgggtcctattgggcttattatgagttaggatggggtggttattggttttgggatccagtagaaaatgtttcgtttatgccttggctttcaggaacagctcttttacattccgctctcgctcttgaaaaacggggaatattgaaaagttggactttatttttgtccattcttactttttccctttctcttatgggaacttttcttgttcgttctggtcttttaatatcagttcatagttttgctcttgatccagcacgaggacgagcaattcttgcacttttattgtttttcacgggaggggctttgtctctttttgctttgcgggtacctgctttgacaccgggaagattttttcagccaatttctcgtgaaggttttattattttaaataatttattgctcacaacaataacagcgacagtcttgattggtacgctctacccttattttattgagctgttaacagggcaaaaaatttctgtaggagcagatttttttaaccttacctgtgggcctttaatgatgttattgttattattggttccatttggatcaatgatagcgtggaaacgcggtgattttctcgcagtttttgaacggctgtgggttgtttttgcattagtcgctatagtttgttttatcacattttatgtagtttctttgcgtgatatttttgccattttaggaattggactttcaacttttgttttcttaggtagtttagctggtctttgggcgaagagcggacatcgcaaaatagctttattagcacggtttaaaagatttattggattaccatggtccgtttttggtgcagcaatagcgcatatgggattaggtgttacattgtttggtattatctatgtcgcaacttttgggcaagagcgtattctcatcatgcataaaggagatatggtaacgatagcagataaaactcttcatttgaatgaagtgcatgatgaaactggcccgaattattcagcaatagagtttcattttacaatatatgaaaataaaaatacggtgggtaatgtaacagcatcaaagcggttttatccaagtcaaaatacatcaacaacggaagttggtattcaaaatcatggtttatctcagctctatattgttccaggacggatagatgaacgagggcttgttttacatatatggtggaagccttacataatatgtgtttggttaggggcattgatgatggctatgggcggatgtttctctctttttagttattggtttcgcattagagtgcatcaacggagagtctcccgctttaaattttctgaaaaggcattgagatga

SEQ ID NO: 68035 - protein, 661 aa, Bartonella henselae str. Houston-1
MLIELGHLFLSAAFAVSLLGAFLPVLVFLWGERSLMQTAVPLTYITFTLLFLSFLIIVHAHIVSDFSVLNVVENSHSEKPMLYKIIGVWGNHEGSMLLWVLSLAFFSTLVALFSQHLPEQLKALILVCQSWMTSAFLLFILFMSNPFLRVNPPALQGKDLNPLLQDIALAIHPPLLYLGYVGFSLCFSFAVAALIMGYVDRLWARWVRPWLLLAWCFLTLGIMVGSYWAYYELGWGGYWFWDPVENVSFMPWLSGTALLHSALALEKRGILKSWTLFLSILTFSLSLMGTFLVRSGLLISVHSFALDPARGRAILALLLFFTGGALSLFALRVPALTPGRFFQPISREGFIILNNLLLTTITATVLIGTLYPYFIELLTGQKISVGADFFNLTCGPLMMLLLLLVPFGSMIAWKRGDFLAVFERLWVVFALVAIVCFITFYVVSLRDIFAILGIGLSTFVFLGSLAGLWAKSGHRKIALLARFKRFIGLPWSVFGAAIAHMGLGVTLFGIIYVATFGQERILIMHKGDMVTIADKTLHLNEVHDETGPNYSAIEFHFTIYENKNTVGNVTASKRFYPSQNTSTTEVGIQNHGLSQLYIVPGRIDERGLVLHIWWKPYIICVWLGALMMAMGGCFSLFSYWFRIRVHQRRVSRFKFSEKALR

SEQ ID NO: 68036 - DNA, 1878 bp, Erwinia carotovora subsp. atroseptica SCRI1043
  CDS (1)..(1878)
ttgatgttgttattgccagagtttgggtatgtgtcgctgttactggcggtttgcgtcggtgtggcaacagcattgctgacattttcaggctacaccctgcgctggtcgggcacttaccgactggcgcggtgctggacgctggtgctgtttggtctcgtgctgttcgcgtttgtcgcgctgacgttgagcgtggtgcaggatgatttttctgttaattacgtcgctcagcatagccaccgtgatttaccgctggggctcaaaattgcggcggtctggggcgggcatgaaggttcgctgctgctgtggctcttgtgtttatccggctggagcgccacatttgcctgccgctatcgcaaggcgatgagcgatctgttcccgctgacgctggcgatgctcgcggtgattgcgaccgcattgctggtattcattgtgtttttttccgatccttttgtgcgcctcttcccgcctgcggtggcggggagggatctcaacccgatgttgcaacatattggcctcattctccatccaccgttgctctatctaggctatggcggcttaaccgtgagtgcggcactggcgttagctgccctgattcacggcgagtttactgcaccagccgcctggatttgctggcgttggacgctgcccgcctggagcctgttgacgctgggaatcattttgggatcgtggtgggcttataacgagctgggctggggaggatggtggttctgggatccggtagagaacgcctcgttgcttccgtggttaacggctagcgcattgcttcacagtctgtctgtcactcgaatgcgcggtatcttccgccattggtcgctgatattggcgctgttgacgttcattttatgcctgctggggacgctgattgttcgttccggaatactggtttctgtccatgcctttgccctcgaacatgatcgcgcggtacctttatttatcttgtttgcctgcttaagcatggctgcgctggctgtttatggctggcgtgctcagcttgtccattccgcagcccgcttctctggctggtcacgggaaatggcaatactgctggttttgttgctattcagtgccgtcgcgctggtggtactactcggtacgctttatccgatgatttatggactagcgggctgggggaaaatctcagtaggcgcaccctattttaaccgcgtgctcttgccctttgctggcttgatgctgttgctcattggcgttgcggcgggaggctactggaaacgcagtacgcggtggcctgtctggcacttaggcgtgacgctggcagtcggtgtcgtcaccgctctggtcttatggccgtatggatacgatgtggcgctggcttccggtctgatcggctgggtgatggctgcgcagtggctacagccgctgttggcgctacgccagcagcttccagcgctgttagcacatacgggcgtggtgctgtttgccttggggattgcgttctctgcggggagcaagcaggaaattagcgccaatgtgggtcagggagaacaggtcacgctgggtgactatcaatttcattttttacagctggatttagtggcggcgcagaattacaccgcagagcaggccgtgattgcgatttatcgtggcgactcgccgatcgcccgcgtcatcccagaacggcgttattacaatgcacgcaaacagcagatgattgaaccgggtattgcctggggaccaatcagagaatggtatgccgtgatgggagaaaaaaccggcgaaaaccgctatgcgatgcgtttctatgtgcaaaccggtgttcgctgggtgtggggcggcggcatgctaatggttgcgggcgcactgctgggatggttccgagggagaagggtctatgactaa

SEQ ID NO: 68037 - protein, 625 aa, Erwinia carotovora subsp. atroseptica SCRI1043
MMLLLPEFGYVSLLLAVCVGVATALLTFSGYTLRWSGTYRLARCWTLVLFGLVLFAFVALTLSVVQDDFSVNYVAQHSHRDLPLGLKIAAVWGGHEGSLLLWLLCLSGWSATFACRYRKAMSDLFPLTLAMLAVIATALLVFIVFFSDPFVRLFPPAVAGRDLNPMLQHIGLILHPPLLYLGYGGLTVSAALALAALIHGEFTAPAAWICWRWTLPAWSLLTLGIILGSWWAYNELGWGGWWFWDPVENASLLPWLTASALLHSLSVTRMRGIFRHWSLILALLTFILCLLGTLIVRSGILVSVHAFALEHDRAVPLFILFACLSMAALAVYGWRAQLVHSAARFSGWSREMAILLVLLLFSAVALVVLLGTLYPMIYGLAGWGKISVGAPYFNRVLLPFAGLMLLLIGVAAGGYWKRSTRWPVWHLGVTLAVGVVTALVLWPYGYDVALASGLIGWVMAAQWLQPLLALRQQLPALLAHTGVVLFALGIAFSAGSKQEISANVGQGEQVTLGDYQFHFLQLDLVAAQNYTAEQAVIAIYRGDSPIARVIPERRYYNARKQQMIEPGIAWGPIREWYAVMGEKTGENRYAMRFYVQTGVRWVWGGGMLMVAGALLGWFRGRRVYD

SEQ ID NO: 68038 - DNA, 1956 bp, Erwinia carotovora subsp. atroseptica SCRI1043
  CDS (1)..(1956)
atgatgcctgaagtgggcaattatctgctctgtctggcgctgggcgttgcactgctgctcagcgtgtatccgctgtggggagcatcgcgtcaggatgaacgcctaatggcgctggcgcgtccacttgcctgggcgctgtttgcatgcattttggcttccttcctcgtgttggtacacgcgctggtgatcaatgatttcaccgtcctctatgtagcaaataactcgaaccgtgcgctgccagtctggtatcgcgtggcggcggcgtggggcgcacatgaaggatcgctgctgctctgggttctgctgatgagcggttggaccttcgccgtggcggtcttcagccgagggatgtcgctggatgcagtagcccgggtattagccgtcatgggaatgattaatgtcggcttcttattgttcattattctgacgtcgaatccctttacgcgcacgctgccggactacccaattgacgggcgcgatctcaatccgctgctgcaggatgtcgggttaatcttccaccctccgctgctttacatgggttatgtcggtttttccgtggcgtttgcgtttgcggttgcctcgctgctggctgaacggctggacagcgcgtgggcacgttggtctcgaccgtggacgcaggcggcctggtcgttcctgacgttgggtatcgtgctcggctctggttgggcgtattacgaactcggctggggcggttggtggttctgggatccggtagaaaatgcctcactgatgccgtggctggtgggcacggcgctgctgcattcgctgtcggtcaccgaaaaacgcggcagctttaaagcctggacggtgttgttggctatcggcgcgttctcgctctgcctgttgggtacctttctggtgcgttctggcgtactggtgtcggtgcatgcatttgcctccgatccggcgcgtgggatgtttattctcgcatttctggtcattgtcatcggcggttcattgctgctgttcgccatcaaaggcaacagagtacgggcacgggtgacgaattcgctctggtcgcgtgagacgttcctgctcggcaataacctgatcctgatggctgccacgctcgtggtgctgctgggaacgctgctgccgttggtgcataagcaattgggtttgggcagcatttccattggcgcaccgttcttcaacaccatgtttaccctgttaatgtcgccttttgctctgctgttgggcgtggggccactggttcgttggcggcgcgatgagccgcaaaagctgcgtaagctgctgctggttgcgctggctgtgaccgccgcgctgtcgctgctgcttccgtggttgttgcaggactcgctggttgccatgacggtagtcggcttgtcgatggcgctgtgggtatttttcttaacggtgtacgacctgcatgccaattctactcgacgtcatggcctgctgcgcggtttgaccacactctcactgagccagtggggcatggtgtgcggtcatattgggctggcggtgacggtggtgggcatcgccttcagtcagaattatagcgtcgagcgtgatgtgcggatgcgggcaggcgacagcatccagatccatgattatcggtttacgtttcaaggtgtgcagaatgttgtggggcctaactggcacagcggtaaagggacgattgaggtcacgcgtaacggcaagccggaggcgatcctgaaagcggaaaaacgcttctataacaccagcggcgcggtcatgacggaagctgctattgatgcgggtgtgacgcgcgatctctatgcggccttgggcgaacaattagatgacgatagctgggcggtacggctgtattacaaaccctttattcgctggatttggtatggcggggggctgatggcgttaggtggcattctgtgcatgtttgaccctcgctatcgcctgcgtcgggccgttagggagacatcagcatga

SEQ ID NO: 68039 - protein, 651 aa, Erwinia carotovora subsp. atroseptica SCRI1043
MMPEVGNYLLCLALGVALLLSVYPLWGASRQDERLMALARPLAWALFACILASFLVLVHALVINDFTVLYVANNSNRALPVWYRVAAAWGAHEGSLLLWVLLMSGWTFAVAVFSRGMSLDAVARVLAVMGMINVGFLLFIILTSNPFTRTLPDYPIDGRDLNPLLQDVGLIFHPPLLYMGYVGFSVAFAFAVASLLAERLDSAWARWSRPWTQAAWSFLTLGIVLGSGWAYYELGWGGWWFWDPVENASLMPWLVGTALLHSLSVTEKRGSFKAWTVLLAIGAFSLCLLGTFLVRSGVLVSVHAFASDPARGMFILAFLVIVIGGSLLLFAIKGNRVRARVTNSLWSRETFLLGNNLILMAATLVVLLGTLLPLVHKQLGLGSISIGAPFFNTMFTLLMSPFALLLGVGPLVRWRRDEPQKLRKLLLVALAVTAALSLLLPWLLQDSLVAMTVVGLSMALWVFFLTVYDLHANSTRRHGLLRGLTTLSLSQWGMVCGHIGLAVTVVGIAFSQNYSVERDVRMRAGDSIQIHDYRFTFQGVQNVVGPNWHSGKGTIEVTRNGKPEAILKAEKRFYNTSGAVMTEAAIDAGVTRDLYAALGEQLDDDSWAVRLYYKPFIRWIWYGGGLMALGGILCMFDPRYRLRRAVRETSA

SEQ ID NO: 68040 - DNA, 1947 bp, Mannheimia succiniciproducens MBEL55E
  CDS (1)..(1947): transl_table=11
atgattgcggaattaggtaattttgcgttagccctcggcttagctatttctgttttattagcggtttttccgttatggggagccgaaaaagggaataaacaattgatgtcattggcacgcccaatgacttatgggttatttatttgtttaacttttgcattcggcgctttgttttatgcctttgcggtcaatgatttttctattcagtatgtcgtaaataactctaatagccgcttgccgttgcaatatcggttatccgcagtgtggggggctcacgagggttcgttattactatggatttggttgttatcggtctggagtgtcgctgtttcattatttagccgacaactgccacaagaagcggtagcgcgggttcttggcattatggggttagtgactattgggtttttaatctttattttgttcacgtctaacccttttgcgcgtacattccctaatttgccgattgacggtaaagagcttaatccaatgttgcaggatgtaggtttgatttttcatccgccgctgctttacatgggttatgtaggattctccgtcgcgtttgctttttcaatcgcctcattaatgacaggaaaattagacaccgcatgggcgcgttggtctcgtccctggacaatggcggcttgggtgtttttaaccgtaggtatcgtacttggttcctggtgggcttattacgaacttggctggggcggctggtggttctgggatccggtagaaaattcatccttaatgccttggcttgccggcaccgcgttattgcattctttagcagtgaccgagaaacggggagcgttcaaagcctggacggtactgcttgccattcttgccttttcgctttgcttattaggtacttttttagtgcgttcgggcgtgttggtttctgtacatgcttttgcttccgatcctacgcgcggtttatatattttggcctatttgattgttgtgattggcggttcattaactctgtatgcttacaaaggggggcaaattcgttcccgtgataatgccgagcgctattcgcgcgagtctatgttgctgttaaataatattttattaatggcggcattggttgtagtgctgttgggtacattattgccgttagttcataagcagttgggattaggttcgatttccatcggtgcaccgttttttaatcaaatgtttttggttttaatgacgccgttcgctttgttattaggcatcgggcctttagttaaatggcgtcgggataaattttccgctatccgtaagccggttattatcagtttgtttttgatgattattctaggttttgcgttgccttactttatcggcaataaattatccctaagtgcggtacttggtacgatgatggtggtgattattactctgctaagcttgtatgaactgaaacaacgcgccgcccatcgggacaacttcttaataggcattactaaattatcacgttctcattggggaatgtttttagctcatttaggcgttgccatgactgtttggggcgtgactttcagccaaaactttagtgttgagcgtgacgtaagaatgtcagtcggcgattccgtgaacattgccggttatgaatataaattccaaggcatacgggatgcaaacggaccgaactatttaggcggcacggcacaagtggatattttaaaagagggtaaacttgaaggttctttatttgccgaaaaacggttctatacggtaagccgcatgacaatgacggaagccgccatcgattggggatttacccgtgatctgtatgtggcgttaggcgagcagttagaggataaatcctgggcaatgcgtctatattacaaaccttttatccgttggatttggtttggcggcgtctttatggctctagggggggtactctgtatgttcgatcgtcgttaccgtttttctaaaattttaaataaatag

SEQ ID NO: 68041 - protein, 648 aa, Mannheimia succiniciproducens MBEL55E
MIAELGNFALALGLAISVLLAVFPLWGAEKGNKQLMSLARPMTYGLFICLTFAFGALFYAFAVNDFSIQYVVNNSNSRLPLQYRLSAVWGAHEGSLLLWIWLLSVWSVAVSLFSRQLPQEAVARVLGIMGLVTIGFLIFILFTSNPFARTFPNLPIDGKELNPMLQDVGLIFHPPLLYMGYVGFSVAFAFSIASLMTGKLDTAWARWSRPWTMAAWVFLTVGIVLGSWWAYYELGWGGWWFWDPVENSSLMPWLAGTALLHSLAVTEKRGAFKAWTVLLAILAFSLCLLGTFLVRSGVLVSVHAFASDPTRGLYILAYLIVVIGGSLTLYAYKGGQIRSRDNAERYSRESMLLLNNILLMAALVVVLLGTLLPLVHKQLGLGSISIGAPFFNQMFLVLMTPFALLLGIGPLVKWRRDKFSAIRKPVIISLFLMIILGFALPYFIGNKLSLSAVLGTMMVVIITLLSLYELKQRAAHRDNFLIGITKLSRSHWGMFLAHLGVAMTVWGVTFSQNFSVERDVRMSVGDSVNIAGYEYKFQGIRDANGPNYLGGTAQVDILKEGKLEGSLFAEKRFYTVSRMTMTEAAIDWGFTRDLYVALGEQLEDKSWAMRLYYKPFIRWIWFGGVFMALGGVLCMFDRRYRFSKILNK

SEQ ID NO: 68042 - DNA, 1935 bp, Mannheimia succiniciproducens MBEL55E
  CDS (1)..(1935): transl_table=11
atgatcccagaactcggctttattgcattgcttattgcattactttcttctttcttgcttacgttaattccgcttgtaggtatgataaaacgcaatacgaatttactgagttatgcctggaatttcagttatctgtttgccattttcagcacgatttccattgcctgtttagcctattctttttcggttaatgatttttcggtggaatatgtcgccgcccattcgaattcacagcttcctctgttttttaaaattgccgcgacctggggcgggcatgaaggctccatgttattctggctgttttcattaagtttatggactgccgcttttgcttttttcagtcgaaaaattgatcctgttttttcagcgcggaccctttctattctcggttttatttgtttgagttttgctatttttattctgtttttttccaaccctttcattcgtcagttccctttaccgccggaagggcgggatcttaatccgatgttgcaagatatcggtctgattattcatccgccgctgctttatttgggttatgtggggttcgcggtaaattttgctatgactttatccgtcatgctaagcggacatgttgatgccgctatcgcacgctggacaagaatttgggtattgttatcatggttcttcttaactttaggcattatgctcggtgcatggtgggcatattacgaactcggctggggcggctggtggttctgggatccggtggaaaacgcctcgttgatgccttggttaatcggtctggcgttattgcacagcctgatagttaccgaacaacgcgggattttcagctattggacgatacttttttcattatttgcctttgctttcagcctgcttggcacctttatcgtgcgttccggcgtattaacttcggttcacgcttttgccgtggacggcgaacgggggactgcattattacttattttcttcctgttaacggcgttggcattaaccgttttcgcccttaaagtcaatttgcgtcaaagtgcggtccgtttttccgttttttcgaaagaaagctttttgttgttggctaatgtagttctcactattgccactgtcagcgtgtttttaggaactttttatccaatggtattttcggcgatgggctggggttctatttccgtcggtgcgccgtattttaatagcatttttgtgcctttgttgctgattatgcttattgcgatggttttcgtattagctacaaaatggcaaaaaatgaaccgcactttattgcggcaaaaatcaatattgcttatccccgcccttctgattgcatatttgattattcatttcaccgttcggcaggatgaaagtctgcgctttcatttttccgcatttgtgctgcttagtttggcaatttggctgttgcttgcaactttatggataaattggcgaaaaatagggttgcggcggtcaggcatgatccttgctcattgcggtgttgcttttgcggtgattggtgcggtgatgtccggttatttcggcagtgaaatcggcgtacgtttagcgccgcaacagagccaaatgttaaacggttatgagttccgctatataggctttactaatgagctaggtcctaactttacttcggaaaaagcgcattttgaaatttataaaaataaccaaaaactgaccgcactttatccggaacgccgttattatgaggtacgaactatgaatatgtcggaagtgggtattcaatggggcgttttaggcgatatttatattgtcatgggagataagctggcgccgaatgagttcagttttcgcctgcattacaaaccttttgtccgctggttatggctgggtggaattttaatggcattaggcgctttagtagccgccgttagcctggttcaacggaaaaacgccatggcgttttcatcggcaattaaaaaagaataa

SEQ ID NO: 68043 - protein, 644 aa, Mannheimia succiniciproducens MBEL55E
MIPELGFIALLIALLSSFLLTLIPLVGMIKRNTNLLSYAWNFSYLFAIFSTISIACLAYSFSVNDFSVEYVAAHSNSQLPLFFKIAATWGGHEGSMLFWLFSLSLWTAAFAFFSRKIDPVFSARTLSILGFICLSFAIFILFFSNPFIRQFPLPPEGRDLNPMLQDIGLIIHPPLLYLGYVGFAVNFAMTLSVMLSGHVDAAIARWTRIWVLLSWFFLTLGIMLGAWWAYYELGWGGWWFWDPVENASLMPWLIGLALLHSLIVTEQRGIFSYWTILFSLFAFAFSLLGTFIVRSGVLTSVHAFAVDGERGTALLLIFFLLTALALTVFALKVNLRQSAVRFSVFSKESFLLLANVVLTIATVSVFLGTFYPMVFSAMGWGSISVGAPYFNSIFVPLLLIMLIAMVFVLATKWQKMNRTLLRQKSILLIPALLIAYLIIHFTVRQDESLRFHFSAFVLLSLAIWLLLATLWINWRKIGLRRSGMILAHCGVAFAVIGAVMSGYFGSEIGVRLAPQQSQMLNGYEFRYIGFTNELGPNFTSEKAHFEIYKNNQKLTALYPERRYYEVRTMNMSEVGIQWGVLGDIYIVMGDKLAPNEFSFRLHYKPFVRWLWLGGILMALGALVAAVSLVQRKNAMAFSSAIKKE

SEQ ID NO: 68044 - DNA, 1953 bp, Legionella pneumophila subsp. pneumophila str. Philadelphia 1
  CDS (1)..(1953): transl_table=11
atgatagcggaattagggctgttttttttggttttggctttagtggcttctttgatgttagctttgatcccattggcgggtttgcaattcaatcggaaagactggattgattcctccaggaattatgtcgtgctgcaatttttatttgtggcatgtgcttacctatgtctcacggcctgttttttgatggatgatttttcggtgatctatgtgctgaataattccagcttattgctcccatggttttataaattttgtgctgtgtggggtgggcatgaaggttccatgctgttatgggtcgctatccttagtttttggatgatcctggtttgtttttttagctcaagccttgatacggaaatgcgcgctcgggtattagttattttaggttggctaagtattggttttattctttttttgttaatgacttccaatcctttcttgcgccaatttcaagtattgaatacacagggccgtgatctgaatccattgctgcaagatcctggctttttattccatcctcctatgttgtacatgggatatgtagggttttgtgtcgcttttgcttttgctattgccgctttatgggcagggaaagtagaaaccagttggtctaaatggaccagaccctggactctggctgcctggtgttgtttaaccgcgggaattactttaggcagttggtgggcttatagagaattaggctggggtggttggtggttttgggatcctgtagaaaacgcttcttttatgccctggctggttggtacggcactattgcattctttggcagttacagagcaacgccagcaatttaaagcgtggaccatgttgcttgcaatcgctgctttttctttaagtttaattggtacttttcttgttcgctctggagttttaacttcagttcatgcctttgcggttgatcctcagcggggattatatattctgggatttttgttattcgtcattgggggttctttaacattgtttcttttcagagcccaaaccttgcaagtcaataaacatcctggcttattatcccgagaaagtgcgttgttgttaaacaatgtgtttttagtggttattatgctgacggtattaatgggcacggtttatccattgctggtggaagggttagggttaggtaaattatccgttggagcgccctattttaatgcagtatttgttccattaatgattcctttattgttgctaatggggttaggtgtccgtttgaaatggcagaatgattgttggagggatgtcttcagaaagctaaatcgtatttttttgcttagtctgatattgcctgtcattttactattctgtacctcaactgaaatacaccttacagcccttttgggattaattttggcattctgggttttgttgagtactgctaatgcggcgtatcacaaagtcagggatagaggggtggcaggagttggacaggcttattgggggatggttttggctcattgtggtgtcgcagcaacagtgattggcattgctgtttcttcagcttatggcgtacaagatgatgtacgtatgtctcctggcaagcaagtgaatctgctggattatcagattggattcattaatcagactccgttgaatggcccaaattacaaagggacaagggctgagttttcaatacaatatcagaataaaaccaggaaaatttttcctgaaaaaagagtgtataccattggacaaatgccaatgactgagtctgcgattgatgttactcctttccgagatatttacattgctttgggggaaccactgtctgaggatgcctggtcggtacgtatttattataaaccgttggtccgctggatttgggctggcggatttatgattttagccggaggcgttttggcattaacagatagaaggtattacagaaaaaggcaagtaacggtaatgtcagtgcgggagatcaagatatga

SEQ ID NO: 68045 - protein, 650 aa, Legionella pneumophila subsp. pneumophila str. Philadelphia 1
MIAELGLFFLVLALVASLMLALIPLAGLQFNRKDWIDSSRNYVVLQFLFVACAYLCLTACFLMDDFSVIYVLNNSSLLLPWFYKFCAVWGGHEGSMLLWVAILSFWMILVCFFSSSLDTEMRARVLVILGWLSIGFILFLLMTSNPFLRQFQVLNTQGRDLNPLLQDPGFLFHPPMLYMGYVGFCVAFAFAIAALWAGKVETSWSKWTRPWTLAAWCCLTAGITLGSWWAYRELGWGGWWFWDPVENASFMPWLVGTALLHSLAVTEQRQQFKAWTMLLAIAAFSLSLIGTFLVRSGVLTSVHAFAVDPQRGLYILGFLLFVIGGSLTLFLFRAQTLQVNKHPGLLSRESALLLNNVFLVVIMLTVLMGTVYPLLVEGLGLGKLSVGAPYFNAVFVPLMIPLLLLMGLGVRLKWQNDCWRDVFRKLNRIFLLSLILPVILLFCTSTEIHLTALLGLILAFWVLLSTANAAYHKVRDRGVAGVGQAYWGMVLAHCGVAATVIGIAVSSAYGVQDDVRMSPGKQVNLLDYQIGFINQTPLNGPNYKGTRAEFSIQYQNKTRKIFPEKRVYTIGQMPMTESAIDVTPFRDIYIALGEPLSEDAWSVRIYYKPLVRWIWAGGFMILAGGVLALTDRRYYRKRQVTVMSVREIKI

SEQ ID NO: 68046 - DNA, 1974 bp, Methylococcus capsulatus str. Bath
  CDS (1)..(1974): transl_table=11
atgatcgccgaactcggccacatcgccctgatcatggccctcctgatggccctcctgcagggcgccttcccgctgatgggcgcctcccagggcgtggacatctggatgagcgtcgccaagccggccggccgcgcgcagttcctgtttctgctggtatccttcggcgccctcaccgcctgcttcgtcaacaacgatttttcggtggaatacgtcgcccgcaactcgaactcggccctgccgctctactatcgcatcgccgcggtatggggctcacatgaggggtcgatgctgctgtgggccacgatcctgggtctctggacagcggcggtgacggtgttcagccgcagcctgtcggaagactttctggcccgggtgctgggcatcatggggctggtgagcgtcggcatcctgctgttcatcctgttcacctcgaacccgttcgagcggctgacaccggtgccgcccgacggcaacgacctgaatccgctgctgcaggatttcggcatgacggtgcatccgcccatgctgtacatgggctatgtgggactgagcgtagccttcgccttcgccatcgccgccctgctgggcggctcgctggactcggcatgggcgcgctggtcacggccctggaccctggtggcctggctgttcctgaccggcggcatcaccctcggctcatggtgggcctattacgaactgggctggggcggctggtggttctgggacccggtggaaaacgcctccttcatgccctggctggtcgccaccgcacttatccactcgctggccgtcaccgagaagcgcggcgccttcaaggcctggaccgtgctgctggcgatcttcgccttttcgctgagcctgctgggcaccttcctggtacgttccggcgtgctgacctccgtgcatgccttcgcttccgaccccacccgcggcctgttcatcctgatcctgctggccatcgtggtgggcggttcgctgctggtttacaccgtgaaggcgccggccgtgcgcgatgtggcgcgctatagcctggtgtccaaggaaaacctgctgctgctcaacaacatcctgctggtgaccgcctccggcagtatcctgctcggcaccctttatccgctgatcctggacgcgctgaagctgggcaagatttcggtcggcccgccgtatttcggcacggtgttcgctccgctgatggcgccgatcttcctgctcgccggtatcgggccgatgttcgcctggcgggagagcccgatcggccgcatcctgcaccgggtccgctatctgttcccggcgagcttcgcggccggcatcgcgctcgccgccctggcctgggacgagaccgacttcaagatgatggccgggctgggctgcgcgttctggctggcggcgagcgcctgcctcagcctgtggagccggatccggctgcgcgacggctggctcgaaggactgcgcgcccagtcgcccagcgtctacgggatgaccgccgcgcatctcggcgtcgcggtgttcctggtgggcgccgtgctgtccgaccgcctgagtcaggaaaagctggtacgcatggcgcctggcgacagcgtgatgctggccggctacgccttccacttcctcggcacggagaccgtgcaggggccgaacttctcggcccagcaggccaccttccgggtggagcgggacggcgaaagcctggaacttcggccccagaagcggaactacaaggtgcagcgcaacatgatgaccgaagctgcgatagaccccggtctgtcccgcgatctctatgtcgccctcggcgagccactggacgggaacgcctggagcgtgcggctctacgtcaaaccgttcatccgctggatctgggccggcggcctgttcatgatcgccgggggcatcctgtccgtcagcgaccgacgctaccgcctgccgctgcctgaaacccgcgcagttgccggacgcgccgcgtcccgtgcaatttga

SEQ ID NO: 68047 - protein, 657 aa, Methylococcus capsulatus str. Bath
MIAELGHIALIMALLMALLQGAFPLMGASQGVDIWMSVAKPAGRAQFLFLLVSFGALTACFVNNDFSVEYVARNSNSALPLYYRIAAVWGSHEGSMLLWATILGLWTAAVTVFSRSLSEDFLARVLGIMGLVSVGILLFILFTSNPFERLTPVPPDGNDLNPLLQDFGMTVHPPMLYMGYVGLSVAFAFAIAALLGGSLDSAWARWSRPWTLVAWLFLTGGITLGSWWAYYELGWGGWWFWDPVENASFMPWLVATALIHSLAVTEKRGAFKAWTVLLAIFAFSLSLLGTFLVRSGVLTSVHAFASDPTRGLFILILLAIVVGGSLLVYTVKAPAVRDVARYSLVSKENLLLLNNILLVTASGSILLGTLYPLILDALKLGKISVGPPYFGTVFAPLMAPIFLLAGIGPMFAWRESPIGRILHRVRYLFPASFAAGIALAALAWDETDFKMMAGLGCAFWLAASACLSLWSRIRLRDGWLEGLRAQSPSVYGMTAAHLGVAVFLVGAVLSDRLSQEKLVRMAPGDSVMLAGYAFHFLGTETVQGPNFSAQQATFRVERDGESLELRPQKRNYKVQRNMMTEAAIDPGLSRDLYVALGEPLDGNAWSVRLYVKPFIRWIWAGGLFMIAGGILSVSDRRYRLPLPETRAVAGRAASRAI

SEQ ID NO: 68048 - DNA, 2049 bp, Photobacterium profundum SS9
  CDS (1)..(2049): transl_table=11
atgatcccagaagttggacattatgcattaatacttgggtgtgtattcgctgtattaggcggaacaatcccgttgtatggtcttataaaaaaagacccatatcttatccgctatgcgtggccgttaagctatggtgcttttttcgctatctcatcttcaatcgtattacttggctatagctttgctgttgatgatttttcggtggtgtatatcgcgcagcattctaattctcagcttcctcaagtgtttaaaattgccgctgtatggggcgggcatgaagggtcatttttattttggttattttcacttgcaggctggagcgctgctgttgcatttgtctatcagtacaaagccccttcaggcgttaatcaaccagaaaaacaagtgcagcatgaagcttttatcgggcgggtgttggttgttctttctctgttaattgccgcatttagtttatttacgttattcacctcgaatccttttttacgcttattgccaataccgatggaagggagagatttaaacccaatgttgcaagatgtggggctaatttttcatcctcctatgttgtatctcggttatgtcggttttgcggtgagcttcgcattcgccattgctgcgttaacaacgtctgcatcgtctgaactgccttgggcggggtggagtcgtccttgggcattgagtgcatgggtgtttctaactggtggtatctcactgggttcttggtgggcatattatgaactgggttggggaggctggtggttttgggatcctgtcgaaaatgcttctctaatgccttggttaacgggtaccgctttactgcattctttgataatgactgaaaagcgaaatgcattaaccagttggacgatactgctgtcgatctttaccttctcgttaagcttactcggcacatttatcgttcgttcaggcgtactaacttctgtgcacgcgtttgctgttgatccaacccgtggtgttgcattgctaagtattcttggcgtggtgctactgagttctttgacgttgtttgctttaaggggcggtcaatatattaaacccgtccggtttggattcttatcgcgtgaagctgcgttattggcgggtaacagtttatttgccgttgcgacgcttactattttacttggcacgttttatccaatgatattccaagcatttgggttgggaaatatttcagtaggagccccgtattttaatagcttgttcgtgccattaagtttcgtgatttttgcagttatgggcttagcaccattgataaaatggaaaaatgcgacatcagataatttcatcatgcgtattattgccccactgtctgcttctgtggtcattggtgttgcactatccgtgatgtttgaacgagggattaacctcgtagtttgcgtcgcctttattatggcattatgggttacgctaacgtcattacaagtgttttatattgttcaaaaatcgcgtaagcattggaaatttgatagccaatgttgccgccagttcgcgatggtgaccgcgcatattggtgtggctgttgcgcttgtgggggcaacgctagtcagttattacgttgaagaaactaataatagaatggggccgggtagccaattagttctgggtgattaccagtttgattaccaagaaacggagttattaattggccctaattacactgcagaacaagccaatattgcagtaacacgaattaatggcgttgataaaaatgcggaacgtattggtgttattaagccacagcgtcggcattacacggtgcgaacaatgaatatgagtgagccgggtattcattggttttggaaaggtgatatttacataacgctgggcgacaaaatcaataagacagattacgcggtacgtattcaatataagccttatgttcgttggttatggatcggtagcttgttgatgatgttgggcggtattatggcagtgcttgcccgtattagaatcatggtgatgaccaagaagcagcagcgccaatgtcaaaaggcaaaactcacatcaacaattatcatgtggaagtag

SEQ ID NO: 68049 - protein, 682 aa, Photobacterium profundum SS9
MIPEVGHYALILGCVFAVLGGTIPLYGLIKKDPYLIRYAWPLSYGAFFAISSSIVLLGYSFAVDDFSVVYIAQHSNSQLPQVFKIAAVWGGHEGSFLFWLFSLAGWSAAVAFVYQYKAPSGVNQPEKQVQHEAFIGRVLVVLSLLIAAFSLFTLFTSNPFLRLLPIPMEGRDLNPMLQDVGLIFHPPMLYLGYVGFAVSFAFAIAALTTSASSELPWAGWSRPWALSAWVFLTGGISLGSWWAYYELGWGGWWFWDPVENASLMPWLTGTALLHSLIMTEKRNALTSWTILLSIFTFSLSLLGTFIVRSGVLTSVHAFAVDPTRGVALLSILGVVLLSSLTLFALRGGQYIKPVRFGFLSREAALLAGNSLFAVATLTILLGTFYPMIFQAFGLGNISVGAPYFNSLFVPLSFVIFAVMGLAPLIKWKNATSDNFIMRIIAPLSASVVIGVALSVMFERGINLVVCVAFIMALWVTLTSLQVFYIVQKSRKHWKFDSQCCRQFAMVTAHIGVAVALVGATLVSYYVEETNNRMGPGSQLVLGDYQFDYQETELLIGPNYTAEQANIAVTRINGVDKNAERIGVIKPQRRHYTVRTMNMSEPGIHWFWKGDIYITLGDKINKTDYAVRIQYKPYVRWLWIGSLLMMLGGIMAVLARIRIMVMTKKQQRQCQKAKLTSTIIMWK

SEQ ID NO: 68050 - DNA, 2367 bp, Haloarcula marismortui ATCC 43049
  CDS (1)..(2367): transl_table=11
atgacaacagtcgtattcgggctagcagtcgggacctggctgctggcaatcggcctgttcggaagcgtgcttgccacggcgctactcggctacgagtacgtgaccggcgacgagtcgttccttcgcgtcagcaaggctgccgcgggcgtcgcgacggggtcgttcgttatcgcactgctatacctgacttcgcagtttctcagtggggattacaccaacgcgtatgtctgggacaacactgcaaattacctcccgacgctgtacaaagtcacaggagtgtacgcgtccaacgcgggatcgatactgctgtgggcgatgctcacggctgttgtcgtcacgacgaccttgcttctgggccggtacagcacacgcggcgcacgtctctcgcaatcccttgggatgggcgttgtcaccgtgttcgcctggatgctagtcaacgacagcccgtttactcccctgtcggcagagtacccgtcggtcgcggctaacgggattccacaggacggcagcgggctgaacccgctactggtcgacccgttcatggcaatccacccgccgataacgttctcggcgtacgcgctcatggtggttcccttcaccgttggcgtgacccacttcgtcgccaaactccgggggacggagagcatgttcgacgactggctgggcagcatgacgcgctggctccgggggtcgtggctcctgctgactgccgcgatcacgctcggcggcatctgggcgtatcgagtcctcggctggggtggcttctggtcgtgggacccagtcgaaacgtcagtgctcatcccgtggctcggactgaccgccgtgttgcatacgctcaaccagtaccggcgctccggccggtacgcagtactcgcgccggccgccacggcggcgttgctcccgctcgtcatctacgcgacgaccgtggtccggagcggcgtcttccggagcgtccactcgttcgccggcgggggcatcgggagcggcgtcctgttcctcctcggaacgacgagcacgctggcggtcggtcccgcgttcatccactggttcaggactgagcaaagcgacgccgaagaagcgagcctgctcgaccgggcgacaatctaccacgctgccgtgctcgggttcatcctgcttgcgttcgtctcgctctggggcctcacgttccccgtggttcgcagcctcgcttcaggtgtcgaagtcagcgtcgacgcgcggtactacaacctctggagcttcccggtcgtcgtcgggatgctccttgccggagggatgtacgcacaacaagagcgcttcagtacgcgagcgacagtcgtgaccgccgctacagtgctcatcgccgccctcgccgttggtttcgtgctggcacgacctgagtggcagctggcgtcgactgagccgttcgacccggtgtattaccgcgccatcgggagcctcagtgtggtcaccgtgctgccgccggccgtgtacttcgcaggcgcgtgggtcgtccgctacgcgggccgtctccgccgactgaccggacggcaggcgaagctaaacgagaccggcatcgccctcattcacgtcggcgcggcgctgctcatcgtctccgtctccttcgtctatgtcttctcgacgacagcgtccgtcggtatcgtgggcgcgacagaactggacgataccggcgagcgaatcgtccgcgacgtcgaggggtcgccgtacacggtcgaggtaaccaactactcgccggagaacacgccgacgatgaccgaggcggcgatgacgccggccgaagtcggctccgttgacccctcgtcatcggtgattctcgtaaaaggagaggtgaccgcagtgcaacgcttcgaggacacgaccatcgcacagctcaacgggtcccgcgtgtgggtcggtgccgacagcgggacagtgcagttcgaagaggggtcggtgatcgtcgcccgcgggacactctctgaccctcgttccgagaacatcgacgcgctcgtctacaccaacggggaaaacgtcggaccggcgtcggccccgccgacagacgtgtactcgccgcgggtcgtcgaccatcggttcgacgttcaactgtaccggggcgacacgctggtcgccgatggcactgtggccgaacagtcatatcgcggtcgcgatatgcagacgaacgacccgctcatcgaacgcggtatcaccggcgacacgtacgtcgtggggactcgaaccgcgggcgggctctcgatcgaaatcagtcgctacccgcttgccaaccagatctggttcggcgtcgcagtgatgctcgtcggcatggggctggtcttcctgttcgatccagcgtcgggtgccgccggtggccgtcgctccggaaatcgcgattga

SEQ ID NO: 68051 - protein, 788 aa, Haloarcula marismortui ATCC 43049
MTTVVFGLAVGTWLLAIGLFGSVLATALLGYEYVTGDESFLRVSKAAAGVATGSFVIALLYLTSQFLSGDYTNAYVWDNTANYLPTLYKVTGVYASNAGSILLWAMLTAVVVTTTLLLGRYSTRGARLSQSLGMGVVTVFAWMLVNDSPFTPLSAEYPSVAANGIPQDGSGLNPLLVDPFMAIHPPITFSAYALMVVPFTVGVTHFVAKLRGTESMFDDWLGSMTRWLRGSWLLLTAAITLGGIWAYRVLGWGGFWSWDPVETSVLIPWLGLTAVLHTLNQYRRSGRYAVLAPAATAALLPLVIYATTVVRSGVFRSVHSFAGGGIGSGVLFLLGTTSTLAVGPAFIHWFRTEQSDAEEASLLDRATIYHAAVLGFILLAFVSLWGLTFPVVRSLASGVEVSVDARYYNLWSFPVVVGMLLAGGMYAQQERFSTRATVVTAATVLIAALAVGFVLARPEWQLASTEPFDPVYYRAIGSLSVVTVLPPAVYFAGAWVVRYAGRLRRLTGRQAKLNETGIALIHVGAALLIVSVSFVYVFSTTASVGIVGATELDDTGERIVRDVEGSPYTVEVTNYSPENTPTMTEAAMTPAEVGSVDPSSSVILVKGEVTAVQRFEDTTIAQLNGSRVWVGADSGTVQFEEGSVIVARGTLSDPRSENIDALVYTNGENVGPASAPPTDVYSPRVVDHRFDVQLYRGDTLVADGTVAEQSYRGRDMQTNDPLIERGITGDTYVVGTRTAGGLSIEISRYPLANQIWFGVAVMLVGMGLVFLFDPASGAAGGRRSGNRD

SEQ ID NO: 68052 - DNA, 1923 bp, Anaplasma marginale str. St. Maries
  CDS (1)..(1923): transl_table=11
atgcaatattcgatgggcggcttgggcgcgtttttaatgtgcgcgtgcgcgctgtctctgctatgttccgtggttgcgcgcttatcaaccgcgtggggggcaacactgacgcacgtggcattctcgttatacagcgcagctgcagccctgctcacctacctgcgggttacggaccacttcaactacgcacacgtatatcagaattcgcatactactcaaccactcctgtacaaggtgtgcgggatatggggaaactatgagggctcaaacctgctgtttgtatggatgctgagtgcatatggaacgcttattgcgcttctggtcaagcgagacgatctgaaaggagctgcgctcgtcgtacaaaacttgctcagctttggctttgcgctgtttggcgtcatatttgcaaatccattcctgaaagttataaccctggacgcagacgggctgggttttaacccaatgttgcaggatgtcgggcttgcacttcaccccccagtattgtttgggggttatacgggttttggcgcagtattttccataacgattgctgcacttgttttgcgcatagaccccaaagaatgggtcgcggttatacgtggttgggtgttaggcgcgtggactttactcacgctgggtgtagcacttggcggatggtgggcatatagggaattaggttggggaggattttggtcttgggatccggttgagaatgtttccttgatgccgtggtttttgggggtggcgctcattcacatgatgccggtggtgaaaaagtttggcatatattgcaattttacgtttttgctcgctttgctggcgtttatttccagtttgtgcggcacatttttagtgcgctctgggtttttagtttctgtccatgctttcgcgaatgatcaaggatgcggcatttttctactggctttggttacgacaataacggtgggcgggctgctaacatttgttattaagtacagaaatttgccggagacctgctgccacttcggctgcatatcaaaactcaccgcgattttggccaatagcgtaataatgttgaccgcgtttttggtggttttggcagggactgtgtatcccataattctagagctgcttgagggggataccatatctgtaggcgcgccatattacaataacgtgttcagcgtgctatccgtagcgttgttttcggttatgatattgctctctggcctaagttgggacggctcggagaaatttaaaatgaccttcaaaatttcttccgtaatcgcaacacttcttgtaccttttgcagcgccccttgggctcaccggagtgttaattttgctggctgcgctgttgtttttttcgatactggaagattacatttatcgagtgcgtagctcacaaatgcggctgagtgctgcggtcaggcgtgtgagccttgggcgatatgcaatgatgatgacacacgccggtgttgcggtttgcatgtttggcatcatctgctctactgcatttcaggaagatgtaacacaatacatgaaagagcgcgaatccgcagaaattcacgggtttagcgtgacattatctggtgtgtcactggtaaagcggccgcataacgaggccataagggcgaagttttccgtggctagatcaggcaaagtagtgtgtctattgttccccgaaagtaggttctactatgtcgaaggtattagaaattctgaaagtagcatctgtcacggattacttgcggacatatacatagtagtaggtgaagtggataaaaatcgcgggatagcggtgcagatgcactacaaaccactaatcaatctggtatgggcagggtttgccctgatggcggccgggggagtgctgtcggtagttaaagtatggctgcgccgcaggcaaaacaatcctgctataggtgcaaatagtactgcctga

SEQ ID NO: 68053 - protein, 640 aa, Anaplasma marginale str. St. Maries
MQYSMGGLGAFLMCACALSLLCSVVARLSTAWGATLTHVAFSLYSAAAALLTYLRVTDHFNYAHVYQNSHTTQPLLYKVCGIWGNYEGSNLLFVWMLSAYGTLIALLVKRDDLKGAALVVQNLLSFGFALFGVIFANPFLKVITLDADGLGFNPMLQDVGLALHPPVLFGGYTGFGAVFSITIAALVLRIDPKEWVAVIRGWVLGAWTLLTLGVALGGWWAYRELGWGGFWSWDPVENVSLMPWFLGVALIHMMPVVKKFGIYCNFTFLLALLAFISSLCGTFLVRSGFLVSVHAFANDQGCGIFLLALVTTITVGGLLTFVIKYRNLPETCCHFGCISKLTAILANSVIMLTAFLVVLAGTVYPIILELLEGDTISVGAPYYNNVFSVLSVALFSVMILLSGLSWDGSEKFKMTFKISSVIATLLVPFAAPLGLTGVLILLAALLFFSILEDYIYRVRSSQMRLSAAVRRVSLGRYAMMMTHAGVAVCMFGIICSTAFQEDVTQYMKERESAEIHGFSVTLSGVSLVKRPHNEAIRAKFSVARSGKVVCLLFPESRFYYVEGIRNSESSICHGLLADIYIVVGEVDKNRGIAVQMHYKPLINLVWAGFALMAAGGVLSVVKVWLRRRQNNPAIGANSTA

SEQ ID NO: 68054 - DNA, 1956 bp, Idiomarina loihiensis L2TR
  CDS (1)..(1956): transl_table=11
atgattgctgaagcaggacatcttgccatagcgattgcgctggccttttctgtattactggcggtttatcctttatggggagcggcgaaaggaaacggcggcatgatggctttagcccggccgtttgcctatggccagtttttctttaccgctatcgcttttgctttattagtctggggctttgtcagtaacgactttagtattgcttatgttgcggcaaactcgaatagtcagctaccggttgcgtatcgggttaccgcggtgtgggggtcacatgagggctcttttcttctctggatgctaatgcaggcaggctggatagccgcagttgcgatattttcccgctctatgccattgccgatgatagcccgggtgcttgccattctggggctggtcagcattggcttctatttgtttatgctaacggtttcgaacccctttgatcccagtttgcctctcattcctgttgacggtcgcgatctcaatccgctgctgcaagacccgggaatgatcattcatccgccattgctgtatatgggctacgtcggtttctctgttgcttttgcttttgctattgccgctttaatgtcaggcaagcttgatgcagcctgggctcgttggtctcgtccctggactctcgcagcatggatttttctgacactgggtattgccattggtagctggtgggcatattacgaacttggctggggtggctggtggttctgggacccagttgaaaatgcgagctttatgccatggctggtaggaacggcattactgcactcacttgccgtaactgaaaaacgtggcagctttaagtcctggacggtattgctggctatatccgctttcagtttgagcttattaggcacctttttggtacgttccggcgttttagtgtcagtgcatgcgtttgcaaccgaccccgcccgaggcttgtttattctgatactgctggggctggttgtcggcggttcgcttattctttacggcctgcgcgccggaaagatgcaaagttacagccgttatgaactgctttcacgagaagtgatgctgctgggtaacaatgtcttgttaatggcggctatgatagttgtgtttctgggcaccatgctacctctggttcataaagaaattggtctgggtaccatttctattggggcacctttctttaatgagctgtatagctggctggttattccatttgcattaatgctgggtcttggacccttaatgcgctggcgcagacaagctatgcaaccacttctgaaaccgctggccttagcactttctttggcgctgattctggcctacacgctgccgaagatttgggccgacgaattacccgcgttggtggttattgcgctgtttctggcgttctgggtggctctggctacactgaccgaagtccagcaaacggtaaaacaacgcaagcagggttgggccgggctgaccaaaatttcaggtagtcattggggaatggttctggggcatttaggttttgccgtaacgcttatcggcatcaccctggtttcaaactatgagcaggagcgcgatattgcgcttgcgccggggcaatcggttgatgttatcggttataacgttgtgttcgaaagcctgcagcatagggaaggacctaactacgatgccgatcagggagtatttactgtctacaaagacgggcaggaagtaacgcagttaaccagcgagaaacgtttttaccgggtacaacgcaccagtatgaccgaagttgggctcgatgcgagtttgttacgcgatatctatattgctatgggcgagccgctggatgatgaaacctgggccattcgtttctatatcaagccctttgtccgctgggtttggctgggcgctattatcatggcaataggcggcgctatggcatttgctgataaacgttatcgtaagcgtggcaaaaaggagatggccaatgactaa

SEQ ID NO: 68055 - protein, 651 aa, Idiomarina loihiensis L2TR
MIAEAGHLAIAIALAFSVLLAVYPLWGAAKGNGGMMALARPFAYGQFFFTAIAFALLVWGFVSNDFSIAYVAANSNSQLPVAYRVTAVWGSHEGSFLLWMLMQAGWIAAVAIFSRSMPLPMIARVLAILGLVSIGFYLFMLTVSNPFDPSLPLIPVDGRDLNPLLQDPGMIIHPPLLYMGYVGFSVAFAFAIAALMSGKLDAAWARWSRPWTLAAWIFLTLGIAIGSWWAYYELGWGGWWFWDPVENASFMPWLVGTALLHSLAVTEKRGSFKSWTVLLAISAFSLSLLGTFLVRSGVLVSVHAFATDPARGLFILILLGLVVGGSLILYGLRAGKMQSYSRYELLSREVMLLGNNVLLMAAMIVVFLGTMLPLVHKEIGLGTISIGAPFFNELYSWLVIPFALMLGLGPLMRWRRQAMQPLLKPLALALSLALILAYTLPKIWADELPALVVIALFLAFWVALATLTEVQQTVKQRKQGWAGLTKISGSHWGMVLGHLGFAVTLIGITLVSNYEQERDIALAPGQSVDVIGYNVVFESLQHREGPNYDADQGVFTVYKDGQEVTQLTSEKRFYRVQRTSMTEVGLDASLLRDIYIAMGEPLDDETWAIRFYIKPFVRWVWLGAIIMAIGGAMAFADKRYRKRGKKEMAND

SEQ ID NO: 68056 - DNA, 2142 bp, Azoarcus sp. EbN1
  CDS (1)..(2142): transl_table=11
atgcctgagcgcacgagctgggtcgccgtcatcctggcagccttggcgggcgtgctgttttcagggcttggcgatgtcgtgatcggcctcgcggccctatccgtgcttgtcgccggtgcttcggcacgataccggctgcgcctgtgccgggtcggcgctgcggcgctttgggggtcgatcctgacacttgcggtgctgatgctcgccgaccgcttcgatgtccgctatgtatggctctacagcggagccgaactgccgattttcctgaagctctccaacctgtggggaggcgacgagggcactacgctgctgctggcagccttcggtgcaagcctcgctgcccgttcttcgtcggccccgctgcgttttgacgtcaccgcgtttcttgccggggcgctcgcgctcgctgcggcgaccttgtcgccgtttgcagcgaccccgccggagtggctggagcgagcggcttaccagggcatgaatgcgcacctgatgaaagtgtggatgcttgcccacgctccgttggtgctggcggcctatgcctggacactgtctctcgcgtcgccggcgctggcagcgcttgcgggagaccttgcacgctggcccgacgacgcgttgatacgtgcgcgccgcgcttgggcactgctgacggccggcatcggattcggcatggtgtgggcgttcgaggatgcgatgtatggccaggtgtggcattgggatccggtgcagaccgccgtgttcgcagtctggtgtctcctcggcgcccacttgcatggtctctccggctggcgcgcgggccgcccgatgtggcgctggacgccgctcgcggccgcactcgcggcggcgctgaccttggtggcgatgggagtcacgcgacacgatgcgctcgccagttcgcatcgctacgtcggcgcaacgtcgtctttcgtgtacttctcgctcgccggccttctcgtgctgacgatcggcgcaacctgggtgcgcggattgcgccgtgcagcggccgtcgggtcgcagtcgccgctcggcctgtcgacaggggcactgcgtgccacgcaggttgcgttcgtcatcgtgggagtattcgcggccgcacaccttgcgtgggccttcgctgcaagtgcgaaggagttgccgcggccggacgagctgagaccctttttctcgacgctgacgaactgggcgcgcggctccgagttgccatacctgcgctcagccttcgcccagtgggatgtcgatggctatgcgctggcccaggctttgctgtttccgctcatcgtcgtcgggcttctcggcgggtggttcttcctgcggcgtgtgtctgcccggctcgcgtggatgtcgttggcgctcgcgtccgttgcctgcgccggcatatggttcgaaggcggcgtgctcgtccgcgaatactccgggaagggcgttctttcgcagcagatcatcgccgttttgccgcgcatcgacgccagccttgccgcaggcgcgtatctggctctgggcaccgccgtctggagtatccgcactgcgtgcaagacctcggcgaaaggctatgtactgtcgctgggcatggtgcatcttggcgcaatgatgagcctgtggggcgcgctgctttcgaccgccctcaatggctactcgcaacacgtcatcgacgtcgccgaaacctggcagcgcgaccaccacggctatgcgtttcgcgtgacgtcgcttgccgtcgatcattccgccgacggaggacggacgaacggcgaggccggtttccgggcccttgcgcaggtcgagctccggaccccctcgcaccaggtgctgaacggggagacgctgtatcgcgacgggcgccgcgccgtcgaaggctacgccgggccggtgcgccagatctgcgagatcctcgactaccgctacgcgcgctatgcgaacacgccgggctatgtcctcgatccattcatcgatcgcggctgggagcgcgatgtccagctctgggtctccccttcggccgcggtggccgcgctcgaaggcgggccgcaggcctcgcaggtggtcgtggtcctgcgcgtattccctttcgcatcccttctctggatggggctcctgctgacctcggcgggagctctctggctcgcgctgcgccggcccaaggagcattcatga

SEQ ID NO: 68057 - protein, 713 aa, Azoarcus sp. EbN1
MPERTSWVAVILAALAGVLFSGLGDVVIGLAALSVLVAGASARYRLRLCRVGAAALWGSILTLAVLMLADRFDVRYVWLYSGAELPIFLKLSNLWGGDEGTTLLLAAFGASLAARSSSAPLRFDVTAFLAGALALAAATLSPFAATPPEWLERAAYQGMNAHLMKVWMLAHAPLVLAAYAWTLSLASPALAALAGDLARWPDDALIRARRAWALLTAGIGFGMVWAFEDAMYGQVWHWDPVQTAVFAVWCLLGAHLHGLSGWRAGRPMWRWTPLAAALAAALTLVAMGVTRHDALASSHRYVGATSSFVYFSLAGLLVLTIGATWVRGLRRAAAVGSQSPLGLSTGALRATQVAFVIVGVFAAAHLAWAFAASAKELPRPDELRPFFSTLTNWARGSELPYLRSAFAQWDVDGYALAQALLFPLIVVGLLGGWFFLRRVSARLAWMSLALASVACAGIWFEGGVLVREYSGKGVLSQQIIAVLPRIDASLAAGAYLALGTAVWSIRTACKTSAKGYVLSLGMVHLGAMMSLWGALLSTALNGYSQHVIDVAETWQRDHHGYAFRVTSLAVDHSADGGRTNGEAGFRALAQVELRTPSHQVLNGETLYRDGRRAVEGYAGPVRQICEILDYRYARYANTPGYVLDPFIDRGWERDVQLWVSPSAAVAALEGGPQASQVVVVLRVFPFASLLWMGLLLTSAGALWLALRRPKEHS

SEQ ID NO: 68058 - DNA, 1974 bp, Azoarcus sp. EbN1
  CDS (1)..(1974): transl_table=11
atgattcccgaactcggccatttctcgctgatcctggcgctggtgctcgcgctcgtccaggcggtcgtcccgatgatcggcgccaaccgcaaccgcatcgcgctgatggcagtcggacggccggcggcgcaggggcagttccttgccatcgcgttcgccttcggctgcctgacctgggcgttcgtcacgagcgatttctcgttgcagctcgcggcagtcaactcgcataccgacacgccgctgatctacaagatcaccggcgtgtggggcaaccacgaagggtcgctgctgctgtgggcgctgtcgctgtcgctgtggacggtcgcagtgacggtgttcagccgcaatttgccggacgccttcatggcgcgcgtcctcggcgtgctcggctggatcagcgcgggattcctgtcgttcacgctggtcacgtccaaccctttcgaccgcctgctgccggcggtcgcgcagggacgcgacctcaacccgctgctccaggacgccggcatgatcatccacccgccgctgctgtacatgggctacgtgggcttttcggtcgcgttcgcgttcgcgatcgcggcgctgctcagcggccgcatggatgccgcatgggcgcgctggtcgcgaccatggacgacggtcgcgtgggtgttcctcactgccggcatcgcggtcgggtcgggctgggcctactatgagctcggttggggcggctggtggttctgggatccggtcgaaaacgcgtccttcatgccgtggctgctcggcaccgcgctgatccattcgctcgcggtcacggaaaaacgcggcgcgttccgcagctggacgatcctgctcgcgatcagtgcgttctcgctgtcgctgctcggcactttcctggtccgctcgggcgtcatcacgtcggtgcatgcgtttgcgaccgacccgcgccgcggtctgttcatcctcgcgctgctggtcgtcgtgatcggcgtttcgctgacgctgttcgcatggcgcgcgccgaagctcgccggcggcggcagcttcggcctcgtgtcgcgcgacgcgacgctgctcggcaacaacgtcctgctcgcagtggcgacgggttcggtgctgctcggaacgctctacccgctgttcctcgacgcgctgaacctcggcaagatctcggtcgggccgccgtacttcgaagcggtgttcgtgccgctgatgacgccggtcgtggtgctgatggtgctcgggccgttcgtccgctggaaaggggacggcctcgggcgcgtgctgcggccgctgctgccggtgatggtggcgagcatcgcgatcggtctcggtgtcgcgttcgcggtcgggcacgtcacggtgcgcacggtgctcggcctggtgctggcgtcgtgggtgctgctcggcagcgcccggctgctggcgagccgcttcgcggagcgtcgcggcgcgagtactgcggcagtgctgcggggcatcccgttggcgtggtggggaatgtggctcgcgcacgccggcatcggcatcttcatcatcggcgcgacgatggcgggcagtctcaacgagcgcctcgacgtcaagatgcagcccggccagaccgcacaactcgccggctacacgttcacgttccgcggtgtcgccgacgcaccggggccgaactacgacgccgcgcgggcgacgatcgacgtgacgcgcagcggcattccggtcgcgacgctgcacccggaaaagcgcttctacgtcgcgcagcagatgccgatgaccgaggcgtcgatcgacatcggcccgtttcgcgatgtctacgtcaacctcggcgaccgcctcgacgacggcagctgggttgtcggcctgttctacaaacccttcatcagctgggtatggctcggctgcgtgctgatggcaatcgggggcgttttcgcggcctcggatcgtcgctaccgccgcctcgccgagcgtgaagtccctgccggcgcggcgcgccggacgacatga

SEQ ID NO: 68059 - protein, 657 aa, Azoarcus sp. EbN1
MIPELGHFSLILALVLALVQAVVPMIGANRNRIALMAVGRPAAQGQFLAIAFAFGCLTWAFVTSDFSLQLAAVNSHTDTPLIYKITGVWGNHEGSLLLWALSLSLWTVAVTVFSRNLPDAFMARVLGVLGWISAGFLSFTLVTSNPFDRLLPAVAQGRDLNPLLQDAGMIIHPPLLYMGYVGFSVAFAFAIAALLSGRMDAAWARWSRPWTTVAWVFLTAGIAVGSGWAYYELGWGGWWFWDPVENASFMPWLLGTALIHSLAVTEKRGAFRSWTILLAISAFSLSLLGTFLVRSGVITSVHAFATDPRRGLFILALLVVVIGVSLTLFAWRAPKLAGGGSFGLVSRDATLLGNNVLLAVATGSVLLGTLYPLFLDALNLGKISVGPPYFEAVFVPLMTPVVVLMVLGPFVRWKGDGLGRVLRPLLPVMVASIAIGLGVAFAVGHVTVRTVLGLVLASWVLLGSARLLASRFAERRGASTAAVLRGIPLAWWGMWLAHAGIGIFIIGATMAGSLNERLDVKMQPGQTAQLAGYTFTFRGVADAPGPNYDAARATIDVTRSGIPVATLHPEKRFYVAQQMPMTEASIDIGPFRDVYVNLGDRLDDGSWVVGLFYKPFISWVWLGCVLMAIGGVFAASDRRYRRLAEREVPAGAARRTT

SEQ ID NO: 68060 - DNA, 1947 bp, Zymomonas mobilis subsp. mobilis ZM4
  CDS (1)..(1947): transl_table=11
gtgattgccgaatccggtcttatctttttgtggctcgccgccatgatggccttgttgcaaggcctctttggcctgtctgttctgaataatcgccttgatgacgtcttctccggtgccgtcaaaataacagcccttatccaagccgccttggcgctatccgcttttgcaatgctgctttggttgtttatgcgggtggatttatcggtaaccttggtcgctgaaaacgatcattgggcaaaaccgatgctttatcgtgtggccgccagttggggcaatcacgaaggttcaatgctgctttgggtcactattctcagcttttgcggggctttgcttgcgctttttggcgggaagatcgaccagaaattattatctttggctttgggatcgcaagcctttctagccttaggcttttttgcctttttgctctttgtttccaatcctttcgctcgcctcaatccacctgcgacagaaggccttggcttaaatccgctgttacaagacccaggattggcctttcatcctccaacgctttatcttggctatgtcggcctatcggtcgctttttcttttgcggtcgccgctttactgacagggaaagcagatcgtgcctttgcgaaagccatgcgcatttgggttctaggcgcttgggtttttctgactatcggcattaccgcaggcagctattgggcatattacgaattgggctggggcggcttctggttctgggaccctgttgaaaatgccgctttgatgccgtggctcgccgctaccgccttattccattccgtttccgtcctcgccaaaagggattctttacgggtctggacattggtcttggctgttaccgctttttcaatgagcatgatcggcacttttctggtgcgttccggtattctagtcagtgttcatgcctttgcggttgatccatggcggggcagttttatccttggcttgcttgggctttatatcggtggtgccttagccctgtttgcgcttcggatcgctaaaatccaccaaggcaatcattttattctacccagccgtgaagccggtttggtgctgaataatcttttcctcggcgtcattctggcaatcgtgctgattggcacgctctatccgcttctggcggaaatgatgaacggagaaaaactatccgtcggcgcgccttattttaatatgattatcacgccgctagccttgcttctctgccttttgatgcctttcggtacattactccgctggaaacaagaccgttgggcaagtctcaaatggccgcttctggtcggggcagggctattcatcctgacagaagtcattcttgccttaaaaggcctgttctcaaccgcacctcttgcctcaatttctttgggcgttgcggtaatggtagggcttctttgcctctggccactcctccggcaaaagaccatccatctcaatttatggggcatggtgctggcgcatcttggcattgcgataactttaggcggtattgcatcagatacacttttttctcaagaattgctcaccgccctcaaaccgcaacaaacggcgcgtttgggtgattggcaactgcatttcgacagggtaatgcccgatcttggttcggattggacagcgattgtcgccgatatccgcctcgaaagaaacggacaatcttttacccttcatccagctttgcggcattttaccaatcctgtcacggataccagtgaaaccgcccttaaaacaacaaaggccggtcaactctatctggtattgggacaacaggccgaagatggtcgctggcaaattcgtgcttggtggaaacctttggtaacgcttatctgggatggcggtttcctaaccgctttcggcggcatactgatcctgctggataggcttttgcgctatctccagaaacgccgttatcaaaatcgccccgatgaaagacaaaggctgtctttatga

SEQ ID NO: 68061 - protein, 648 aa, Zymomonas mobilis subsp. mobilis ZM4
MIAESGLIFLWLAAMMALLQGLFGLSVLNNRLDDVFSGAVKITALIQAALALSAFAMLLWLFMRVDLSVTLVAENDHWAKPMLYRVAASWGNHEGSMLLWVTILSFCGALLALFGGKIDQKLLSLALGSQAFLALGFFAFLLFVSNPFARLNPPATEGLGLNPLLQDPGLAFHPPTLYLGYVGLSVAFSFAVAALLTGKADRAFAKAMRIWVLGAWVFLTIGITAGSYWAYYELGWGGFWFWDPVENAALMPWLAATALFHSVSVLAKRDSLRVWTLVLAVTAFSMSMIGTFLVRSGILVSVHAFAVDPWRGSFILGLLGLYIGGALALFALRIAKIHQGNHFILPSREAGLVLNNLFLGVILAIVLIGTLYPLLAEMMNGEKLSVGAPYFNMIITPLALLLCLLMPFGTLLRWKQDRWASLKWPLLVGAGLFILTEVILALKGLFSTAPLASISLGVAVMVGLLCLWPLLRQKTIHLNLWGMVLAHLGIAITLGGIASDTLFSQELLTALKPQQTARLGDWQLHFDRVMPDLGSDWTAIVADIRLERNGQSFTLHPALRHFTNPVTDTSETALKTTKAGQLYLVLGQQAEDGRWQIRAWWKPLVTLIWDGGFLTAFGGILILLDRLLRYLQKRRYQNRPDERQRLSL

SEQ ID NO: 68062 - DNA, 2001 bp, Silicibacter pomeroyi DSS-3
  CDS (1)..(2001): transl_table=11
atgatcgaaacgtcgatagagcttggtcagttcgcggtcagccttgccctgatcctgagcgtatttggctgctttcaggctgtgctggcggcccggtcgggggcagcgtcacggctggtatcggcccgaaacgcaatcttcgcaaacttcgtgcttgcgacgattggctgcgccgttctgatccaggcgttcgtgacctcggatttctcggtcgcctatgtggcgcagaacagcaaccgggatctgccgatgctctacaaggtgacggcaatgtggggcgcgcatgagggcagcctgcttctgtggctgtggtatctgacgctgttttcggccgccgcagtctggctgcactggcgggactacccgaaatccatgccctgggtgatcgccacgctggcggcgattcagctggggttcctggcctttgtcgttttcctgtcaaacccgttcctgacgctcacgccgatgcccggaaacgggcgtgatctgaaccctcttctgcaggatccgggcctcgcctttcatccgccggttctctatctcggctatgtcggctttgccgtgccctttgcctttgccatcgcttcgctgatccggggtcagaccggggtggaatgggtcaccgtggtgcgccgctgggtgctgtttgcgtggacggcgctgacctcgggcatcatttgcggcggttactgggcctattacgagctgggctggggcgggtactgggcctgggacccggtcgagaacgcctcgttgatgccctggctcaccggcaccgcgttgctgcattcgatgatggtgcaggacaagcgcgggatgttccgggcctggaacgtgtttctggtggtcaccaccttcctgctgaccctgctgggaacattcctggtgcgttcgggcgtgctgacatcggtccatgcctttgccgtcgatcccgggcgcggagcctatatgctgggcttcatgactgtcgcgatggtggtcggttacgggctgatcattctgcgggcggaccggctgcaggatgacggcggcatctcgtcacttctgtcgcgcgaggctgcgatccttggcaacacggtgctgctgctggtggtgacggccacggtcatggccggtacgcttttcccgctggtggtcgaggtcttctcggacgccaagatcagcatcggcgcgccctactataacaaggtcatcgtccccatcatggtggcgctggtctttctgctggggctggggccatcggtgccctggcggcagatgagtgcgaaacgcttcgtgggccggtttcgcctgccgctggcttttgccgggctgacggctgttgccgcggtgctggtcagcgaggccgggatcatcactcttgccgcgatctttgcggtaggtttcgcgggctttgcatcactggcggatattgccagtgcgattgccgctcggcgccgggtgatggagcagggggtgctgcgcgccacgggcgacgtgctgacacattcccgacagcgtatcggcgcgctgatcattcatttcggggtcgtcatgatcggggctggcatgattgcatcgggcctgttccagaccacccagaccgtggccatgcgcatcggcgacagggcagaggcgggcggctacacgctgacgctgcgcgagcttcaggataccggcagcgccaattacaacgcgcgggtcgcacggttcagtatcagccgcgacggggagttgctgttcgagatggcgcccgaaaagcgattctatccggtccgcgaaatggcaacgaccgagattgccatccggtcatcgctggccggggatctctacatggtcatgggcgatgaggatgggcagggaacggttgtcgtccgcatcttctggaacccgctggtcaactggatctggctgggatggctggttctgctgctgggcgcgttgctgtccttgtcaaaaccgtcgcgccgggcggcgcggagccgcacgcccgaaccgatcgaaggagtgcccgcagaatga

SEQ ID NO: 68063 - protein, 666 aa, Silicibacter pomeroyi DSS-3
MIETSIELGQFAVSLALILSVFGCFQAVLAARSGAASRLVSARNAIFANFVLATIGCAVLIQAFVTSDFSVAYVAQNSNRDLPMLYKVTAMWGAHEGSLLLWLWYLTLFSAAAVWLHWRDYPKSMPWVIATLAAIQLGFLAFVVFLSNPFLTLTPMPGNGRDLNPLLQDPGLAFHPPVLYLGYVGFAVPFAFAIASLIRGQTGVEWVTVVRRWVLFAWTALTSGIICGGYWAYYELGWGGYWAWDPVENASLMPWLTGTALLHSMMVQDKRGMFRAWNVFLVVTTFLLTLLGTFLVRSGVLTSVHAFAVDPGRGAYMLGFMTVAMVVGYGLIILRADRLQDDGGISSLLSREAAILGNTVLLLVVTATVMAGTLFPLVVEVFSDAKISIGAPYYNKVIVPIMVALVFLLGLGPSVPWRQMSAKRFVGRFRLPLAFAGLTAVAAVLVSEAGIITLAAIFAVGFAGFASLADIASAIAARRRVMEQGVLRATGDVLTHSRQRIGALIIHFGVVMIGAGMIASGLFQTTQTVAMRIGDRAEAGGYTLTLRELQDTGSANYNARVARFSISRDGELLFEMAPEKRFYPVREMATTEIAIRSSLAGDLYMVMGDEDGQGTVVVRIFWNPLVNWIWLGWLVLLLGALLSLSKPSRRAARSRTPEPIEGVPAE

SEQ ID NO: 68064 - DNA, 1965 bp, Silicibacter pomeroyi DSS-3
  CDS (1)..(1965): transl_table=11
atgattacggaactcggtcacttcgccctcatcctcgccttcatggtcgccatcgtgcaaatggtcgtgcccttgatcggagcccataaacgctggcccggctggatggccctggccgaaccggcggcaggggcgcaattcctgctcaccgcctttgcctttgccgcgctggtctgggcctttgtgacctcggatttctcgctgcggctggtggtgttgaacagccattcggccaagccgatgctgtacaagatcagcggcacatggggcaatcacgaggggtccatgctgctctgggtgctgatcgtcaccctgtttggcgccatggcggcctggtttggcggcggtctgccgccgacgctcaaggcccgcgtgctggcggtgcaatcggcgattgcggtggcgttcttcgccttcatcctgtttacctcgaacccgttcctgcggctggcggtgccgccctttgacgggcaggacctgaacccgctgttgcaggatccgggcctcgcgttccatccgccgttcctctatctcggctatgtgggcctgagcatggcgttttcctttgccgtggctgccctgatcgaggggcgcgtcgatgccgcctggggccgctgggtgcggccctggacgcttgcggcctggattttcctgaccatcgggatcgcgctgggctcgtggtgggcctattacgagctgggttggggcgggttctggttctgggatccggtggaaaatgccagtttcatgccctggctgctggccgccgccttgctgcattcggccatcgtggtggaaaagcgcgaggcgttgaaaagctggaccatcctgctggcgatccttgccttcggcttctcgcttatcgggacgttcatcgtgcgctcgggcttgctgaccagcgtgcatgcctttgccaatgaccctgagcgcggcgtgttcatcctgattatcctcggcctttttaccggcggcgcgctgacactgttcgccgcgcgcgcgcaggcgatggaggccaagggcgtcttttccatggtcagccgggaaagcgcgctggtgctcaacaatatcctgctggcggtgtcggcctttgtggtgttcttcggaacgctctggccgatcctggccgagatgttctttgaccgcaaactctcggtcggggcgccgttcttcaacgcggccttcacaccgttcatggtggcgctgggggtggtgttgccgctgggcgccatgctgccgtggaaacgcggcaagctgggccgggtggcgcacagcctgcgctatgcctttgtgctggcgctggcgctggcgatcctggtctgggtcatgcagaccgggcgcagcgcgctgggtccggtgggtctgttcctgggggcctggatcacctttggcgctattgtcgatctgtggtcgcgcaccgggcgcagtggcagcgtggcgcggctgttccgtctgccgcgcgccgactggggcaaggcggtggcccattccggtctgggtgtcaccatgttcgcgattgccgggctgatggcctgggaggtcgaggatatccgcgtcgcccgtctcggcgaacctttcgaggtgggcgggttcaccctgacgctcgacggggtcgagcgcgtgcaggggcccaactatatctcgaccatgggcagtgtccgcctggaacaggcgggtcgggccatcgacacgctgcaccccgaaaagcgcgactatccggttgcgcgcatgcccaccacagaggcggcgatcgactatcgcattctgcgcgatgtctatgttgtgatcggcgaccagcaggacgacggcggctggaccatacggacctatatcaagccctttgccaactggatctggggcggctgtatcctgatggcgcttggcggcgcgctcagcctcagcgaccggcgcttccgggtggcggcgggtgcgcgcaaggcaccggccggcggggtgcccgcggaatga

SEQ ID NO: 68065 - protein, 654 aa, Silicibacter pomeroyi DSS-3
MITELGHFALILAFMVAIVQMVVPLIGAHKRWPGWMALAEPAAGAQFLLTAFAFAALVWAFVTSDFSLRLVVLNSHSAKPMLYKISGTWGNHEGSMLLWVLIVTLFGAMAAWFGGGLPPTLKARVLAVQSAIAVAFFAFILFTSNPFLRLAVPPFDGQDLNPLLQDPGLAFHPPFLYLGYVGLSMAFSFAVAALIEGRVDAAWGRWVRPWTLAAWIFLTIGIALGSWWAYYELGWGGFWFWDPVENASFMPWLLAAALLHSAIVVEKREALKSWTILLAILAFGFSLIGTFIVRSGLLTSVHAFANDPERGVFILIILGLFTGGALTLFAARAQAMEAKGVFSMVSRESALVLNNILLAVSAFVVFFGTLWPILAEMFFDRKLSVGAPFFNAAFTPFMVALGVVLPLGAMLPWKRGKLGRVAHSLRYAFVLALALAILVWVMQTGRSALGPVGLFLGAWITFGAIVDLWSRTGRSGSVARLFRLPRADWGKAVAHSGLGVTMFAIAGLMAWEVEDIRVARLGEPFEVGGFTLTLDGVERVQGPNYISTMGSVRLEQAGRAIDTLHPEKRDYPVARMPTTEAAIDYRILRDVYVVIGDQQDDGGWTIRTYIKPFANWIWGGCILMALGGALSLSDRRFRVAAGARKAPAGGVPAE

SEQ ID NO: 68066 - DNA, 1971 bp, Rhodobacter sphaeroides 2.4.1
  CDS (1)..(1971)
atgattgtcgaactcggccatttcgcgctggtgctgtcgctggctgtggcccttgtgcagtccgtggtgccgctcgtcggcgcggatcggcgctggtctggctggatggcggtggccgaacccgcggcggtcacccagcttctgctgatcggcttctccttcgccgcgctgacctgggccttcgtgacctcggatttctcggtgcgcctcgtggtgctgaactcgcacacgctgaagcccatgctctacaagatcagcggcgtctgggggaaccacgagggctcgctgctcctgtgggtgctgatcctcgcgctgttcggagcctgcgccgcggtcttcgggcagaacctgccgcccacgctcaaggcgcgcgtgctggcggtgcaggggatgatcggcgcggccttcctggcctttctcctcttcacctcgaacccgttcctgcgcatgggcgaggtgcccttcgacggcgaggatctgaacccgctcctgcaggatccgggcctcgccttccacccgcccttcctttacctcggctatgtcggcctctcgatggccttctccttcgcggtggcggccctgatcgagggccgcgtcgatgccgcctggggccgctgggtccggccctggacgctcgccgcctgggtgtttctcaccatcggcatcgcgctcggctcctggtgggcctattacgagctcggctggggcggcttctggttctgggacccggtcgagaacgcctccttcatgccctggctgatcgcggcggcgctgctccactctgccatcgtggtcgagaagcgcgaagcgctgaagagctggacgatcctgctggccatcctcgccttcggcttctcgctcattggcaccttcatcgtgcgctcgggcgtcatcacctccgtccatgccttcgccaacgatcccgagcgcgggatcttcatcctgatgatcctcgcggtcttcatgggcggggcgctcacgctcttcgccgcgcgggcgagcgccatggaggccaagggggtcttcggcatcgtcagccgcgagtcgggcctcgtgctgaacaacgtgctgctgacggtggcctgtttcgtggtcttcatcggcacgatctggccgctcctggccgaactcctctggggccgcaagctgtcggtgggtgctccgttcttcaacgcggccttcacccccttcatggtggtgatcgccctcgtcctgcctctgggcgccgtcctgccctggaagcgggccgagctcggccgcgggatgcggccgctctggggggcgctcgcgctctcggcggccctgggtgcgctggtcttcgcgctgcagacgggccggtcggcgctcgggcccgtcggcctcgcgctcggcgcctggctcgtcttcggcacgctcctcgacctctggggccgcaccgggcgcggcgcgctcggcgggcggctcgcgcgcctccggcgactgccgcgcgcggactggggcaaggccactgcccatgcgggcctcggcgtcacgatcttcgccgtggcggccatcaccgcctggcaggtcgagtcgatccgcgtgatgaagccgggcgagaccttcgccctcggccgctacgacgtcctgctcgagggcgtgcgcgagatcgaggggccgaactaccgctcgaccgtggccgacttccgcgtgacccgcgacggggccgaagtggcgacactccatcccgagaagcgcgtctatccggtggccgccatgcccacgacggaagccgccatcgactacggcttcacccgcgacctctacctcgtgatcggcgacccgcaggagggcggcggctatgcggtgcgcagctacatcaagcccttcgccaactggatctggggcggcgcgctgctgatggcgctcggcgggctgctgagcctctcggaccgccgctaccgcatcgccgccggggcgcgccggatgccggccgcggtggctgcagaatga

SEQ ID NO: 68067 - protein, 656 aa, Rhodobacter sphaeroides 2.4.1
MIVELGHFALVLSLAVALVQSVVPLVGADRRWSGWMAVAEPAAVTQLLLIGFSFAALTWAFVTSDFSVRLVVLNSHTLKPMLYKISGVWGNHEGSLLLWVLILALFGACAAVFGQNLPPTLKARVLAVQGMIGAAFLAFLLFTSNPFLRMGEVPFDGEDLNPLLQDPGLAFHPPFLYLGYVGLSMAFSFAVAALIEGRVDAAWGRWVRPWTLAAWVFLTIGIALGSWWAYYELGWGGFWFWDPVENASFMPWLIAAALLHSAIVVEKREALKSWTILLAILAFGFSLIGTFIVRSGVITSVHAFANDPERGIFILMILAVFMGGALTLFAARASAMEAKGVFGIVSRESGLVLNNVLLTVACFVVFIGTIWPLLAELLWGRKLSVGAPFFNAAFTPFMVVIALVLPLGAVLPWKRAELGRGMRPLWGALALSAALGALVFALQTGRSALGPVGLALGAWLVFGTLLDLWGRTGRGALGGRLARLRRLPRADWGKATAHAGLGVTIFAVAAITAWQVESIRVMKPGETFALGRYDVLLEGVREIEGPNYRSTVADFRVTRDGAEVATLHPEKRVYPVAAMPTTEAAIDYGFTRDLYLVIGDPQEGGGYAVRSYIKPFANWIWGGALLMALGGLLSLSDRRYRIAAGARRMPAAVAAE

SEQ ID NO: 68068 - DNA, 1941 bp, Xylella fastidiosa Dixon
  CDS (1)..(1941)
atgctgcctgagtttggccagatcctcctgatcctcgccctgctgacagcactgctgcagggactgcttcccctgattggcgcccagcgccgccgcactgcttggatggccgttgcacgcccagccgcctatgtgcaactgagcctgctcgctagcgcattcgcactgctcacctatgccttcctcggcaacgacttctccgtccagtacgtcgccgaaaattcccattcactgctacccaccctctaccgctctaccgccgtatggggtgcccacgaaggatccctcctactctgggtattactcctggcaggatggaccgccaacgtcgccttacgttcccacacccttccagccaccctgagcgcacgcatccttggcgtcctgggcctgattgcactcggcttcctcgcactgatcctcttcacctccaacccattcgcacgtctcctgcctgccgccccagaagggaacgacctcaacccgttgctgcaagatcctgggatgattctgcatccccccctgttatatgccggctacatcggtttggcagtgccattcgcctttgccgtcgcggtcctgctggaaggacggatagagccagcctggctacgctggagccgaccttggaccaacatcgcctgggcactgctgaccttgggcattgccctgggcagctggtgggcctattacgaactcggctggggcggctggtggttctgggacccagtggaaaacgccagcttcatgccttggctcatcggtgtcgcactgattcattcccaagcgatcaccgacaaacgcggcagcttcacccactggacactcttgctcgcaatcaccgcctttgcactagcactgcttggcacattcctcgtccgctcaagcgtactgacctcagtccatgcctttgctgctgatccggtacgcggcgcgtttattctgctgctcatcttcacgttgattggcggcgcactgctgctgtatgcacggcgtgcaccgcaactcacccccgtcacaatggacatgcaacaacgctttacacccgtctcacgcgaaaccctattactgctcaacaacctattgctgacctgcgcctgtgcgatggtactgctaggcaccctatatcccctgctggccgatgcactggcactgggtcaactttcagtcggcccaccctacttcggccccctattcaccctgctgatgacaccactaatcgtcttactgccattgggtccattcacccgatggcaacgcgaacacccctcaacacccctcgtattgctggccccttgggccgcactgagcctggctgtcgccgcactggctggcatcaccacaccacaacaccattggaaaaccatgctcagcgtggccgcggcagcatgggtactcctaggaaccctccgcttcctctggtggcactggcgcaccaccggatcccgtcccacccccagcaccctgggcatggtcctggcacacgccggaattggcgtcttcctcactggtgcgctgttagttgaaacactcagcctacaacgtgaaattgcactcaccccgggccagacactcacccttggccccatcaccctacactttgatgccctcctcgaacaccacggccccaactacgtggctgatcgcgcccaattcagcctattacgcaacacgcatcccctgggcaccctgacgacagaaaaacgccgctatgtcagcggcggccaagtcaccaccgaagttggcatccatcctggagcgctcggtgacatttacgtcgccttaggagaatcgctcggcaatgggtcatgggcaattcaggcacactacaaaccattcgtccgttggatctggctgggcgcagcactgatggccctgggtgggctgatcgctgctgctgatcgccggttccgccaccacccggagtcatcgcatgtctga

SEQ ID NO: 68069 - protein, 646 aa, Xylella fastidiosa Dixon
MLPEFGQILLILALLTALLQGLLPLIGAQRRRTAWMAVARPAAYVQLSLLASAFALLTYAFLGNDFSVQYVAENSHSLLPTLYRSTAVWGAHEGSLLLWVLLLAGWTANVALRSHTLPATLSARILGVLGLIALGFLALILFTSNPFARLLPAAPEGNDLNPLLQDPGMILHPPLLYAGYIGLAVPFAFAVAVLLEGRIEPAWLRWSRPWTNIAWALLTLGIALGSWWAYYELGWGGWWFWDPVENASFMPWLIGVALIHSQAITDKRGSFTHWTLLLAITAFALALLGTFLVRSSVLTSVHAFAADPVRGAFILLLIFTLIGGALLLYARRAPQLTPVTMDMQQRFTPVSRETLLLLNNLLLTCACAMVLLGTLYPLLADALALGQLSVGPPYFGPLFTLLMTPLIVLLPLGPFTRWQREHPSTPLVLLAPWAALSLAVAALAGITTPQHHWKTMLSVAAAAWVLLGTLRFLWWHWRTTGSRPTPSTLGMVLAHAGIGVFLTGALLVETLSLQREIALTPGQTLTLGPITLHFDALLEHHGPNYVADRAQFSLLRNTHPLGTLTTEKRRYVSGGQVTTEVGIHPGALGDIYVALGESLGNGSWAIQAHYKPFVRWIWLGAALMALGGLIAAADRRFRHHPESSHV

SEQ ID NO: 68070 - DNA, 1917 bp, Actinobacillus pleuropneumoniae serovar 1 str. 4074
  CDS (1)..(1917)
atgcttcctgagttgggttattttacgttaatttttgcagcggttgccgctgtttgccaagtggggctgacattgtggggagagatcactaagaaaacggattttcttcgatacaatgcgttgttgagcagcctgcaaacggtaggttgtttgtcgtcgttcgggatattggcttacgcttttttgagtgatgatttttcggtgatttatgtcgcccaacattccaacagccaattaccggatttctttaaatttgcggcgacttggggcggacacgaaggctcaatgctgttttggctgaccgctctgacactatggaccagcgttttttgcattttttcggataaatctgaccgcttgtttaatcagcgaaccttggcggtattaggtttaatcagccttggatttatgctctttattttattggtttccaatccgtttgagcgtagttttccgcctccgccggagggcagagatcttaacccgatgttgcaagacgtagggcttatcttccatccgcctttactttatttaggttatgtcggttttgcggtaagctttgcaatggtcgtggcggcattaatggaaggtatgctggatgccgcagtagtgcgttggattcgaccttggacaatgatctcttggggctttcttaccgcagggattattctcggtgcatggtgggcgtattatgaactgggctggggcggctggtggttctgggatccggttgaaaacgcttcgttaatgccgtggctattgggaaccgcattagtgcatagcttggttgtgagcgagcagcgcggtatttttaactattggacgattttactggcgatttttgcttttgcattgagcttactcgggacttttatcgtgcgttccggcgtactcacttcggtacatgcgtttgcagttgatccggatagaggaatggcactgcttattctgtttttcagtttaagttttattgcgttagccttgttcgcttttagagtgaatttgtggcagggcgaagtgcgtttccaaccgctatccaaagaaaccgctttattattagtaaacggcttattgagcgtagcgacttcggttgtcctactcgggactttttacccgatgatttttacggcgatgaattggggctcgatttcggtcggcgcaccttatttcaataatgtttttgcaccgttggcattattattaatgacggtaatgggatttgccgtcgtattgcgttggaagcaaattccgtcaaaacaaattctgatgaaattatggctgttaccggtagcggtaggattgagtttcctattgattcaacaaacgatttcgcaaacaaagttgtatcaatttggcgtcttgccgacggtattcgtcagccttgccgtttggattattctgacgcatttgccttattcggcgaaatttctgaaaatccgaccgcttgctatgcgtttggcgcatatcggttttgcgatttgtgttattggtgccatgatgaacagttattacggcgatgaaatcggcgtacgtttaaaaccgcagcaacaggcggatcttgccggatttacctttaaatatgaagattatcaggatgggatcggtgcgaactatacgtccgaaaatgcgttatttagcataagcaaagcgggaaaaacgcttgcgacggtagtggcggagcgccgctattacgatattcgtaccatgacgatgtcggaagtcgggctttatcatcacggcttggacgatatttatattgtgatgggcgataaattcggcaatttggaatatgctttccgtttgcattataagccttatgtcggcgcattatggcttggcggtattattatggtgatagcttccatacttgccttattcggttatcgtcgaaaatcggatcttacagcggataaataa

SEQ ID NO: 68071 - protein, 638 aa, Actinobacillus pleuropneumoniae serovar 1 str. 4074
MLPELGYFTLIFAAVAAVCQVGLTLWGEITKKTDFLRYNALLSSLQTVGCLSSFGILAYAFLSDDFSVIYVAQHSNSQLPDFFKFAATWGGHEGSMLFWLTALTLWTSVFCIFSDKSDRLFNQRTLAVLGLISLGFMLFILLVSNPFERSFPPPPEGRDLNPMLQDVGLIFHPPLLYLGYVGFAVSFAMVVAALMEGMLDAAVVRWIRPWTMISWGFLTAGIILGAWWAYYELGWGGWWFWDPVENASLMPWLLGTALVHSLVVSEQRGIFNYWTILLAIFAFALSLLGTFIVRSGVLTSVHAFAVDPDRGMALLILFFSLSFIALALFAFRVNLWQGEVRFQPLSKETALLLVNGLLSVATSVVLLGTFYPMIFTAMNWGSISVGAPYFNNVFAPLALLLMTVMGFAVVLRWKQIPSKQILMKLWLLPVAVGLSFLLIQQTISQTKLYQFGVLPTVFVSLAVWIILTHLPYSAKFLKIRPLAMRLAHIGFAICVIGAMMNSYYGDEIGVRLKPQQQADLAGFTFKYEDYQDGIGANYTSENALFSISKAGKTLATVVAERRYYDIRTMTMSEVGLYHHGLDDIYIVMGDKFGNLEYAFRLHYKPYVGALWLGGIIMVIASILALFGYRRKSDLTADK

SEQ ID NO: 68072 - DNA, 1974 bp, Pseudomonas aeruginosa UCBPP-PA14
  CDS (1)..(1974)
atgatccccgaactcggccacctggccctgatcctcgccctttgcctggccctggtgcagtcgagcctgccgctggtcggcgcctggcgcggcgaccgccagtggatgagcctggcgcgcccagcggcctgggggcagttcgccttcctcgccttcgccttcggctgcctgacctgggccttcctgcgcgacgacttctcggtggcctacgtggccggcaactccaacagcgcgctgccctggtactacaagttcagcgccgtctggggcgcccacgaaggttcgctgctgctctgggcgttgatcctcggcggctggaccttcgccgtgtcgatcttctcccggcaactgccggaggtcatgctggcccgcgtgctggcggtgatgggcatgatcagcaccggcttcctgctgttcctgatcatcacctccaacccgttcagccgcctgctgccgcagaccccgatggacggcaacgacctcaacccgctgctgcaggacgtcggcctgatcgtccacccgccgatgctctacatggggtacgtcggattctcggtggccttcgccttcgccatcgccgcactgctcggcggccgcctggacgccgcctgggcgcgctggtcgcggccctggaccctggtggcctgggccttcctcggtatcggcatcgtgcttggctcctggtgggcctactacgagctgggctggggtggctggtggttctgggacccggtggaaaacgcctccttcatgccctggctggtcggcactgcactgatccactcgctggcggtgaccgagaagcgcggcgtgttcaagagctggaccgtgctgctggcgatcgccgctttctccctgagcctgctgggcaccttcctggtccgctccggcgtgctcacctcggtgcacgccttcgcctccgacccggagcgcggggtgttcatcctcgccttcctgctgctggtggtcggcggctcgctgaccctgttcgccctgcgcgcgccggtggtcaagagccaggtcggcttcgccctgtggtcgcgcgagaccctgctgctgctgaacaacctggtgctggtggtggcggcctcgatgatcctcctcgggactctctacccgctgctgctcgatgccctcagcggcgccaagctgtcggtcggcccgccgtacttcaacgccatgttcctgccgctgatggcggcgctgatggcggccctggcggtcggcgtgctggtgcgctggaaggacaccccgagccgctggctgctcggcatgctgaccccggtgctggtggccagcgcggtcctggcggcggccggttcgatgtacttcggcgatttcaactgggcggtgctggcggtgttcctgctgtccgcctgggtggtcctggccggtttccgcgacttcctcgacaagacccggcacaagggcgtgctggccggcgcccgcagcctgacgcgcagctactggggcatgcaactggcgcacctgggcatcgccgtgtgcgccatcggcatcgtcctcagcagccagtacagcgcccagcgtgacctgcgcatgtcgcccggcgacaccgtcgaactgggcggctaccacttcctcttcgacggcgcgaagcaccacgaagggccgaactacacctcggacaagggcagcatccacgtcagccgcgacggcaaggagatcgccaccctgcatccggagaagcgcctgtacaccgtgcagagttcgatgatgaccgaggccgggatcgatgccggctttacccgcgacctctacgtggcgctcggcgagccgctggagaacggtgcctgggcggtgcgcgtgcacgtcaagccgttcgtccgctggatctggttcggtggcctgctgatgggcctcggcggcgccctggcggcgctcgaccggcgctaccgggtgaaggtgaaaacacgtgtgcgcgaggccctgggcctcgccggtcagggagcctga

SEQ ID NO: 68073 - protein, 657 aa, Pseudomonas aeruginosa UCBPP-PA14
MIPELGHLALILALCLALVQSSLPLVGAWRGDRQWMSLARPAAWGQFAFLAFAFGCLTWAFLRDDFSVAYVAGNSNSALPWYYKFSAVWGAHEGSLLLWALILGGWTFAVSIFSRQLPEVMLARVLAVMGMISTGFLLFLIITSNPFSRLLPQTPMDGNDLNPLLQDVGLIVHPPMLYMGYVGFSVAFAFAIAALLGGRLDAAWARWSRPWTLVAWAFLGIGIVLGSWWAYYELGWGGWWFWDPVENASFMPWLVGTALIHSLAVTEKRGVFKSWTVLLAIAAFSLSLLGTFLVRSGVLTSVHAFASDPERGVFILAFLLLVVGGSLTLFALRAPVVKSQVGFALWSRETLLLLNNLVLVVAASMILLGTLYPLLLDALSGAKLSVGPPYFNAMFLPLMAALMAALAVGVLVRWKDTPSRWLLGMLTPVLVASAVLAAAGSMYFGDFNWAVLAVFLLSAWVVLAGFRDFLDKTRHKGVLAGARSLTRSYWGMQLAHLGIAVCAIGIVLSSQYSAQRDLRMSPGDTVELGGYHFLFDGAKHHEGPNYTSDKGSIHVSRDGKEIATLHPEKRLYTVQSSMMTEAGIDAGFTRDLYVALGEPLENGAWAVRVHVKPFVRWIWFGGLLMGLGGALAALDRRYRVKVKTRVREALGLAGQGA

SEQ ID NO: 68074 - DNA, 1659 bp, Rickettsia sibirica 246
  CDS (1)..(1659): transl_table=11
atgttattatggttttgtttattacaaatcgttagttgctgttatatatttttacttgaagataaccgtcttaaatttttatctattattattctatcagccatacaattattttttagcagctttatttactttacctccaatccttttaacgtgttttctttcgttcctaaagaagggttaggcttaaacccgatgctacaagatattgctttgagcatccatcctcctctgctttatttaggctatgttagctatgtagtaccgtttactattgtttgtgcctctatgtcattctcatacccacttatgtcattcccgcgaaagcgggaatccattaatgacataagactgctcaaaacattttccaatatcggtatcttatttactaccataggaattagccttggttcttggtgggcatatagagaactcggctggggcggattttggttttttgatccggtagaaaatatttcactatttccttggttatccggaattatgctccatcattctataattgtaacaacaaaaaccagacgtatgcaaaactggacagtaattttatccatcattacttttttattagtaatatttagtgcttttttagtacgttccggttttattacctcaattcactcttttgcattctcacctgagagaggaatatacttgcttggaatatttttgattatggggattggtagtattgggtggtatactaccacatcattgcgaggaaatgcattaacattgacgaagcaatctcaggaagctaaccgagattgccacagccactttcgtggcttcgcaatgacgcattgtggaaactccatactcctcggtaatatattcctccttcttagccttattgtgctaatagctgccacactttatccaccaatttactctttattcgacgataaatctattattattagtgaaacattttttattaataattttattatattcgttatccctattcttggtaccataggattatttactaccagaagctctattaaaaaacatattataattctaatattatctctaataattacttatttaatatcattaaaagtaacatttagtgttatatcgattttaactataatcgcatctatatttcttatgcttcataatattcattatcttttggttaaaactaattattgtagaaatagacttaaagcaagtaacgctagtatgatccttgggcatttcggttttgcactaattagttttagtattactatgaatacattattacaaagtgaaatggattttaccggcagagtaggaacaagtaaaacatttaacgaatttaaagtaacattgcaaaatattaagtttgctcaaggtaaaaattattatagacaaatcgctgaattttggcttgaggataatagccgtaatataactatattaaagccggaaaatagactttatatagttgaaaagagtttatcgcaagaaagtgatatatactcttacttattatatgatctttacgcagttttaagtaatatagacggcgatataatccatgctaaaatatattacaagccaacgataagctttatttggcttggaattattcttaccgcgtccggtttttttattgcactaatcagaaaaaattctagctaa

SEQ ID NO: 68075 - protein, 552 aa, Rickettsia sibirica 246
MLLWFCLLQIVSCCYIFLLEDNRLKFLSIIILSAIQLFFSSFIYFTSNPFNVFSFVPKEGLGLNPMLQDIALSIHPPLLYLGYVSYVVPFTIVCASMSFSYPLMSFPRKRESINDIRLLKTFSNIGILFTTIGISLGSWWAYRELGWGGFWFFDPVENISLFPWLSGIMLHHSIIVTTKTRRMQNWTVILSIITFLLVIFSAFLVRSGFITSIHSFAFSPERGIYLLGIFLIMGIGSIGWYTTTSLRGNALTLTKQSQEANRDCHSHFRGFAMTHCGNSILLGNIFLLLSLIVLIAATLYPPIYSLFDDKSIIISETFFINNFIIFVIPILGTIGLFTTRSSIKKHIIILILSLIITYLISLKVTFSVISILTIIASIFLMLHNIHYLLVKTNYCRNRLKASNASMILGHFGFALISFSITMNTLLQSEMDFTGRVGTSKTFNEFKVTLQNIKFAQGKNYYRQIAEFWLEDNSRNITILKPENRLYIVEKSLSQESDIYSYLLYDLYAVLSNIDGDIIHAKIYYKPTISFIWLGIILTASGFFIALIRKNSS

SEQ ID NO: 68076 - DNA, 2046 bp, Psychrobacter sp. 273-4
  CDS (1)..(2046)
atgttaatcacagaattgggttattttgccgtgctagccgcctttatgttggcgattttgcaggtagtattaccaacaataggcgttatgcgtgaccatgttgcttggcagcgtttggcaccgagcttggcgtgggcgcagtttgcagccatgattacctcgtttggcgcactaatggcaggcttttattttaatgactttagccttgtctatgtgtcgcagcactcgaatactttgctgccttggtattataagctatcagcgacgtggggcgggcatgaaggctcgctcctgctatggatgactatcatggcaacgtggtgtgccttggtctcatactttagtcgtggtttaccattgtcgatgcgcgcgcgcgtattggtgatattagccggtgtacagatgatgatgctggcaatgctcatctttacctcgtcaccgtttgaccgcactttaccaaacctgccagtggatggtgctgacctaaatcctgtcttacaagactttggtctaattatccatccaccgatgctgtatatgggctatgttggtatggtggtgccgtttgcattttgtatggcagcattgtgggaaggtcgcttggatgcggtatggacacgctggtcacgtccatgggcattggctgcttgggggtttttaaccatcggtattgcactaggttcgtggtgggcatattacgagcttggttggggtgggtggtggttttgggatccagtagaaaacgcttcattgctgccttggctggcaggtttggcattgctacattcgcttgcagtcactgaaaagcgtggtgtctttaaagcgtggacgattatgctggcaatttttgcctttgcattaagcttactcgggacatttttggtacgctctggggtaattacctctgtgcattcatttgccgcagatcccacgcgtggtttagtggttttagcgattcttgggattattattggtggtggtttattgatgtttgctgtacgtggctggcgtcttacgatcgagagtcagtatcagctgatttcacgtgagtcgtttttagtcattaacaacgtcattattttgattgcgaccttagtggtattacttggtacgctatatcccatcattgccgatgcctttaatttaggtcaggtatccgtaggtcctccgtattttaatgcgctgtttgtaccgttgacttggctattgatggtagcaatgggcatgggctctaatatccgctggaaacaagacagccgtccgttattgggcgttggcatggtcattgcggcaagtagccttgttttagccgcagttattgcctattttgttagcccatctgccatgctcaatattggcgtgacgctagcggtgagtttttgggtattgttatggatggtagttgattttaaagacaagaccaaaaatgccccaagcttctttaaaggcttagctaagctgcgtttaagctactggggtcagcagacagctcacattggcgttattatagcggtcattggtattgcctttaccagtaccttaagtattgagcgcgatgtggcattgggtgaaacggatactgttcatgtgcaagggtacgactttgaaataaaagacttccatgaagtcagaggcagtaactttgatggtatgcaagcagaagttgaagtgaccaaagacggtcgcccagtcgttactttatatccagaaaaacgtacctatgttatcagtggtatgccactgactgaggcagcgattgatgccagccttatgcgtgatgtgtacgtagcactcggtgagcctatcgctgaagacggcaaccaatgggcgatacgtatttacgtgaagccattgattcgctggatatggcttggcgctattattatggcattgggtggtctgctgagtatgcttgataggcgctatcgtctcaaaacaactaagacgcccgctcaaatcgcagcgagtaagtcaggttttgcgaccgttgctgacttagatattaacaatgcgacagatgccacggcaccaatgggggagaagtaa

SEQ ID NO: 68077 - protein, 681 aa, Psychrobacter sp. 273-4
MLITELGYFAVLAAFMLAILQVVLPTIGVMRDHVAWQRLAPSLAWAQFAAMITSFGALMAGFYFNDFSLVYVSQHSNTLLPWYYKLSATWGGHEGSLLLWMTIMATWCALVSYFSRGLPLSMRARVLVILAGVQMMMLAMLIFTSSPFDRTLPNLPVDGADLNPVLQDFGLIIHPPMLYMGYVGMVVPFAFCMAALWEGRLDAVWTRWSRPWALAAWGFLTIGIALGSWWAYYELGWGGWWFWDPVENASLLPWLAGLALLHSLAVTEKRGVFKAWTIMLAIFAFALSLLGTFLVRSGVITSVHSFAADPTRGLVVLAILGIIIGGGLLMFAVRGWRLTIESQYQLISRESFLVINNVIILIATLVVLLGTLYPIIADAFNLGQVSVGPPYFNALFVPLTWLLMVAMGMGSNIRWKQDSRPLLGVGMVIAASSLVLAAVIAYFVSPSAMLNIGVTLAVSFWVLLWMVVDFKDKTKNAPSFFKGLAKLRLSYWGQQTAHIGVIIAVIGIAFTSTLSIERDVALGETDTVHVQGYDFEIKDFHEVRGSNFDGMQAEVEVTKDGRPVVTLYPEKRTYVISGMPLTEAAIDASLMRDVYVALGEPIAEDGNQWAIRIYVKPLIRWIWLGAIIMALGGLLSMLDRRYRLKTTKTPAQIAASKSGFATVADLDINNATDATAPMGEK

SEQ ID NO: 68078 - DNA, 1995 bp, Dechloromonas aromatica RCB
  CDS (1)..(1995)
atgattcctgaactcggccatttcgccctgatccttgccgcactggttgccctgatcctcggcaccctgccgctagtcggcgcccaccagaaccgcctggcctgggttgccatcgcccgccccgccgcttcggcgatggcgctgctgctcaccttctcttttgcctgcctggtgcaggctttcgtgaccaacgatttctccgtggtttatgtcgcgcaacactccaattcgttgctgcccattcagtaccgcgttgccgccgtctggggcggccatgagggctcgctgctactttggatgctgttcctgacctggtgggccttcagcgtcgccatgctgtccaagcaactgccggaaacgatggttgcccgcgtgctcggaacccttgggctggtcgccttcggcttcatgctcttcatcctgatcacctccaatccatttgagcgcctgcttccagccgccgccgaagggcgcgacttgaacccgctgctacaggacccgggactcgtcatccatccgcccatgctctacatgggttacgtcggtttctcggtcgccttcgcctttgccattgcagccctgctttctggccagttggatgccgcctgggcacgctggtcgcggccatggaccatggctgcctggtgcttcctgaccatgggcatcgccctcggctcgtggtgggcctattacgaactgggctggggcggctggtggttctgggatccggttgaaaacgcctcgttcatgccctggctggtcggcacggcgctgatccactcattggcggtcaccgaaaagcgcggcagtttcaagaactggacggttctgctggccatctctgccttctcgctgtcgctgctcggcaccttcctggtccgttccggcgtactgacctcggttcatgccttcgccaccgatccacggcgcggtatcttcatcctgattttcctggtcgccgtcatcggtagctcgctggcactgttcgcctggcgggcgccgaaggttggcctgggtggccgttttgggctgatttctcgcgagtcgctgctgctaaccaataacgtactgctcgtcgtcgcctgcgccaccgtgctcctcggcacgctctacccactgctgatcgacgccctcggcatcggcaagatttcggtcgggccaccgtacttcaacgcggttttcgttcccgtcatggctccggttctgtttctgatgggcattgctcccttcgcccgctggaaggaagcgtcgattccggacatcacccgaatcgtgcgctgggcgatggtcgccgctgcggtagtcgctatcgccctgccgctgatttacggccactggagcacgctgatcgcactgggcatcctgctcgccgcctgggtcgcgatcacgacggtgattaccttcgtcgagcgtgtccagcacacgcgtgccggccagtccttcctgagtaccgccgtcaagcagccgcgcagcttcgtcggcatgtgcctggcgcactttggcatcgccgttttcgtggttggcgtgaccatggtcaatagcttccaggacgaaaaggacatcaagatggcgccgggtgaaacaaccacggttgccggctacagtttcactttcaacggcgtcaaatccgtgcaggggccaaactacacggccgctcagggtgatttcgaccttgcggtcgacggcaaattcatgcgcaaaatgaacccggaaaagcgcaactacgcgtcctccggcatgccgatgaccgaagccgccatcgacgctggtttcctgcgcgatgtctatgtctcgctcggtgagccaatcgaccgtgacaagccggaagccgagtgggcggtgcgcgtctattacaagcccttcgttgactggatctggggtggctgcttcctgatggcactgggcggcctgctcgctctgctcgaccgccgctatcgcgtcaaatcccgcgtctcagccactgtcaaaatccctgccggaacacaacaagcatga

SEQ ID NO: 68079 - protein, 664 aa, Dechloromonas aromatica RCB
MIPELGHFALILAALVALILGTLPLVGAHQNRLAWVAIARPAASAMALLLTFSFACLVQAFVTNDFSVVYVAQHSNSLLPIQYRVAAVWGGHEGSLLLWMLFLTWWAFSVAMLSKQLPETMVARVLGTLGLVAFGFMLFILITSNPFERLLPAAAEGRDLNPLLQDPGLVIHPPMLYMGYVGFSVAFAFAIAALLSGQLDAAWARWSRPWTMAAWCFLTMGIALGSWWAYYELGWGGWWFWDPVENASFMPWLVGTALIHSLAVTEKRGSFKNWTVLLAISAFSLSLLGTFLVRSGVLTSVHAFATDPRRGIFILIFLVAVIGSSLALFAWRAPKVGLGGRFGLISRESLLLTNNVLLVVACATVLLGTLYPLLIDALGIGKISVGPPYFNAVFVPVMAPVLFLMGIAPFARWKEASIPDITRIVRWAMVAAAVVAIALPLIYGHWSTLIALGILLAAWVAITTVITFVERVQHTRAGQSFLSTAVKQPRSFVGMCLAHFGIAVFVVGVTMVNSFQDEKDIKMAPGETTTVAGYSFTFNGVKSVQGPNYTAAQGDFDLAVDGKFMRKMNPEKRNYASSGMPMTEAAIDAGFLRDVYVSLGEPIDRDKPEAEWAVRVYYKPFVDWIWGGCFLMALGGLLALLDRRYRVKSRVSATVKIPAGTQQA

SEQ ID NO: 68080 - DNA, 1989 bp, Mesorhizobium sp. BNC1
  CDS (1)..(1989)
atgagcgtcgaacttggccatttcgcactcgtgctggcgctggcgctggccttggtgcaggcgctggtgccgctcctcggcgcgcgcttgggcagcgctccgctgatgcggatgggcgaaccggtggccattaccgggtttgcgctgatcgcgttcgccttcgcggcgctggtgcttgcctatgtccaatcggatttctcggtgctgaatgtgtgggagaactcacactcggccaagccgcttctgttcaagattaccgggacttggggcaatcatgaaggctcgatgctcctttgggtgctgatcctagcctttttcggggctcttgtggcagccttcggccagaatctgccgccaacgctcagggccaatgtgctggccatacagggcctgattgccagcgccttcctcctgttcatcctctttacctccaatcccttcatccgccttgagcgggcgccgattgaaggccgtgacctcaatccgatcctgcaggacatcgggctcgcgatccatccgccgctgctctatctcggctatgtggggttctcgatctccttttcgttcgcggtggcggcgctgatcgacgggcgcctggacgcggcttgggcacggtgggtgcgtccgtggacgctcgttgcctgggccttcctcaccggcggcatcgcgatgggctcctactgggcctattatgaattgggatggggcggcttctggttctgggacccggtggagaacgcttccctgatgccctggctggcgggtacggcgttgctgcactcggccattgtcatggaaaagcgctcggcactgaaaatctggacggtgctgctggccattctcactttttcgctgtcgctgcttggcacatttctggtccgctcgggcgttttgacctctgttcactcctttgcgacagatcccacacgcggcgtcttcattcttgcgatactggtgttctttatcggcggcgctctggctttgtttgcagtaaggggcgcgtcgctcgcgccgggtggactgttccatcccatttccagggagggggcgcttgtcttcaacaatctgatgcttacgaccgcggcggcgacggtgctcatcggcactctctaccccctgctgatcgaggccatcagcgaagacaagatttccgtcggcgcgccgttctttaatctgaccttcgtgccgctgttcctgccgctcctgctggccgtgccttttgggccgcttctcgcctggaagcgcggcgatctgccaggagctctccagcgcctgcaattcgcgttctgggcagccggggcggccgcaatcgcgagctatttcctgattgaccgcgccaacgccgcagctgcgctcggcatcggcctggggctgtggcttgtcttcggcgcgctgacagatctcgctttcaaatccggcatcggcaaggtcgggccagcacttgcccttcgccggctctccggcttgcccctttcgatgttcggcacctgtttcgcacatgccgggctgggccttaccgtgctcggcattgtctccgtcaccgcgcttcaggccgagaaaatcctgacaatgcagccaggccagagcaccgaaatcagcggctacactcttcgcttcgtggatctgcggcccttcaccggcccaaattacacggaagaccgcgccgagttcgcgctcgggaccacccgcggtgcgtcgctgggggaactcgtttcgtccaagcgtctttatacggcccggggtatgccgacgaccgaagccggcatcagaacgatgggcctgagccagctctatgtttcgatcggtgaccgtacaccggctgggctcgtcgtgcggatctggtggaagcctttcgtcacgctgatctgggccggtgcgctggtgatgatgggcggcggcttcatctctctcatggaccgcaggctgcgcgtcggtgcgccggcaaggcgcaaagcagcgctcgcggcggacggtgggggaacgcgatga

SEQ ID NO: 68081 - protein, 662 aa, Mesorhizobium sp. BNC1
MSVELGHFALVLALALALVQALVPLLGARLGSAPLMRMGEPVAITGFALIAFAFAALVLAYVQSDFSVLNVWENSHSAKPLLFKITGTWGNHEGSMLLWVLILAFFGALVAAFGQNLPPTLRANVLAIQGLIASAFLLFILFTSNPFIRLERAPIEGRDLNPILQDIGLAIHPPLLYLGYVGFSISFSFAVAALIDGRLDAAWARWVRPWTLVAWAFLTGGIAMGSYWAYYELGWGGFWFWDPVENASLMPWLAGTALLHSAIVMEKRSALKIWTVLLAILTFSLSLLGTFLVRSGVLTSVHSFATDPTRGVFILAILVFFIGGALALFAVRGASLAPGGLFHPISREGALVFNNLMLTTAAATVLIGTLYPLLIEAISEDKISVGAPFFNLTFVPLFLPLLLAVPFGPLLAWKRGDLPGALQRLQFAFWAAGAAAIASYFLIDRANAAAALGIGLGLWLVFGALTDLAFKSGIGKVGPALALRRLSGLPLSMFGTCFAHAGLGLTVLGIVSVTALQAEKILTMQPGQSTEISGYTLRFVDLRPFTGPNYTEDRAEFALGTTRGASLGELVSSKRLYTARGMPTTEAGIRTMGLSQLYVSIGDRTPAGLVVRIWWKPFVTLIWAGALVMMGGGFISLMDRRLRVGAPARRKAALAADGGGTR

SEQ ID NO: 68082 - DNA, 1908 bp, Haemophilus influenzae R2866
  CDS (1)..(1908)
atgctcccagaacttggctttttccttcttttactcgcaacagctagcgcgttttttcttgcgttagtgcctcaatttgggttattcaaaaaaaattcgactttaattaatgctgcttggccgcttagttatatttttacccttgcgacgacgttctcaattggtttgcttgcttattcttttgcggtggatgatttcacccttgaatatgtagcggcacattctaattcccaattacctacattttttaaaatggctgccacttggggaggacatgaaggttcaatgttgttttggttattttcattgagtttatggcttgctgcttttgctttttttaatcgaaaaaatgaccgcactttttccgctcaatctttatctttattgggattgatttgctttggttttgcggtgtttattttattttattccaatccatttggacgcattttccctgctcccgcagaagggcgcgatctcaatccaatgttgcaagatgtgggattaattttccatccgcctttattatatgttggctatgtgggctttgcggtaaattttgcaatgagtttgagtgcgttgatttataaccaatctgcacgacaaattgcccgctcaatgcgtggatgggtgttggtttcttggttgtttttaaccattggtattgtgctcggtgcttggtgggcatattacgagctcggctggggcggttggtggttctgggatcccgtagaaaatgcgtctttaatgccttggttacttgggttagcgttattacacagtttaatggcgacggaaaaacaaggcgtatttagttattggacaacgcttttttctctgcttgcttttgcctttagcgtattaggcacgtttattgttcgttctggtgcgctcacttctgtgcacgcctttgcattggataacacgcgcggttatgtgttgttattaattttctttgttttgacagcgttagcctttggtttattcgctttacgagcgggaagttcatcagaaagtgcggtgaaatttcagttcatttctaaatcaggtggcattttattactgaatattttgctgaccattgcgacggtttctacctttttaggtaccttttacccgatgttattccaagcgatgaattggggctcaatttcggtgggaagtccttattttaatagtattttcttccccattattacggcgattttaatcttaatggtaattgtgcttagcatacgtaaggggcaatttgatcgcacattattgatacgttatgggtggttgcttattccgtctttgattcttgcaggcctaatgatttggcaacagctacgccataattctgcgttgaattttcacgctttcgcctttgtgttattaactcttgcgatttggcttttattcgtcacgttatggcaaaattggcgacaaattcgcttgtctcaatttgggatgattttagcacactgtggcgtggcgattgtgactattggtgcggtgatgactgggtattttggcagtgaaattggtgtgcgtttagcaccgcaacaaagtcaaacgctggggcaatatgaatttcattatcgccaattttctaatgaaattgggccaaattttacggcagaagtcgccttttttgacgtaactaaaaatggtaaaccttatgcaaaaattatcccagaacgccgttattacgatgtacgaacaatgacaatgagtgaagtggggcttgatggtggtttttggggagatttatatattgtgatgggcgattctctcggcaaaggggaatttactttccgcttacattataaaccactgattcgttggctctgggcgggcggtattttaatggcctttggcgcactttttagcgttttcggattacgcagaaaacaggaaaaataa

SEQ ID NO: 68083 - protein, 635 aa, Haemophilus influenzae R2866
MLPELGFFLLLLATASAFFLALVPQFGLFKKNSTLINAAWPLSYIFTLATTFSIGLLAYSFAVDDFTLEYVAAHSNSQLPTFFKMAATWGGHEGSMLFWLFSLSLWLAAFAFFNRKNDRTFSAQSLSLLGLICFGFAVFILFYSNPFGRIFPAPAEGRDLNPMLQDVGLIFHPPLLYVGYVGFAVNFAMSLSALIYNQSARQIARSMRGWVLVSWLFLTIGIVLGAWWAYYELGWGGWWFWDPVENASLMPWLLGLALLHSLMATEKQGVFSYWTTLFSLLAFAFSVLGTFIVRSGALTSVHAFALDNTRGYVLLLIFFVLTALAFGLFALRAGSSSESAVKFQFISKSGGILLLNILLTIATVSTFLGTFYPMLFQAMNWGSISVGSPYFNSIFFPIITAILILMVIVLSIRKGQFDRTLLIRYGWLLIPSLILAGLMIWQQLRHNSALNFHAFAFVLLTLAIWLLFVTLWQNWRQIRLSQFGMILAHCGVAIVTIGAVMTGYFGSEIGVRLAPQQSQTLGQYEFHYRQFSNEIGPNFTAEVAFFDVTKNGKPYAKIIPERRYYDVRTMTMSEVGLDGGFWGDLYIVMGDSLGKGEFTFRLHYKPLIRWLWAGGILMAFGALFSVFGLRRKQEK

SEQ ID NO: 68084 - DNA, 1935 bp, Ehrlichia canis str. Jake
  CDS (1)..(1935)
atgattaatttaatagagcttccgcttttaatagcgtgtgtattttcaattgtatatccatttgtttcttatttatctttttgctggtcaaaggtatttacaatattgatatttatgctgacaagttctgctatgggtttactgttgtatacacacattgttgatgatttctcattttataatgtgtactacaactcacatacaacgaaacctttattatataaaatatttggtatttggggtaatcatgaaggctctattttattatgggtatggataataagtttttatagtttactattagagttttttcttgaaagggaagatctcaaaaaaatagctatttcaatacaacatataatgaactttggatttttgttatttaccttgttcatatctaacccttttctaaagatgcctactattgaatatgaaggattagggtttaaccctatactgcaggatactgggttaatgatacatcctcctattttgtatttaggatatgtaggatttagtgtagtgttttcccttgctgtagctggtgtaatcgttcaaaaggatagtgtaaaatgggcaactattataaataagtgggtcttgttagcgtggtcatttttaactttaggaatagggttaggtagctggtgggcttatagagaattaggttggggaggattttggttttgggatcctgttgaaaatgcttcacttatgccatggctatttggaacagctttacttcatttgctgcccttagttagaaagtttaatatattttataactttgcaattttattatcaattttttcatttataatgagcctgattggtacgttcttagtgagatctggtgttttaatatctgttcatgcttttgctaatgatccaaagtgtggattctatatattaatgttgattggtatcataattagtagtgggattgtaagtttcatttgttttgcaaagaaggctcaagagaaaaaacatgattttttactcttgtcaaaagtaacaatgttgttgtttaacaatgttctgctgttaacagcttttactatagtatttatcggtactatatatcctattgtattagaagttataacaggagatgttatttctataggtgcaccgtattataattctttatttaactatttaatattttgtactttgttattgatgatcattgttatgggattggacaaaaagagaaataaaattttagtagagaattttaagttttcaggacttataacttcattgattgttccttttattatagataataatttttttattattgcaatgattctattatcagttttattgtttttatctgtactggaaacctattgtaggaaaataagaatacttgctgtgccattttgtgaaactgccagattaattaaatcatactctacaaaatattattccatgctagtgtcacacattggtgttgctgtttttatatttggtgtgattggatctactgtatggggcgaaacttatgaactttatatgaaggaaggcaactctgttaagacaaaaaatcttcaagttgttttatctaaattatcttttgtaaaaaatgaaaattacaatgctatacgtggaaagtttctaataataaagtctggggaaatattagataaaatatttcctgagaatagattttatatagttgaaggagttagaaatactgaaagtgctatatatagacattggttatctgatgtttatattgtgattggtgatatagataaagcgatgggtatagcagtaaagatatattataagccttttataaatttgatatggataggatttttgttaatcacgtttggtggtgttataggattgttcgctaacactactacaagaaaagcttcgatgtttgaagaattgaaagctgatgattccacttgtatgtga

SEQ ID NO: 68085 - protein, 644 aa, Ehrlichia canis str. Jake
MINLIELPLLIACVFSIVYPFVSYLSFCWSKVFTILIFMLTSSAMGLLLYTHIVDDFSFYNVYYNSHTTKPLLYKIFGIWGNHEGSILLWVWIISFYSLLLEFFLEREDLKKIAISIQHIMNFGFLLFTLFISNPFLKMPTIEYEGLGFNPILQDTGLMIHPPILYLGYVGFSVVFSLAVAGVIVQKDSVKWATIINKWVLLAWSFLTLGIGLGSWWAYRELGWGGFWFWDPVENASLMPWLFGTALLHLLPLVRKFNIFYNFAILLSIFSFIMSLIGTFLVRSGVLISVHAFANDPKCGFYILMLIGIIISSGIVSFICFAKKAQEKKHDFLLLSKVTMLLFNNVLLLTAFTIVFIGTIYPIVLEVITGDVISIGAPYYNSLFNYLIFCTLLLMIIVMGLDKKRNKILVENFKFSGLITSLIVPFIIDNNFFIIAMILLSVLLFLSVLETYCRKIRILAVPFCETARLIKSYSTKYYSMLVSHIGVAVFIFGVIGSTVWGETYELYMKEGNSVKTKNLQVVLSKLSFVKNENYNAIRGKFLIIKSGEILDKIFPENRFYIVEGVRNTESAIYRHWLSDVYIVIGDIDKAMGIAVKIYYKPFINLIWIGFLLITFGGVIGLFANTTTRKASMFEELKADDSTCM

SEQ ID NO: 68086 - DNA, 1986 bp, Rubrivivax gelatinosus PM1
  CDS (1)..(1986)
atgattcccgagctcgggcagatcgcgctgctgctggcgctggccaccgccctgatccagggcaccctgccgctgctgggcgccgctcgcggccgcgccgactggatggcgctcgcgcggccggcggcgcagacgcagttcctgctggtcgcgctggccttcggctgcctggtggcgtccttcgtgcgacacgacttctcggtgctgaacgtggccaccaactcgaacagcgcgctgccgctgttctaccgcatcgccgcctcctggggcagccacgagggctcgctgctgctgtgggtgctgatgctcagcagctggacgctcgcggtggcgctgcgcagccgccacctgccggtgccggtggtgtcgcgcatcctcgcggtgatgggcctgatcagcgtgggcttcctgctgttcatgctgatcacctccaaccccttcgaccgcctgttcccggtcccaccggacggcaacgacctgaacccgctgctgcaggaccccggcatgatcgtgcacccgccgatgctctacatgggctacgtgggcttctcggtggccttcgccttcgccgtcgcggcgctgctcggcggcacgctcgacgccacctgggcgcgctggacgcggccctggaccaccgccgcctgggccttcctgacgctgggcatcatgctcggcagcacctgggcctactacgtgctgggctggggcggctggtggttctgggacccggtggagaacgcctccttcctgccctggctggccggcacggcgctgatccattcgctggcggtcaccgagaagcgcggcgccttcaagtcctggacggtgctgctggcgatcgtcgccttctcgctgtcgctgctcggcaccttcctcgtgcgctcgggcgtgctgtcgtcggtccacgccttcgccacggacccgcagcgcggcctgttcatcctgctgttcctggtcatcgtgatcggcggctcgctcaccctgtacgcgtggcgcgcgcccaaggtggggctcggcgcgcgcttcggcgtggtgtcgcgcgagtcgatgctgctcgccaacaacgtgctgttcgtcgtcgccacgctgtcggtgctgctcggcacgctctacccgctgctgctcgacgccatgggcctgggcaagatctccgtcgggccgccctacttcgacgccgtgttcgtgccgctcatggcgccagcggtgttcttgctcggcgtggggccgctggcgcgctggaagcaggccgaactgcccgacctggcccgccggctgcgctgggctgccgccatcgcggtggtcgcggcgctgctcacgggctggctggccggccgcatcgcgctgggcgcgacgctcggcctgctgatgagctactggatcgtcgccgccctcggggtcgacctgtgggagcggctgcgcccggccggtggcctgccgatgagcctggcggcccgcgcgcggcagctgccgcgcgcgatgctcggcatgatgctggcccacctgggcgtggcggtgttcgccttcggcgtgagcatggtcaccacctaccagctcgagcgtgacgtgaagatggcgatcggcgacaccaccgaggccggcggcttcgtgttcgcgctgcgcggcctgaaggagatccagggcccgaactacgacggcctgcagggccagatcgaagtcacgcgcgacggcaaggcggtggcgctgctgaagcccgagaagcgcatctaccgcgtgcagcgcaacccgatgaccgaggccgacatcaaccgcggcatcacgcgcgacctctacgtgtcgctgggcgagcccaccgccgacggcagctggatcgtgcgggtctacttcaagcccttcgtcaactggatctggggcggctgcgtcctgatggcgctgggcggcgccctcgcggcgagcgatcggcgctaccgcgcccggcagcgccaggagcacgggcagcaggccggcccggccggagcggtggcgtga

SEQ ID NO: 68087 - protein, 661 aa, Rubrivivax gelatinosus PM1
MIPELGQIALLLALATALIQGTLPLLGAARGRADWMALARPAAQTQFLLVALAFGCLVASFVRHDFSVLNVATNSNSALPLFYRIAASWGSHEGSLLLWVLMLSSWTLAVALRSRHLPVPVVSRILAVMGLISVGFLLFMLITSNPFDRLFPVPPDGNDLNPLLQDPGMIVHPPMLYMGYVGFSVAFAFAVAALLGGTLDATWARWTRPWTTAAWAFLTLGIMLGSTWAYYVLGWGGWWFWDPVENASFLPWLAGTALIHSLAVTEKRGAFKSWTVLLAIVAFSLSLLGTFLVRSGVLSSVHAFATDPQRGLFILLFLVIVIGGSLTLYAWRAPKVGLGARFGVVSRESMLLANNVLFVVATLSVLLGTLYPLLLDAMGLGKISVGPPYFDAVFVPLMAPAVFLLGVGPLARWKQAELPDLARRLRWAAAIAVVAALLTGWLAGRIALGATLGLLMSYWIVAALGVDLWERLRPAGGLPMSLAARARQLPRAMLGMMLAHLGVAVFAFGVSMVTTYQLERDVKMAIGDTTEAGGFVFALRGLKEIQGPNYDGLQGQIEVTRDGKAVALLKPEKRIYRVQRNPMTEADINRGITRDLYVSLGEPTADGSWIVRVYFKPFVNWIWGGCVLMALGGALAASDRRYRARQRQEHGQQAGPAGAVA

SEQ ID NO: 68088 - DNA, 1962 bp, Pseudomonas fluorescens PfO-1
  CDS (1)..(1962)
ttgggccatctggccatgatcctggcgctgtgtttcgcgctggtgcaggcggtggtgccgttgctcggtgcctggcgcggtgatcgtctgtggatgggcctcgctcaaccggcggcgtgggggcagttcgcgttcctgctgttcgccttcggttgcctgacctacgccttcatgaccgacgatttctccgtggcctacgtcgcgatgaactccaacagcgcgctgccgtggtactacaagttcagcgcggtgtggggcgcccacgaagggtcgctgctgctgtgggcgctgatcctcggcggctggaccttcgcggtgtcggtgttctcgcggcagttgccgcaagtcatgctcgctcgcgtgctggcggtgatgggcatgatcagcaccggttttctgctgttcctgatcctcacctcgaacccgttttcgcggatcctgccgcagatcccggccgacggtcgtgacctcaatccgctgctgcaggacatcggcctgatcgttcatccgccgatgctgtacatgggctatgtcggtttctcggtggccttcgcgtttgccattgccgcattgctgggcggtcgtctcgatgcggcgtgggcacgctggtcgcgtccgtggaccatcgtcgcctgggccttcctcggcatcggcatcaccctcggttcatggtgggcttactacgaactcggctggggcggctggtggttctgggacccggtggaaaacgcatcgttcatgccatggctggtgggcacggcgctgattcactcgctggcggtcaccgagaaacgtggcgtgttcaagagctggacggtgttgctggcgattgccgcattctccctgagcctgctcggtacgttcctcgtacgttccggcgtgctgacctcggtgcacgcgtttgcctccgatcctgagcgcggcgtgttcatcctgatcttcctgctgttcgtggtcggtggttcgctgacactgtttgcgctgcgcgcgccggtggtcaagagccaggtcggtttcaatctgtggtcgcgggaaaccctgctgctgggtaacaacctggtgctggtggtggcggcgtcgatgatcctgctcggcacgctgtacccgctgattctcgatgcgatcagcggcgccaagctgtcggtcggcccgccgtacttcaacgcgctgttcattccgttgatggcgctgttgatgctggtgatggcggtcggcgtgatcgtgcgctggaaggacaccccggtgaaatggctggtcagtatgctgactccggtgctgctgggcagcgtcgcgctggcggtggtggccggtgtcgcttatggtgatttcaactgggcggtgatcgcgacgttcctgcttgcggcctgggtgttgctggccggtgtgcgcgacatcttcgacaagactcgtcacaaaggcctgatcaaaggcctgccgaccctgacccgcagctactggggcatgcagatcgcccacctcgggatcgccgtctgcgcgctgggcgtggtgttgtcgagccagaacagtgccgaacgtgacctgcgtctggcaccgggcgaatcaatggacctggccggttatcagttcgtgtttgaaggcgccaagcacttcgaaggcccgaacttcacttccgacaagggcaccgtccgggtgatccgcaacggtcaggaagtcagcgtgctgcacccggaaaaacgcctgtacaccgtgcagaactcggtgatgaccgaagccgggatcgacgccggtttcacccgtgacctctacgtcgctttgggtgaaccgctgggcgatggcgcctgggcagtgcgggtccacgtcaaaccgttcgtgcgctggatctggttcggcggcctgctgaccggtttcggtggtttgctggcggcgctggatcggcgttatcgagtgaaggtcaaagccaaagtgcgtgaagcgctgggcatggaaggagccgctgcatga

SEQ ID NO: 68089 - protein, 653 aa, Pseudomonas fluorescens PfO-1
MGHLAMILALCFALVQAVVPLLGAWRGDRLWMGLAQPAAWGQFAFLLFAFGCLTYAFMTDDFSVAYVAMNSNSALPWYYKFSAVWGAHEGSLLLWALILGGWTFAVSVFSRQLPQVMLARVLAVMGMISTGFLLFLILTSNPFSRILPQIPADGRDLNPLLQDIGLIVHPPMLYMGYVGFSVAFAFAIAALLGGRLDAAWARWSRPWTIVAWAFLGIGITLGSWWAYYELGWGGWWFWDPVENASFMPWLVGTALIHSLAVTEKRGVFKSWTVLLAIAAFSLSLLGTFLVRSGVLTSVHAFASDPERGVFILIFLLFVVGGSLTLFALRAPVVKSQVGFNLWSRETLLLGNNLVLVVAASMILLGTLYPLILDAISGAKLSVGPPYFNALFIPLMALLMLVMAVGVIVRWKDTPVKWLVSMLTPVLLGSVALAVVAGVAYGDFNWAVIATFLLAAWVLLAGVRDIFDKTRHKGLIKGLPTLTRSYWGMQIAHLGIAVCALGVVLSSQNSAERDLRLAPGESMDLAGYQFVFEGAKHFEGPNFTSDKGTVRVIRNGQEVSVLHPEKRLYTVQNSVMTEAGIDAGFTRDLYVALGEPLGDGAWAVRVHVKPFVRWIWFGGLLTGFGGLLAALDRRYRVKVKAKVREALGMEGAAA

SEQ ID NO: 68090 - DNA, 2016 bp, Rhodospirillum rubrum
  CDS (1)..(2016)
atgatcgccgagcttggacatttctgcctcgtgctcgccctgttcgtcgccctcgtccaggcggtggtgccgatggttggggcgcagcgcggcaatctggcgtggatggacttggcgcgcagcggctcggtcgccctgttcggcctgatcgttctggccttcgccgccctgacctattgctatgtcgtcagcgacttctcggtgatgaacgtcttcgagaacagccatagcgacaagccgatgctctataaggtctcgggcgtctggggcaatcacgaggggtcgctgctgctgtggatcctgatcctgtcgggcttcagtctggcggtcagtctggtcggcggcaatctgccccccgccctgcgggcccgcaccctgtcggtccaggcgatgatcacctgcggctttttgctgttcatcttgttcacctccaatcccttcgcccgggtgcccggcctcgaggttcccttgaatggccgcggccttaacccgctgctccaggatcccggcctcgccttccatccgcccatgctctatgccggctatgtcggcttctcgatggccttctccttcgccatcgccgccctgatcgagggcaaggtcgatgccgcctgggcccgctgggtccgcccgtggacgctggtggcctgggtcttcctgaccttcggcatcgccctgggcagttggtgggcctattacgaactgggctggggcggctggtggttctgggacccggtcgagaacgccagcttcatcccctggctatcgggcacggcgctgctgcattcggccgtcgtcgtcgagaagcgcgacgccttgaaatcctggacgatcctgctggcgatcgtcaccttctcgctgtcgctgcttggcactttcctggtgcgttcgggcgtcatcacctcggttcacgcctttgccaccgatcccacgcgcggcctgttcattctggggctgctgctggtcgccatcggcggatccttcaccctttacgccgtgcgcgccccggcgctgaagggcggcgggctgttcgcgccgatttcgcgcgaaggcgggctgttgatcaataatctgctgatgagcacggcctcggccacggtgctgctcggcacgctgtatccgctgatcgccgacgccctcgatttgggcaaggtcacggtgggcgcgccgttcttcaaccgggtcttcctgccgctgatggtgcccttgctggtgctgatggcgatcggcccgctgctgtcgtggaagcgcgccgatctgcgtggggcgctcggccggctgaagggcgcgctgatcgtcgcggcgctggttttcgccggcaccttcctggcgaccgggggcggtctggcccaggtcggcgccgccgccggcatgaccctggccgcctgggtgctggtcggcaccctggtcgaactggccgatcggatccgctttttgcgcattcccttagccgattcgctgcgccgcctcgtcggtctgccgcgatcgacctggggcatggttctggcccatggcggcatggggctggtggtgatcggcgtcgttggcaatacggcctggaaggccgaaagcatccagaccctgcgcccgggcgaaagccgcgagctggccggccataccttcaccctgcaaggcgccgccccgatccagggccccaattacgaggcgctgcgcggcgatatcctcctgtcgcgcgagggcgagaccctggcccgcttggctcccgagaagcggctttacaccaccccgccgatgccgaccaccgaggccgggatccacagcaacggcctgtcggactattacgcggtgatcggcgatcccaccgacaacggcggcttcgtcacccgcttctattacgagccggcggtgcctttcttgtggtatggcgccttgttcatgggcctgggcggactggtctcgctgtcggatcgccgccaccgggtgggggcgccaacggcgcgccgcgtctccccggccaagaccgccagcccccccgcccccgccccggcggaataa

SEQ ID NO: 68091 - protein, 671 aa, Rhodospirillum rubrum
MIAELGHFCLVLALFVALVQAVVPMVGAQRGNLAWMDLARSGSVALFGLIVLAFAALTYCYVVSDFSVMNVFENSHSDKPMLYKVSGVWGNHEGSLLLWILILSGFSLAVSLVGGNLPPALRARTLSVQAMITCGFLLFILFTSNPFARVPGLEVPLNGRGLNPLLQDPGLAFHPPMLYAGYVGFSMAFSFAIAALIEGKVDAAWARWVRPWTLVAWVFLTFGIALGSWWAYYELGWGGWWFWDPVENASFIPWLSGTALLHSAVVVEKRDALKSWTILLAIVTFSLSLLGTFLVRSGVITSVHAFATDPTRGLFILGLLLVAIGGSFTLYAVRAPALKGGGLFAPISREGGLLINNLLMSTASATVLLGTLYPLIADALDLGKVTVGAPFFNRVFLPLMVPLLVLMAIGPLLSWKRADLRGALGRLKGALIVAALVFAGTFLATGGGLAQVGAAAGMTLAAWVLVGTLVELADRIRFLRIPLADSLRRLVGLPRSTWGMVLAHGGMGLVVIGVVGNTAWKAESIQTLRPGESRELAGHTFTLQGAAPIQGPNYEALRGDILLSREGETLARLAPEKRLYTTPPMPTTEAGIHSNGLSDYYAVIGDPTDNGGFVTRFYYEPAVPFLWYGALFMGLGGLVSLSDRRHRVGAPTARRVSPAKTASPPAPAPAE

SEQ ID NO: 68092 - DNA, 1962 bp, Ralstonia metallidurans CH34
  CDS (1)..(1962)
atgattccagaaatcggccacctcgccctcatcgctgccttgttcgtggcactcgctcaaggtgttcttgccctggccggcgcggcgcgagccaacctcacctggatcgcgttcgcccgccccgctgcacgcgctcaattcctgttggtgatggtcggttttgccgcgctcacctgggcctttgtcgcgaaggactactcggtcgcctacgtcgctcaaaactccaattctcagctcccgctgggctacagaatggccgcggtctggggcggacatgagggttcgctcctgctctggctgctgatgcagaccggctgggcctatgcggtcagccggttgtcgaaacagcttccggatgccatggtggcgcgcgttctgggcgtgctcggcctggtgacggccggcttcctgctgttcgtcctgttgacctccaatcccttcgagcgacttttcccggtaccgcaagatggatgggatctgaatccgctcctgcaggatatcggcttgatctttcatccaccgctgctttacatggggtacgtcggattttcggtggccttcgcattcgcgattgctgcattgcttgccggacaactggactcgacgtgggcacgctggtctcgtccctgggccaccgcagcctgggcaaatctgacggtcggaatcgccttggggagttggtgggcctactacgagttgggctgggggggctggtggttttgggacccggtcgagaactcgtcgttcatcccctggctggtgggcaccgccttgatccactctttggcggtgacggaaaagcgggccagtttcaagaactggacggtgctgctctcgatcggcgcattttcttgctcgcttttgggtgcctttctggtgcgctcgggcgtactgacttctgtgcatgcatttgccaccgatccgcgacgcgggttattcattctgattctgctgacggtcattgtgggcacgtcgctcgctttgttcgcatggcgagcccctaaggtcggcatgggaggacggttcgacatggtctccagggagtccttgctgctggtcaacaatgtgctgttggtcgtcactgccggcgctgtcgcgctcggtacgctgtacccactgctcgtcgatgcgctgggcctgggcaagctctccgtggggccgccatacttcaatgcggtgttcgtgccattgatgatccccgcgttgcttctgattgcggtaggacccgccgccaattggaaggccgcccagttcggtgccatcttcaggcagttgcgcgtgccgatgattgctgcacccctggtgggcctgaccgccccgttcgtgctggggcactggtcagcttctgcggcgttgggcttgatgctcgccacgtggattgcggtgtcggtggtgacgggcatcttcggccgaatgcgcgccacccgcggcgggttgcgtgcccagccacgcagttggcttgggatgcatatggcgcatctgggcatcgcggtattcgtgactggcgtgaccatcgtcagtgggtatgagaccgagcgagacgttcgattggcccagggcgagtccgtcagcatcggcggctacgacctcactttgatcggcgtcagaagcacgcgggggcccaactacgtggcgcagataggcgatatcgaactgtcgcgcgacggcaaggtcttgcgtcggctgcatccggaaaagcgcaattacccggcctcgcagatgccgatgaccgaggtggcgatcgatgcaaacggactgcgccacgtctacgcggcgctcggcgaaccgctcggcgacggtgtttggagcgttcgtgtctaccacaagccattcgttgactggatctggatcggctgcatcctgatggcgcttggcggtggcttggccatcagcgatcgtcgataccgtctgaagcctcgccgtcaacacgtcgctccgccattgcccgaggccgcatcatga

SEQ ID NO: 68093 - protein, 653 aa, Ralstonia metallidurans CH34
MIPEIGHLALIAALFVALAQGVLALAGAARANLTWIAFARPAARAQFLLVMVGFAALTWAFVAKDYSVAYVAQNSNSQLPLGYRMAAVWGGHEGSLLLWLLMQTGWAYAVSRLSKQLPDAMVARVLGVLGLVTAGFLLFVLLTSNPFERLFPVPQDGWDLNPLLQDIGLIFHPPLLYMGYVGFSVAFAFAIAALLAGQLDSTWARWSRPWATAAWANLTVGIALGSWWAYYELGWGGWWFWDPVENSSFIPWLVGTALIHSLAVTEKRASFKNWTVLLSIGAFSCSLLGAFLVRSGVLTSVHAFATDPRRGLFILILLTVIVGTSLALFAWRAPKVGMGGRFDMVSRESLLLVNNVLLVVTAGAVALGTLYPLLVDALGLGKLSVGPPYFNAVFVPLMIPALLLIAVGPAANWKAAQFGAIFRQLRVPMIAAPLVGLTAPFVLGHWSASAALGLMLATWIAVSVVTGIFGRMRATRGGLRAQPRSWLGMHMAHLGIAVFVTGVTIVSGYETERDVRLAQGESVSIGGYDLTLIGVRSTRGPNYVAQIGDIELSRDGKVLRRLHPEKRNYPASQMPMTEVAIDANGLRHVYAALGEPLGDGVWSVRVYHKPFVDWIWIGCILMALGGGLAISDRRYRLKPRRQHVAPPLPEAAS

SEQ ID NO: 68094 - DNA, 2043 bp, Ralstonia metallidurans CH34
  CDS (1)..(2043)
atgaatccggaactgggccacttcgcactgatcctggccatgctcgtggcgctggtgctggcaacgctgccgatggtgggcgcggcgcgcggcaatgttgcctggatgtgccttgcacggcccgccgccttcctgcatggcacgctgctgatcgcggcctacctctcgctgacatacgctttcgtcgacaacgacttcagcgtgctctatgtggcggcgaactctaacagcgcgctgccactgatctaccgcatggcggcggtatggggcggccatgaggggtcgatgctgctgtggtcgctgatgctggcgctgtgggcaatggccgtggctggcttcagccgccgcctgccactggcgttcgtcgcccgcgtgcttggcgtgatggggggcatcagcaccggactgctgctgttcgtgctgttcgcatcgaatccgttcctgcgtctgttgccccgcgcgatggaggggcgcgacctcaatccgctgctgcaggaccccggcatggtgttccatccgccattcctgtacatgggctacgtcggcttcgcggtggcattctcattcgcggtggcggccttgcttgaaggacgactcgacgcggcctgggcacgctggtcgcgcccgtggacgatcctggcgtggatgttcctgaccatcggcatcgcgatgggcagcatgtgggcctactacgaactgggctggggcggctggtggttctgggacccggtggagaacgcgtcgttcatgccctggctggccggcaccgcgctgatccactcgctggcggtcaccgagaagcgcggcgcgttccgcgcctggaccgctctgctggcgatcttcacgttctcgctgagcctgctcggcacgttcctggtccgctctggcgtgcttacctcggtccacgcgttcgcggtggatccccggcgcggcatcttcatcctgacgttgctgggactggtcacggggctggcgctcgcgctattcgcgtggcgcgcgccccggctgacccagcgcaccgatttcaacctgacctcgcgcgagtcttttctgctggccaataacgtgctgctggccgtggccgcctcggcggtgctgctcggcacgctgtatccgctgctgctcgacgtgctggacctcggcaaggtatcggtcggccccgagtacttcgaagaagtgttcgtgccgctgatggcccccgccgtgctgctgatgggtgccgccccgctggcacgctggggacgcagcgacctgcccgacatggccaggcgactgcgctgggcggccgtggcaagtgtggtcatcgcgcttgggctgctggccgtgctgcgcaacagctccgccatgaccgggctcggcctcacgctggccgcgtggtgtgcaatgagcgggctggccagcctggccacgcagatgcggcacgcgcgggactggcgctccggcctgcgccagttgccggccggctactacggcatgttgctggcccacatcggcgtgggcgtgttcatcaccggcgtcacgctggtcaagagccaggagagcgtgcgcgagttgtcgatgcgcgtgggcgattcggtcgcggttggcggctacgatttccgcttcgacggtgtggcgccggtcaggggaccgaactacgacgcgctgcggggcacggtcacggtgacgcggcaaggccgtccggtcaccacgctcgccaccgagcggcgcgtctaccgcagccaggacatgccgaccaccgaggccgccatcgacaccgggctcgcacgcgatctctatgtggcgctcggcgattcgtcggatgccacgtccgccgatgcccgctgggcgctgcgggtctacgtgaagcccttcgtctcgtgggtctggggcggctgcgcgttgatggcgctgggcggactccttgccgccagcgaccgccgatatcgcgcgcgccatccggcggcagcggtcacgtctgcggtcacggccaatgacgatgcgggggcccggcccgccacgccaccgctgacgctgcctgctggcaaggagtccgaagcatga

SEQ ID NO: 68095 - protein, 680 aa, Ralstonia metallidurans CH34
MNPELGHFALILAMLVALVLATLPMVGAARGNVAWMCLARPAAFLHGTLLIAAYLSLTYAFVDNDFSVLYVAANSNSALPLIYRMAAVWGGHEGSMLLWSLMLALWAMAVAGFSRRLPLAFVARVLGVMGGISTGLLLFVLFASNPFLRLLPRAMEGRDLNPLLQDPGMVFHPPFLYMGYVGFAVAFSFAVAALLEGRLDAAWARWSRPWTILAWMFLTIGIAMGSMWAYYELGWGGWWFWDPVENASFMPWLAGTALIHSLAVTEKRGAFRAWTALLAIFTFSLSLLGTFLVRSGVLTSVHAFAVDPRRGIFILTLLGLVTGLALALFAWRAPRLTQRTDFNLTSRESFLLANNVLLAVAASAVLLGTLYPLLLDVLDLGKVSVGPEYFEEVFVPLMAPAVLLMGAAPLARWGRSDLPDMARRLRWAAVASVVIALGLLAVLRNSSAMTGLGLTLAAWCAMSGLASLATQMRHARDWRSGLRQLPAGYYGMLLAHIGVGVFITGVTLVKSQESVRELSMRVGDSVAVGGYDFRFDGVAPVRGPNYDALRGTVTVTRQGRPVTTLATERRVYRSQDMPTTEAAIDTGLARDLYVALGDSSDATSADARWALRVYVKPFVSWVWGGCALMALGGLLAASDRRYRARHPAAAVTSAVTANDDAGARPATPPLTLPAGKESEA

SEQ ID NO: 68096 - DNA, 2079 bp, Burkholderia fungorum LB400
  CDS (1)..(2079)
ttgattcctgaaatcgggcactttgcgctgatcctcgcgttgctgctcgcactcacgactggtgtactgccggtgatcggtgtgcagcgcggcatcgatggctggatacgtcttgcctggccggcggcgcgcgcgcagtttgctttcgtcgcgattgcttttggctgtctgtcatggtcgttcctcatcaatgacttttccgtcctctacgtggtggagaactcgaattccgcgttacccgccgtctatcgttttactgcggtctggggcggtcatgaaggctcgctgctgctgtgggtgttgctgttgacgctttggatggtggccgtcacctgtttcagcaagcaattgccggtgacgatggtggccacggtactgggtgtgatgagttggattgcgagtggctttttgctgttcatgctcttcacgtcgaacccattcagccgcctgattccgcagtccatggagggccgcgatctgaatccgctgctgcaggaccctggcatggtcattcatccgccggtgctctacgcgggctacgtcggtttctcggtggctttcgcatttgcgattgcggcgttgctgtcgggccggcttgacgcggcatgggcacgctggtcgcgcccgtggaccacggccgcctgggtgttcctgacgctgggcatcatgctgggcagcggctgggcttactacgaacttggctggggcggatggtggttctgggatccggtcgaaaacgcttcattcatgccgtggctggcgggtacggccttgatccattcgctcgcggtcacggagaagcgcggcagcttccgcagttggaccgctttgctggcgatctgcgcgttttcgttgagcctgctaggcacgttcctcgtgcgttccggcgtgattacctcggtccatgcatttgcgtccgatccgacccgcggcgtgttcatcctcgggtttcttgcgctggtggtgggtggcgcgctgcttctctttgcctggcgcgcgccgcagatcggcctgggggccggctttgagcccgtgtcgcgggaggccttgctgctgtcgaacaatgtgctgttaatggtggctgccgcgtcggtgctgctcggcacgctttatccgatggtgctggatgcacttggactcgacaagatttcggtcgggccgccgtatttcgacagcgtgttcgtgccgttgatgacgccggctatctttctgatgggcgtgggaccgcttgcccgctggaaggcggctcgcgtgcccgatctcgcggcgcgcctgcgctgggccgcggcggtcagcgtcgtcacagcgctggcgctgccgttcacgctcggcagttggcggccgctcgtcagtcttggcctgctgctcgcgacctggagcttcgcgacggtcgcggtgagcatgcgtgagcgcatcggtagccagcagggccgtcctcttctgcgattcaggcgcgtaccgcgggcgagctacggcatgtggctcgcgcacgctgggatcggtgtgtttatcgtgggtgtgacgctggtcaaaggttacgagtcggagcgcgatgtgccgatgcgcaggggccagaccgtcgaggttggcggctaccagttccgtttcgacggggtccgcgatgtcgacgggccgaactaccgtgcgacgcgcgcctcgatcgcagtgagtcgcgaggggcgaccggttacgacgctctatccggagaagcgtctttttctcgtgcagaagatgcccatgaccgaggctgcgatcgaccacggcgtgctacgcgatctgtacgtggcaatgggcgagccgattggcgaggaagcatggaccttgcggatccagatcaagccattcgttcgctggatctgggcgggttgcctgctgatggcattgggcggaatgcttgccgccagcgaccggcgatatcggttgtttccgggccggcgcgtgctgcagatgaacgaggctgcgcgtagtgctggagtgcggccccttgctgcaaacgaaattcgccaaaccggcgcgatcggagcgccgggcgtgatagctgccgcgccacaccatcccgtcaacgaggaccgcggatga

SEQ ID NO: 68097 - protein, 692 aa, Burkholderia fungorum LB400
MIPEIGHFALILALLLALTTGVLPVIGVQRGIDGWIRLAWPAARAQFAFVAIAFGCLSWSFLINDFSVLYVVENSNSALPAVYRFTAVWGGHEGSLLLWVLLLTLWMVAVTCFSKQLPVTMVATVLGVMSWIASGFLLFMLFTSNPFSRLIPQSMEGRDLNPLLQDPGMVIHPPVLYAGYVGFSVAFAFAIAALLSGRLDAAWARWSRPWTTAAWVFLTLGIMLGSGWAYYELGWGGWWFWDPVENASFMPWLAGTALIHSLAVTEKRGSFRSWTALLAICAFSLSLLGTFLVRSGVITSVHAFASDPTRGVFILGFLALVVGGALLLFAWRAPQIGLGAGFEPVSREALLLSNNVLLMVAAASVLLGTLYPMVLDALGLDKISVGPPYFDSVFVPLMTPAIFLMGVGPLARWKAARVPDLAARLRWAAAVSVVTALALPFTLGSWRPLVSLGLLLATWSFATVAVSMRERIGSQQGRPLLRFRRVPRASYGMWLAHAGIGVFIVGVTLVKGYESERDVPMRRGQTVEVGGYQFRFDGVRDVDGPNYRATRASIAVSREGRPVTTLYPEKRLFLVQKMPMTEAAIDHGVLRDLYVAMGEPIGEEAWTLRIQIKPFVRWIWAGCLLMALGGMLAASDRRYRLFPGRRVLQMNEAARSAGVRPLAANEIRQTGAIGAPGVIAAAPHHPVNEDRG

SEQ ID NO: 68098 - DNA, 1965 bp, Magnetococcus sp. MC-1
  CDS (1)..(1965)
atgtggatagaagttggacattatgccgccatcctggcgttgctgctgagtattacccaaatggtcacccctatggtgggcatacgcagtggtcagatggcctgggtcagggttggtcgctacagcgcctttgcggtgtttttgctcttgagcgtagccagtggcacactgatacacgcctttatgagccacgatttttccgtgctctatgtggcccgcaactcttccttgagcctgccatccttctatttggccaccgccatgtgggggggacatgagggctctttgttgctgtgggcttggttaatgtccttttttattgccgttgcagcatggcgccactggaacacccactcggtctcgatgccctggattttgaccattctaggggccgtgaccctgggttttctgtgcttggtattgctgctctcttcgccctttgagcggctgtttcccatccccatggatggacgggatcttaatccgctgttgcaagatcctggtatggtttttcaccccccctttctctatctgggttatgtgggttttgcggttccctatgcctttgccatggcggcactgataaccggacaggccaaggatgagtggatcttggcaacccggcgctggaccctgtttgcctggaccatgcttacgacgggcatcgtgtttggtgcctactgggcctattatgagctgggctggggcggctattgggcttgggatccggtggagaatgcctctttcatgccctggttaaccggtaccgcctttttgcattcgatcatggtgcaagagcgccgccagatgtttaaggtatggaatctattcctgattatcaccaccttttcgctctcactgctgggtacctttttggtgcgttcgggggtgcttagttcggtacatgcgtttgctaccgacccgggccggggtatgtttattttaagctttatggcggttatgttgctgtttagctttggtgtgctggtgtggcgagccgatgccttaaaagcggaaaaccgcatggacgcggtggtgtgtcgcgagagcaccttcttgtttaataacctgttcctgttggttggggcgatcacggtgctgctgggcaccctctacccgctcgctttggaagcgttgatggatgccaaggtcacggtgggccccccctactttaacaaggtgtttgtgccgattatgctgggcctgcttattctgatgggcattggtcccttgatctcttggcggcgggccgcccagggacagttaaaaaagaactttttggtgccgggtctgttggccttggtggggattcctatcgccctgctcttgggtgtgcagcacccttacgccattgttacggtgatgatcattctgtttgtgggcagcacccaccttattgatgtacagcggggcgttgcggctcgccttcaagcgggtagccacaaccccatttctgctttcgttaaaatggtcgcccgtaacaagcgccgctacggtggcctgacggtgcatattggcattctggttatgtgcgcgggttttattggcagtggcatgttccaggaggttcagaccgtcattatgcaacccggcgataaggtacgcctttcgggttgggagctgaccctggaaaagtaccatcaggtgcgtaaagataactggacagcaaccgaagcggtgatgcatggcgtgcgggaggatggtctgaccgtcagcttgcatccccaaaaacgtaagtatgataaccatgagatggagaccaccgaggcctccattatcaactttttctgggaagatctctatgtggtgttgggagatcgcatccctggcaaggggtgggccattaaagcctaccgcaaccccttgattagctgggtttggtatggctccttcatcatcgcggcgggggctatactggcactcttccagggacgccgttttaaacgcatccagggggcctcttag

SEQ ID NO: 68099 - protein, 654 aa, Magnetococcus sp. MC-1
MWIEVGHYAAILALLLSITQMVTPMVGIRSGQMAWVRVGRYSAFAVFLLLSVASGTLIHAFMSHDFSVLYVARNSSLSLPSFYLATAMWGGHEGSLLLWAWLMSFFIAVAAWRHWNTHSVSMPWILTILGAVTLGFLCLVLLLSSPFERLFPIPMDGRDLNPLLQDPGMVFHPPFLYLGYVGFAVPYAFAMAALITGQAKDEWILATRRWTLFAWTMLTTGIVFGAYWAYYELGWGGYWAWDPVENASFMPWLTGTAFLHSIMVQERRQMFKVWNLFLIITTFSLSLLGTFLVRSGVLSSVHAFATDPGRGMFILSFMAVMLLFSFGVLVWRADALKAENRMDAVVCRESTFLFNNLFLLVGAITVLLGTLYPLALEALMDAKVTVGPPYFNKVFVPIMLGLLILMGIGPLISWRRAAQGQLKKNFLVPGLLALVGIPIALLLGVQHPYAIVTVMIILFVGSTHLIDVQRGVAARLQAGSHNPISAFVKMVARNKRRYGGLTVHIGILVMCAGFIGSGMFQEVQTVIMQPGDKVRLSGWELTLEKYHQVRKDNWTATEAVMHGVREDGLTVSLHPQKRKYDNHEMETTEASIINFFWEDLYVVLGDRIPGKGWAIKAYRNPLISWVWYGSFIIAAGAILALFQGRRFKRIQGAS

SEQ ID NO: 68100 - DNA, 1968 bp, Novosphingobium aromaticivorans DSM 12444
  CDS (1)..(1968)
atgatcgctgaactcggtcttgccgtcctgtggatggcggcggcgcttgccgccttgcagcttttcgccggcgtttcggccctgcgcccaggcggcggggcggcgggcaagtcgctcgccggcatggttcgcccgctagctgtcatgcagggtgcgctcgtcgcgatctcgttcctggcgctgatcgacttgttcctggaaacggacctgtcggtgaagctcgtggcggaaaacagccactcgatgaagccgttcatcttcaagctggcgggtacgtggggcaaccacgaaggctcgatgctgctgtgggtgacgatcatggcggtatcgggcggtttcgtcgcgctcatcgagaagcgcctgcgcgaagacacgctgatcgccacgctggcggggcaggccttcgtcagcctcggcttctatgccttcctgctgttctcctcgaacccgttcgagcgactggcggaaccagcgcctgatggtgccggcctcaacccgctgctgcaggacatcggcctcgcatttcatccgcccacgctctacgtcggttatgtcgggctttcggtggcgttcagctttgccatcggcgcgctgatcacgcgtgacgtcggccccgctttcgcccgcgcgatgcgcccctgggtgctgggcgcgtggattttcctcaccatcggcatcacggccggttcctactgggcctactacacgctcggctggggtggctggtggttctgggaccctgtcgagaacgcctcgctcatgccctggctggccgcgacggcattgcttcactcggcctccgtccttgccagtcgcaacgccttgcgcgcgtggacggtgatgcttggcgtgatcgccttttcgatgtcgatggtcggcaccttcctggtgcgctcgggcatcctgacgtcggtccatgctttcgccgtcgatccggaacgcggctcgttcatccttgcgcttctggccatctacatcggcggtgcattggcactcttcggcctgcgcgcgtcgaccgtgaccgagggtgaacgtttcagcctgttcagccgtgaggcgagcctcgtgttcaacaacgtgatgctctgcggcacgctcggcatcgtgctgatcggcacgctctacccactgctgaccgaagcgttcggtgccaaggtttcggtgggacctccctatttcaatccggtatccgcgatcttcgtgattccgatgatgctcgtcatgggcgtcgggccgctgcttcgctggcgcaaggacaagccaggccgcgtgaccggcagtgtcgcggtgcctgcgctgctcaccgcgctcgtcctgctcgccgtcgtggtcctggcccccggcattcgcatcctgcccgcgctcggccttgcggttggcgccgggttggcgctggcgagctggttcccgctcaggggccgcaacctgcgccgcacgccgctcagcgtctggggcatggtcttcggccacttcggcattgccgtcgccttgctcggcgctgccagcgaaagcgcattctcgaccgaacggctggccgcgatgaatgtgggcgatacgcaaagcgtcggtccgatctcgctcaagctcgagaagatcgaacctgtcgccggccccaactggaccgcgctcgaggcaacggtcagcgcatcgtacaagggcggggcgccggtcacgctgcatccgcaggcgcgcaccttctcctcgccgcctggcgagcgtaccgaatccgcactccatacgcgctggaacggccagctctatgccgtgctcggcaacgagggcgaggatggccgctggcagatgcgcttctggtggaagccgttcgtgccgctgctctggctcggcgggctgctgattgcgtttggcggcgttctggcgcttctgggccgggtggcgcatgatgttcgccgcctgcgcgcaggcggcaagattgcatatcgccgggcccggatggagcaggtgaagtga

SEQ ID NO: 68101 - protein, 655 aa, Novosphingobium aromaticivorans DSM 12444
MIAELGLAVLWMAAALAALQLFAGVSALRPGGGAAGKSLAGMVRPLAVMQGALVAISFLALIDLFLETDLSVKLVAENSHSMKPFIFKLAGTWGNHEGSMLLWVTIMAVSGGFVALIEKRLREDTLIATLAGQAFVSLGFYAFLLFSSNPFERLAEPAPDGAGLNPLLQDIGLAFHPPTLYVGYVGLSVAFSFAIGALITRDVGPAFARAMRPWVLGAWIFLTIGITAGSYWAYYTLGWGGWWFWDPVENASLMPWLAATALLHSASVLASRNALRAWTVMLGVIAFSMSMVGTFLVRSGILTSVHAFAVDPERGSFILALLAIYIGGALALFGLRASTVTEGERFSLFSREASLVFNNVMLCGTLGIVLIGTLYPLLTEAFGAKVSVGPPYFNPVSAIFVIPMMLVMGVGPLLRWRKDKPGRVTGSVAVPALLTALVLLAVVVLAPGIRILPALGLAVGAGLALASWFPLRGRNLRRTPLSVWGMVFGHFGIAVALLGAASESAFSTERLAAMNVGDTQSVGPISLKLEKIEPVAGPNWTALEATVSASYKGGAPVTLHPQARTFSSPPGERTESALHTRWNGQLYAVLGNEGEDGRWQMRFWWKPFVPLLWLGGLLIAFGGVLALLGRVAHDVRRLRAGGKIAYRRARMEQVK

SEQ ID NO: 68102 - DNA, 1956 bp, Microbulbifer degradans 2-40
  CDS (1)..(1956)
atggcgggtagctacaacggtaagctggtgtggatggcctctgcgcgatctttatccaccggcatgtttgtgtttgttgcaatctcaatagtgttgcttggcgtttcgttctatcaggacgatttcactgtagcctatgtcgccaatcactcgaattcattgctgcctgtggtgtacaaaatatgtgccgtttggggcgggcacgagggttcaatgctgctgtgggtgttaatgcttgcaggttggactttagcggtaactatttttagccgcgaattaccgctagattttcaagctagggtgctttcagtactcggcatggtgtcgtttggctttattttgtttattttgctcacctcaaacccatttgaccgaatattgcccttaccgcctgtggatggcgctgacttaaacccattcttacaagaccccggctttatcttccatccgccaatgctgtatatgggctatgttggctttgctgttatttttgcattcagtattgcggcattgctaagtggccggttagatagcgcctgggcaagatggtgtaggccttggggtaatttggcgtggtgctttttaacgctgggtttaacacttggaagttggtgggcgtactacgagctaggttggggtggctggtggttctgggacccagttgaaaacgcagcctttatgccttggttggtgggtaccgcatttatccataatttggcggtgtcggaaaagcgtgggttatttaaaaactggaccctatttttagctatttttggcttctcgctgagcttgttgggcacgttactagtgcgctcgggcttgcttacatccgttcatgcttttgccagtgatccgtcgcgcggggtatttattggggcattcttatttattgtgattcttgcctcgctcatactatttgctatgcgggcgcctctggttaaatcaaaaacaggttttgcgctgctatcgcgcgatgcgtttttattgctaaacagtgtggtgtttattgtttctgcttccattgtattgctaggcacactttaccctgtagtgttgttgctacttgggttgggcgctgtgtcggtgggcgagccatactttaatatctttttctctatattaatgagcattgccgccatagctaccggtattggcatggtgcttaattggaaaaagaccgaagctaaaagaatgcgtgactgggttaagtcgcccgcgttgtatgcgctttggttgggtaccgcattgccgggcatgatagccgatgaatattcttgggctgcggcggtttctattgcgcttggcagctgggttattttgtcttgtttgttcgatctagtacgtaaaacccgcaatgctgcgagtgtgtggattggaatgggcaagctaacggctacgtactacggcatgattgtggcgcatattggctttggtatatgcctattgggtgtgtgtttagataccatttacgatgatcagcgtgatctacggttagagctaggtaagcccgcgtttgctggccacttagagtatgagcttgttgatgtaagccgcgtaagagggccaaactataatggcgagcgagccgaagttatagtgcgcaaagacggcgagacaataagcattctgcacccagaaaagcgcgcttatttttctggtggcaatataatgagtgaagtggctatcgaccctggctttttttacgatatttatattgcgctgggggaaaagctagacaatacctcgtggagtatgcgtattcactacaaaccggtagtgcgttggatatggtttggcgcagtgtttatggcgctgggtggccttatagctattacagataaacgctacaagcgcaaaaaaactgttgctgtaaaaaatgcagtgggtgaagacgcaaaagctggcgatgccgatgcgaagcccatacttgccactgccaaacaacaacccgagtaa

SEQ ID NO: 68103 - protein, 651 aa, Microbulbifer degradans 2-40
MAGSYNGKLVWMASARSLSTGMFVFVAISIVLLGVSFYQDDFTVAYVANHSNSLLPVVYKICAVWGGHEGSMLLWVLMLAGWTLAVTIFSRELPLDFQARVLSVLGMVSFGFILFILLTSNPFDRILPLPPVDGADLNPFLQDPGFIFHPPMLYMGYVGFAVIFAFSIAALLSGRLDSAWARWCRPWGNLAWCFLTLGLTLGSWWAYYELGWGGWWFWDPVENAAFMPWLVGTAFIHNLAVSEKRGLFKNWTLFLAIFGFSLSLLGTLLVRSGLLTSVHAFASDPSRGVFIGAFLFIVILASLILFAMRAPLVKSKTGFALLSRDAFLLLNSVVFIVSASIVLLGTLYPVVLLLLGLGAVSVGEPYFNIFFSILMSIAAIATGIGMVLNWKKTEAKRMRDWVKSPALYALWLGTALPGMIADEYSWAAAVSIALGSWVILSCLFDLVRKTRNAASVWIGMGKLTATYYGMIVAHIGFGICLLGVCLDTIYDDQRDLRLELGKPAFAGHLEYELVDVSRVRGPNYNGERAEVIVRKDGETISILHPEKRAYFSGGNIMSEVAIDPGFFYDIYIALGEKLDNTSWSMRIHYKPVVRWIWFGAVFMALGGLIAITDKRYKRKKTVAVKNAVGEDAKAGDADAKPILATAKQQPE

SEQ ID NO: 68104 - DNA, 1524 bp, Haemophilus influenzae 86-028NP
  CDS (1)..(1524)
ttgggattgatttgctttggttttgcggtgtttattttattttattccaatccatttggacgcattttccctgctcccgcagaagggcgcgatctcaatccaatgttgcaagatgtgggattaattttccatccgcctttattatatgttggctatgtgggctttgcggtaaattttgcaatgagtttgagtgcgttgatttataaccaatctgcacgacaaattgcccgctcaatgcgtggatgggtgttggtttcttggttgtttttaaccattggcattgtgcttggtgcttggtgggcatattacgaacttggctggggcggttggtggttctgggatcccgtagaaaatgcgtctttaatgccttggttgcttgggttagcgttattacacagtttaatggcgacggaaaaacaaggcgtatttagttattggacaacgcttttttctctgcttgcttttgcctttagcgtattaggcacgtttattgttcgttctggcgcgctcacttctgtgcacgcctttgcattggataacacgcgcggttatgtgttgttattaattttctttgttttgacagcgttagcctttggtttattcgctttacgagcgggaagttcatcagaaagtgcggtgaaatttcagttcatttctaaatcgggtggcattttattactgaatattttgctgaccattgcgacggtttctacctttttaggtaccttttacccgatgttattccaagcgatgaattggggctcaatttcggtgggaagtccttattttaatagtattttcttccccattattacggcgattttaatcctaatggtaattgtgcttagcatacgtaaggggcaatttgatcgcacattattgatacgttgtgggtggttgcttattccgtctttaattcttgcaggcctaatgatttggcaacagctacgccataattctgcgttgaattttcacgctttcgcttttgtgttattaactcttgcgatttggcttttgttggtcactttatggcaaaattggcgacaaattcgtttgtctcaatttggtatgattttagcgcattgtggcgtggcgattgtaactattggtgcggtaatgagtggttattttggcagtgaaattggtgtgcgtttagcaccgcaacaaagtcaaacgctgggacaatatgaatttcactatcgccaattttctaatgaaatcggaccaaactttacggcagaagtcgccttttttgacgtaactgaaaatggtaaaccttatgcagaaattatccccgaacgccgttattacgatgttcgtacaatgacaatgagtgaagtggggcttaatggcggtttttggggcgatttatatattgtgatgggcgattctctcggcaaaggggaatttactttccgcttacattataaaccactgattcgttggctttgggcgggcggtattttaatggcctttggcgcactttttagcgtcttcggattacgcagaaaacaggaaaaataa

SEQ ID NO: 68105 - protein, 507 aa, Haemophilus influenzae 86-028NP
MGLICFGFAVFILFYSNPFGRIFPAPAEGRDLNPMLQDVGLIFHPPLLYVGYVGFAVNFAMSLSALIYNQSARQIARSMRGWVLVSWLFLTIGIVLGAWWAYYELGWGGWWFWDPVENASLMPWLLGLALLHSLMATEKQGVFSYWTTLFSLLAFAFSVLGTFIVRSGALTSVHAFALDNTRGYVLLLIFFVLTALAFGLFALRAGSSSESAVKFQFISKSGGILLLNILLTIATVSTFLGTFYPMLFQAMNWGSISVGSPYFNSIFFPIITAILILMVIVLSIRKGQFDRTLLIRCGWLLIPSLILAGLMIWQQLRHNSALNFHAFAFVLLTLAIWLLLVTLWQNWRQIRLSQFGMILAHCGVAIVTIGAVMSGYFGSEIGVRLAPQQSQTLGQYEFHYRQFSNEIGPNFTAEVAFFDVTENGKPYAEIIPERRYYDVRTMTMSEVGLNGGFWGDLYIVMGDSLGKGEFTFRLHYKPLIRWLWAGGILMAFGALFSVFGLRRKQEK

SEQ ID NO: 68106 - DNA, 1965 bp, Silicibacter sp. TM1040
  CDS (1)..(1965)
atgattacagagctcggtcacttcgccctcatcctcgcctttatgatcgccatcgtgcagacggttgtgcccctgattggtgcgcataaacgctggcccggctggatggccgtggcggaacccgcagcgcaggcccagttcctgtttacggcgttttcctttggggcgctcacatgggcctttgtgacctcggatttctcgctgcggctggtgacgctcaacagccactccgccaaaccgatgatctacaagatctcgggcacttgggggaaccatgagggctccatgctgctctgggtgctgatcgtgaccctctttggggccttggcctcggtgtttggaggcgggctgccgccgacactcaaggcgcgggtgctcagtgtgcaatcggccattggcgtggcctttttcgcgttcatcctctttacctccaaccccttcttgcggctggaaaaccctccctttgacgggcaggatctcaatccgctcctgcaagatccgggcctcgcgttccacccgccgtttctgtacttgggctatgtggggctctcgatggcgttctcctttgctgtggctgccctgatcgaagggcgggttgatgcggcctgggggcgctgggtccggccctggacattggcggcgtgggtgttcctgaccatcggcatcgcgctggggtcctggtgggcctattacgagcttggctggggcggcttctggttctgggatccggtggagaatgcgtccttcatgccatggcttctcgccgctgcgcttctgcattccgcgatcgtggtggaaaagcgcgaggcgctcaagagctggaccatccttctcgcgatcctcgcctttggcttttcgctcatcggcaccttcatcgtgcgctctgggcttttgacctcggtgcatgcctttgccaatgatccagagcgtggcgtggtgatccttggaattctcgccttctttaccggcggcgcgctgctgctctttgccctgcgcgcgcaggctatggaggccaaaggcgtgttctccatggtcagccgggagagcgcgctggtggccaacaacctcttgctggcggtcagctgctttgtggtttttgttggcacgctctggccggtggtggcggagatggcctttgatcgcaagctctcggtcggggcaccgttctttgatgcggccttcccgcccttcatggtggcgctggggctcttgctgccgatcggctcaatgctgccgtggaagcgcggtaaaggcgccaagacgctctggacgctgcgctatggcatcgtactggcgctggcccttgcggggctcgcctgggcgatccagaccgaaaagagcctgcttggccccgttggcgttctgctgggcgcttgggtcgtaagcggcgctgcacttgatttgttgcaacgcgcagggcgcaaggaccggctctcgcgcctgatgcggttgccgcgtgccgattggggcaaggcggtggcgcatgccgggcttggcgtgacgatctttgccgtggcagggctgacggcctggcaaaaagaagacatccgtgttgccaacctcaatgagccgttccgcgtcggtccctttgaactggtgctgtctgcggtcgaagaggggcgcgggccgaattacttcaccacgatgggcgtggtggatgtgacccgcaacggcaaggacgtcgcaacgctgcggccggagaaacgcgtctatccggtggcgcagatgcccaccacggaggcggcgattgattatcggttcacccgcgatctctatgtggtgctgggcgatgcgcaagagggcggcggatttactctgcgcacctatatcaagcccttcgccaactggatctggggcggcagcctgctgatggcccttggcggcttcctgagcctctcggaccgtcggttccgggttgcggccggggtgcgcaaggcccccaccgagggggtgcccgcggaatga

SEQ ID NO: 68107 - protein, 654 aa, Silicibacter sp. TM1040
MITELGHFALILAFMIAIVQTVVPLIGAHKRWPGWMAVAEPAAQAQFLFTAFSFGALTWAFVTSDFSLRLVTLNSHSAKPMIYKISGTWGNHEGSMLLWVLIVTLFGALASVFGGGLPPTLKARVLSVQSAIGVAFFAFILFTSNPFLRLENPPFDGQDLNPLLQDPGLAFHPPFLYLGYVGLSMAFSFAVAALIEGRVDAAWGRWVRPWTLAAWVFLTIGIALGSWWAYYELGWGGFWFWDPVENASFMPWLLAAALLHSAIVVEKREALKSWTILLAILAFGFSLIGTFIVRSGLLTSVHAFANDPERGVVILGILAFFTGGALLLFALRAQAMEAKGVFSMVSRESALVANNLLLAVSCFVVFVGTLWPVVAEMAFDRKLSVGAPFFDAAFPPFMVALGLLLPIGSMLPWKRGKGAKTLWTLRYGIVLALALAGLAWAIQTEKSLLGPVGVLLGAWVVSGAALDLLQRAGRKDRLSRLMRLPRADWGKAVAHAGLGVTIFAVAGLTAWQKEDIRVANLNEPFRVGPFELVLSAVEEGRGPNYFTTMGVVDVTRNGKDVATLRPEKRVYPVAQMPTTEAAIDYRFTRDLYVVLGDAQEGGGFTLRTYIKPFANWIWGGSLLMALGGFLSLSDRRFRVAAGVRKAPTEGVPAE

SEQ ID NO: 68108 - DNA, 1974 bp, Azotobacter vinelandii
  CDS (1)..(1974)
atgattcccgaactcggccacctggggatgatcctcgccctgtgcctggcgctggtgcagggcaccttgccgctgatcggcgcctggcgtggcgaccgcctgtggatgggcctggccgtgccggccgcctgggggcagttcgctttcctgtcgttcgccttcgtctgtctgacccaggctttcctggtcgacgacttctcggtcgcctacgtggccggcaactccaacagcgccttgccctggtactacaagctgagcgccgtgtggggcgcccacgaaggatcgctgctgctctgggcgctgatcctctccggctggaccttcgcggtgtcggtcttttcccggcaactgcccgaggagatgctggcccgcgtgctgggcgtgatggggctgatcagcgtcggcttcctgctgtttctgatcgtcacctccaaccccttcgcccgcctgttgccgcagacgccggtcgatggccgcgacctcaacccgctgttgcaggacttcggcctgatcgtccatccgccgatgctctacatgggttacgtcggcttctcagtggccttcgccttcgccatcgccgcgctgctcggcgggcgcctcgatgccgcctgggcgcgctggtcgcggccctggacgctggtcgcctgggcctttctcggtatcggcatcgtgctcggctcctggtgggcctattacgagctgggctggggcggctggtggttctgggacccggtggagaacgcttccttcatgccctggctgctgggcaccgcactgttgcactcgctggcggtgacggagaagcgcggggtgttcaagagctggacggtgcttctggccatcgccgccttctcgctgagcctgctcggcaccttcctggtgcgttccggggtgctgacttcggtgcatgccttcgccaacgatccggagcgcggcgtgttcatcctgatcttcctgctggtggtggtcggcagttcgctgaccctgttcgccatccgcgcgccggtggtcaggagccaggtgggcttcgccctccgctcgcgggaaaccctgctgctggtgaacaacctgctgctggtggtggcgacctcgaccatcctgctcggcacgctctatccgctactgctggatgcgctgtccggcgccaagctgtcggtcgggccgccgtacttcaatgcgctgttcctgccgctgatggggctgctgatgctgacgctggcggtcggcgtgctggtgcgctggaaggacacgccgctgcgctggctgtccggcatgctcgcgccggtactgctggccagcgtggcgctggccctgctggccgccttcgtgctcggcgatttcgcctgggcggtgctggcgaccgctttcctggcggcctgggtggttctcgccggggcgcgcgacctgctcgacaagacccgccacaagggactgctcaagggcctgcacgcgctttcgccgagctactggggcatgcaactgtcccacctggggatcgccgtctgcgccctgggcatcgtcctgagcagccaggaaagcgccgagcgcgacctgcgcatggcgccgggcgatgccgtggaactgggcggctaccgcttcgtcttcgagggcacccgccaccatgaggggcccaacttcgtcgccgaccgggccagcgtccgcgtcttcgacggcgacgacgaggtggccgtgctgcacccggagaagcgtctctataccgtgcagcggatgccgatgaccgaggccggcatcgacgcaggtttcacccgcgacttctacgtcgccctgggcgagccgctggaaaacggcgcctgggcggtccgcctgcatatcaagccgttcgtccgctggatctggctggggggcctgatgatggctttcggcgcggcgctggcggcctgcgaccggcgttatcgggtcaaggtcagggcccgcgtgcgcgaggctctgggcctggccggacaaggagcctga

SEQ ID NO: 68109 - protein, 657 aa, Azotobacter vinelandii
MIPELGHLGMILALCLALVQGTLPLIGAWRGDRLWMGLAVPAAWGQFAFLSFAFVCLTQAFLVDDFSVAYVAGNSNSALPWYYKLSAVWGAHEGSLLLWALILSGWTFAVSVFSRQLPEEMLARVLGVMGLISVGFLLFLIVTSNPFARLLPQTPVDGRDLNPLLQDFGLIVHPPMLYMGYVGFSVAFAFAIAALLGGRLDAAWARWSRPWTLVAWAFLGIGIVLGSWWAYYELGWGGWWFWDPVENASFMPWLLGTALLHSLAVTEKRGVFKSWTVLLAIAAFSLSLLGTFLVRSGVLTSVHAFANDPERGVFILIFLLVVVGSSLTLFAIRAPVVRSQVGFALRSRETLLLVNNLLLVVATSTILLGTLYPLLLDALSGAKLSVGPPYFNALFLPLMGLLMLTLAVGVLVRWKDTPLRWLSGMLAPVLLASVALALLAAFVLGDFAWAVLATAFLAAWVVLAGARDLLDKTRHKGLLKGLHALSPSYWGMQLSHLGIAVCALGIVLSSQESAERDLRMAPGDAVELGGYRFVFEGTRHHEGPNFVADRASVRVFDGDDEVAVLHPEKRLYTVQRMPMTEAGIDAGFTRDFYVALGEPLENGAWAVRLHIKPFVRWIWLGGLMMAFGAALAACDRRYRVKVRARVREALGLAGQGA

SEQ ID NO: 68110 - DNA, 1950 bp, Actinobacillus pleuropneumoniae serovar 1 str. 4074
  CDS (1)..(1950)
atggttgcggaattaggtaattacgcattggcacttgcgttcggattgtcaatttttttggcaattttaccgcttgttggtgcacaaaaacagaatagtactcttatggcgttagctcgtccgataacatgggcaatgtttttagcattaacgatttcattcggttcgcttttttatctgtttgcggtaaatgacttcagcgtgcaatacgtagtgaataactccaactcaacattacctatccaatatcgtctttctgcggtttggggatcgcacgaaggatcaatgctgttatgggtttggttgctttcgctttggtctatcgctgtggtggcattttctcgccagatgccggaagaagccgtttcgcgcgtattgagtgtaatgggattaatcagtatcggatttttggttttcttaatctttagttcaaatccgtttaaacgtactttccccgattttcctgcggacggtcgagaattaaatccgatgttgcaagatgtcggactgattttccatccgccgttattatatatgggatatgtcggtttctcggtggcatttgcgttcgcgattgcttcactaatgaccggaagattggataccgcttgggctcgttggtctcgtccttggacaatggcggcttgggtatttttaacacttggtatcgtactcggttcgtggtgggcttattacgaattaggctggggaggctggtggttctgggatccggttgaaaatgcttcgttaatgccgtggattgccggaacggcactgattcactcgttagccgttacggaaaaacgcggtacttttaaagcttggacggttttactggcgatattggcgttctcgctgtgtttattaggcaccttcttagtacgttccggtattttggtttcggtacatgcgtttgcttccgatccgactcgcggtttgtatattcttgcctatttagttttagtaattggcggttcattattactttacgctttacaaggctcgaaaattaaaagtttggataattatgaacgttattcgagagaatcgatgttgttaattaataacgtaatgctgatggcattcttatccgtagtgctgctgggtacattattaccgttagtacataaacaaatcggtttaggcacgatttcgatcggtgcgccgttctttgatcaaatgtttttaattttaatggtaccgttctcgtttattttaggtatcgggccattagtaaaatggcgtagagatcaagtatctgcgattcgaacaccggtaattattgccttaattatgatggtggtactcggtttcggcttaccgtatttactgcacgaccgtattactgccacttcggtattaggcgtgatgatggcatcgattattgtcattttgagcctatatgaattacatcaaagagcgacgcatagacattcatttttagccggtgtgtttaaattatcccgttctcattgggggatggtattggcgcacgtaggtgtcgcaatgacagtattcggaatcgcattcagccaaaactatagcgtagagaaaaacgtacgtatgaatgtcggcgatacggtatcgcttcaaggttacgactttactttcaaaggaatcaaaattaccgacggtgcgaactatcagggcggcacggctgaaattgagatttcgcgtcaagggcaatatgaatcgactctgaatgcggagaaacgcttctataacgtcagtaaaatggggatgaccgaagcggcaatcgactggggctttagaagagacttatatgccgctttaggtgaaaagttggaagacggttcatggggcgtacgtttatattataaaccgtttgttcgctggatctggattggcggcttatttatggtgttcggcggtttgctctgtatgtttgacaaacgttacagattaaacgtagttaaaaaagctgcataa

SEQ ID NO: 68111 - protein, 649 aa, Actinobacillus pleuropneumoniae serovar 1 str. 4074
MVAELGNYALALAFGLSIFLAILPLVGAQKQNSTLMALARPITWAMFLALTISFGSLFYLFAVNDFSVQYVVNNSNSTLPIQYRLSAVWGSHEGSMLLWVWLLSLWSIAVVAFSRQMPEEAVSRVLSVMGLISIGFLVFLIFSSNPFKRTFPDFPADGRELNPMLQDVGLIFHPPLLYMGYVGFSVAFAFAIASLMTGRLDTAWARWSRPWTMAAWVFLTLGIVLGSWWAYYELGWGGWWFWDPVENASLMPWIAGTALIHSLAVTEKRGTFKAWTVLLAILAFSLCLLGTFLVRSGILVSVHAFASDPTRGLYILAYLVLVIGGSLLLYALQGSKIKSLDNYERYSRESMLLINNVMLMAFLSVVLLGTLLPLVHKQIGLGTISIGAPFFDQMFLILMVPFSFILGIGPLVKWRRDQVSAIRTPVIIALIMMVVLGFGLPYLLHDRITATSVLGVMMASIIVILSLYELHQRATHRHSFLAGVFKLSRSHWGMVLAHVGVAMTVFGIAFSQNYSVEKNVRMNVGDTVSLQGYDFTFKGIKITDGANYQGGTAEIEISRQGQYESTLNAEKRFYNVSKMGMTEAAIDWGFRRDLYAALGEKLEDGSWGVRLYYKPFVRWIWIGGLFMVFGGLLCMFDKRYRLNVVKKAA

SEQ ID NO: 68112 - DNA, 2394 bp, Chloroflexus aurantiacus
  CDS (1)..(2394)
atgtatctctttggtacgttcctcctgatggccagtctggggatgaccttgctggcgattatcagttatggactagttttacgtgggcagcgggtagcgcttagttatgcccgtttcggtgtctatgcggcgttagccggcgtgctgatgtcgtggacgctactgattacggtgtttcttgcccgccgctttgatctggactacgtctacaactatagctcccgcgatctggagttcttcttcacgattgcggccagttgggccggtcaaccaggtagttttatgatctggttgctgtgggggtcaattgccagcgcgttgctgattcgccgtaccaagcattttgagtcgtatgtgttaatggttgttatggcgatccaggcagcgatcattgggtttgtgctggtgctcaatccattccagcccctggtcgatcccaataccggcgtcgcacttaccccaggtgacggtcgcggtctcaatccgctgttgcacaacttctggatgatcattcaccccccaatcctgttcgttggctatgcgctttccatgattcccttcgcatttgccctggctgcgctgtggcggcgcgattacgatacatgggtgaaacgggccttgccatggacattggcggcctgggcatttctggggctggcactcttgctcggcggttactgggcttatgagacgctgggctggggtggctattggggttgggatccggttgaaaacttgtcgctggtaccctggctcattctaaccgccctgatccacgggatgcttgtgcaacgcacccacggtggtttgcgaaagaccaacctcgtgttgggtgtggcgacgtacattacggtgttctacgctacctttatgacccgcagcggggtctatgctaacttctctgtccactcatttgtcgccgaagggatttttgagggactggttggctttcagattttcttgctggcggttgccattgtctcgttgctggcccgctggaacgatattcctgcccgtccacttagtgacaaattcttctcgcgtgatagcttcttcgtgctggcgattattaccattgtcatgaccgcgctggtcgttggtatcggcacctcgatgccggtcatttcggctattcctggggtagggcatacgctgcaagagtggatggggcgttatttcgagcttgatgacggcaccctgatgaacccgcaggcgcaaccgtttgaagatggccgtttttcgcttgccccatccttctaccagcgcacagtacctccactcggcgtggtagcaatcgtgttgctgatcgttgggccactccttggctggcgcgacgctaatctcagccacctcctgcgtgcattgcgttggccggcagtgtttgcagtgatagcggctgtcgtggccatgattatcaatgtgcgcgatttgctctccctggcttatgttgccggtggtgtcttcgcgtttggaacgaacctggtgatgattattcgtaccctgcgtggtggctggttacggatcggtggctatcttgctcacctcggttttacagtgatggcgattgggatggttgcctcttcggcctacgctactcccgatactcgcctgacgctatctcccggtgagtcggcccgattgtttggctatgagtttatcttcaacggctatcaacttgatgaccagcagcgtggtgtgctcgatctcacggtgagtgacggatcgggtaccttctcggctcgaccgtatctctactttaatcagcgtatgggcgcaaccatgcaaacgccctcgatccacagctatctctggcacgatctctacatttcaccggcaggttatgacccggaacgtgatccttcgcgaccggtgttaggtgtggatcagagcgcacagatggggccatacacgttgaccttccgcgggttcaatatcgaccgcgaggcaatgatgcgtggtgaagcgaaggttggcgcccgtgtcgaagttacttatgaaggccagaccttcgaggttgagccgcgggtggaagttgtccccaatccgaccacgaatgaaggtgagttgcagttcattccggtcaccctacccggtggccacaccctgcgtctagcggagcttgatccgaccaaccgcatggtgcttctcgaaggtagtggtcccggcctggatgatctgccggtggtgccggccaaggctgtcattgcggtgagtgtcaaaccgctggttgtgctggtctggactggtgttatcatgatggtgatcggcggtgcaatcgcactggtacggcgctaccttgaaggtagtctggcgctggctggtgcacgagtacgactacccaaagcgttgccggaactggcggctcaactgggctggcgcggggccggcgactag

SEQ ID NO: 68113 - protein, 797 aa, Chloroflexus aurantiacus
MYLFGTFLLMASLGMTLLAIISYGLVLRGQRVALSYARFGVYAALAGVLMSWTLLITVFLARRFDLDYVYNYSSRDLEFFFTIAASWAGQPGSFMIWLLWGSIASALLIRRTKHFESYVLMVVMAIQAAIIGFVLVLNPFQPLVDPNTGVALTPGDGRGLNPLLHNFWMIIHPPILFVGYALSMIPFAFALAALWRRDYDTWVKRALPWTLAAWAFLGLALLLGGYWAYETLGWGGYWGWDPVENLSLVPWLILTALIHGMLVQRTHGGLRKTNLVLGVATYITVFYATFMTRSGVYANFSVHSFVAEGIFEGLVGFQIFLLAVAIVSLLARWNDIPARPLSDKFFSRDSFFVLAIITIVMTALVVGIGTSMPVISAIPGVGHTLQEWMGRYFELDDGTLMNPQAQPFEDGRFSLAPSFYQRTVPPLGVVAIVLLIVGPLLGWRDANLSHLLRALRWPAVFAVIAAVVAMIINVRDLLSLAYVAGGVFAFGTNLVMIIRTLRGGWLRIGGYLAHLGFTVMAIGMVASSAYATPDTRLTLSPGESARLFGYEFIFNGYQLDDQQRGVLDLTVSDGSGTFSARPYLYFNQRMGATMQTPSIHSYLWHDLYISPAGYDPERDPSRPVLGVDQSAQMGPYTLTFRGFNIDREAMMRGEAKVGARVEVTYEGQTFEVEPRVEVVPNPTTNEGELQFIPVTLPGGHTLRLAELDPTNRMVLLEGSGPGLDDLPVVPAKAVIAVSVKPLVVLVWTGVIMMVIGGAIALVRRYLEGSLALAGARVRLPKALPELAAQLGWRGAGD

SEQ ID NO: 68114 - DNA, 1962 bp, Paracoccus denitrificans
  CDS (1)..(1962): transl_table=11
atgctggtcgagaccgggcattttgcgctgctggtggccctctgcgtcgcgctgatccagtcggtcattcccctggtgggggcccagcgcggctggtcgggctggatggcggtttcgacccccaccgcgctgggccagtttgggatgatcgcgatcgcgttggcgaccctgatctatgccttcgtgacggccgacttttcgctcaagatgctctacgaaaactcccataccgataagccgctgctctacaaggtggccggggtctggggcaaccatgaggggaacgtgcttctgtgggtgctgatcctggccatgtttacggccgcgtccgcggcctttggcggtgcgatgccggagcggctgcgggcccggctgctcgcggtgcagggctccatcggggtcgcctttctgctctttgtgctttttacctcgaacccattcattcgggtggaagaagcccccttcagcggccgcgacctgaacccgatcctgcaggaccccgggctcgcgttccatccgccgttcctgtacgtcgggtatgtggggttttcgatcggcttcggcttcgccgtggccgcgctgctcgagggcaaggtcgacgccgcctgggcgcgctgggtcaggccatggacgctggcgggctgggtcttcctgaccgtcggcatcgcgctgggttcgtggtgggcctattacgaggtgggctggggcgggttctggttctgggatcccgtggaaaacgccagcttcatgccctggctgatcgccgccggcctcctgcattccgccatcgtggtggaaaagcgcgaggtgctgaaaagctggaccatcctgctggcgatcatggctttcggcttttcgctgatcggcaccttcatcgtgcgctcgggggtcattacctcggtccacagctttgccagcgaccccaagcgcggggtgttcatcctggcgatcctggcgttcttcctcggcgggtcgctgaccctttatgccgcgcgggcgaacgagatccaggcgaagggggtgctgtccatggtcagccgcgaatcgtcgctcatcatgaacaacgtccttatcgcggtggccgcgctggtggtcttgaccggcacggtgtggcccctgctggcggagctgttttgggaccgacgactggcggtgggggcgccgttctttgaaaagacctttaccccattcatggtggggctggccctgcttctccccatcggggcgatggtgccgtggaaacgctcgagcctcggcaagctggtccggccggtgttgcccgcgctggtctttgccggggcggtgatggcgctggtctttgccgtctcgaccggccgttcggcgctggcggtgggcgccgcgtcgctgggcggctggatggtgtttggcgccctgtccgagatctggcaacgcgccaaccggaccccgggacgcctcctgcggctgccgcggaacgattggggcaaggcgttggcgcatgggggcctgggcatcgcctttgcgggcgtcgggctgttgatgatgggccaggtcgaggatgtccgcgtggcgaagacgggggacgcgttcgaggtcgcaggttacaccatctcgctgatctccgtcgaggatctgccggggcccaacttcgccgccaagtccgcgacgatggaggtccggcagggcgggaagctgctgacgaccctgcatcccgaaaagcgcgtctatccggcgcaggcgatgccgaccacggaggccgccatcgacagcggcttttggcgcgatgtctatgcggtcatcggcgacccgcaggaggcggggggctgggcggtgcggtcgtattacaagcctttcgccaactggatctgggcgggctgtctggtgatggcctttggcggcgtgctgagccttaccgaccggcggtaccgtacggccaccggcgcgcggcgcgcggcggtcgccgatgctctggccgcggagtga

SEQ ID NO: 68115 - protein, 653 aa, Paracoccus denitrificans
MLVETGHFALLVALCVALIQSVIPLVGAQRGWSGWMAVSTPTALGQFGMIAIALATLIYAFVTADFSLKMLYENSHTDKPLLYKVAGVWGNHEGNVLLWVLILAMFTAASAAFGGAMPERLRARLLAVQGSIGVAFLLFVLFTSNPFIRVEEAPFSGRDLNPILQDPGLAFHPPFLYVGYVGFSIGFGFAVAALLEGKVDAAWARWVRPWTLAGWVFLTVGIALGSWWAYYEVGWGGFWFWDPVENASFMPWLIAAGLLHSAIVVEKREVLKSWTILLAIMAFGFSLIGTFIVRSGVITSVHSFASDPKRGVFILAILAFFLGGSLTLYAARANEIQAKGVLSMVSRESSLIMNNVLIAVAALVVLTGTVWPLLAELFWDRRLAVGAPFFEKTFTPFMVGLALLLPIGAMVPWKRSSLGKLVRPVLPALVFAGAVMALVFAVSTGRSALAVGAASLGGWMVFGALSEIWQRANRTPGRLLRLPRNDWGKALAHGGLGIAFAGVGLLMMGQVEDVRVAKTGDAFEVAGYTISLISVEDLPGPNFAAKSATMEVRQGGKLLTTLHPEKRVYPAQAMPTTEAAIDSGFWRDVYAVIGDPQEAGGWAVRSYYKPFANWIWAGCLVMAFGGVLSLTDRRYRTATGARRAAVADALAAE

SEQ ID NO: 68116 - DNA, 2145 bp, Pseudomonas fluorescens
  CDS (1)..(2145): transl_table=11
atgacctctacattgtttattcccgagttgggccagttggcgatgatcctcgccctgtgctttgccatcgtccaggccatcgtgccgctgctgggcgcctggcgcggtgatcggctgtggatgagcctggcgcaacccgcgctggggccagttcgcgttcctggcgttcgctttggttgcctgacctacgcctttatgaccgacgacttttccgtcgcctatgtcgccagcaactccaacagcgctttgccctggtactacaagttcagcgccgtctggggtgcccacgaaggctccctgctgctgtgggccttcatcctcggcggctggacctttgcggtgtcggtgttctcccggcagttgccgcaagtgatgctggcgcgggtgctggcggtgatgggcatgatcagcatcggcttcctgctgttcttgatcatgacctccaacccgttcgagcggattctgccgcagattcccgtggacggtcgcgacctcaacccgctgctgcaggatatgggcctgatcgtccacccgccgatgctatacatgggttatgtgggcttctccgtggctttcgcctttgccatcgccgccttgctcggcgggcgtctcgacgccgcctgggcgcgctggtcgcggccgtggaccatcgtcgcctgggccttcctgggtatcggcatcaccctgggctcgtggtgggcctactatgaactcggctggggcggctggtggttctgggacccggtggaaaacgcctccttcatgccctggctggtgggcacggcgctgattcactccctggcagtcacggaaaaacgcggcgtgttcaagagctggacggtgttgctggccatcgccgccttctccctgagcctgctgggcaccttcctcgtgcgttccggcgtgctgacgtcggtgcatgcgttcgctgccgaccctgagcgcggcgtgttcatcctgatcttcctgctgtgcgtggtgggcggctcgctgaccctgttcgccctgcgtgcgccggtggtcaagagccacgtgggcttcaacctgtggtcgcgggaaaccctgctgctggggaacaacctggtcctggtggtcgccgcttcgatgatcctgctgggcaccctgtacccgctggtgctcgatgccctgaccggcgccaaactgtcggtcggcccgccgtacttcaacgccttgttcatcccgttgatgggcctgctgatggtggtgatggcgattggcgtgctggtgcgctggaaagacaccccggtcaaatggctgctgggcatgctcactccggtgctgctgggcagtgccgccttgtcggtgattgccgggattcctacggcgacttcaactgggccgtgctcgcgactttcatgctggcggcctgggtgttactggccgcgtgcgcgatatcttcgacaagacccgccacaagggcctgatcaaaggcctgccgaccctgacccgcagttactggggtatgcagatcgcccacatcggcatcgccgtgtgtgccctgggcgtggtgttgtccagccagaacaggcccgagcgcgacttgcgcctggcccctggcgagtccatggctcgccaggggccaggcgcaagtctgcgctcggcgctgttctggctggacaacaccacgcccagggcacacacggcgatgccgatgtgggcgatctgcataccccagtaactgctgggtcaagggtcggcaggcctttgatcaggcccttgtggcgcatggacctggcgggctaccagttcgtgtttgaaggtgccaagcacttcgaagggccgaacttcacttccgacaaaggcaccgtgcgcgtggtgcgcaacggcaagcaaatcgccgtgctgcacccggagaaacgcctgtacaccgtgcaaagctcgatgatgaccgaagccgggatcgacgccgggttcacccgtgatctctacgtggcactgggcgagccgttgggcgatggcgcctgggccgtgcgcgtgcacgtcaaaccgtttgtgcgctggatctggttcggtggcctgctgaccggcttcggcgggttgctggccgcgatggaccggcgttaccgggtcaaggtcaagagccgggtgcgtgaagcccttggcatgcaaggagccgctgtatga

SEQ ID NO: 68117 - protein, 714 aa, Pseudomonas fluorescens
MTSTLFIPELGQLAMILALCFAIVQAIVPLLGAWRGDRLWMSLAQPALGPVRVPGVRFGCLTYAFMTDDFSVAYVASNSNSALPWYYKFSAVWGAHEGSLLLWAFILGGWTFAVSVFSRQLPQVMLARVLAVMGMISIGFLLFLIMTSNPFERILPQIPVDGRDLNPLLQDMGLIVHPPMLYMGYVGFSVAFAFAIAALLGGRLDAAWARWSRPWTIVAWAFLGIGITLGSWWAYYELGWGGWWFWDPVENASFMPWLVGTALIHSLAVTEKRGVFKSWTVLLAIAAFSLSLLGTFLVRSGVLTSVHAFAADPERGVFILIFLLCVVGGSLTLFALRAPVVKSHVGFNLWSRETLLLGNNLVLVVAASMILLGTLYPLVLDALTGAKLSVGPPYFNALFIPLMGLLMVVMAIGVLVRWKDTPVKWLLGMLTPVLLGSAALSVIAGIPTATSTGPCSRLSCWRPGCYWPRARYLRQDPPQGPDQRPADPDPQLLGYADRPHRHRRVCPGRGVVQPEQARARLAPGPWRVHGSPGARRKSALGAVLAGQHHAQGTHGDADVGDLHTPVTAGSRVGRPLIRPLWRMDLAGYQFVFEGAKHFEGPNFTSDKGTVRVVRNGKQIAVLHPEKRLYTVQSSMMTEAGIDAGFTRDLYVALGEPLGDGAWAVRVHVKPFVRWIWFGGLLTGFGGLLAAMDRRYRVKVKSRVREALGMQGAAV

SEQ ID NO: 68118 - DNA, 2001 bp, Rhizobium etli
  CDS (1)..(2001): transl_table=11
atgatcatcgagatcggccattacgctctggtcgtgcggctggcgacggcgctgatcgtctcgatcgtgcctgtcatcgcggcccgccgtcatgatccggcgctgatggatgtggcgacatcaggttcgctggcgatgtttgcccttgtcgcctttgccttcgccgtcttgacctatgcccatgtcgtctccgacttctccgtcgagaacgtctgggagaattcgcattcgctggtgccgctgatctacaaatattccggcgtctggggcaatcacgagggatcgatgatgctctggctgctgatcctggcgctgttcagcgcgctggtcgcgatcttcggcgccaatctgccggagacgctgaaagccaatgtgcttgccgtgcaggcctggatctcgctcgccttcaccctgttcatccttttgacctccaatcccttcctgcggctcgatccggccccggccgagggccgcgatctcaatccggtgctgcaggatgtcgggctcgccatccacccgccgctgctctatctcggctattgtcggcttttccgttgcttctccttcgccgttgcagccctcattgaaagccgcatcgacgccgcctgggcgcgctgggtccggccctggacgctcgccgcctggacctgcctgacgcttggcatcgccatgggctcctactgggcctattacgagctcggctggggcggctggtggttctgggacccggtggaaaacgcctcgttcatgccgtggctcgccggcaccgcgctgctgcattcggcgctcgtcatggaaaagcgcgaggcgctgaagatctggacggtgctgctcgccatcctgaccttctcgctgtcgctgatgggcaccttcctggtgcgctccggggtgctgacctcggtgcatgcctttgccagcgatcccacccgcggcgttttcatcctgtcgatcctgctgatcttcatcggcggagcgctgtcgctgtttgccctgcgggcgccgaagcttgcggccggcgggctgtttgcgccgatctcgcgcgagggggcgctcgtcctcaacaatctgatcctgacggtcgcctgcggcacggtgctgaccggcacgctctatccgctgctgttggaaacgctgaccggcgacaagatctccgtcgggccgcccttcttcaacctgaccttcggcctgctgatggcgccgctgctcgtcatcgtgccgttcgggccgctgctggcctggaagcgcggcgatctgctcggcgccctgcagcggctctacgttgtcgcggctctcgccttcaccgccgcggtcatcgtcttttatctccaacatggcgggccggtgctctccgtgctcgggctcgggctggcgccgggctgttcctggatcctcggcgccgttgccgatctctggtatcgggccggcatctgcataggtcgccgggcagcatcgcctggcgccgcctttccggcttgccgcgctcggccttcgcacgcgcttgcccatgccggcctcgcggtcacggtgctcggcatcgtcgccgtcaccaccttccagagcgaacatgttgtcgcgatgaagccgggcgagataatcgaggccgggggctacagccttgcgttcgacggcatgcgcccgggcagggacccgaactacaccgaggagcgcggccayttcaccatccgacgcgccggggttgcggtcgccgagacctggtcggccaagcgcctttacaccgcccggcagatgccgacgacggaggccggcatccagaccttcggtctcagccagctctatgtctcgctgggcgacgccaccaaggacggcggcatcgtcgtgcgcatctggtggaagccgttcatcctgtgcatctggggcggcgcgatgatcatggccgccggcggcctcgtctcgctctccgaccggcgcctgcgtgtcggcgcaccgcggagaaaggctaaggcaaaaccgacgacgcctgcgatggagccggcggaatga

SEQ ID NO: 68119 - protein, 666 aa, Rhizobium etli
MIIEIGHYALVVRLATALIVSIVPVIAARRHDPALMDVATSGSLAMFALVAFAFAVLTYAHVVSDFSVENVWENSHSLVPLIYKYSGVWGNHEGSMMLWLLILALFSALVAIFGANLPETLKANVLAVQAWISLAFTLFILLTSNPFLRLDPAPAEGRDLNPVLQDVGLAIHPPLLYLGYCRLFRCFSFAVAALIESRIDAAWARWVRPWTLAAWTCLTLGIAMGSYWAYYELGWGGWWFWDPVENASFMPWLAGTALLHSALVMEKREALKIWTVLLAILTFSLSLMGTFLVRSGVLTSVHAFASDPTRGVFILSILLIFIGGALSLFALRAPKLAAGGLFAPISREGALVLNNLILTVACGTVLTGTLYPLLLETLTGDKISVGPPFFNLTFGLLMAPLLVIVPFGPLLAWKRGDLLGALQRLYVVAALAFTAAVIVFYLQHGGPVLSVLGLGLAPGCSWILGAVADLWYRAGICIGRRAASPGAAFPACRARPSHALAHAGLAVTVLGIVAVTTFQSEHVVAMKPGEIIEAGGYSLAFDGMRPGRDPNYTEERGHFTIRRAGVAVAETWSAKRLYTARQMPTTEAGIQTFGLSQLYVSLGDATKDGGIVVRIWWKPFILCIWGGAMIMAAGGLVSLSDRRLRVGAPRRKAKAKPTTPAMEPAE

SEQ ID NO: 68120 - DNA, 1995 bp, Rhizobium leguminosarum
  CDS (1)..(1995): transl_table=11
atgatcatcgagatcggccattacgcgctggtgctggcgctggcaacggcgctcatcctctccatcgtgccggtaatcggagcccgtcgtcacgaccgggcgatgatggatgtggcgacgatcggctcgctggcgatgttctcgctggtggccttctccttcggcgtgctgacctatgcccatgtcgtctcggatttctcggtcgagaacgtctgggagaattcgcattctctggtgccgctgctctacaaatattccggcgtctggggcaatcacgaagggtcgatgatgctctggctgttgatcctgacgctgttcagcgccctggtcgccgtcttcggccgcaatctgccggagacgctgaaggccaatgtactttccgtgcaggcctggatatcggtcgccttcacgctgttcattctgttgacctccaatcccttcctccggctcgatccggcgccggccgagggccgcgatctcaacccggtccttcaggatgtcggtctggcgatccacccgccgctgctctatctcggctattgtcggcttctccgctgtttctcctttgcggtcgcggccctgctggaagggcggatcgacgccgcctgggcccgctgggtgcggccctggacgcttgccgcctggacctttctgacgcttggcatcgccatgggctcttactcttactgggcctattacgagctcggctggggcggctggtggttctgggacccggtggaaaacgcctccttcatgccatggctcgccggtaccgcactgttgcattctgccctcgtcatggaaaagcgcgaggcgctgaagatctggacggtgctgctggccatcctcaccttttcgctgtcgctgatgggcaccttcctggtgcgctccggcgtgttgacctcggtgcatgcctttgccagcgacccatcccgcggcgttttcattctctgcatcctgctgatcttcatcggcggggcgctgtcgctatttgctttccgcgcgccgcggctgtcggcaggcgggctgtttgcgccgatctcgcgcgagggcgcgctcgttgtcaacaatcctgatctgacggtcgcctgcggcacggtgctcaccggcacgctctatccgctgctcttggaaacgctgaccggcgacaagatttccgtcgggccgcccttcttcaacctgaccttcggcctgctgatggcgccgctgatcgtcatcgtccccttcgggccgatgctggcctggaagcgcggcgatctgctcggtgccctgcagcggctctatgtcgtggcaggtcttgccttccttgccgcagtaatcttcttctacatcgaacatggcgggccggtgctgtcagtgctcggcctcgcgccgggctgttcctggatcctcggcgccgtcgccgatctctggtatcgcgccggcatctgtataggtcgccgggccgtcttgcctggcgccggctttccggcctgccgtgttcgcttcggcaccgcccttgcccatgccggactcggcgtcaccgtgcttggcatcgtcgcggtgacgacgttccagagcgagcatgtcatcgagatgaagccgggtgaggtgaccgaggccggcggttatagcctgcatttcgacggcatgcagccggggaccgaaccgaactataccgaggagcgtggccacttcaccatccgacgtgccggcgtcgcggttgccgatacctggtcggccaagcgcctttataccgcccggcagatgccgacgacggaggccggcatcctgaccttcgggctgaggcagctctatgtctctttgggtgatgccaccaaggacggcggcatcgtcgtacgcatctggtggaagccgttcattctctgcatctggggcggcgcggtgttcatggccttcggcggcctcgtctcgctcagcgaccggcgcctgcgtgtcggcgccccggccaaggcaagcgcaaagccggctcccgcaatggagccggcggaatga

SEQ ID NO: 68121 - protein, 664 aa, Rhizobium leguminosarum
MIIEIGHYALVLALATALILSIVPVIGARRHDRAMMDVATIGSLAMFSLVAFSFGVLTYAHVVSDFSVENVWENSHSLVPLLYKYSGVWGNHEGSMMLWLLILTLFSALVAVFGRNLPETLKANVLSVQAWISVAFTLFILLTSNPFLRLDPAPAEGRDLNPVLQDVGLAIHPPLLYLGYCRLLRCFSFAVAALLEGRIDAAWARWVRPWTLAAWTFLTLGIAMGSYSYWAYYELGWGGWWFWDPVENASFMPWLAGTALLHSALVMEKREALKIWTVLLAILTFSLSLMGTFLVRSGVLTSVHAFASDPSRGVFILCILLIFIGGALSLFAFRAPRLSAGGLFAPISREGALVVNNPDLTVACGTVLTGTLYPLLLETLTGDKISVGPPFFNLTFGLLMAPLIVIVPFGPMLAWKRGDLLGALQRLYVVAGLAFLAAVIFFYIEHGGPVLSVLGLAPGCSWILGAVADLWYRAGICIGRRAVLPGAGFPACRVRFGTALAHAGLGVTVLGIVAVTTFQSEHVIEMKPGEVTEAGGYSLHFDGMQPGTEPNYTEERGHFTIRRAGVAVADTWSAKRLYTARQMPTTEAGILTFGLRQLYVSLGDATKDGGIVVRIWWKPFILCIWGGAVFMAFGGLVSLSDRRLRVGAPAKASAKPAPAMEPAE

SEQ ID NO: 68122 - DNA, 1977 bp, Acetobacter diazotrophicus
  CDS (1)..(1977): transl_table=11
atgacgccggaactgggcaatttcgcgctggcgctggcctgctgcctggccggcgggcaggcgatcctgccgctggtgggcgcgcggcggcgcgacccgcggctgatggcgctggcccccgccctggcggtggggcagatgctggcgctggccttttccttcgcatgcctgatcgatgcggcggtgcgtgacgatttctcggtccagaacgtcgcggccaacagcgccgccgccaagccgctgctgtacaaaatcaccggcgtatggggcaatcacgagggatcggtactgctgtgggcgctgatcctggggatctgcggcggggcggtggcactgttcggccgcaacctgccctctgccctgcgggcgcgggtcatcgcggtcctgggcggcgtttcggccggcttccagctgttctgcctgacgacgtccaatccgttcgaccgcgtctggcccgcgccgatggacggccagggcatgaacccgctgctgcaggacccgggcctggccttccatccgcccattctctacaccggctatgtcggcttcgccgtgcccttcgccttcgccgtcgccgccctgatcgagggacgggtggacgccgcctggggccgctgggtccgcccctgggccgtcgcggcctggtgcttcctgacctgcggcatcgcgctggggtcgtggtggtcgtactacgtgctgggctggggcggctactggttctgggacccggtggaaaacgcgtcgctgatcccgtggctgaccggcaccgcgctggtccattccgccatcgtggtggaaaagcgcgaggcgctgaagatctggaccgtgctgctggcatcggacatttcgttctcgctgtccggcacgttcctggtccgctcgggcattctcaattccgtccatgccttcgccaacgacccggcgcgcggcatcttcatcctgggcctgctggcgctggtcatcggcgggtcgctgctgctgttcgcgatccgcgcgccggcgctggtggcgggcggcctgttcgcgccggtctcgcgcgaggggctgctggtcgtgaacaatatcctgctgtgctcgatctgcgcggtggtgctgaccgggaccatgtatccgcccttcatgtcgctgctgttcggcaagacgatttcggtcggcaagccgttcttcgacgccacggcggcgccgctggcgattccgcttctggccttcatggggttcggcccgatgatgccgtggaagcgcgcccagttctggcccgtgctgcgccggctgtggtgggccgggatcgtcaccgccctcgccttctgcctgatggcctggcgcatccgcgacgtgctgccgctgctggccgcgaccggcgcggtctgggtgatcgcggccagcgtcgccgacattgccgagcgcgtccgcctgttccgcatcccgcccggcgccagcctgcagcgcgcgcgcatgctgccgcgcgcggcgctgggcgcggccctggcccatgccggcgtcggcatcagcgtgctggggctggccgccatgtcgcaggcccagcaccgcatcgtcgaggtccgggtcggccagaccgagatgctggccggcgacgcctggaccctgaccgcgatccgcgcggcccccggcccgaactacacgtccctgatcgcgacgatcgaggtccggcatgacggcaggctggtcaccgtgctgcatccgtccaagcgcaccttccccagccagaaccagacgacgaccgaggtcgccatccataccaacctgatgtccgacctgtacggcgtgctgggcgaccggcacggcaccgacgccgacccgacctacgtgctgcgcctgcactacaatccgctggcgccgtggatctgggctggcgggctgatcatggcgctgggcggggcgctgtcgctgtccgaccggcggacgcgcgtcggcgcgccgcgccgcgccgccgcccccggcatggtggccgcgcaatga

SEQ ID NO: 68123 - protein, 658 aa, Acetobacter diazotrophicus
MTPELGNFALALACCLAGGQAILPLVGARRRDPRLMALAPALAVGQMLALAFSFACLIDAAVRDDFSVQNVAANSAAAKPLLYKITGVWGNHEGSVLLWALILGICGGAVALFGRNLPSALRARVIAVLGGVSAGFQLFCLTTSNPFDRVWPAPMDGQGMNPLLQDPGLAFHPPILYTGYVGFAVPFAFAVAALIEGRVDAAWGRWVRPWAVAAWCFLTCGIALGSWWSYYVLGWGGYWFWDPVENASLIPWLTGTALVHSAIVVEKREALKIWTVLLASDISFSLSGTFLVRSGILNSVHAFANDPARGIFILGLLALVIGGSLLLFAIRAPALVAGGLFAPVSREGLLVVNNILLCSICAVVLTGTMYPPFMSLLFGKTISVGKPFFDATAAPLAIPLLAFMGFGPMMPWKRAQFWPVLRRLWWAGIVTALAFCLMAWRIRDVLPLLAATGAVWVIAASVADIAERVRLFRIPPGASLQRARMLPRAALGAALAHAGVGISVLGLAAMSQAQHRIVEVRVGQTEMLAGDAWTLTAIRAAPGPNYTSLIATIEVRHDGRLVTVLHPSKRTFPSQNQTTTEVAIHTNLMSDLYGVLGDRHGTDADPTYVLRLHYNPLAPWIWAGGLIMALGGALSLSDRRTRVGAPRRAAAPGMVAAQ

SEQ ID NO: 68124 - DNA, 1953 bp, Legionella pneumophila
  CDS (1)..(1953): transl_table=11
atgatagcggaattaggactgttttttttgattttggctttagtggcttctttgatgttagctttgatcccattagctggtttgcaattcaatcggaaagactggattgattcctccaggaattatgtcgtgctgcaatttttatttgtggcatgtgcttacctatgtctcacggcctgttttttgatggatgatttttcggtgatctatgtgctgaataactccagcttattgctcccatggttttataaattttgtgctgtgtggggtgggcatgaaggttccatgctgttatgggttgctatccttagtttttggatgatcctggtttgtttttttagctcaagccttgatacggaaatgcgcgctcgggtattagttattttaggttggctaagcattggttttattctttttttgttaatgacttccaatcctttcttgcgccaatttcaagtattgaatacacagggccgtgatctgaatccattgctgcaagatcctggctttttattccatcctcctatgttgtacatgggatatgtagggttttgtgtcgcttttgcttttgctattgccgccttgtgggcagggaaagtagaaaccagttggtctaaatggaccagaccctggactctggctgcctggtgttgtttaaccgcgggaattactttgggcagttggtgggcttatagagaattaggctggggtggttggtggttttgggatcctgtagaaaacgcttcttttatgccctggctggttggtacggcactattgcattctttggcagttacagagcagcgccagcaatttaaagcgtggaccatgttgcttgcaatcgctgctttttctttaagtttaattggtacttttcttgttcgctctggagttttaacttcagttcatgcctttgcggttgatcctcagcggggattatatattctgggatttttgttattcgtcattgggggttctttaacattgtttcttttcagagcccaaaccttgcaagtcaataaacatcctggcttattatcccgagaaagtgcgttgttgttaaacaatgtgtttttagtggttattatgctgacggtattaatgggcacggtttatccattgctggtggaagggttagggttaggcaaattatccgttggagcgccctattttaatgcagtatttgttccattaataattcctttattattgctaatggggttaggtgtccgtttgaaatggcagaatgattgttggagggatgtcttcagaaaactaaatcgtatttttttgcttagtctgatattgcctgtcattttactattctgtacctcaactgaaatacaccttacagcccttttgggattaattttggcattctgggttttgttgagtactgctaatgcggcgtatcacaaagtcagagatagaggggtggcaggagttggacaggcttattgggggatggttttggctcattgtggtgtcgcagcaacagtgattggcattgctgtttcttcagcttatggcgtacaagatgatgtacgtatgtctcctggcaagcaagtgagtctgctggattatcagattggattcattaatcagactccgttgaatggcccaaattacaaagggacaagggctgagttttcaatacaatatcagaataaaactaggcaaatttttcctgaaaaaagagtgtataccattggacaaatgccaatgactgagtctgcgattgatgtgactcctttccgagatatttacattgctttgggggagccactgtctgaggatgcctggtcggtccgaatttattataaaccgttggtccgctggatatgggctggcggatttatgattttagccggaggcgttttggcattaacagatagaaggtattacagaaaaaggcaagtaacggtaatggcagggcaggagatcaagatatga

SEQ ID NO: 68125 - protein, 650 aa, Legionella pneumophila
MIAELGLFFLILALVASLMLALIPLAGLQFNRKDWIDSSRNYVVLQFLFVACAYLCLTACFLMDDFSVIYVLNNSSLLLPWFYKFCAVWGGHEGSMLLWVAILSFWMILVCFFSSSLDTEMRARVLVILGWLSIGFILFLLMTSNPFLRQFQVLNTQGRDLNPLLQDPGFLFHPPMLYMGYVGFCVAFAFAIAALWAGKVETSWSKWTRPWTLAAWCCLTAGITLGSWWAYRELGWGGWWFWDPVENASFMPWLVGTALLHSLAVTEQRQQFKAWTMLLAIAAFSLSLIGTFLVRSGVLTSVHAFAVDPQRGLYILGFLLFVIGGSLTLFLFRAQTLQVNKHPGLLSRESALLLNNVFLVVIMLTVLMGTVYPLLVEGLGLGKLSVGAPYFNAVFVPLIIPLLLLMGLGVRLKWQNDCWRDVFRKLNRIFLLSLILPVILLFCTSTEIHLTALLGLILAFWVLLSTANAAYHKVRDRGVAGVGQAYWGMVLAHCGVAATVIGIAVSSAYGVQDDVRMSPGKQVSLLDYQIGFINQTPLNGPNYKGTRAEFSIQYQNKTRQIFPEKRVYTIGQMPMTESAIDVTPFRDIYIALGEPLSEDAWSVRIYYKPLVRWIWAGGFMILAGGVLALTDRRYYRKRQVTVMAGQEIKI

SEQ ID NO: 68126 - DNA, 1965 bp, Rhodobacter sphaeroides
  CDS (1)..(1965): transl_table=11
atgattgtcgaattcggccatttcgcgctggtgctgtcgctggctgtggcctttgtgcaagtccgtggtgccgttcgtcggcggcgaatcggcgttgttctggctggatggcggtgccgaacccgcggcggtcaccccagttctgctgatcggttctctttcgccgcgctgacctgggccttcgcgacctcggatttctcggtgcgcctcgtggtgctgaactcgcacacgctgaagcccatgctctacaagatcagcggcgtctgggggaaccacgagggctcgctgctcctgtgggtgctgatcctcgcgctgttcggagcctgcgccgcggtcttcgggcagaacctgccgcccacgctcaaggcgcgcgtgctggcggtgcaggggatgatcggcgcggccttcctggcctttctcctcttcacctcgaacccgttcctgcgcatgggcgaggtgcccttcgacggcgaggatctgaacccgcttctgcaggatccggggctcgccttccacccgcccttcctttacctcggctatgtcggcctctcgatggccttctccttcgcggtggcggccctgatcgagggccgcgtcgatgccgcctggggccgctgggtccggccctggacgctcgccgcctgggtgtttctcaccatcggcatcgcgctcggctcctggtgggcctattacgagctcggctggggcggcttctggttctgggacccggtcgagaacgcctccttcatgccctggctgatcgcggcggcgctgctccactctgccatcgtggtcgagaagcgcgaagcgctgaagagctggacgatcctgctggccatcctcgccttcggcttctcgctcattggcaccttcatcgtgcgctcgggcgtcatcacctccgtccatgccttcgccaacgatcccgagcgcgggatcttcatcctgatgatcctcgcggtcttcatgggcggggcgctcacgctcttcgccgcgcgggcgagcgccatggaggccaagggggtcttcggcatcgtcagccgcgagtcgggcctcgtgctgaacaacgtgctgctgacggtggcctgtttcgtggtcttcatcggcacgatctggccgcttcctgccgaactcctctggggccgcaagctgtcggtgggtgctccgttcttcaacgcggccttcacccccttcatggtggtgatcgccctcgtcctgccttatgggcgccgtcctccctggaagcgggccgagctcggccgcgggatgcggccgctctggggggcgctcgcgctctcggcggccctgggtgcgctggtcttcgcgctgcagacgggccggtcggcgctcgggcccgtcggcctcgcgctcggcgcctggctcgtcttcggcacgctcctcgacctctggggccgcaccgggcgcggcgcgctcggcgggcggctcgcgcgcctccggcgactgccgcgcgcggactggggcaaggccactgcccatgcgggcctcggcgtcacgatcttcgccgtggcggccatcaccgcctggcaggtcgagtcgatccgcgtgatgaagccgggcgagaccttcgccctcggccgctacgacgtcctgctcgagggcgtgcgcgagatcgaagggccgaactaccgctcgaccgtggccgacttccgcgtgacccgcgacgggccgaatggcgaactccatcccgagaagcgcgtctatccggtggccgccatgccaacgacggaagcgccatcgatacggttcacccgcgactcttacctcgtgatcggcgacccgcaggagggcggcggctatgcggtgcgcagctacatcaagcccttcgccaactggatctggggcggcgcgctgctgatggcgctcggcgggctgctgagcctctcggaccgccgctaccgcatcgccgccggggcgcgccggatgccggccgcggtggctgcagaatga

SEQ ID NO: 68127 - protein, 654 aa, Rhodobacter sphaeroides
MIVEFGHFALVLSLAVAFVQVRGAVRRRRIGVVLAGWRCRTRGGHPSSADRFSFAALTWAFATSDFSVRLVVLNSHTLKPMLYKISGVWGNHEGSLLLWVLILALFGACAAVFGQNLPPTLKARVLAVQGMIGAAFLAFLLFTSNPFLRMGEVPFDGEDLNPLLQDPGLAFHPPFLYLGYVGLSMAFSFAVAALIEGRVDAAWGRWVRPWTLAAWVFLTIGIALGSWWAYYELGWGGFWFWDPVENASFMPWLIAAALLHSAIVVEKREALKSWTILLAILAFGFSLIGTFIVRSGVITSVHAFANDPERGIFILMILAVFMGGALTLFAARASAMEAKGVFGIVSRESGLVLNNVLLTVACFVVFIGTIWPLPAELLWGRKLSVGAPFFNAAFTPFMVVIALVLPYGRRPPWKRAELGRGMRPLWGALALSAALGALVFALQTGRSALGPVGLALGAWLVFGTLLDLWGRTGRGALGGRLARLRRLPRADWGKATAHAGLGVTIFAVAAITAWQVESIRVMKPGETFALGRYDVLLEGVREIEGPNYRSTVADFRVTRDGPNGELHPEKRVYPVAAMPTTEAPSIRFTRDSYLVIGDPQEGGGYAVRSYIKPFANWIWGGALLMALGGLLSLSDRRYRIAAGARRMPAAVAAE

SEQ ID NO: 68128 - DNA, 1968 bp, Pantoea citrea
  CDS (1)..(1968): transl_table=11
atgatacctgaaataggcagttttttgttatgcctggcccttggctgggctgtgttactgagtatttacccgctgtggggagccgcgcgacaggacagtcgtttgatgggactggcccggcctttgacttatggtttgtttacctgtattgcggcacgatttctgattctggtgcattcttttattgtcaacgactttactgtggcctatgtcgctgagaactccaataccatgctgccaatctggtaccgcattgcagcaacctggggagctcatgagggatcgttactgctctggttactgatgctcagtggctggacactggcggtacggttgctgagtcgtggtatgccacaggatgccattgcccgggtgctggcggtgatgggcatgattaaccttggcttcctgctgtttattactctgacctccaacccgtttatccggacattacctgatttccccgttgatggcagcgatctcaacccaatgctccaggatatcggactgattttccacccgccattactctatatggggtacgtcggattctcagtggcatttgcgtttgccattgcttcactgatgaccgggcggctcgatacggcatgggcccgctggtcacgtccgtggacgacagcggcgtggattttcctgaccatcgggattgttttagggctcggctgggcttattacgacctgggctggggtggctggtggttctgggatccggttgaaaatgcctcgctgatgccgtggctggccggaaccgcattgattcactcactggcggtgacagagaaacgcgggacctttaaatcctggactgtgttactggctattaccgccttctcactgagtctgttggggaccttcctggtacgttcaggtgtcctggtatcggttcactcgttcgcgtccgatccttcccgtggtatttttattctgatattcctggtgattgtcatcggatgttcgttactgctgtacgctatccgtggtggacaggtgcgtagcagggtacagcctgaaggctggtcgagagagtcgtttctgttaggaaataatgttctgttgattgccgctatgctggtggtattgctggggactttgttacccctggtacacaaggaactgggcctgggcagcatttcgattggtgcgccgttcttcaatactatgtttacctggctgatggcgccgtttgctctgatgttgggtattgggcctctggtacgctggcgtcgtgatgaacctcagaaattgtataagcggttaattattgcggcggttgtcactctgattgcttccgttgtcctgccattactgttgcaggaccgtattgaagcgatgacggtggttggtctgctgatgtcagtctgggtaattgtactgacgctgatggaacttcatgagcgtgcaacccatcgccatacctttttccgtgggctgggacatctgtcccgcagtcactggggaatggttctggggcatcttggcgtggcggtgacggtgattggaatagcgttcagtacccaatacagtgttgaacgcgatgtccgtatgaaagccggtgataacgtcgatatccataattatcattttgttttccgtgatgttcagcgcctggtgggtcctaactataccggcggggtggcaattattgatgtcacccgcaacggaaaacaagaagctgtgctgcatgcagagaaacgtttttataccgccgcccgcaccatgatgacgatggtgcaatcagtggcggttttggccgcgatctttacgcacgcagccctgggtgaagagataggccagggttcctgggccgttcgtctctattacaaaccttttgttcgctggatttggttcggtggtgtgtttatggcggttggcggtattttgtgtctgctcgacccgcggtatcgctcccgcaagaaagcacaggcacaggaggaatcactgtcatga

SEQ ID NO: 68129 - protein, 655 aa, Pantoea citrea
MIPEIGSFLLCLALGWAVLLSIYPLWGAARQDSRLMGLARPLTYGLFTCIAARFLILVHSFIVNDFTVAYVAENSNTMLPIWYRIAATWGAHEGSLLLWLLMLSGWTLAVRLLSRGMPQDAIARVLAVMGMINLGFLLFITLTSNPFIRTLPDFPVDGSDLNPMLQDIGLIFHPPLLYMGYVGFSVAFAFAIASLMTGRLDTAWARWSRPWTTAAWIFLTIGIVLGLGWAYYDLGWGGWWFWDPVENASLMPWLAGTALIHSLAVTEKRGTFKSWTVLLAITAFSLSLLGTFLVRSGVLVSVHSFASDPSRGIFILIFLVIVIGCSLLLYAIRGGQVRSRVQPEGWSRESFLLGNNVLLIAAMLVVLLGTLLPLVHKELGLGSISIGAPFFNTMFTWLMAPFALMLGIGPLVRWRRDEPQKLYKRLIIAAVVTLIASVVLPLLLQDRIEAMTVVGLLMSVWVIVLTLMELHERATHRHTFFRGLGHLSRSHWGMVLGHLGVAVTVIGIAFSTQYSVERDVRMKAGDNVDIHNYHFVFRDVQRLVGPNYTGGVAIIDVTRNGKQEAVLHAEKRFYTAARTMMTMVQSVAVLAAIFTHAALGEEIGQGSWAVRLYYKPFVRWIWFGGVFMAVGGILCLLDPRYRSRKKAQAQEESLS

SEQ ID NO: 68130 - DNA, 1983 bp, Bradyrhizobium japonicum
  CDS (1)..(1983)
atgatcgcggaatccgggcattacgcgctggtgctggcgctcgggctggcactgatccaatccatcgtgccgttgatcggcgcgcggctgcgcgacgatgcgctgatgagcgtggcgcgctccaccgcgctggcgcagctgctgttcgtcggcgcctcgttcgtggcgctggtgatgctgcatgtgaattcggatttctccgtcgccaacgtctacgagaattcgcattcgatgaagccgctgctctacaagatcaccggcgtctggggaaaccatgaaggctcgatgctgctgtgggtgtcgatcctggcgctgttcggcggattggtcgcggcgttcggcaacaatcttccgctgtcgctgcgcgcgcatgtgctcgcggtgcaggcctggatcgccagtgccttctatctcttcatcctggtgacctcgaacccgttcctgcgtatcgccaacccgccgatcgagggacgcgatctcaatcccgtgctgcaggacatcggtctcgccgtgcatccgccgatgctctatctcggctatgtcggattctcgatctcgttctcctttgccatcgcggcgctgatggaggggcggatcgacgccgcctgggcgcgctgggtgcggccgtggacgctggtcgcgtggatcttcctgacgctcggcatcgcgatgggctcctactgggcctattacgagctcggctggggcggctggtggttctgggatccggtcgagaacgcctcgctgatgccgtggcttgccgggacggcgctgctccattcggcgctggtgatggagaagcgcaacgcgctgaaggtctggaccatcctgctgtcgatcctgaccttctcgctatcgctgctcggcaccttcctggtgcgctcgggcgtcatcacctccgtgcatgcctttgccaccgatccgacccgcggcgtgttcattctgctgatcctctgcctgttcatcggcggcagcctgtcgctgttcgcaggccgcgcgacatcgttgaagcagggcggcctgttcgcgccgatctcgcgtgagggcgcgctggtgctgaacaatctgctgctgaccgtcgcctgcgcggtcgtgctgttcggcacgctctatccgctggcgatggagatgctcgccgacttcaagatgtcggttggcgcgccgttctacaacctcaccttcgcaccgctgtttgccctgttgctgctcgccgtgccgttcgggccgatgctggcgtggaagcgcggcgatctgctcggcgtcacccagcggctgctcgcggccggcgttgccgggctcgttgtagtcgcgatcgtctgggcctggacgcgtggcggcagcgcgctcgcaccgctcgcgatcggacttggcgtcttcgtcatcgccggcgccgtcaccgatctggtcgagcggacgggcctggttcgtctgccgctcgcaacagcgctgcagcgggcgcgcggcctgccacgctcggcctggggcgcggcattggcgcatgccggcctcggcgtcgcgctgatcgggatcgtctgcgagaccacctggaacagcgaatatatcgcgacgatgaagcggagcgacgtcgcccatgtcgccggctacgacgtgaagctcgacgggttgtttcagcgtcagggcccgaactaccgcgagatgatcgccgagttcaacgtcagccgcgacggtgagacactgagcgtcatgacgccgtccaagcgcagcttcaccacccgcggctcctccaccacggaggccgcgctgctgacccgcggggcgagccagctctacatctcgctgggcgatgccaatgccgagggcgcgattgccgtgcgcatctatcacaagccgctggtgctgctgatctggtggggtccggtgctgatggccttcggcggcgtgctgtcgctgtccgatcgccgcctgcgggtcggcgcgccaaaaccggcgcgggccaagcagcgcctgcagccggcggagtga

SEQ ID NO: 68131 - protein, 660 aa, Bradyrhizobium japonicum
MIAESGHYALVLALGLALIQSIVPLIGARLRDDALMSVARSTALAQLLFVGASFVALVMLHVNSDFSVANVYENSHSMKPLLYKITGVWGNHEGSMLLWVSILALFGGLVAAFGNNLPLSLRAHVLAVQAWIASAFYLFILVTSNPFLRIANPPIEGRDLNPVLQDIGLAVHPPMLYLGYVGFSISFSFAIAALMEGRIDAAWARWVRPWTLVAWIFLTLGIAMGSYWAYYELGWGGWWFWDPVENASLMPWLAGTALLHSALVMEKRNALKVWTILLSILTFSLSLLGTFLVRSGVITSVHAFATDPTRGVFILLILCLFIGGSLSLFAGRATSLKQGGLFAPISREGALVLNNLLLTVACAVVLFGTLYPLAMEMLADFKMSVGAPFYNLTFAPLFALLLLAVPFGPMLAWKRGDLLGVTQRLLAAGVAGLVVVAIVWAWTRGGSALAPLAIGLGVFVIAGAVTDLVERTGLVRLPLATALQRARGLPRSAWGAALAHAGLGVALIGIVCETTWNSEYIATMKRSDVAHVAGYDVKLDGLFQRQGPNYREMIAEFNVSRDGETLSVMTPSKRSFTTRGSSTTEAALLTRGASQLYISLGDANAEGAIAVRIYHKPLVLLIWWGPVLMAFGGVLSLSDRRLRVGAPKPARAKQRLQPAE

SEQ ID NO: 68132 - DNA, 1944 bp, Escherichia coli
  CDS (1)..(1944): transl_table=11
atgatgccagaaattggtaacggactgctgtgcctggcgctgggaattgcgctgctgctgtccgtgtatccgctatggggcgtggcgcgcggagatgcgcgcatgatggcgtcttcccgcttgtttgcctggctgctgtttatgtctgtggctggcgcatttctggtgctggtcaatgctttcgtggtcaacgacttcaccgtcacctatgttgccagcaactccaatacccagcttccggtgtggtatcgcgtggcggctacctggggcgcgcatgaaggctcgctactgctgtgggtgctgctgatgagcggctggacctttgcggtggcgatttttagtcagcgtattccgctggatattgtggcccgtgtactggcgataatggggatggtcagtgtcggctttttgctgttcattctctttacctctaacccgttctctcgcacgttgccgaacttcccgattgaaggtcgcgatcttaacccgctattgcaggatccggggctgatcttccatccgcctctgctttatatggggtacgtgggtttctcggtggcgtttgcttttgccattgcttctttgctgagcgggcgtctggacagcacttatgcgcgttttactcgtccgtggacgctggcagcgtggatcttcctgacgctcggcatcgtgctcggttccgcatgggcctattacgaactcggctggggtggctggtggttctgggatccggtagaaaacgcctcgtttatgccgtggctggtggggactgcgctgatgcactcactggcggtcactgaacaacgcgccagcttcaaagcgtggacattactgctggcaatcagtgccttctcgttgtgtctgttggggactttcctcgtgcgttccggcgtgctggtatcggtacacgcgtttgcgtctgatccggcgcgcggtatgtttatcctcgcctttatggtgctggtgattggcggttcgctgctgctgtttgccgcgcgtggacacaaagttcgctcacgcgtaaacaatgcgctgtggtcgcgggaatctttgctgttagcgaacaatgttttgctggtcgctgcgatgctggtggtgttgctggggacgctgctgccgttggtgcataagcaactgggactgggcagtatttcgattggcgaaccgttcttcaacaccatgtttacctggctgatggtgccgtttgcgctactgcttggtgtcggtcctctggtgcgctgggggcgggatcgcccgcgtaagatccgcaatttattgattatcgccttcatctctacgctggtgctgtcgctgctgttgccgtggctgttcgaaagcaaagttgtggcgatgacggtgctcggcctggcaatggcctgctggattgcggtgctggcaattgcggaagctgcgctacgtatttcacgcggcacgaaaaccaccttcagttattgggggatggtggcggctcaccttgggctggcagtgacaattgttggcattgcctttagccagaactatagcgttgagcgtgatgtgcgcatgaagtccggcgatagcgtcgatattcatgaatatcgcttcaccttccgtgatgtcaaagaggtgactggcccgaactggcgtggcggtgtggcgactatcggcgtaacgcgcgatggcaagccggaaacggtgctgtatgcggaaaaacgttattacaacactgccgggtcgatgatgaccgaagcggcaattgacggcggcatcacgcgtgacctgtacgcggccctcggtgaagagctggaaaacggcgcgtgggccgtgcgtctttactacaaaccatttgttcgctggatttgggcgggcgggctgatgatggcgttgggcggactgctgtgtctgtttgatcctcgctatcgtaagcgcgtgagtccgcaaaaaactgcgccggaggccgtatga

SEQ ID NO: 68133 - protein, 647 aa, Escherichia coli
MMPEIGNGLLCLALGIALLLSVYPLWGVARGDARMMASSRLFAWLLFMSVAGAFLVLVNAFVVNDFTVTYVASNSNTQLPVWYRVAATWGAHEGSLLLWVLLMSGWTFAVAIFSQRIPLDIVARVLAIMGMVSVGFLLFILFTSNPFSRTLPNFPIEGRDLNPLLQDPGLIFHPPLLYMGYVGFSVAFAFAIASLLSGRLDSTYARFTRPWTLAAWIFLTLGIVLGSAWAYYELGWGGWWFWDPVENASFMPWLVGTALMHSLAVTEQRASFKAWTLLLAISAFSLCLLGTFLVRSGVLVSVHAFASDPARGMFILAFMVLVIGGSLLLFAARGHKVRSRVNNALWSRESLLLANNVLLVAAMLVVLLGTLLPLVHKQLGLGSISIGEPFFNTMFTWLMVPFALLLGVGPLVRWGRDRPRKIRNLLIIAFISTLVLSLLLPWLFESKVVAMTVLGLAMACWIAVLAIAEAALRISRGTKTTFSYWGMVAAHLGLAVTIVGIAFSQNYSVERDVRMKSGDSVDIHEYRFTFRDVKEVTGPNWRGGVATIGVTRDGKPETVLYAEKRYYNTAGSMMTEAAIDGGITRDLYAALGEELENGAWAVRLYYKPFVRWIWAGGLMMALGGLLCLFDPRYRKRVSPQKTAPEAV

SEQ ID NO: 68134 - DNA, 1983 bp, Pseudomonas fluorescens
  CDS (1)..(1983): transl_table=11
atgacgtccgcactgtttattccggagctgggccagttgcggatgatcctcgccctgtgctttgccgtggtccaggctgtggtgccattgctcggcgcctggccgggtgaccgcctgtggatgagcctggcgcagccggcgcgctggggccagtttgccttcctgttgttcgccttcggttgcctgacctacgcctttatgaccgacgacttttccgtcgcctatgtcgcaaacaactccaacagcgccttgccctggtattacttgttcagcgccgtgtggggcgcccacgaaggttcgttgctgctgtgggcgttgatcctcggtggctggaccttcgccgtatcggtgttttcgcgccaactgccgcaagtcatgctggcacgggtgctggcggtgatgggcatgatcagcattggctttttgctgttcctgatcatgacctccaaccctttcagccgcatgctgccgcagatcccggcggacgggcatgacctcaacccgctgttgcaggacatcggcctgatcgtgcatccgcccatgctctatatgggctacgtcggcttctccgtagcctttgccttcgccatcgccgccttgcttggcgggcgtctggatgcggcgtgggcgcgttggtcgcggccatggaccatcgttgcctgggccttcctcggtatcggtatcaccctgggctcatggtgggcctactacgaacttggctggggcggctggtggttctgggatccggtggaaaacgcgtccttcatgccctggctggtgggcactgcgctgattcattccctggcggtcaccgaaaaacgcggcgtgttcaagagctggactgtgttgctcgccatcgccgcgttttccctcacgctgctcgcagccttcctggtgcgttcgggcgtgctgacctcggtgcatgcgttcgcctctgaccccgagcgtggcgtgttcatcctgatcttcctgctgtttgtggtgggcggctcgctgaccctgttcgtgcgcgcaccggtggtcaagagccaggtcggcttcaacctgtggtcgcgggaaaccctgctgctgggcaataacctggtgctggtggtagccgcgtcgatgatcctgctcggcaccctctacccgctggtgctggatgccctcagcggcgccaagctgtccgtcggcccgccgtatttcaatgcgttgttcatcccgctgatgggcctgttgatggtggtgatggcggtcggcgtgctggtgcgctggaaagacactccggtgaaatggctggtgggcatgctcgctccggtgctgctaggcagcgttgcgctggccgtggtcgccggtattgcctacggcgacttcaactgggcagtgctcgccaccttcctgctcgccgcctgggtattactggccggtgtgcgtgacatcttcgacaagacccgtcacaaaggtttgctcaaaggtctgccgaccctgacccgcagctactggggcatgcagatcgcccacatcggcatcgcggtgtgcgccctcggcgtggtgctgtccagccagaacagcgccgagcgcgacctgcgcctggcgccgggcgaatccatggacttggccggttaccacttcatcttcgaaggcgccaagcacttcgaagggccgaactttacctcagacaaaggcacggtgcgcgtggtgcgcaacggcaaggaaatcgccgtgctgcacccggaaaaacgcctttacaccgtgcagagttcgatgatgaccgaagcgggcattgacgccggcttcacccgtgacctctatgtggccctcggagaacccctgggcgacggcgcctgggccgtgcgggtgcatgtcaaacccttcgtgcgctggatctggttcggcggtttgctcaccggttttggcggtttgctcgcggcgctggaccggcgttatcgggtcaaggtcaaaagccgggtgcgtgaagcactgggtatgggagctgcggtatga

SEQ ID NO: 68135 - protein, 660 aa, Pseudomonas fluorescens
MTSALFIPELGQLRMILALCFAVVQAVVPLLGAWPGDRLWMSLAQPARWGQFAFLLFAFGCLTYAFMTDDFSVAYVANNSNSALPWYYLFSAVWGAHEGSLLLWALILGGWTFAVSVFSRQLPQVMLARVLAVMGMISIGFLLFLIMTSNPFSRMLPQIPADGHDLNPLLQDIGLIVHPPMLYMGYVGFSVAFAFAIAALLGGRLDAAWARWSRPWTIVAWAFLGIGITLGSWWAYYELGWGGWWFWDPVENASFMPWLVGTALIHSLAVTEKRGVFKSWTVLLAIAAFSLTLLAAFLVRSGVLTSVHAFASDPERGVFILIFLLFVVGGSLTLFVRAPVVKSQVGFNLWSRETLLLGNNLVLVVAASMILLGTLYPLVLDALSGAKLSVGPPYFNALFIPLMGLLMVVMAVGVLVRWKDTPVKWLVGMLAPVLLGSVALAVVAGIAYGDFNWAVLATFLLAAWVLLAGVRDIFDKTRHKGLLKGLPTLTRSYWGMQIAHIGIAVCALGVVLSSQNSAERDLRLAPGESMDLAGYHFIFEGAKHFEGPNFTSDKGTVRVVRNGKEIAVLHPEKRLYTVQSSMMTEAGIDAGFTRDLYVALGEPLGDGAWAVRVHVKPFVRWIWFGGLLTGFGGLLAALDRRYRVKVKSRVREALGMGAAV

SEQ ID NO: 68136 - DNA, 2031 bp, Rhizobium meliloti
  CDS (1)..(2031): transl_table=11
atgatcatcgaactcgggcactatgcactggttttggcgctcgcgaccgcgatcatccagggcgtcctgcccgtcctgggggtgcggcgcggcgacccttccttgatgggactggcagcaaacgcggcgctcgtctgcttcctgctcgtcgctttctccttcgccgtgctgacattcgcctatgtgacatcggatttctcggtcaagaacgtctgggagaactcgcattccctcaaaccgctgatctacaagatcaccggggtctggggaaaccatgaaggctcgatgcttctctggctgctcattcttgtcttcttttccgcgatggtggcgctcttcggccgcaacctgccggagacgttgaaggcgaacgtccttgcggtgcaggcctggatcgcgaccgccttcgcgttcttcgtcctgctgacctccaatcccttcgcgcggctcgtgccggcaccgggcgagggcagggacctcaaccccgtgctgcaggatatcgggctcgcgatccacccgcccttgctctatctcggctatgtcggcttttccgtatgcttctccttcgcggtcgccgcgctcatcgaggggcggatcgatgcggcctgggcgcgttgggtgcggccgtggacacttgccgcctggacttttcttaccgccggcatcgccatgggctcctattgggcctattacgagctgggctggggcggctggtggttctgggacccggtcgaaaacgcctccttcatgccttggctcgccggaacggcacttctgcactcggccctggtcatggaaaagcgcgaagcgctaaagatatggaccgtgctgctggcgatcatgaccttctcgctgtcgctgctcggcacgttcctggtgcgctccggcgtgctgacatccgtccatgccttcgccaccgacccgacccgcggcgtcttcattctcgccatcctggtcgtcttcatcggcggtgcgttctcgctctttgccttccgtgcctcccatctcaaggccgggggaatattcgcaccggtttcgcgtgagggtgcgctcgtcgtgaacaacctgatcctgacgacggccacggcgacggtgctgaccggcacgctgtatccgctggtactcgaagcgctgaccggcgacaaaatttcggtcggcgcgccgttcttcaacatgacgttcggcctgctgatgctgccgctcatcgccgtcgttcccttcggcccgctgcttgcctggaagcgcggcgaccttgccggtgcggcgcagcgtctgtttgcggctgccgcgctcggcctgctcgccgcggcgatctgttattacgcggtaaacggtggcccggtcctggctcctttcggcctcggcctcggcgtctacctgattctgggagcgctcaccgatctggttctgcgctccgggctcggcaaggtggcggcgggcgtcgcctggagacggctttcgggcctgccgcgttcggctttcggcacggcgctcgcccatatcgggctcggaatcaccctgatcgggatcgtcacggtcacggctttcgaaacggaaacggtcgtcgagatgaaaccgggggcggtggtcgatgtcgggcgttacagcctgcgtttcgacggcatgcgtgaagggcgcgggccgaactataccgaggatgccggccatttcaccgtcagtcgaggcggcgtcgaggttaccgagatctggtcgtcgaaacggctctattcggcgcggcgcatgccgacgaccgaggccggaatccggaccttcggcctgagccagctctatgtatccttgggcgacgacatggcggacggcggcatcgtcgtccgcatctggtggaaaccgctgatcctatgcatctggggcggcgcgctcgtgatgatggccggcggcgtcgtttcgctcagcgaccggcgccttcgcgtcggcgcgccggcgcgtgccagaaaggccctcgccctggatcacgatgatttcaggtcggatcgaccaaaaatcatcaacgtgatcgattctaaaggttag

SEQ ID NO: 68137 - protein, 676 aa, Rhizobium meliloti
MIIELGHYALVLALATAIIQGVLPVLGVRRGDPSLMGLAANAALVCFLLVAFSFAVLTFAYVTSDFSVKNVWENSHSLKPLIYKITGVWGNHEGSMLLWLLILVFFSAMVALFGRNLPETLKANVLAVQAWIATAFAFFVLLTSNPFARLVPAPGEGRDLNPVLQDIGLAIHPPLLYLGYVGFSVCFSFAVAALIEGRIDAAWARWVRPWTLAAWTFLTAGIAMGSYWAYYELGWGGWWFWDPVENASFMPWLAGTALLHSALVMEKREALKIWTVLLAIMTFSLSLLGTFLVRSGVLTSVHAFATDPTRGVFILAILVVFIGGAFSLFAFRASHLKAGGIFAPVSREGALVVNNLILTTATATVLTGTLYPLVLEALTGDKISVGAPFFNMTFGLLMLPLIAVVPFGPLLAWKRGDLAGAAQRLFAAAALGLLAAAICYYAVNGGPVLAPFGLGLGVYLILGALTDLVLRSGLGKVAAGVAWRRLSGLPRSAFGTALAHIGLGITLIGIVTVTAFETETVVEMKPGAVVDVGRYSLRFDGMREGRGPNYTEDAGHFTVSRGGVEVTEIWSSKRLYSARRMPTTEAGIRTFGLSQLYVSLGDDMADGGIVVRIWWKPLILCIWGGALVMMAGGVVSLSDRRLRVGAPARARKALALDHDDFRSDRPKIINVIDSKG

SEQ ID NO: 68138 - DNA, 1962 bp, Rhodobacter capsulatus
  CDS (1)..(1962): transl_table=11
atgatcgtcgagaccggccatttcgccctgatcctggccctgtgcgtggcgctggtgcaggcggtcattcccctggtgggcgcgcaaaagggctggtcgggctggatggccgttgccacccccgcggcgctggcgcagttcgggctgatcgccatcgcctttgccgcgctgacctatgcctttgtgacgtctgacttttcgctgaagctcgtctacgaaaactcgcataccgacaagccgatgctctacaaggtcaccggggtctggggcaaccatgagggctcgatgctgctttgggtgctgatcctcgccatgttcggcgcggcggccgcggcctttggcggtgccttgccggagcggctgcgggcgcgggtgctggcggtgcagggcaccatcggggtcgcgtttctggtctttgtgcttttcacctcgaacccgttcctgcggctggaagaagcgccgttcaacggccgcgacatgaacccgctgctgcaggacccgggtctcgccttccatccgccgttcctgtaccttggctatgtcgggctttcgatggccttcagcttcgccgtcgccgcgctgatcgaggggcgggtcgatgccgcctgggcgcgctgggtccggccctggaccttggccgcctggatcttcctgaccatcggcatcgcgctgggatcgtggtgggcctattacgagctcggctggggcggcttctggttctgggacccggtggaaaacgcctcgctgatgccctggctgctggcggcggcgctgttgcattccgccatcgtcgtcgaaaagcgcgaggcgctgaaaagctggacgatcctgctcgccatcatggccttcggcttttcgctgatcggcacgttcctggtgcggtccggggtgatttcctcggtgcacagtttcgccaatgaccccgagcgcggggtgttcatcctgttcatccttgccttcttcaccggcggggcgctgacgctttatgccgcgcgggcctcggagatgcaggcgaaggggctgttttccatggtcagccgcgaatcggcgctggtgatgaacaacgtgcttttggcggtggcggcgctggtggtgttcaccggcacggtctggccgctgatcgcggagctgttctgggaccgcaagctctcggtgggggcgccgttcttcgaaaaggcctttacccccttcatggtcgggctggcgctgctgttgccgctgggatcgatgatgccgtggaaacgcgcgagcctcggcaagctggtgcggccgctgttgcccgcgcttgtgctgacgctggcggtgctggcgctggtctgggtgatggcgacggggcggccgatgctggcgcttggcgcggcggggctgggcgcctggatcctttttggcgccctggccgagatctggcaacgcgccgggcggacgccgggacgcatcctgcggctgccgcgggcggattggggcaaggccttcgcgcatggcgggctgggcatcgtctttgcgggcgtcggcctcttgatggccgggcaggtcgaggatatccgcgtggcgaaggcgggcgacagtttcgaggtggcaggttacacgatcacgctggtgtcggtcgaggatgtgccggggccgaacttcaccgccaagaccgcgacgatggaggtgcggcagggcggcaagctggtggcgaccctgcatcccgaaaagcgcatctatccggtgcaggcgatgccgacgaccgaggccgatatcgacaacggcttctggcgcgatgtctatctggtgatcggcgacccgcaggagggcggcggctgggcggtgcggacctatgtcaagcctttcgcgaactggatctgggcgggctgtctgctgatggcctttggcggcgggctgagcctgaccgaccggcgttatcgcagcgccgccggggcgcggcgggcgacggtggccgatgctgttgcggcggagtga

SEQ ID NO: 68139 - protein, 653 aa, Rhodobacter capsulatus
MIVETGHFALILALCVALVQAVIPLVGAQKGWSGWMAVATPAALAQFGLIAIAFAALTYAFVTSDFSLKLVYENSHTDKPMLYKVTGVWGNHEGSMLLWVLILAMFGAAAAAFGGALPERLRARVLAVQGTIGVAFLVFVLFTSNPFLRLEEAPFNGRDMNPLLQDPGLAFHPPFLYLGYVGLSMAFSFAVAALIEGRVDAAWARWVRPWTLAAWIFLTIGIALGSWWAYYELGWGGFWFWDPVENASLMPWLLAAALLHSAIVVEKREALKSWTILLAIMAFGFSLIGTFLVRSGVISSVHSFANDPERGVFILFILAFFTGGALTLYAARASEMQAKGLFSMVSRESALVMNNVLLAVAALVVFTGTVWPLIAELFWDRKLSVGAPFFEKAFTPFMVGLALLLPLGSMMPWKRASLGKLVRPLLPALVLTLAVLALVWVMATGRPMLALGAAGLGAWILFGALAEIWQRAGRTPGRILRLPRADWGKAFAHGGLGIVFAGVGLLMAGQVEDIRVAKAGDSFEVAGYTITLVSVEDVPGPNFTAKTATMEVRQGGKLVATLHPEKRIYPVQAMPTTEADIDNGFWRDVYLVIGDPQEGGGWAVRTYVKPFANWIWAGCLLMAFGGGLSLTDRRYRSAAGARRATVADAVAAE

SEQ ID NO: 68140 - DNA, 1908 bp, Haemophilus influenzae
  CDS (1)..(1908): transl_table=11
atgcttccagaacttggctttttccttcttttactcgcaacagctagcgcgtttttccttgcgttagtgcctcaatttgggttattcaaaaaaaatccgactttaattaatgctgcttggccgcttagttatatttttacccttgcgacgacgttatcaattggtttgcttgcttattcttttgcggtggatgatttcacccttgaatatgtagcggcacattctaattcccaattacctacattttttaaagtggctgccacttggggaggacatgaaggttcaatgttgttttggttattttcattgagtttatggcttgctgcttttgctttttttaatcgaaaaaatgaccgcactttttctgctcaatctttatctttattgggattgatttgctttggttttgcggtgtttattttattttattccaatccatttggacgcattttcccagcacccgcagaagggcgcgatctcaatccaatgttgcaagatgtgggattaattttccatccacctttactatatgttggctatgtgggctttgcggtaaattttgcaatgagtttgagtgcgttgatttataaccaatctgcacgacaaattgcccgctcaatgcgtggatgggtgttggtttcttggttatttttaaccattggcattgtgcttggtgcttggtgggcttattacgaacttggctggggcggttggtggttctgggatcccgtagaaaatgcgtctttaatgccttggttgcttggtttggcattattacacagtttaatggcgacggaaaaacaaggcgtatttagttattggacaacgcttttttctctgcttgcttttgcctttagcgtattaggcacgtttattgttcgttctggcgcactcacttctgtgcatgcttttgcattggataacacgcgcggttatgtgttgttattaattttctttgttttgacagcgttagcctttggtttattcgctttacgagcgggaagttcatcagaaagtgcggtgaaatttcagttcatttctaaatcgggtggcattttattactgaatattttgctgaccattgcgacggtttctacctttttaggtaccttttacccgatgttattccaagcgatgaattggggctcaatttcggtgggaagtccttattttaatagtattttcttccccattattacggcgattttaatcttaatggtaattgtgcttagcatacgtaaggggcaatttgatcgcacattattgatacgttgtgggtggttgcttattccgtctttaattcttgcaggcctaatgatttggcaacagctacgaaataattctgcattacatttccatgctttcgcctttgtgttattaactcttgcgatttggcttttattcgtcacgttatggcaaaattggcgacaaattcgcttgtctcaatttgggatgattttagcacactgtggcgtggcgattgtgactattggtgcggtgatgagtgggtattttggcagtgaaattggtgtgcgtttagcaccgcaacaaagtcaaacgttagggcaatatgaatttcattatcgccaattttctaatgaaattgggccaaactttacggcagaagtcgccttttttgacgtaactaaaaatggtaaaccttatgcagaaattatcccagaacgccgttattacgatgtacgaacaatgacaatgagtgaagtggggcttgatggtggtttttggggcgatttatatattgtgatgggcgattctcttggcaaaggggaatttactttccgcttacattataaaccactgattcgttggctttgggcgggcggtattttaatggcctttggcgcactttttagcgttttcggattacgcagaaaacaggaaaaataa

SEQ ID NO: 68141 - protein, 635 aa, Haemophilus influenzae
MLPELGFFLLLLATASAFFLALVPQFGLFKKNPTLINAAWPLSYIFTLATTLSIGLLAYSFAVDDFTLEYVAAHSNSQLPTFFKVAATWGGHEGSMLFWLFSLSLWLAAFAFFNRKNDRTFSAQSLSLLGLICFGFAVFILFYSNPFGRIFPAPAEGRDLNPMLQDVGLIFHPPLLYVGYVGFAVNFAMSLSALIYNQSARQIARSMRGWVLVSWLFLTIGIVLGAWWAYYELGWGGWWFWDPVENASLMPWLLGLALLHSLMATEKQGVFSYWTTLFSLLAFAFSVLGTFIVRSGALTSVHAFALDNTRGYVLLLIFFVLTALAFGLFALRAGSSSESAVKFQFISKSGGILLLNILLTIATVSTFLGTFYPMLFQAMNWGSISVGSPYFNSIFFPIITAILILMVIVLSIRKGQFDRTLLIRCGWLLIPSLILAGLMIWQQLRNNSALHFHAFAFVLLTLAIWLLFVTLWQNWRQIRLSQFGMILAHCGVAIVTIGAVMSGYFGSEIGVRLAPQQSQTLGQYEFHYRQFSNEIGPNFTAEVAFFDVTKNGKPYAEIIPERRYYDVRTMTMSEVGLDGGFWGDLYIVMGDSLGKGEFTFRLHYKPLIRWLWAGGILMAFGALFSVFGLRRKQEK

SEQ ID NO: 68142 - DNA, 22 bp, Artificial sequence
  (1)..(22): primer
atgttgaccccgttgacggcct

SEQ ID NO: 68143 - DNA, 23 bp, Artificial sequence
  (1)..(23): primer
ttattcatcgcgcttcttccccc

SEQ ID NO: 68144 - protein, 954 aa, Artificial sequence
  Variant (2)..(37): xaa in position 2 to 37 is any amino acid
  Variant (38)..(67): xaa in position 38 to 67 is any or no amino acid
  Variant (69)..(75): xaa in position 69 to 75 is any amino acid
  Variant (79)..(81): xaa in position 79 to 81 is any amino acid
  Variant (83)..(85): xaa in position 83 to 85 is any amino acid
  Variant (87)..(90): xaa in position 87 to 90 is any amino acid
  Variant (92)..(99): xaa in position 92 to 99 is any amino acid
  Variant (102)..(102): xaa in position 102 is any amino acid
  Variant (107)..(107): xaa in position 107 is any amino acid
  Variant (111)..(129): xaa in position 111 to 129 is any amino acid
  Variant (130)..(149): xaa in position 130 to 149 is any or no amino acid
  Variant (151)..(151): xaa in position 151 is any amino acid
  Variant (152)..(159): xaa in position 152 to 159 is any or no amino acid
  Variant (161)..(162): xaa in position 161 to 162 is any amino acid
  Variant (164)..(167): xaa in position 164 to 167 is any amino acid
  Variant (169)..(169): xaa in position 169 is any amino acid
  Variant (172)..(178): xaa in position 172 to 178 is any amino acid
  Variant (179)..(189): xaa in position 179 to 189 is any or no amino acid
  Variant (191)..(192): xaa in position 191 to 192 is any amino acid
  Variant (196)..(196): xaa in position 196 is any amino acid
  Variant (199)..(199): xaa in position 199 is any amino acid
  Variant (201)..(201): xaa in position 201 is any amino acid
  Variant (203)..(205): xaa in position 203 to 205 is any amino acid
  Variant (209)..(209): xaa in position 209 is any amino acid
  Variant (212)..(212): xaa in position 212 is any amino acid
  Variant (215)..(215): xaa in position 215 is any amino acid
  Variant (217)..(220): xaa in position 217 to 220 is any amino acid
  Variant (222)..(225): xaa in position 222 to 225 is any amino acid
  Variant (227)..(227): xaa in position 227 is any amino acid
  Variant (229)..(231): xaa in position 229 to 231 is any amino acid
  Variant (232)..(275): xaa in position 232 to 275 is any or no amino acid
  Variant (277)..(277): xaa in position 277 is any amino acid
  Variant (279)..(281): xaa in position 279 to 281 is any amino acid
  Variant (282)..(282): xaa in position 282 is any or no amino acid
  Variant (284)..(285): xaa in position 284 to 285 is any amino acid
  Variant (288)..(288): xaa in position 288 is any amino acid
  Variant (291)..(292): xaa in position 291 to 292 is any amino acid
  Variant (295)..(295): xaa in position 295 is any amino acid
  Variant (296)..(297): xaa in position 296 to 297 is any or no amino acid
  Variant (301)..(301): xaa in position 301 is any amino acid
  Variant (308)..(308): xaa in position 308 is any amino acid
  Variant (319)..(320): xaa in position 319 to 320 is any amino acid
  Variant (324)..(326): xaa in position 324 to 326 is any amino acid
  Variant (329)..(329): xaa in position 329 is any amino acid
  Variant (332)..(333): xaa in position 332 to 333 is any amino acid
  Variant (334)..(337): xaa in position 334 to 337 is any or no amino acid
  Variant (339)..(339): xaa in position 339 is any amino acid
  Variant (340)..(343): xaa in position 340 to 343 is any or no amino acid
  Variant (346)..(346): xaa in position 346 is any amino acid
  Variant (347)..(347): xaa in position 347 is any or no amino acid
  Variant (349)..(351): xaa in position 349 to 351 is any amino acid
  Variant (352)..(352): xaa in position 352 is any or no amino acid
  Variant (354)..(356): xaa in position 354 to 356 is any amino acid
  Variant (358)..(358): xaa in position 358 is any amino acid
  Variant (362)..(362): xaa in position 362 is any amino acid
  Variant (367)..(369): xaa in position 367 to 369 is any amino acid
  Variant (370)..(371): xaa in position 370 to 371 is any or no amino acid
  Variant (375)..(375): xaa in position 375 is any amino acid
  Variant (378)..(378): xaa in position 378 is any amino acid
  Variant (380)..(380): xaa in position 380 is any amino acid
  Variant (381)..(383): xaa in position 381 to 383 is any or no amino acid
  Variant (386)..(388): xaa in position 386 to 388 is any amino acid
  Variant (390)..(401): xaa in position 390 to 401 is any amino acid
  Variant (403)..(408): xaa in position 403 to 408 is any amino acid
  Variant (409)..(451): xaa in position 409 to 451 is any or no amino acid
  Variant (453)..(453): xaa in position 453 is any amino acid
  Variant (455)..(466): xaa in position 455 to 466 is any amino acid
  Variant (467)..(473): xaa in position 467 to 473 is any or no amino acid
  Variant (476)..(477): xaa in position 476 to 477 is any amino acid
  Variant (479)..(483): xaa in position 479 to 483 is any amino acid
  Variant (484)..(518): xaa in position 484 to 518 is any or no amino acid
  Variant (520)..(520): xaa in position 520 is any amino acid
  Variant (522)..(522): xaa in position 522 is any amino acid
  Variant (524)..(524): xaa in position 524 is any amino acid
  Variant (526)..(547): xaa in position 526 to 547 is any amino acid
  Variant (549)..(554): xaa in position 549 to 554 is any amino acid
  Variant (555)..(667): xaa in position 555 to 667 is any or no amino acid
  Variant (669)..(669): xaa in position 669 is any amino acid
  Variant (671)..(676): xaa in position 671 to 676 is any amino acid
  Variant (678)..(708): xaa in position 678 to 708 is any amino acid
  Variant (709)..(746): xaa in position 709 to 746 is any or no amino acid
  Variant (748)..(766): xaa in position 748 to 766 is any amino acid
  Variant (767)..(789): xaa in position 767 to 789 is any or no amino acid
  Variant (791)..(791): xaa in position 791 is any amino acid
  Variant (793)..(799): xaa in position 793 to 799 is any amino acid
  Variant (800)..(800): xaa in position 800 is any or no amino acid
  Variant (802)..(803): xaa in position 802 to 803 is any amino acid
  Variant (804)..(837): xaa in position 804 to 837 is any or no amino acid
  Variant (839)..(845): xaa in position 839 to 845 is any amino acid
  Variant (846)..(846): xaa in position 846 is any or no amino acid
  Variant (848)..(850): xaa in position 848 to 850 is any amino acid
  Variant (852)..(865): xaa in position 852 to 865 is any amino acid
  Variant (866)..(938): xaa in position 866 to 938 is any or no amino acid
  Variant (940)..(944): xaa in position 940 to 944 is any amino acid
  Variant (946)..(946): xaa in position 946 is any amino acid
  Variant (948)..(953): xaa in position 948 to 953 is any amino acid
GXXXXXXXXXXXXXXXXXXXXXXXXXXXXXXXXXXXXXXXXXXXXXXXXXXXXXXXXXXXXXXXXXXLXXXXXXXDFSXXXVXXXSXXXXPXXXXXXXXWGXHEGSXLLWXXXXXXXXXXXXXXXXXXXXXXXXXXXXXXXXXXXXXXXLXXXXXXXXXFXXFXXXXSXPFXXXXXXXXXXXXXXXXXXGXXLNPXLQXDXGXXXHPPXLYXGYXGXXXXFXXXXAXLXXXXXXXXXXXXXXXXXXXXXXXXXXXXXXXXXXXXXXXXXXXXXXXRXWXXXXWXXLTXGIXXGSXXXWAYXELGWGGXWFWDPVENASXXPWLXXXALXHSXXXXXXRXXXXXWTXXLXXXXFXXXLXGTFXVRSGXXXXXSVHXFAXDXXXXRGXXXLXXXXXXXXXXXXLXXXXXXXXXXXXXXXXXXXXXXXXXXXXXXXXXXXXXXXXXXXXXXXXXSXEXXXXXXXXXXXXXXXXXXXGTXXPXXXXXXXXXXXXXXXXXXXXXXXXXXXXXXXXXXXXXXXXSXGXPXFXXXXXXXXXXXXXXXXXXXXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHXGXXXXXXGXXXXXXXXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXRXYXXXXXXXXEXXXXXXXXXXXXXXXXXXXXXXXXXXXXXXXXXXXXIXXXXXXXXYXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXWXGXXXXXXG

SEQ ID NO: 68145 - protein, 11 aa, Artificial sequence
  Variant (2)..(2): xaa in position 2 is Gly or Ser
  Variant (3)..(3): xaa in position 3 is Ala, Gly, Asn or Ser
  Variant (8)..(8): xaa in position 8 is Phe, Ile, Leu, Met or Val
  Variant (10)..(10): xaa in position 10 is Phe or Leu
WXXHEGSXLXW

SEQ ID NO: 68146 - protein, 39 aa, Artificial sequence
  Variant (2)..(4): xaa in position 2 to 4 is any amino acid
  Variant (7)..(7): xaa in position 7 is Ile, Leu, Met or Val
  Variant (10)..(10): xaa in position 10 is Asp or His
  Variant (11)..(11): xaa in position 11 is any amino acid
  Variant (12)..(12): xaa in position 12 is Ala or Gly
  Variant (13)..(13): xaa in position 13 is Phe, Leu or Met
  Variant (14)..(14): xaa in position 14 is any amino acid
  Variant (15)..(15): xaa in position 15 is Phe, Ile, Leu, Met or Val
  Variant (19)..(19): xaa in position 19 is any or no amino acid
  Variant (21)..(21): xaa in position 21 is any or no amino acid
  Variant (23)..(23): xaa in position 23 is any amino acid
  Variant (26)..(32): xaa in position 26 to 32 is any amino acid
  Variant (33)..(33): xaa in position 33 is Ala, Gly, Ser or Thr
  Variant (34)..(34): xaa in position 34 is Phe, Ile, Leu, Met or Val
  Variant (35)..(35): xaa in position 35 is Ala, Cys, Ser, Thr or Val
  Variant (36)..(36): xaa in position 36 is any amino acid
  Variant (37)..(37): xaa in position 37 is Ala, Gly or Ser
  Variant (38)..(38): xaa in position 38 is Ala, Gly, Ser or Val
  Variant (39)..(39): xaa in position 39 is Leu, Met or Val
GXXXNPXLQXXXXXXHPPXLXYXGYXXXXXXXXXXXXXX

SEQ ID NO: 68147 - protein, 53 aa, Artificial sequence
  Variant (2)..(5): xaa in position 2 to 5 is any amino acid
  Variant (6)..(7): xaa in position 6 to 7 is any or no amino acid
  Variant (9)..(10): xaa in position 9 to 10 is any amino acid
  Variant (12)..(12): xaa in position 12 is Gly or Thr
  Variant (13)..(13): xaa in position 13 is any amino acid
  Variant (16)..(17): xaa in position 16 to 17 is any amino acid
  Variant (19)..(20): xaa in position 19 to 20 is any amino acid
  Variant (22)..(22): xaa in position 22 is Ala or Ser
  Variant (24)..(25): xaa in position 24 to 25 is any amino acid
  Variant (26)..(26): xaa in position 26 is Leu or Val
  Variant (31)..(31): xaa in position 31 is Phe, Trp or Tyr
  Variant (33)..(33): xaa in position 33 is any amino acid
  Variant (40)..(40): xaa in position 40 is Ala, Ser or Val
  Variant (41)..(41): xaa in position 41 is Ala or Ser
  Variant (42)..(42): xaa in position 42 is Phe or Leu
  Variant (43)..(43): xaa in position 43 is Ile, Leu or Met
  Variant (46)..(46): xaa in position 46 is Ile, Leu or Val
  Variant (47)..(47): xaa in position 47 is any amino acid
  Variant (48)..(48): xaa in position 48 is Ala, Gly or Ser
  Variant (49)..(49): xaa in position 49 is any amino acid
  Variant (50)..(50): xaa in position 50 is Ala or Gly
  Variant (51)..(52): xaa in position 51 to 52 is any amino acid
WXXXXXXWXXLXXGIXXGXXWXYXXXGWGGXWXWDPVENXXXXPWXXXXXXXH

SEQ ID NO: 68148 - protein, 42 aa, Artificial sequence
  Variant (2)..(2): xaa in position 2 is Asn, Ser or Thr
  Variant (3)..(3): xaa in position 3 is any amino acid
  Variant (4)..(4): xaa in position 4 is Phe, Ile, Leu, Met or Val
  Variant (5)..(5): xaa in position 5 is Phe, Leu or Val
  Variant (6)..(6): xaa in position 6 is any amino acid
  Variant (7)..(7): xaa in position 7 is Ile, Leu or Val
  Variant (8)..(12): xaa in position 8 to 12 is any amino acid
  Variant (13)..(13): xaa in position 13 is Ala, Cys, Ser, Thr or Val
  Variant (14)..(14): xaa in position 14 is Ile, Leu, Met or Val
  Variant (15)..(15): xaa in position 15 is any amino acid
  Variant (16)..(16): xaa in position 16 is Ala, Gly or Ser
  Variant (17)..(17): xaa in position 17 is Ala or Thr
  Variant (18)..(18): xaa in position 18 is Phe or Leu
  Variant (19)..(19): xaa in position 19 is Phe, Ile or Leu
  Variant (23)..(23): xaa in position 23 is Gly or Ser
  Variant (24)..(24): xaa in position 24 is any amino acid
  Variant (25)..(25): xaa in position 25 is Ile or Leu
  Variant (26)..(26): xaa in position 26 is any amino acid
  Variant (28)..(28): xaa in position 28 is Ile or Val
  Variant (30)..(30): xaa in position 30 is Ala or Ser
  Variant (33)..(33): xaa in position 33 is any amino acid
  Variant (34)..(34): xaa in position 34 is Asp, Glu or Ser
  Variant (35)..(36): xaa in position 35 to 36 is any amino acid
  Variant (38)..(39): xaa in position 38 to 39 is any amino acid
  Variant (40)..(41): xaa in position 40 to 41 is any or no amino acid
WXXXXXXXXXXXXXXXXXXVRSXXXXSXHXFAXXXXRXXXXL

SEQ ID NO: 68149 - protein, 16 aa, Artificial sequence
  Variant (2)..(2): xaa in position 2 is any amino acid
  Variant (3)..(3): xaa in position 3 is Ala, Ile or Val
  Variant (4)..(5): xaa in position 4 to 5 is any amino acid
  Variant (6)..(6): xaa in position 6 is Ile, Leu or Val
  Variant (8)..(8): xaa in position 8 is any amino acid
  Variant (10)..(11): xaa in position 10 to 11 is any amino acid
  Variant (12)..(12): xaa in position 12 is Phe, Ile, Leu, Met or Val
  Variant (13)..(15): xaa in position 13 to 15 is any amino acid
PXXXXXWXGXXXXXXG

SEQ ID NO: 68150 - DNA, 2280 bp, Escherichia coli K12; identical to SEQ ID NO: 11018
  CDS (470)..(1951)

SEQ ID NO: 68151 - protein, 493 aa, Escherichia coli K12; identical to SEQ ID NO: 11019

SEQ ID NO: 68152 - DNA, 1770 bp, Arabidopsis thaliana; identical to SEQ ID NO: 11020
  CDS (84)..(1559)

SEQ ID NO: 68153 - protein, 491 aa, Arabidopsis thaliana; identical to SEQ ID NO: 11021

SEQ ID NO: 68154 - DNA, 1512 bp, Arabidopsis thaliana; identical to SEQ ID NO: 11022
  CDS (1)..(1479)

SEQ ID NO: 68155 - protein, 492 aa, Arabidopsis thaliana; identical to SEQ ID NO: 11023

SEQ ID NO: 68156 - DNA, 1500 bp, Arabidopsis thaliana; identical to SEQ ID NO: 11024
  CDS (1)..(1500)

SEQ ID NO: 68157 - protein, 499 aa, Arabidopsis thaliana; identical to SEQ ID NO: 11025

SEQ ID NO: 68158 - DNA, 1865 bp, Solanum tuberosum; identical to SEQ ID NO: 11026
  CDS (66)..(1547)

SEQ ID NO: 68159 - protein, 493 aa, Solanum tuberosum; identical to SEQ ID NO: 11027

SEQ ID NO: 68160 - DNA, 1616 bp, Arabidopsis thaliana; identical to SEQ ID NO: 11028
  CDS (44)..(1576)

SEQ ID NO: 68161 - protein, 510 aa, Arabidopsis thaliana; identical to SEQ ID NO: 11029

SEQ ID NO: 68162 - DNA, 1416 bp, Nostoc sp. PCC 7120; identical to SEQ ID NO: 11030
  CDS (1)..(1416)

SEQ ID NO: 68163 - protein, 471 aa, Nostoc sp. PCC 7120; identical to SEQ ID NO: 11031

SEQ ID NO: 68164 - DNA, 1437 bp, Salmonella enterica subsp. enterica serovar Typhi; identical to SEQ ID NO: 11032
  CDS (1)..(1437)

SEQ ID NO: 68165 - protein, 478 aa, Salmonella enterica subsp. enterica serovar Typhi; identical to SEQ ID NO: 11033

SEQ ID NO: 68166 - DNA, 1452 bp, Brucella melitensis; identical to SEQ ID NO: 11034
  CDS (1)..(1452)

SEQ ID NO: 68167 - protein, 483 aa, Brucella melitensis; identical to SEQ ID NO: 11035

SEQ ID NO: 68168 - DNA, 1416 bp, Bacillus halodurans; identical to SEQ ID NO: 11036
  CDS (1)..(1416)

SEQ ID NO: 68169 - protein, 471 aa, Bacillus halodurans; identical to SEQ ID NO: 11037

SEQ ID NO: 68170 - DNA, 1428 bp, Haemophilus influenzae; identical to SEQ ID NO: 11038
  CDS (1)..(1428)

SEQ ID NO: 68171 - protein, 475 aa, Haemophilus influenzae; identical to SEQ ID NO: 11039

SEQ ID NO: 68172 - DNA, 1398 bp, Neisseria meningitidis; identical to SEQ ID NO: 11040
  CDS (1)..(1398)

SEQ ID NO: 68173 - protein, 465 aa, Neisseria meningitidis; identical to SEQ ID NO: 11041

SEQ ID NO: 68174 - DNA, 1425 bp, Pseudomonas aeruginosa; identical to SEQ ID NO: 11042
  CDS (1)..(1425)

SEQ ID NO: 68175 - protein, 474 aa, Pseudomonas aeruginosa; identical to SEQ ID NO: 11043

SEQ ID NO: 68176 - DNA, 1398 bp, Clostridium acetobutylicum; identical to SEQ ID NO: 11044
  CDS (1)..(1398)

SEQ ID NO: 68177 - protein, 465 aa, Clostridium acetobutylicum; identical to SEQ ID NO: 11045

SEQ ID NO: 68178 - DNA, 1446 bp, Agrobacterium tumefaciens; identical to SEQ ID NO: 11046
  CDS (1)..(1446)

SEQ ID NO: 68179 - protein, 481 aa, Agrobacterium tumefaciens; identical to SEQ ID NO: 11047

SEQ ID NO: 68180 - DNA, 1377 bp, Thermotoga maritima; identical to SEQ ID NO: 11048
  CDS (1)..(1377)

SEQ ID NO: 68181 - protein, 458 aa, Thermotoga maritima; identical to SEQ ID NO: 11049

SEQ ID NO: 68182 - DNA, 1407 bp, Campylobacter jejuni; identical to SEQ ID NO: 11050
  CDS (1)..(1407)

SEQ ID NO: 68183 - protein, 468 aa, Campylobacter jejuni; identical to SEQ ID NO: 11051

SEQ ID NO: 68184 - DNA, 1452 bp, Vibrio cholerae; identical to SEQ ID NO: 11052
  CDS (1)..(1452)

SEQ ID NO: 68185 - protein, 483 aa, Vibrio cholerae; identical to SEQ ID NO: 11053

SEQ ID NO: 68186 - DNA, 1413 bp, Clostridium acetobutylicum; identical to SEQ ID NO: 11054
  CDS (1)..(1413)

SEQ ID NO: 68187 - protein, 470 aa, Clostridium acetobutylicum; identical to SEQ ID NO: 11055

SEQ ID NO: 68188 - DNA, 1407 bp, Helicobacter pylori; identical to SEQ ID NO: 11056
  CDS (1)..(1407)

SEQ ID NO: 68189 - protein, 468 aa, Helicobacter pylori; identical to SEQ ID NO: 11057

SEQ ID NO: 68190 - DNA, 2867 bp, Serratia marcescens; identical to SEQ ID NO: 11058
  CDS (787)..(2223)

SEQ ID NO: 68191 - protein, 478 aa, Serratia marcescens; identical to SEQ ID NO: 11059

SEQ ID NO: 68192 - DNA, 1428 bp, Bacillus subtilis; identical to SEQ ID NO: 11060
  CDS (1)..(1428)

SEQ ID NO: 68193 - protein, 475 aa, Bacillus subtilis; identical to SEQ ID NO: 11061

SEQ ID NO: 68194 - DNA, 2066 bp, Pseudomonas fluorescens; identical to SEQ ID NO: 11062
  CDS (323)..(1759)

SEQ ID NO: 68195 - protein, 478 aa, Pseudomonas fluorescens; identical to SEQ ID NO: 11063

SEQ ID NO: 68196 - DNA, 1437 bp, Bacillus cereus; identical to SEQ ID NO: 11064
  CDS (1)..(1437)

SEQ ID NO: 68197 - protein, 478 aa, Bacillus cereus; identical to SEQ ID NO: 11065

SEQ ID NO: 68198 - DNA, 1419 bp, Acinetobacter sp; identical to SEQ ID NO: 11066
  CDS (1)..(1419)

SEQ ID NO: 68199 - protein, 472 aa, Acinetobacter sp; identical to SEQ ID NO: 11067

SEQ ID NO: 68200 - DNA, 1431 bp, Bacillus anthracis str; identical to SEQ ID NO: 11068
  CDS (1)..(1431)

SEQ ID NO: 68201 - protein, 476 aa, Bacillus anthracis str; identical to SEQ ID NO: 11069

SEQ ID NO: 68202 - DNA, 1461 bp, Photobacterium profundum; identical to SEQ ID NO: 11070
  CDS (1)..(1461)

SEQ ID NO: 68203 - protein, 486 aa, Photobacterium profundum; identical to SEQ ID NO: 11071

SEQ ID NO: 68204 - DNA, 1431 bp, Bdellovibrio bacteriovorus; identical to SEQ ID NO: 11072
  CDS (1)..(1431)

SEQ ID NO: 68205 - protein, 476 aa, Bdellovibrio bacteriovorus; identical to SEQ ID NO: 11073

SEQ ID NO: 68206 - DNA, 1575 bp, Corynebacterium diphtheriae; identical to SEQ ID NO: 11074
  CDS (1)..(1575)

SEQ ID NO: 68207 - protein, 524 aa, Corynebacterium diphtheriae; identical to SEQ ID NO: 11075

SEQ ID NO: 68208 - DNA, 1407 bp, Desulfovibrio vulgaris; identical to SEQ ID NO: 11076
  CDS (1)..(1407)

SEQ ID NO: 68209 - protein, 468 aa, Desulfovibrio vulgaris; identical to SEQ ID NO: 11077

SEQ ID NO: 68210 - DNA, 1413 bp, Desulfovibrio vulgaris; identical to SEQ ID NO: 11078
  CDS (1)..(1413)

SEQ ID NO: 68211 - protein, 470 aa, Desulfovibrio vulgaris; identical to SEQ ID NO: 11079

SEQ ID NO: 68212 - DNA, 1434 bp, Bacillus cereus; identical to SEQ ID NO: 11080
  CDS (1)..(1434)

SEQ ID NO: 68213 - protein, 477 aa, Bacillus cereus; identical to SEQ ID NO: 11081

SEQ ID NO: 68214 - DNA, 1392 bp, Treponema denticola; identical to SEQ ID NO: 11082
  CDS (1)..(1392)

SEQ ID NO: 68215 - protein, 463 aa, Treponema denticola; identical to SEQ ID NO: 11083

SEQ ID NO: 68216 - DNA, 1392 bp, Geobacter sulfurreducens; identical to SEQ ID NO: 11084
  CDS (1)..(1392)

SEQ ID NO: 68217 - protein, 463 aa, Geobacter sulfurreducens; identical to SEQ ID NO: 11085

SEQ ID NO: 68218 - DNA, 1437 bp, Yersinia pestis; identical to SEQ ID NO: 11086
  CDS (1)..(1437)

SEQ ID NO: 68219 - protein, 478 aa, Yersinia pestis; identical to SEQ ID NO: 11087

SEQ ID NO: 68220 - DNA, 1401 bp, Bradyrhizobium japonicum USDA 110; identical to SEQ ID NO: 11088
  CDS (1)..(1401)

SEQ ID NO: 68221 - protein, 466 aa, Bradyrhizobium japonicum USDA 110; identical to SEQ ID NO: 11089

SEQ ID NO: 68222 - DNA, 1416 bp, Wolinella succinogenes; identical to SEQ ID NO: 11090
  CDS (1)..(1416)

SEQ ID NO: 68223 - protein, 471 aa, Wolinella succinogenes; identical to SEQ ID NO: 11091

SEQ ID NO: 68224 - DNA, 1452 bp, Vibrio vulnificus; identical to SEQ ID NO: 11092
  CDS (1)..(1452)

SEQ ID NO: 68225 - protein, 483 aa, Vibrio vulnificus; identical to SEQ ID NO: 11093

SEQ ID NO: 68226 - DNA, 1428 bp, Porphyromonas gingivalis W83; identical to SEQ ID NO: 11094
  CDS (1)..(1428)

SEQ ID NO: 68227 - protein, 475 aa, Porphyromonas gingivalis W83; identical to SEQ ID NO: 11095

SEQ ID NO: 68228 - DNA, 1425 bp, Photorhabdus luminescens subsp; identical to SEQ ID NO: 11096
  CDS (1)..(1425)

SEQ ID NO: 68229 - protein, 474 aa, Photorhabdus luminescens subsp; identical to SEQ ID NO: 11097

SEQ ID NO: 68230 - DNA, 1410 bp, Gloeobacter violaceus PCC 7421; identical to SEQ ID NO: 11098
  CDS (1)..(1410)

SEQ ID NO: 68231 - protein, 469 aa, Gloeobacter violaceus PCC 7421; identical to SEQ ID NO: 11099

SEQ ID NO: 68232 - DNA, 1404 bp, Chromobacterium violaceum ATCC 12472; identical to SEQ ID NO: 11100
  CDS (1)..(1404)

SEQ ID NO: 68233 - protein, 467 aa, Chromobacterium violaceum ATCC 12472; identical to SEQ ID NO: 11101

SEQ ID NO: 68234 - DNA, 1440 bp, Helicobacter hepaticus ATCC 51449; identical to SEQ ID NO: 11102
  CDS (1)..(1440)

SEQ ID NO: 68235 - protein, 479 aa, Helicobacter hepaticus ATCC 51449; identical to SEQ ID NO: 11103

SEQ ID NO: 68236 - DNA, 1428 bp, Haemophilus ducreyi 35000HP; identical to SEQ ID NO: 11104
  CDS (1)..(1428)

SEQ ID NO: 68237 - protein, 475 aa, Haemophilus ducreyi 35000HP; identical to SEQ ID NO: 11105

SEQ ID NO: 68238 - DNA, 1413 bp, Streptomyces avermitilis; identical to SEQ ID NO: 11106
  CDS (1)..(1413)

SEQ ID NO: 68239 - protein, 470 aa, Streptomyces avermitilis; identical to SEQ ID NO: 11107

SEQ ID NO: 68240 - DNA, 1395 bp, Eikenella corrodens; identical to SEQ ID NO: 11108
  CDS (1)..(1395)

SEQ ID NO: 68241 - protein, 464 aa, Eikenella corrodens; identical to SEQ ID NO: 11109

SEQ ID NO: 68242 - DNA, 1452 bp, Vibrio parahaemolyticus; identical to SEQ ID NO: 11110
  CDS (1)..(1452)

SEQ ID NO: 68243 - protein, 483 aa, Vibrio parahaemolyticus; identical to SEQ ID NO: 11111

SEQ ID NO: 68244 - DNA, 1425 bp, Pseudomonas syringae pv; identical to SEQ ID NO: 11112
  CDS (1)..(1425)

SEQ ID NO: 68245 - protein, 474 aa, Pseudomonas syringae pv; identical to SEQ ID NO: 11113

SEQ ID NO: 68246 - DNA, 1437 bp, Pseudomonas putida; identical to SEQ ID NO: 11114
  CDS (1)..(1437)

SEQ ID NO: 68247 - protein, 478 aa, Pseudomonas putida; identical to SEQ ID NO: 11115

SEQ ID NO: 68248 - DNA, 1401 bp, Lactobacillus plantarum WCFS1; identical to SEQ ID NO: 11116
  CDS (1)..(1401)

SEQ ID NO: 68249 - protein, 466 aa, Lactobacillus plantarum WCFS1; identical to SEQ ID NO: 11117

SEQ ID NO: 68250 - DNA, 1413 bp, Clostridium tetani E88; identical to SEQ ID NO: 11118
  CDS (1)..(1413)

SEQ ID NO: 68251 - protein, 470 aa, Clostridium tetani E88; identical to SEQ ID NO: 11119

SEQ ID NO: 68252 - DNA, 1461 bp, Bacteroides thetaiotaomicron VPI; identical to SEQ ID NO: 11120
  CDS (1)..(1461)

SEQ ID NO: 68253 - protein, 486 aa, Bacteroides thetaiotaomicron VPI; identical to SEQ ID NO: 11121

SEQ ID NO: 68254 - DNA, 1440 bp, Wigglesworthia glossinidia brevipalpis; identical to SEQ ID NO: 11122
  CDS (1)..(1440)

SEQ ID NO: 68255 - protein, 479 aa, Wigglesworthia glossinidia brevipalpis; identical to SEQ ID NO: 11123

SEQ ID NO: 68256 - DNA, 1617 bp, Corynebacterium efficiens YS; identical to SEQ ID NO: 11124
  CDS (1)..(1617)

SEQ ID NO: 68257 - protein, 538 aa, Corynebacterium efficiens YS; identical to SEQ ID NO: 11125

SEQ ID NO: 68258 - DNA, 1473 bp, Bifidobacterium longum; identical to SEQ ID NO: 11126
  CDS (1)..(1473)

SEQ ID NO: 68259 - protein, 490 aa, Bifidobacterium longum; identical to SEQ ID NO: 11127

SEQ ID NO: 68260 - DNA, 1410 bp, Cytophaga sp; identical to SEQ ID NO: 11128
  CDS (1)..(1410)

SEQ ID NO: 68261 - protein, 469 aa, Cytophaga sp; identical to SEQ ID NO: 11129

SEQ ID NO: 68262 - DNA, 1386 bp, Thermoanaerobacter tengcongensis; identical to SEQ ID NO: 11130
  CDS (1)..(1386)

SEQ ID NO: 68263 - protein, 461 aa, Thermoanaerobacter tengcongensis; identical to SEQ ID NO: 11131

SEQ ID NO: 68264 - DNA, 1419 bp, Pasteurella multocida; identical to SEQ ID NO: 11132
  CDS (1)..(1419)

SEQ ID NO: 68265 - protein, 472 aa, Pasteurella multocida; identical to SEQ ID NO: 11133

SEQ ID NO: 68266 - DNA, 1374 bp, Thermoplasma acidophilum; identical to SEQ ID NO: 11134
  CDS (1)..(1374)

SEQ ID NO: 68267 - protein, 457 aa, Thermoplasma acidophilum; identical to SEQ ID NO: 11135

SEQ ID NO: 68268 - DNA, 2106 bp, Bacillus sp; identical to SEQ ID NO: 11136
  CDS (349)..(1755)

SEQ ID NO: 68269 - protein, 468 aa, Bacillus sp; identical to SEQ ID NO: 11137

SEQ ID NO: 68270 - DNA, 1428 bp, Rhizobium etli; identical to SEQ ID NO: 11138
  CDS (1)..(1428)

SEQ ID NO: 68271 - protein, 475 aa, Rhizobium etli; identical to SEQ ID NO: 11139

SEQ ID NO: 68272 - DNA, 1581 bp, Corynebacterium glutamicum; identical to SEQ ID NO: 11140
  CDS (1)..(1581)

SEQ ID NO: 68273 - protein, 526 aa, Corynebacterium glutamicum; identical to SEQ ID NO: 11141

SEQ ID NO: 68274 - DNA, 26 bp, Artificial sequence
  (1)..(26): primer
atgtgtttaaagcaaatcattggcag

SEQ ID NO: 68275 - DNA, 25 bp, Artificial sequence
  (1)..(25): primer
ttactgttcgctttcatcagtatag

SEQ ID NO: 68276 - protein, 465 aa, Artificial sequence; identical to SEQ ID NO: 33375
  Variant (2)..(2): xaa in position 2 is any amino acid
  Variant (4)..(4): xaa in position 4 is any amino acid
  Variant (6)..(7): xaa in position 6 to 7 is any amino acid
  Variant (9)..(12): xaa in position 9 to 12 is any amino acid
  Variant (14)..(16): xaa in position 14 to 16 is any amino acid
  Variant (18)..(18): xaa in position 18 is any amino acid
  Variant (20)..(21): xaa in position 20 to 21 is any amino acid
  Variant (23)..(23): xaa in position 23 is any amino acid
  Variant (26)..(27): xaa in position 26 to 27 is any amino acid
  Variant (30)..(30): xaa in position 30 is any amino acid
  Variant (32)..(49): xaa in position 32 to 49 is any amino acid
  Variant (51)..(51): xaa in position 51 is any amino acid
  Variant (53)..(53): xaa in position 53 is any amino acid
  Variant (55)..(56): xaa in position 55 to 56 is any amino acid
  Variant (58)..(70): xaa in position 58 to 70 is any amino acid
  Variant (72)..(73): xaa in position 72 to 73 is any amino acid
  Variant (75)..(88): xaa in position 75 to 88 is any amino acid
  Variant (90)..(91): xaa in position 90 to 91 is any amino acid
  Variant (93)..(94): xaa in position 93 to 94 is any amino acid
  Variant (102)..(102): xaa in position 102 is any amino acid
  Variant (106)..(106): xaa in position 106 is any amino acid
  Variant (110)..(110): xaa in position 110 is any amino acid
  Variant (113)..(113): xaa in position 113 is any amino acid
  Variant (115)..(115): xaa in position 115 is any amino acid
  Variant (117)..(118): xaa in position 117 to 118 is any amino acid
  Variant (120)..(122): xaa in position 120 to 122 is any amino acid
  Variant (124)..(124): xaa in position 124 is any amino acid
  Variant (126)..(129): xaa in position 126 to 129 is any amino acid
  Variant (132)..(133): xaa in position 132 to 133 is any amino acid
  Variant (136)..(137): xaa in position 136 to 137 is any amino acid
  Variant (143)..(144): xaa in position 143 to 144 is any amino acid
  Variant (147)..(159): xaa in position 147 to 159 is any amino acid
  Variant (161)..(166): xaa in position 161 to 166 is any amino acid
  Variant (168)..(173): xaa in position 168 to 173 is any amino acid
  Variant (175)..(176): xaa in position 175 to 176 is any amino acid
  Variant (179)..(182): xaa in position 179 to 182 is any amino acid
  Variant (184)..(184): xaa in position 184 is any amino acid
  Variant (188)..(188): xaa in position 188 is any amino acid
  Variant (195)..(197): xaa in position 195 to 197 is any amino acid
  Variant (202)..(226): xaa in position 202 to 226 is any amino acid
  Variant (228)..(228): xaa in position 228 is any amino acid
  Variant (230)..(230): xaa in position 230 is any amino acid
  Variant (233)..(233): xaa in position 233 is any amino acid
  Variant (237)..(237): xaa in position 237 is any amino acid
  Variant (239)..(242): xaa in position 239 to 242 is any amino acid
  Variant (244)..(250): xaa in position 244 to 250 is any amino acid
  Variant (252)..(261): xaa in position 252 to 261 is any amino acid
  Variant (263)..(264): xaa in position 263 to 264 is any amino acid
  Variant (266)..(267): xaa in position 266 to 267 is any amino acid
  Variant (270)..(281): xaa in position 270 to 281 is any amino acid
  Variant (284)..(285): xaa in position 284 to 285 is any amino acid
  Variant (287)..(290): xaa in position 287 to 290 is any amino acid
  Variant (292)..(293): xaa in position 292 to 293 is any amino acid
  Variant (300)..(300): xaa in position 300 is any amino acid
  Variant (305)..(305): xaa in position 305 is any amino acid
  Variant (307)..(308): xaa in position 307 to 308 is any amino acid
  Variant (310)..(311): xaa in position 310 to 311 is any amino acid
  Variant (314)..(315): xaa in position 314 to 315 is any amino acid
  Variant (317)..(317): xaa in position 317 is any amino acid
  Variant (324)..(324): xaa in position 324 is any amino acid
  Variant (330)..(331): xaa in position 330 to 331 is any amino acid
  Variant (333)..(334): xaa in position 333 to 334 is any amino acid
  Variant (337)..(340): xaa in position 337 to 340 is any amino acid
  Variant (342)..(342): xaa in position 342 is any amino acid
  Variant (346)..(350): xaa in position 346 to 350 is any amino acid
  Variant (352)..(354): xaa in position 352 to 354 is any amino acid
  Variant (358)..(358): xaa in position 358 is any amino acid
  Variant (361)..(363): xaa in position 361 to 363 is any amino acid
  Variant (365)..(372): xaa in position 365 to 372 is any amino acid
  Variant (374)..(387): xaa in position 374 to 387 is any amino acid
  Variant (389)..(390): xaa in position 389 to 390 is any amino acid
  Variant (393)..(394): xaa in position 393 to 394 is any amino acid
  Variant (396)..(405): xaa in position 396 to 405 is any amino acid
  Variant (407)..(410): xaa in position 407 to 410 is any amino acid
  Variant (412)..(412): xaa in position 412 is any amino acid
  Variant (416)..(417): xaa in position 416 to 417 is any amino acid
  Variant (419)..(432): xaa in position 419 to 432 is any amino acid
  Variant (434)..(447): xaa in position 434 to 447 is any amino acid
  Variant (449)..(464): xaa in position 449 to 464 is any amino acid

SEQ ID NO: 68277 - protein, 50 aa, Artificial sequence; identical to SEQ ID NO: 13505
  Variant (2)..(2): xaa in position 2 is any amino acid
  Variant (4)..(4): xaa in position 4 is any amino acid
  Variant (6)..(6): xaa in position 6 is any amino acid
  Variant (7)..(7): xaa in position 7 is Leu, Ile, Phe, Met or Val
  Variant (9)..(11): xaa in position 9 to 11 is any amino acid
  Variant (12)..(12): xaa in position 12 is Val, Ile or Leu
  Variant (13)..(13): xaa in position 13 is Pro, Ser, Glu or Ala
  Variant (14)..(16): xaa in position 14 to 16 is any amino acid
  Variant (17)..(17): xaa in position 17 is Tyr, Leu or Phe
  Variant (18)..(18): xaa in position 18 is Tyr, Trp, Phe or His
  Variant (20)..(20): xaa in position 20 is Ile, Val or Ala
  Variant (21)..(21): xaa in position 21 is Gln, His or Asn
  Variant (22)..(22): xaa in position 22 is Thr or Ser
  Variant (23)..(23): xaa in position 23 is any amino acid
  Variant (25)..(25): xaa in position 25 is Ala, Ser or Gly
  Variant (26)..(27): xaa in position 26 to 27 is any amino acid
  Variant (29)..(29): xaa in position 29 is Phe, Tyr or Val
  Variant (30)..(30): xaa in position 30 is any amino acid
  Variant (31)..(31): xaa in position 31 is Ile, Leu or Val
  Variant (32)..(32): xaa in position 32 is Ser, Thr or Gly
  Variant (33)..(40): xaa in position 33 to 40 is any amino acid
  Variant (41)..(42): xaa in position 41 to 42 is any or no amino acid
  Variant (43)..(43): xaa in position 43 is Ile, Val or Met
  Variant (44)..(44): xaa in position 44 is any amino acid
  Variant (45)..(45): xaa in position 45 is Ala, Gly or Ser
  Variant (46)..(48): xaa in position 46 to 48 is any amino acid
  Variant (49)..(49): xaa in position 49 is Val, Thr, Ile or Leu

SEQ ID NO: 68278 - protein, 57 aa, Artificial sequence; identical to SEQ ID NO: 13506
  Variant (1)..(1): xaa in position 1 is Gln or Ser
  Variant (2)..(2): xaa in position 2 is Gly, Thr or Ala
  Variant (4)..(4): xaa in position 4 is Ala or Ser
  Variant (7)..(7): xaa in position 7 is Ser, Gln or Thr
  Variant (8)..(8): xaa in position 8 is any amino acid
  Variant (9)..(9): xaa in position 9 is Asn or His
  Variant (12)..(12): xaa in position 12 is any amino acid
  Variant (16)..(16): xaa in position 16 is Ile, Leu or Val
  Variant (17)..(17): xaa in position 17 is Ala, Ser, Thr or Gly
  Variant (19)..(19): xaa in position 19 is Arg, Ile, Leu or Val
  Variant (20)..(20): xaa in position 20 is Ala, Gly or Leu
  Variant (21)..(21): xaa in position 21 is any amino acid
  Variant (22)..(22): xaa in position 22 is Glu, Ile, Gln, Thr or Arg
  Variant (23)..(23): xaa in position 23 is any amino acid
  Variant (24)..(24): xaa in position 24 is Leu, Met, Arg, Ala or Ile
  Variant (25)..(25): xaa in position 25 is Gly, Asn or Pro
  Variant (26)..(27): xaa in position 26 to 27 is any or no amino acid
  Variant (28)..(28): xaa in position 28 is Lys, Arg, Ala or Pro
  Variant (29)..(29): xaa in position 29 is Gly or Val
  Variant (30)..(30): xaa in position 30 is any amino acid
  Variant (31)..(31): xaa in position 31 is Tyr, Phe or no amino acid
  Variant (32)..(33): xaa in position 32 to 33 is any or no amino acid
  Variant (34)..(34): xaa in position 34 is Leu, Val, Ile or Cys
  Variant (35)..(35): xaa in position 35 is His, Asn, Ser or Asp
  Variant (37)..(37): xaa in position 37 is Asn, Met, Ile or Leu
  Variant (38)..(38): xaa in position 38 is any amino acid
  Variant (39)..(39): xaa in position 39 is His or Asp
  Variant (40)..(40): xaa in position 40 is Val or Leu
  Variant (42)..(42): xaa in position 42 is any amino acid
  Variant (43)..(43): xaa in position 43 is Ser, Ala, Cys, Gly or His
  Variant (46)..(46): xaa in position 46 is Thr, Ser or Gln
  Variant (48)..(48): xaa in position 48 is Asp or Cys
  Variant (49)..(49): xaa in position 49 is Ala, Val, Thr or Ser
  Variant (50)..(50): xaa in position 50 is Tyr, Phe or Ile
  Variant (51)..(51): xaa in position 51 is Pro or Ser
  Variant (52)..(52): xaa in position 52 is Thr, Ser or Ala
  Variant (53)..(53): xaa in position 53 is Ala, Gly, Val, Ser or Met
  Variant (54)..(54): xaa in position 54 is any amino acid
  Variant (55)..(55): xaa in position 55 is Arg, His, Lys or Asn
  Variant (56)..(56): xaa in position 56 is Ile, Leu, Val or Met
  Variant (57)..(57): xaa in position 57 is Ala, Gly, Ser or Thr

SEQ ID NO: 68279 - protein, 56 aa, Artificial sequence; identical to SEQ ID NO: 13507
  Variant (1)..(1): xaa in position 1 is Leu, Ile or Val
  Variant (2)..(2): xaa in position 2 is Lys or Arg
  Variant (3)..(3): xaa in position 3 is any amino acid
  Variant (4)..(4): xaa in position 4 is Gly or Ala
  Variant (7)..(7): xaa in position 7 is Gln or His
  Variant (8)..(8): xaa in position 8 is Leu, Thr or Met
  Variant (9)..(9): xaa in position 9 is Gln, Glu or Met
  Variant (11)..(11): xaa in position 11 is Ala or Gly
  Variant (12)..(12): xaa in position 12 is Val, Thr, Leu, Ala or Pro
  Variant (14)..(14): xaa in position 14 is Met, Ile, Leu or Val
  Variant (15)..(15): xaa in position 15 is Thr, Arg, Ser, Met or Leu
  Variant (16)..(16): xaa in position 16 is Leu, Val, Met, Phe or Tyr
  Variant (18)..(18): xaa in position 18 is any amino acid
  Variant (19)..(19): xaa in position 19 is Glu or Thr
  Variant (21)..(21): xaa in position 21 is any amino acid
  Variant (22)..(22): xaa in position 22 is Ala, Gly, Thr or Ser
  Variant (23)..(23): xaa in position 23 is Phe, Tyr or Trp
  Variant (24)..(26): xaa in position 24 to 26 is any amino acid
  Variant (27)..(27): xaa in position 27 is Leu, Val, Ile, Met or Phe
  Variant (28)..(29): xaa in position 28 to 29 is any amino acid
  Variant (30)..(30): xaa in position 30 is Asp, Glu, Gly, His or Asn
  Variant (31)..(33): xaa in position 31 to 33 is any amino acid
  Variant (34)..(34): xaa in position 34 is Leu, Ile, Val or Phe
  Variant (35)..(38): xaa in position 35 to 38 is any amino acid
  Variant (39)..(39): xaa in position 39 is Pro or no amino acid
  Variant (40)..(41): xaa in position 40 to 41 is any amino acid
  Variant (42)..(42): xaa in position 42 is Leu, Ile, Met, Val or Phe
  Variant (43)..(44): xaa in position 43 to 44 is any amino acid
  Variant (45)..(45): xaa in position 45 is Val, Ile, Leu or Met
  Variant (46)..(46): xaa in position 46 is Asn, Ala, Gly or Ser
  Variant (47)..(47): xaa in position 47 is Leu, Met, Ile or Gln
  Variant (49)..(49): xaa in position 49 is Ala or Gly
  Variant (50)..(50): xaa in position 50 is Thr or Ser
  Variant (51)..(51): xaa in position 51 is Ala or Val
  Variant (52)..(52): xaa in position 52 is Ile, Val or Ala
  Variant (55)..(55): xaa in position 55 is Gly, Arg, Ala, Ser or Lys
  Variant (56)..(56): xaa in position 56 is Leu, Ile, Val or Met

SEQ ID NO: 68280 - protein, 105 aa, Artificial sequence; identical to SEQ ID NO: 13508
  Variant (1)..(1): xaa in position 1 is Lys or Arg
  Variant (2)..(2): xaa in position 2 is any amino acid
  Variant (3)..(3): xaa in position 3 is Cys, Ala, Ser or Gly
  Variant (4)..(4): xaa in position 4 is Asn, Ser, His, Asp or Gly
  Variant (6)..(6): xaa in position 6 is Leu or Ile
  Variant (8)..(8): xaa in position 8 is Leu, Phe or Ile
  Variant (9)..(9): xaa in position 9 is Leu or Met
  Variant (10)..(10): xaa in position 10 is any amino acid
  Variant (14)..(15): xaa in position 14 to 15 is any amino acid
  Variant (16)..(16): xaa in position 16 is Gly or Val
  Variant (17)..(17): xaa in position 17 is Leu, Ile or Phe
  Variant (18)..(18): xaa in position 18 is any amino acid
  Variant (19)..(19): xaa in position 19 is Glu or Asp
  Variant (20)..(20): xaa in position 20 is Ile, Leu, Phe or Val
  Variant (21)..(21): xaa in position 21 is any amino acid
  Variant (22)..(22): xaa in position 22 is Leu, Val or Ile
  Variant (23)..(23): xaa in position 23 is Pro or Glu
  Variant (24)..(25): xaa in position 24 to 25 is any amino acid
  Variant (26)..(26): xaa in position 26 is Gln, Glu or Ala
  Variant (27)..(27): xaa in position 27 is Pro, Ala, Asn or Gln
  Variant (34)..(34): xaa in position 34 is Gly or Ala
  Variant (36)..(36): xaa in position 36 is Val, Ile or Tyr
  Variant (39)..(39): xaa in position 39 is Val, Thr or Ser
  Variant (40)..(40): xaa in position 40 is Ile, Met, Val, Gln or Leu
  Variant (41)..(41): xaa in position 41 is Pro, Cys, Ala or Ser
  Variant (43)..(43): xaa in position 43 is any amino acid
  Variant (44)..(44): xaa in position 44 is Val, Ile, Leu, Met or Thr
  Variant (45)..(45): xaa in position 45 is any amino acid
  Variant (46)..(46): xaa in position 46 is Gln, Met, Thr or Leu
  Variant (47)..(47): xaa in position 47 is Val, Ile, Thr, Ala or Cys
  Variant (48)..(48): xaa in position 48 is Cys, Ala or Ser
  Variant (49)..(49): xaa in position 49 is Phe, Tyr, Ala, His or Met
  Variant (50)..(50): xaa in position 50 is any amino acid
  Variant (51)..(51): xaa in position 51 is Val, Ile or Ala
  Variant (52)..(52): xaa in position 52 is any amino acid
  Variant (53)..(53): xaa in position 53 is Gly, Ala or Ser
  Variant (54)..(54): xaa in position 54 is any amino acid
  Variant (55)..(55): xaa in position 55 is Asp, His, Gln or Asn
  Variant (56)..(56): xaa in position 56 is any amino acid
  Variant (57)..(57): xaa in position 57 is Thr, Ala, Cys, Ser or Ile
  Variant (58)..(58): xaa in position 58 is Val, Ile or Leu
  Variant (59)..(60): xaa in position 59 to 60 is any amino acid
  Variant (61)..(61): xaa in position 61 is Ala, Gly or Ser
  Variant (62)..(62): xaa in position 62 is Ala, Ser, Gly, Val or Cys
  Variant (63)..(63): xaa in position 63 is Glu, Ser, Gln, Ala or Asp
  Variant (64)..(64): xaa in position 64 is any amino acid
  Variant (65)..(65): xaa in position 65 is Gly or Ala
  Variant (66)..(66): xaa in position 66 is Gln, His or Asn
  Variant (67)..(67): xaa in position 67 is Leu, Phe or Met
  Variant (68)..(68): xaa in position 68 is Gln or Glu
  Variant (71)..(71): xaa in position 71 is Val, Ala or Gln
  Variant (72)..(72): xaa in position 72 is Met or Phe
  Variant (73)..(73): xaa in position 73 is any amino acid
  Variant (75)..(75): xaa in position 75 is any amino acid
  Variant (76)..(76): xaa in position 76 is Ile, Leu, Met, Thr or Val
  Variant (77)..(79): xaa in position 77 to 79 is any amino acid
  Variant (80)..(80): xaa in position 80 is Leu, Met, Ile or Cys
  Variant (81)..(82): xaa in position 81 to 82 is any amino acid
  Variant (83)..(83): xaa in position 83 is Ser, Gly or Thr
  Variant (84)..(86): xaa in position 84 to 86 is any amino acid
  Variant (87)..(87): xaa in position 87 is Leu, Met or Ile
  Variant (88)..(89): xaa in position 88 to 89 is any amino acid
  Variant (90)..(90): xaa in position 90 is Ala, Gly, Thr or Val
  Variant (91)..(93): xaa in position 91 to 93 is any amino acid
  Variant (94)..(94): xaa in position 94 is Leu or Phe
  Variant (95)..(96): xaa in position 95 to 96 is any amino acid
  Variant (97)..(97): xaa in position 97 is any or no amino acid
  Variant (98)..(98): xaa in position 98 is Cys, Ala, Tyr or Leu
  Variant (99)..(99): xaa in position 99 is Ile, Val or Leu
  Variant (100)..(101): xaa in position 100 to 101 is any amino acid
  Variant (102)..(102): xaa in position 102 is Ile, Leu, Met or Val
  Variant (103)..(103): xaa in position 103 is any amino acid
  Variant (104)..(104): xaa in position 104 is Ala, Val, Ile, Pro or Gly
  Variant (105)..(105): xaa in position 105 is Asn, Asp or Gln

SEQ ID NO: 68281 - DNA, 1216 bp, Saccharomyces cerevisiae; identical to SEQ ID NO: 58384
  CDS (208)..(993)

SEQ ID NO: 68282 - protein, 261 aa, Saccharomyces cerevisiae; identical to SEQ ID NO: 58385

SEQ ID NO: 68283 - DNA, 735 bp, Mus musculus; identical to SEQ ID NO: 58386
  CDS (1)..(735)

SEQ ID NO: 68284 - protein, 244 aa, Mus musculus; identical to SEQ ID NO: 58387

SEQ ID NO: 68285 - DNA, 696 bp, Danio rerio; identical to SEQ ID NO: 58388
  CDS (1)..(696)

SEQ ID NO: 68286 - protein, 231 aa, Danio rerio; identical to SEQ ID NO: 58389

SEQ ID NO: 68287 - DNA, 735 bp, Mus musculus; identical to SEQ ID NO: 58390
  CDS (1)..(735)

SEQ ID NO: 68288 - protein, 244 aa, Mus musculus; identical to SEQ ID NO: 58391

SEQ ID NO: 68289 - DNA, 663 bp, Pyrococcus abyssi GE5; identical to SEQ ID NO: 58392
  CDS (1)..(663): transl_table=11

SEQ ID NO: 68290 - protein, 220 aa, Pyrococcus abyssi GE5; identical to SEQ ID NO: 58393

SEQ ID NO: 68291 - DNA, 660 bp, Pyrococcus horikoshii OT3; identical to SEQ ID NO: 58394
  CDS (1)..(660): transl_table=11

SEQ ID NO: 68292 - protein, 219 aa, Pyrococcus horikoshii OT3; identical to SEQ ID NO: 58395

SEQ ID NO: 68293 - DNA, 723 bp, Aeropyrum pernix K1; identical to SEQ ID NO: 58396
  CDS (1)..(723): transl_table=11

SEQ ID NO: 68294 - protein, 240 aa, Aeropyrum pernix K1; identical to SEQ ID NO: 58397

SEQ ID NO: 68295 - DNA, 1452 bp, Halobacterium sp. NRC-1; identical to SEQ ID NO: 58398
  CDS (1)..(1452): transl_table=11

SEQ ID NO: 68296 - protein, 483 aa, Halobacterium sp. NRC-1; identical to SEQ ID NO: 58399

SEQ ID NO: 68297 - DNA, 672 bp, Sulfolobus solfataricus P2; identical to SEQ ID NO: 58400
  CDS (1)..(672): transl_table=11

SEQ ID NO: 68298 - protein, 223 aa, Sulfolobus solfataricus P2; identical to SEQ ID NO: 58401

SEQ ID NO: 68299 - DNA, 684 bp, Sulfolobus tokodaii str. 7; identical to SEQ ID NO: 58402
  CDS (1)..(684): transl_table=11

SEQ ID NO: 68300 - protein, 227 aa, Sulfolobus tokodaii str. 7; identical to SEQ ID NO: 58403

SEQ ID NO: 68301 - DNA, 636 bp, Pyrobaculum aerophilum str. IM2; identical to SEQ ID NO: 58404
  CDS (1)..(636): transl_table=11

SEQ ID NO: 68302 - protein, 211 aa, Pyrobaculum aerophilum str. IM2; identical to SEQ ID NO: 58405

SEQ ID NO: 68303 - DNA, 681 bp, Arabidopsis thaliana; identical to SEQ ID NO: 58406
  CDS (1)..(681)

SEQ ID NO: 68304 - protein, 226 aa, Arabidopsis thaliana; identical to SEQ ID NO: 58407

SEQ ID NO: 68305 - DNA, 681 bp, Pyrococcus furiosus DSM 3638; identical to SEQ ID NO: 58408
  CDS (1)..(681): transl_table=11

SEQ ID NO: 68306 - protein, 226 aa, Pyrococcus furiosus DSM 3638; identical to SEQ ID NO: 58409

SEQ ID NO: 68307 - DNA, 594 bp, Encephalitozoon cuniculi GB-M1; identical to SEQ ID NO: 58410
  CDS (1)..(594)

SEQ ID NO: 68308 - protein, 197 aa, Encephalitozoon cuniculi GB-M1; identical to SEQ ID NO: 58411

SEQ ID NO: 68309 - DNA, 717 bp, Schizosaccharomyces pombe 972h-; identical to SEQ ID NO: 58412
  CDS (1)..(717)

SEQ ID NO: 68310 - protein, 238 aa, Schizosaccharomyces pombe 972h-; identical to SEQ ID NO: 58413

SEQ ID NO: 68311 - DNA, 621 bp, Methanopyrus kandleri AV19; identical to SEQ ID NO: 58414
  CDS (1)..(621): transl_table=11

SEQ ID NO: 68312 - protein, 206 aa, Methanopyrus kandleri AV19; identical to SEQ ID NO: 58415

SEQ ID NO: 68313 - DNA, 1644 bp, Methanosarcina acetivorans C2A; identical to SEQ ID NO: 58416
  CDS (1)..(1644): transl_table=11

SEQ ID NO: 68314 - protein, 547 aa, Methanosarcina acetivorans C2A; identical to SEQ ID NO: 58417

SEQ ID NO: 68315 - DNA, 1689 bp, Methanosarcina mazei Go1; identical to SEQ ID NO: 58418
  CDS (1)..(1689): transl_table=11

SEQ ID NO: 68316 - protein, 562 aa, Methanosarcina mazei Go1; identical to SEQ ID NO: 58419

SEQ ID NO: 68317 - DNA, 675 bp, Drosophila melanogaster; identical to SEQ ID NO: 58420
  CDS (1)..(675)

SEQ ID NO: 68318 - protein, 224 aa, Drosophila melanogaster; identical to SEQ ID NO: 58421

SEQ ID NO: 68319 - DNA, 690 bp, Plasmodium falciparum 3D7; identical to SEQ ID NO: 58422
  CDS (1)..(690)

SEQ ID NO: 68320 - protein, 229 aa, Plasmodium falciparum 3D7; identical to SEQ ID NO: 58423

SEQ ID NO: 68321 - DNA, 2040 bp, Oryza sativa (japonica cultivar-group); identical to SEQ ID NO: 58424
  CDS (1)..(2040)

SEQ ID NO: 68322 - protein, 679 aa, Oryza sativa (japonica cultivar-group); identical to SEQ ID NO: 58425

SEQ ID NO: 68323 - DNA, 783 bp, Eremothecium gossypii; identical to SEQ ID NO: 58426
  CDS (1)..(783)

SEQ ID NO: 68324 - protein, 260 aa, Eremothecium gossypii; identical to SEQ ID NO: 58427

SEQ ID NO: 68325 - DNA, 1647 bp, Methanococcus maripaludis S2; identical to SEQ ID NO: 58428
  CDS (1)..(1647): transl_table=11

SEQ ID NO: 68326 - protein, 548 aa, Methanococcus maripaludis S2; identical to SEQ ID NO: 58429

SEQ ID NO: 68327 - DNA, 702 bp, Anopheles gambiae str. PEST; identical to SEQ ID NO: 58430
  CDS (1)..(702)

SEQ ID NO: 68328 - protein, 233 aa, Anopheles gambiae str. PEST; identical to SEQ ID NO: 58431

SEQ ID NO: 68329 - DNA, 735 bp, Rattus norvegicus; identical to SEQ ID NO: 58432
  CDS (1)..(735)

SEQ ID NO: 68330 - protein, 244 aa, Rattus norvegicus; identical to SEQ ID NO: 58433

SEQ ID NO: 68331 - DNA, 741 bp, Rattus norvegicus; identical to SEQ ID NO: 58434
  CDS (1)..(741)

SEQ ID NO: 68332 - protein, 246 aa, Rattus norvegicus; identical to SEQ ID NO: 58435

SEQ ID NO: 68333 - DNA, 810 bp, Magnaporthe grisea 70-15; identical to SEQ ID NO: 58436
  CDS (1)..(810)

SEQ ID NO: 68334 - protein, 269 aa, Magnaporthe grisea 70-15; identical to SEQ ID NO: 58437

SEQ ID NO: 68335 - DNA, 789 bp, Gibberella zeae PH-1; identical to SEQ ID NO: 58438
  CDS (1)..(789)

SEQ ID NO: 68336 - protein, 262 aa, Gibberella zeae PH-1; identical to SEQ ID NO: 58439

SEQ ID NO: 68337 - DNA, 711 bp, Apis mellifera; identical to SEQ ID NO: 58440
  CDS (1)..(711)

SEQ ID NO: 68338 - protein, 236 aa, Apis mellifera; identical to SEQ ID NO: 58441

SEQ ID NO: 68339 - DNA, 966 bp, Gallus gallus; identical to SEQ ID NO: 58442
  CDS (1)..(966)

SEQ ID NO: 68340 - protein, 321 aa, Gallus gallus; identical to SEQ ID NO: 58443

SEQ ID NO: 68341 - DNA, 801 bp, Candida glabrata CBS138; identical to SEQ ID NO: 58444
  CDS (1)..(801)

SEQ ID NO: 68342 - protein, 266 aa, Candida glabrata CBS138; identical to SEQ ID NO: 58445

SEQ ID NO: 68343 - DNA, 792 bp, Kluyveromyces lactis NRRL Y-1140; identical to SEQ ID NO: 58446
  CDS (1)..(792)

SEQ ID NO: 68344 - protein, 263 aa, Kluyveromyces lactis NRRL Y-1140; identical to SEQ ID NO: 58447

SEQ ID NO: 68345 - DNA, 783 bp, Debaryomyces hansenii CBS767; identical to SEQ ID NO: 58448
  CDS (1)..(783)

SEQ ID NO: 68346 - protein, 260 aa, Debaryomyces hansenii CBS767; identical to SEQ ID NO: 58449

SEQ ID NO: 68347 - DNA, 747 bp, Yarrowia lipolytica CLIB99; identical to SEQ ID NO: 58450
  CDS (1)..(747)

SEQ ID NO: 68348 - protein, 248 aa, Yarrowia lipolytica CLIB99; identical to SEQ ID NO: 58451

SEQ ID NO: 68349 - DNA, 762 bp, Pan troglodytes; identical to SEQ ID NO: 58452
  CDS (1)..(762)

SEQ ID NO: 68350 - protein, 253 aa, Pan troglodytes; identical to SEQ ID NO: 58453

SEQ ID NO: 68351 - DNA, 759 bp, Dictyostelium discoideum; identical to SEQ ID NO: 58454
  CDS (1)..(759)

SEQ ID NO: 68352 - protein, 252 aa, Dictyostelium discoideum; identical to SEQ ID NO: 58455

SEQ ID NO: 68353 - DNA, 519 bp, Entamoeba histolytica HM-1:IMSS; identical to SEQ ID NO: 58456
  CDS (1)..(519)

SEQ ID NO: 68354 - protein, 172 aa, Entamoeba histolytica HM-1:IMSS; identical to SEQ ID NO: 58457

SEQ ID NO: 68355 - DNA, 696 bp, Entamoeba histolytica HM-1:IMSS; identical to SEQ ID NO: 58458
  CDS (1)..(696)

SEQ ID NO: 68356 - protein, 231 aa, Entamoeba histolytica HM-1:IMSS; identical to SEQ ID NO: 58459

SEQ ID NO: 68357 - DNA, 858 bp, Aspergillus nidulans FGSC A4; identical to SEQ ID NO: 58460
  CDS (1)..(858)

SEQ ID NO: 68358 - protein, 285 aa, Aspergillus nidulans FGSC A4; identical to SEQ ID NO: 58461

SEQ ID NO: 68359 - DNA, 648 bp, Plasmodium berghei; identical to SEQ ID NO: 58462
  CDS (1)..(648)

SEQ ID NO: 68360 - protein, 215 aa, Plasmodium berghei; identical to SEQ ID NO: 58463

SEQ ID NO: 68361 - DNA, 891 bp, Candida albicans SC5314; identical to SEQ ID NO: 58464
  CDS (1)..(891): transl_table=12

SEQ ID NO: 68362 - protein, 296 aa, Candida albicans SC5314; identical to SEQ ID NO: 58465

SEQ ID NO: 68363 - DNA, 648 bp, Plasmodium chabaudi; identical to SEQ ID NO: 58466
  CDS (1)..(648)

SEQ ID NO: 68364 - protein, 215 aa, Plasmodium chabaudi; identical to SEQ ID NO: 58467

SEQ ID NO: 68365 - DNA, 834 bp, Aspergillus fumigatus Af293; identical to SEQ ID NO: 58468
  CDS (1)..(834)

SEQ ID NO: 68366 - protein, 277 aa, Aspergillus fumigatus Af293; identical to SEQ ID NO: 58469

SEQ ID NO: 68367 - DNA, 1476 bp, Ustilago maydis 521; identical to SEQ ID NO: 58470
  CDS (1)..(1476)

SEQ ID NO: 68368 - protein, 491 aa, Ustilago maydis 521; identical to SEQ ID NO: 58471

SEQ ID NO: 68369 - DNA, 723 bp, Strongylocentrotus purpuratus; identical to SEQ ID NO: 58472
  CDS (1)..(723)

SEQ ID NO: 68370 - protein, 240 aa, Strongylocentrotus purpuratus; identical to SEQ ID NO: 58473

SEQ ID NO: 68371 - DNA, 432 bp, Strongylocentrotus purpuratus; identical to SEQ ID NO: 58474
  CDS (1)..(432)

SEQ ID NO: 68372 - protein, 143 aa, Strongylocentrotus purpuratus; identical to SEQ ID NO: 58475

SEQ ID NO: 68373 - DNA, 774 bp, Trypanosoma cruzi; identical to SEQ ID NO: 58476
  CDS (1)..(774)

SEQ ID NO: 68374 - protein, 257 aa, Trypanosoma cruzi; identical to SEQ ID NO: 58477

SEQ ID NO: 68375 - DNA, 741 bp, Trypanosoma brucei; identical to SEQ ID NO: 58478
  CDS (1)..(741)

SEQ ID NO: 68376 - protein, 246 aa, Trypanosoma brucei; identical to SEQ ID NO: 58479

SEQ ID NO: 68377 - DNA, 909 bp, Canis familiaris; identical to SEQ ID NO: 58480
  CDS (1)..(909)

SEQ ID NO: 68378 - protein, 302 aa, Canis familiaris; identical to SEQ ID NO: 58481

SEQ ID NO: 68379 - DNA, 666 bp, Thermococcus kodakarensis KOD1; identical to SEQ ID NO: 58482
  CDS (1)..(666): transl_table=11

SEQ ID NO: 68380 - protein, 221 aa, Thermococcus kodakarensis KOD1; identical to SEQ ID NO: 58483

SEQ ID NO: 68381 - DNA, 660 bp, Sulfolobus acidocaldarius DSM 639; identical to SEQ ID NO: 58484
  CDS (1)..(660): transl_table=11

SEQ ID NO: 68382 - protein, 219 aa, Sulfolobus acidocaldarius DSM 639; identical to SEQ ID NO: 58485

SEQ ID NO: 68383 - DNA, 1638 bp, Methanosarcina barkeri str. fusaro; identical to SEQ ID NO: 58486
  CDS (1)..(1638): transl_table=11

SEQ ID NO: 68384 - protein, 545 aa, Methanosarcina barkeri str. fusaro; identical to SEQ ID NO: 58487

SEQ ID NO: 68385 - DNA, 1596 bp, Ferroplasma acidarmanus Fer1; identical to SEQ ID NO: 58488
  CDS (1)..(1596): transl_table=11

SEQ ID NO: 68386 - protein, 531 aa, Ferroplasma acidarmanus Fer1; identical to SEQ ID NO: 58489

SEQ ID NO: 68387 - DNA, 879 bp, Leishmania major; identical to SEQ ID NO: 58490
  CDS (1)..(879)

SEQ ID NO: 68388 - protein, 292 aa, Leishmania major; identical to SEQ ID NO: 58491

SEQ ID NO: 68389 - DNA, 627 bp, Theileria annulata; identical to SEQ ID NO: 58492
  CDS (1)..(627)

SEQ ID NO: 68390 - protein, 208 aa, Theileria annulata; identical to SEQ ID NO: 58493

SEQ ID NO: 68391 - DNA, 714 bp, Xenopus laevis; identical to SEQ ID NO: 58494
  CDS (1)..(714)

SEQ ID NO: 68392 - protein, 237 aa, Xenopus laevis; identical to SEQ ID NO: 58495

SEQ ID NO: 68393 - DNA, 1671 bp, Caenorhabditis briggsae; identical to SEQ ID NO: 58496
  CDS (1)..(1671)

SEQ ID NO: 68394 - protein, 556 aa, Caenorhabditis briggsae; identical to SEQ ID NO: 58497

SEQ ID NO: 68395 - DNA, 762 bp, Homo sapiens; identical to SEQ ID NO: 58498
  CDS (1)..(762)

SEQ ID NO: 68396 - protein, 253 aa, Homo sapiens [sequence omitted]

SEQ ID NO: 68397 - DNA, 762 bp, Homo sapiens; identical to SEQ ID NO: 58500
  CDS (1)..(762)

SEQ ID NO: 68398 - protein, 253 aa, Homo sapiens; identical to SEQ ID NO: 58501

SEQ ID NO: 68399 - DNA, 735 bp, Mus musculus; identical to SEQ ID NO: 58502
  CDS (1)..(735)

SEQ ID NO: 68400 - protein, 244 aa, Mus musculus; identical to SEQ ID NO: 58503

SEQ ID NO: 68401 - DNA, 26 bp, Artificial sequence
  (1)..(26): primer
atgacgcaagaattcattgataaagt

SEQ ID NO: 68402 - DNA, 25 bp, Artificial sequence
  (1)..(25): primer
ttatcctagcatacttctcttacga

SEQ ID NO: 68403 - protein, 375 aa, Artificial sequence; identical to SEQ ID NO: 58506
  Variant (2)..(3): xaa in position 2 to 3 is any amino acid
  Variant (8)..(8): xaa in position 8 is any amino acid
  Variant (11)..(15): xaa in position 11 to 15 is any amino acid
  Variant (16)..(103): xaa in position 16 to 103 is any or no amino acid
  Variant (105)..(105): xaa in position 105 is any amino acid
  Variant (107)..(107): xaa in position 107 is any amino acid
  Variant (109)..(110): xaa in position 109 to 110 is any amino acid
  Variant (112)..(112): xaa in position 112 is any amino acid
  Variant (115)..(117): xaa in position 115 to 117 is any amino acid
  Variant (120)..(121): xaa in position 120 to 121 is any amino acid
  Variant (123)..(125): xaa in position 123 to 125 is any amino acid
  Variant (127)..(129): xaa in position 127 to 129 is any amino acid
  Variant (131)..(131): xaa in position 131 is any amino acid
  Variant (133)..(133): xaa in position 133 is any amino acid
  Variant (135)..(135): xaa in position 135 is any amino acid
  Variant (137)..(141): xaa in position 137 to 141 is any amino acid
  Variant (142)..(143): xaa in position 142 to 143 is any or no amino acid
  Variant (145)..(146): xaa in position 145 to 146 is any amino acid
  Variant (148)..(148): xaa in position 148 is any amino acid
  Variant (150)..(152): xaa in position 150 to 152 is any amino acid
  Variant (154)..(156): xaa in position 154 to 156 is any amino acid
  Variant (157)..(167): xaa in position 157 to 167 is any or no amino acid
  Variant (169)..(169): xaa in position 169 is any amino acid
  Variant (172)..(172): xaa in position 172 is any amino acid
  Variant (174)..(181): xaa in position 174 to 181 is any amino acid
  Variant (182)..(182): xaa in position 182 is any or no amino acid
  Variant (184)..(186): xaa in position 184 to 186 is any amino acid
  Variant (187)..(227): xaa in position 187 to 227 is any or no amino acid
  Variant (229)..(231): xaa in position 229 to 231 is any amino acid
  Variant (234)..(235): xaa in position 234 to 235 is any amino acid
  Variant (238)..(238): xaa in position 238 is any amino acid
  Variant (241)..(243): xaa in position 241 to 243 is any amino acid
  Variant (257)..(259): xaa in position 257 to 259 is any amino acid
  Variant (260)..(286): xaa in position 260 to 286 is any or no amino acid
  Variant (288)..(288): xaa in position 288 is any amino acid
  Variant (295)..(301): xaa in position 295 to 301 is any amino acid
  Variant (302)..(306): xaa in position 302 to 306 is any or no amino acid
  Variant (317)..(317): xaa in position 317 is any amino acid
  Variant (320)..(321): xaa in position 320 to 321 is any amino acid
  Variant (323)..(323): xaa in position 323 is any amino acid
  Variant (325)..(328): xaa in position 325 to 328 is any amino acid
  Variant (329)..(334): xaa in position 329 to 334 is any or no amino acid
  Variant (336)..(345): xaa in position 336 to 345 is any amino acid
  Variant (346)..(362): xaa in position 346 to 362 is any or no amino acid
  Variant (365)..(365): xaa in position 365 is any amino acid
  Variant (368)..(369): xaa in position 368 to 369 is any amino acid
  Variant (372)..(372): xaa in position 372 is any amino acid

SEQ ID NO: 68404 - protein, 40 aa, Artificial sequence; identical to SEQ ID NO: 58507
  Variant (2)..(3): xaa in position 2 to 3 is any or no amino acid
  Variant (5)..(5): xaa in position 5 is any amino acid
  Variant (8)..(10): xaa in position 8 to 10 is any amino acid
  Variant (11)..(11): xaa in position 11 is Ile, Leu or Val
  Variant (12)..(12): xaa in position 12 is Asp, Glu or Asn
  Variant (13)..(14): xaa in position 13 to 14 is any amino acid
  Variant (15)..(15): xaa in position 15 is Ile, Leu or Met
  Variant (16)..(18): xaa in position 16 to 18 is any amino acid
  Variant (20)..(22): xaa in position 20 to 22 is any amino acid
  Variant (24)..(33): xaa in position 24 to 33 is any amino acid
  Variant (34)..(34): xaa in position 34 is Asp, Gly or Asn
  Variant (35)..(35): xaa in position 35 is Ile, Leu or Val
  Variant (36)..(36): xaa in position 36 is any amino acid
  Variant (37)..(37): xaa in position 37 is Ala, Cys, Ser, Thr or Val
  Variant (39)..(39): xaa in position 39 is any amino acid
  Variant (40)..(40): xaa in position 40 is Ile, Leu or Val

SEQ ID NO: 68405 - protein, 21 aa, Artificial sequence
  Variant (2)..(3): xaa in position 2 to 3 is any amino acid
  Variant (4)..(4): xaa in position 4 is Ile, Leu or Val
  Variant (5)..(5): xaa in position 5 is Ala, Gly or Ser
  Variant (6)..(6): xaa in position 6 is any amino acid
  Variant (7)..(7): xaa in position 7 is Ile, Leu or Met
  Variant (9)..(13): xaa in position 9 to 13 is any amino acid
  Variant (19)..(20): xaa in position 19 to 20 is Ser or Thr
GXXXXXXHXXXXXHGDLTXXN

SEQ ID NO: 68406 - protein, 5 aa, Artificial sequence
  (1)..(5): protein
IDFGL

SEQ ID NO: 68407 - protein, 18 aa, Artificial sequence
  Variant (2)..(2): xaa in position 2 is Ala, Asp, Glu or Asn
  Variant (3)..(3): xaa in position 3 is any amino acid
  Variant (4)..(4): xaa in position 4 is Ala or Gly
  Variant (8)..(8): xaa in position 8 is any amino acid
  Variant (9)..(9): xaa in position 9 is Leu or Val
  Variant (10)..(10): xaa in position 10 is Phe, Leu or Met
  Variant (11)..(11): xaa in position 11 is any amino acid
  Variant (12)..(12): xaa in position 12 is Glu, Lys or Arg
  Variant (13)..(13): xaa in position 13 is Ala, Cys, Ser or Thr
  Variant (14)..(14): xaa in position 14 is Phe, Ile, Leu, Met or Val
  Variant (15)..(17): xaa in position 15 to 17 is any amino acid
  Variant (18)..(18): xaa in position 18 is Glu or His
EXXXVDLXXXXXXXXXXX

SEQ ID NO: 68408 - DNA, 1809 bp, Saccharomyces cerevisiae
  CDS (1)..(1809)
atgatactaaagcttgtacactgtttagttgctcttacaggattaatctttgcaaagccgtatcaacaacaacaggcagttttagcgccgtcgcaggatgtaccattaagagatatccatataggggatataaattttatccatacaaccgatactcatggctggttggggtcccatctatcacaaaacgactatgatgctgactggggagatttcgttgcatttgtagatatacttagagaaaaaattttacgacagtccagagacgtaatagtcatcgacactggcgacaaacgagacggtaatggtttgagtgatgctacttggccccccggcctacgaagctcggagatattcaacatgatggattacgatcttttaacgttaggtaatcatgagctatatacagctgaaagtgccatactagagtatagaggaacttctcagtcctcaaaattcaaagacaaatatgtttgcagcaacgtagaatttattgaagatgacggaacaagggttcctttcgggaataaatacattacattcgagactcccataatgaaacaaagagtcctggcattatcatttttgtttagttttcaaagagcaaataacagagccatcgtaacaccaccattggaagaaataactcaaaaaagctggttccaaaatatggttgagacaaacagagaggaggaaatcgacctaattattgtctttggtcatttgcctgccactgaccctacagagcgtgaaatgcacaaaattcatgctctaataaggaaatactacccaaatactgttatacaatattttggagggcacactcatatcagggattttgtacagctggactcaaaatctacttgtttacaaagtggtagatttgcggaaactgtgggattcttgtcaattaatatgactgaccctgtggacgccgaaagtcctattttctcaagaaggtatattgactttaacaaggaagctttcaaataccatttgagcaaactagggcatgactcgaatgttccagtctcaacgaaaaagggtaaaactatttctcgtttggtgaatgatctgcgccatgaactaaatttgaacgagaaactggggtacattcctcaaacttactacgtttcaacaaggccattaaactccgaagagaatctttatcatttgatcacgcataagattttacccaatttaattcctcccaaaaactatgaaccttcgatgagtcgtttcattttgattaacactggctctgtcaggtacgatctttacaaaggcccatttacaaaggatactgagtatatagtgatgccattcaataatgattggcgcttcatcacagttccattggtcgttgcctccagggtggaaacctatttgaacaagggccctgtcattgcctcattaggaataccatcatcgtctcatcacaaacagcattttggcggttttcagaagtgtcccttcatcaataatccaaatttaagcgaaggctacaccacagaagacgatttcgggtgtcatggtgatgacacacctcacaattcacaaagagaatacgatatccccaatgtagtgcaatgtaaagaggtgaagaaagtgcaagaagaggaagctgatccgtcgaagatggttcatgttatcttctattcctttatggaactcgatatattaaacgccgtaaattctatcataaatgatttaggattacgtatggagaacttgaccaccaatgactgctcccattatggtggtgattcaaccaaaaagttattacgggattacttttctcaattttag

SEQ ID NO: 68409 - protein, 602 aa, Saccharomyces cerevisiae
MILKLVHCLVALTGLIFAKPYQQQQAVLAPSQDVPLRDIHIGDINFIHTTDTHGWLGSHLSQNDYDADWGDFVAFVDILREKILRQSRDVIVIDTGDKRDGNGLSDATWPPGLRSSEIFNMMDYDLLTLGNHELYTAESAILEYRGTSQSSKFKDKYVCSNVEFIEDDGTRVPFGNKYITFETPIMKQRVLALSFLFSFQRANNRAIVTPPLEEITQKSWFQNMVETNREEEIDLIIVFGHLPATDPTEREMHKIHALIRKYYPNTVIQYFGGHTHIRDFVQLDSKSTCLQSGRFAETVGFLSINMTDPVDAESPIFSRRYIDFNKEAFKYHLSKLGHDSNVPVSTKKGKTISRLVNDLRHELNLNEKLGYIPQTYYVSTRPLNSEENLYHLITHKILPNLIPPKNYEPSMSRFILINTGSVRYDLYKGPFTKDTEYIVMPFNNDWRFITVPLVVASRVETYLNKGPVIASLGIPSSSHHKQHFGGFQKCPFINNPNLSEGYTTEDDFGCHGDDTPHNSQREYDIPNVVQCKEVKKVQEEEADPSKMVHVIFYSFMELDILNAVNSIINDLGLRMENLTTNDCSHYGGDSTKKLLRDYFSQF

SEQ ID NO: 68410 - DNA, 1908 bp, Schizosaccharomyces pombe 972h-
  CDS (1)..(1908)
atgaaacctgcccatacattttcattaattttctctcttttatttgttatcaatccttgctattcagcaactttgcccttggcaattcgtcgggaattgacatggggtcaagtcaatattttacacactactgacatccatggctggttagcaggacatgcgcgagataaacgttattcaggagatttaggagatttcgcttcttttgttcaacatatgaagcacttggcaaaacaaaaagacgttgatttactgctagtagataccggcgatcttcatgatggtacgggcctgtcagatctgacagatccccctggtagttggacagattcattacttgcaaatatggattatgatattcttgttgctggaaatcatgagctttatctctcaactgttgcaaatgatacttatcataatttcattcctctgtgggaaggccgatatttagctgcaaacattgacatatatgatgaacatgtttcttcttttgtaccctttggagatcgatatgccatcttttctacaccccacaatgttaaaatccttgcgtttggatttgtaaactcattttctggtgctactgatacggttcgtgtcctcccagtttcgcaattctcgctacagccatggtggaacgatatggtatcaaataaagacatcgatctgattctgattcccgctcatgtacccgttcacaatgcctcagagcttgatatcgttctttcagagcttcggattcacttccctaccactccaatacaagtacttggtggtcattcccatattagagattatgccatttacgatgaaaaagcagtgggaattgagtcaggaagatattgcgaaacagttggttgggtctcaattaacggcattccatccttcaaatcgttggtcaagttatctgggatttcttctttaatgggggtggaatcttatctagctgagcgcttgagatttataggcgaaagtattagacggtcatctcagcagatattttcctctttgcaaagtgctaaatctgccagtgtcagcttctctcgttcctatattgattggaatcccgagggctttatgtttcattcgaaaacaaaaaagtcttctttcaatacctcacttggagaatttatttctaatggcatttacgaagctcggaaggcacttggcttacttactcctataggttgttccccaaaaaagtttgcattttcagaagttccatttaacgattcaaactcaatttatcatctatttcaatccgaactttttccaaaaatagtcgtcaatgagtctcgacatcacattcctcactatattattgtaaattcgggtggcattcgaggtggtctaaattcaggtgcctttggcttagacgaggtctttcaagtctgtccttttaaaagtaatatattctatgttttgaaagatgtcccatggtcgattactaagtacctgccacaagctctacaacacagtggatatctgattgctgaagatactcttcaaattaacactccacaagtttctgatgcaaaatttgaggacttttatgaacactccattcgcaagacatatggatacactacacacgatgatttaggagatgacggagatgacactgctcatcttacaactcctcattatgaaccgctgcggtttatttgctcgcaagttggatttgatgattctttttctggagacgataagcaagttgttgacgttgttgctccatcatttgttattccacgcttagacgacattttaaataaaattgcagataagcctttatattcacctgacgattgggagctttactttacgagacctgacggaaagcattctatgactgatttgttaccattatatgcagatctctattgggaccacgattgcctatataagtaa

SEQ ID NO: 68411 - protein, 635 aa, Schizosaccharomyces pombe 972h-
MKPAHTFSLIFSLLFVINPCYSATLPLAIRRELTWGQVNILHTTDIHGWLAGHARDKRYSGDLGDFASFVQHMKHLAKQKDVDLLLVDTGDLHDGTGLSDLTDPPGSWTDSLLANMDYDILVAGNHELYLSTVANDTYHNFIPLWEGRYLAANIDIYDEHVSSFVPFGDRYAIFSTPHNVKILAFGFVNSFSGATDTVRVLPVSQFSLQPWWNDMVSNKDIDLILIPAHVPVHNASELDIVLSELRIHFPTTPIQVLGGHSHIRDYAIYDEKAVGIESGRYCETVGWVSINGIPSFKSLVKLSGISSLMGVESYLAERLRFIGESIRRSSQQIFSSLQSAKSASVSFSRSYIDWNPEGFMFHSKTKKSSFNTSLGEFISNGIYEARKALGLLTPIGCSPKKFAFSEVPFNDSNSIYHLFQSELFPKIVVNESRHHIPHYIIVNSGGIRGGLNSGAFGLDEVFQVCPFKSNIFYVLKDVPWSITKYLPQALQHSGYLIAEDTLQINTPQVSDAKFEDFYEHSIRKTYGYTTHDDLGDDGDDTAHLTTPHYEPLRFICSQVGFDDSFSGDDKQVVDVVAPSFVIPRLDDILNKIADKPLYSPDDWELYFTRPDGKHSMTDLLPLYADLYWDHDCLYK

SEQ ID NO: 68412 - DNA, 1806 bp, Schizosaccharomyces pombe 972h-
  CDS (1)..(1806)
atgaagacagcctcgatacatttttggtcaacccttgtgcttttgttcagttgtattggttctgtaattgcttactcgtctaccgatttaactacaatgtatgattggaaccaaatcattaaacctttagaatggggtcaaatgaatttcattcatactacggacactcacggttggcttaatggtcaccttagagatgctcgctataaagccgactttggcgaatttaagtcttttgttttgcggatgaaggaattagctgattttaaagacgtagatttattattagttgataccggtgatttacatgacggaaacggactttctgatgcttctgatccagaaggaatatatacaaacaacatttttacgtacctaccctatgatattcttacgattggtaatcacgaattgtaccaagcatccgtttctaataatacccacgaatattttgtacctcactggaatggaacttatctcgcttctaacgttcaaatcttcaactcatcaaatgagttggagcaatttgcggctgaatctgcctactttactacgaaacatggcgttcgagttcttgctgtaggcttcctctacgatttcaccggtaacgccaacaacactgttgttacacctgttgagacagccgtcaactccagatggtatcaacaacaaataaatagaacagatgttgaccttttcttattacttggacatattccggttcgcgattgggacgaatggaagtcactacatgcctcaattagaaaagtgcatcctgatactcccattcaaatctttggcggtcactctcatattcgtgactttgctgtttacgacgagtcttctgtatctcttgagggtggtagatattgtgaaactgtaggctggctttcaattgatggcctagcagcatccaatgcaacccgtcaatatgttggtcgtcccgtcaccaatgaaactcgccagtcgtatcccaatctccctattccaaatacacctctgtattacacgcgccgttacattgatttcaatcgccagaacttccgtttccatactcaacaatcagaagattccttcgataccccagaaggcattgaattatctaaaattattaaacagtatcgcgacgatcttaacctctcatatgtctttggatgcgtccctaaaaactattatatgactgaagtctctcctcaatctgatgacagtatttttaagcttatgactgatcgtgttttgccagaaataattaccaatcgaaaccgttcaactgtgccccgaattatcattagcaatggaggtggtatacgaggttccatgtatcaaggaaaatttggacccgacgaaatgttccaattaaacccttttcttactaattactatatgtatttggcagatgttccttataaatacgctaagaagctatactcgaccttaaacgggggatccaatttacgcaacataaatgaaaatttggctgcccttaatcccggttatgttacaagtgatgattttggtgaagatggagatgatacagtacatacttctgttccttcgtatgctactcctaacattcttcaagcccaagctgggtttaatgctacctcctcgccagaaacaattgatgttgtcttcctcaatttccttcaaagtatcgtgctaaaggctttgaacaatatggcaaatgacactttatatacttcttcaaacgttacacaatactgggttcgtgatgatggttacgacagttctccttattcatttgcctattttgttcaacaagaatggagtgataattgtgattaa

SEQ ID NO: 68413 - protein, 601 aa, Schizosaccharomyces pombe 972h-
MKTASIHFWSTLVLLFSCIGSVIAYSSTDLTTMYDWNQIIKPLEWGQMNFIHTTDTHGWLNGHLRDARYKADFGEFKSFVLRMKELADFKDVDLLLVDTGDLHDGNGLSDASDPEGIYTNNIFTYLPYDILTIGNHELYQASVSNNTHEYFVPHWNGTYLASNVQIFNSSNELEQFAAESAYFTTKHGVRVLAVGFLYDFTGNANNTVVTPVETAVNSRWYQQQINRTDVDLFLLLGHIPVRDWDEWKSLHASIRKVHPDTPIQIFGGHSHIRDFAVYDESSVSLEGGRYCETVGWLSIDGLAASNATRQYVGRPVTNETRQSYPNLPIPNTPLYYTRRYIDFNRQNFRFHTQQSEDSFDTPEGIELSKIIKQYRDDLNLSYVFGCVPKNYYMTEVSPQSDDSIFKLMTDRVLPEIITNRNRSTVPRIIISNGGGIRGSMYQGKFGPDEMFQLNPFLTNYYMYLADVPYKYAKKLYSTLNGGSNLRNINENLAALNPGYVTSDDFGEDGDDTVHTSVPSYATPNILQAQAGFNATSSPETIDVVFLNFLQSIVLKALNNMANDTLYTSSNVTQYWVRDDGYDSSPYSFAYFVQQEWSDNCD

SEQ ID NO: 68414 - DNA, 1758 bp, Eremothecium gossypii
  CDS (1)..(1758)
atgaagtttttgaatattggtcttttgttagctggtgccacggctgcaatagttccagatgatgtggacaaggacactgattcagcggattccataagcttacgcgagttgaagcttggccaattaaattttttacataccactgatacccacggatggctaggatctcatgtatcacaaccagactatgatgcgacttggggtgactatgtctcctttgcccagcggttcagagaacgagtgaaagacaaggaccttattttgatcgactctggtgacaaacgtaccggtaatggtctcagtgatctcactagtccgatgggtttgaagtcaagcggtatctttaaccttcagaaacttgacttgttaactctcggtaatcatgaactgtatacggaagatgtggttcgcttggaatactatggaacagcaatggagcctgagctaagtgataaatatgtcacaagcaatgtggaatttatcacagaagatggggacgtgtatccgttcggcaataaatataggtactttgaaacgccaaaccagaatctacgtgtattggcgttcgcattcatgttcgattttccgtgggctgctaaaaatgttaggttaacccctctggccgaagaggttaaaaaggactggttcacccaaactgtggaaaagtaccccgctgacaagcttgatattatagttgtcttcggtcatttaccagtcacccgtggcgaaaacgaagagcttctgcagttacacaaacgactaagggaatcttaccctgacactattatccagtacttcggaggtcatactcatgtcagagatttcgtggttttggacgaaaaagcgactgcgttacaaagcggcagatattctgaaacagtgggattcctatcgatagatgatgttgctaaagaaaagccagagtttttcagatcctatatggactttaacctgagatcctttatgcaccattctgggtataagaacatcgaagagttccgtacaaaggacggagaatatgtgaacgcacaaattgaagagcttcgtgagaaactcgggttaaatactgtatttggatatgttccagaggattattatctagatgcagaaccaattgaatctccaaacaacatctacaacttcctcaccaacaagatccttccaacgttgcgctccgatgcatatgatgaaactgtgtctcgcttcatcatgataaacactggttccatgagatatgacttatatagaggtaacttcacggccgatgttgaatacattgtgacaccgtatcagaatgattggaaatacatagaagtaccaacaaaattgggaggaatactggccgcgtacatgaatagtggcaagccaatcttcacatcgattgcgaatgaactacctagactttctcgcagagattctagatgcccagtaattactgatgcgaacctatccagaggctacactactgcagacgacgccggttgcacaggcgacgacacgcctcaccaatcaacaccatcttaccctgttccaaatgtagtacaatctgttgagattaacgaagaagctggagaagatggtactgcgcacctagtcttttatagttttatggagaaaagaattgtggtcgcactaaacgagttaaacattttacagaaagtaacaaccaaaacctattcagcagctgatgttaaactatatggtggacccaacagtaggcaattgctgagaaattatttcaagtctctttcctattaa

SEQ ID NO: 68415 - protein, 585 aa, Eremothecium gossypii
MKFLNIGLLLAGATAAIVPDDVDKDTDSADSISLRELKLGQLNFLHTTDTHGWLGSHVSQPDYDATWGDYVSFAQRFRERVKDKDLILIDSGDKRTGNGLSDLTSPMGLKSSGIFNLQKLDLLTLGNHELYTEDVVRLEYYGTAMEPELSDKYVTSNVEFITEDGDVYPFGNKYRYFETPNQNLRVLAFAFMFDFPWAAKNVRLTPLAEEVKKDWFTQTVEKYPADKLDIIVVFGHLPVTRGENEELLQLHKRLRESYPDTIIQYFGGHTHVRDFVVLDEKATALQSGRYSETVGFLSIDDVAKEKPEFFRSYMDFNLRSFMHHSGYKNIEEFRTKDGEYVNAQIEELREKLGLNTVFGYVPEDYYLDAEPIESPNNIYNFLTNKILPTLRSDAYDETVSRFIMINTGSMRYDLYRGNFTADVEYIVTPYQNDWKYIEVPTKLGGILAAYMNSGKPIFTSIANELPRLSRRDSRCPVITDANLSRGYTTADDAGCTGDDTPHQSTPSYPVPNVVQSVEINEEAGEDGTAHLVFYSFMEKRIVVALNELNILQKVTTKTYSAADVKLYGGPNSRQLLRNYFKSLSY

SEQ ID NO: 68416 - DNA, 1887 bp, Neurospora crassa
  CDS (1)..(1887)
atggctgtcaaagcctcaatccttgtcgccagtgctattgcgacactggcacgggcagcgcagcccggagctgcatctcccatcgccgcgcctatgcgagacctcgtctggggcaagctcaacttcctccacacgacagacacccacggctggcatggcggtcatcttcaagaagcacagtattcggcggactggggtgattacatatcctttgccgaacatctccgcgaagaagcagatgggcagggcgttgatctgctccttgtcgacaccggcgatcgcgtcgaaggaaatggactctacgacgcctcgaatcccaaggggaaatactactatgacatataccgcgagcaggacgttgacatcatatgcacggggaaccacgagctgtatcatgcctcgactgccgatggagaacacctgcggaccgtcccgaacttccaggacaagtacgttgcgtccaatctggactacatcgaccctaagacgggactgcagatccccatggcgcagcggtaccgcaagttccagaccaagaaccagaagctgactattgtcgccatgggttttcttttcgactttaccggaaatgccaataacacagtggtacagcccgtgagggagaccatcaaggagcaatggttccaggacgccatccgggagaaccccgatgtgtttgtggtgattggtcacgtcggcgtgaagatgcccgagttcaaggagatctttacagccattcgtaagcagaatcgattaacgcccatcctgttcttcggcggccatgtgcacgtgcgtgacgcgacggcgtatgactccagatcgttcgctatcgccagcggccgttactttgaaacgatcggctggatgtcggtggacggtgacctgaagaggacaaccaaagatgtcgtcgctgctgctgtcaatgacgacgagccgccttcgactgaggccgcggaattctcgttccaccgtaggtacatcgacaacaacctactgggcctctactatcacaccgggttgaacaagtccacatttcctacagaccacggccgaaatgtatcacaaatgatcgcccaggcccgcaaggatctcgatctggactacacgttcggctgtgcaccaaagaacctgtggatgacgagggcgccctatccctccgaggacagcatctacacgtggctcgagaaggaggttcttccagagatcgccatcaacgacgacaggaaagatgtccctcgtctggttatcatgaacaccggtgccatccgcttcgatgtcttcaagggcaaatttaccagagatacaacgtatatcatctcgcccttcctcagcgtcctcaactacatccccgacgtcccttacgaggttgccagtaaagttatcggcttactcaacaacgctgggcggatcatggaggagcatgctcctatggatgctcgatttatggccatcccggagcagtttgccatcacacaggacattattcatgagaagccaatgccttccttcgcgactgagggtcttgtggacgggcaaaagcccctgtcgggtgatggcgcctctaagaaggagcccgttttgatcgaaggctatacgacaaaggatgatattggtgacgatggcgatgatgctatccactctgccattaacttctatgtcgtgcctaactgcatccaggccgaagttgggttctcgcccaaggaggagggcgagaagcctgaaaaggttgatctcgtgttctttgatttcattcaaccatgggtcatggttgcgctgaagatctccggaggcgactacactaatgatgatgccaagagatatgtcaatgggacctttacggaattgatggcgggctggattaaggagaactggcctgctaactgttag

SEQ ID NO: 68417 - protein, 628 aa, Neurospora crassa
MAVKASILVASAIATLARAAQPGAASPIAAPMRDLVWGKLNFLHTTDTHGWHGGHLQEAQYSADWGDYISFAEHLREEADGQGVDLLLVDTGDRVEGNGLYDASNPKGKYYYDIYREQDVDIICTGNHELYHASTADGEHLRTVPNFQDKYVASNLDYIDPKTGLQIPMAQRYRKFQTKNQKLTIVAMGFLFDFTGNANNTVVQPVRETIKEQWFQDAIRENPDVFVVIGHVGVKMPEFKEIFTAIRKQNRLTPILFFGGHVHVRDATAYDSRSFAIASGRYFETIGWMSVDGDLKRTTKDVVAAAVNDDEPPSTEAAEFSFHRRYIDNNLLGLYYHTGLNKSTFPTDHGRNVSQMIAQARKDLDLDYTFGCAPKNLWMTRAPYPSEDSIYTWLEKEVLPEIAINDDRKDVPRLVIMNTGAIRFDVFKGKFTRDTTYIISPFLSVLNYIPDVPYEVASKVIGLLNNAGRIMEEHAPMDARFMAIPEQFAITQDIIHEKPMPSFATEGLVDGQKPLSGDGASKKEPVLIEGYTTKDDIGDDGDDAIHSAINFYVVPNCIQAEVGFSPKEEGEKPEKVDLVFFDFIQPWVMVALKISGGDYTNDDAKRYVNGTFTELMAGWIKENWPANC

SEQ ID NO: 68418 - DNA, 1857 bp, Magnaporthe grisea 70-15
  CDS (1)..(1857)
atggcttttagaacaacactagtcggatgcgtcacggccgcgctggccacggtcgggcgcgcgtcccagcctggagcagccaaaccggttgaagctccgatgagggacctccagtgggcacagctcaactttctgcacacgaccgacacccacggctggcacggtggtcacctcctcgagtcccagtactcggcagactggggtgactatgtttcttttgccgagcacctccgccaccgcgccgaccaggaaggccgcgacttgctgctggtcgacacgggcgacaggattgagggcaacgggctttacgactcttcggaccccaagggccgcttcacctacgacatattccgtcggcaggacattgatatcatctgcaccggcaaccatgagctctaccaagccgacgccgctgaccgcgaatggtcgcagactgtcccgaacttcaaggacaagtacatcgcctccaacctcgattacatacacccagagacgggcgagaagaaacccatggctcagcggtttcgtagattcaaaacaaagaaccaaaagatggacgtcctagccatgggttttctgtttgactttaccggtaacgccaacaacacagtcgtacaacctgttgaggacactgtcgaggaagagtggttcaagaatgcgatcaaggagaagcctgacatctttgtcataattggacacgtcgggttacggatgcaagagtttaagcacatctttacagagatccggaagcaaaactggttcactccaattgctttctttggaggacatgcgcatgttagagacgccgtcaagttcgacgacggcgcttatgctatcgcaagtggtcggtactttgagactatagggtggatgtcggtagatgggctctacaaagacactaccaagggcaagacgccagtcaaattccagaggcggtacatcgacaacaacctgttggggttgtaccatcacactggactcaaccagtccacctttcctaccaagaagggccaagaagtgactgaaatgattacggccgccagaaaagagctcaagctggatgagaagtacggatgtgcacctcagacctactggatgaaccgcgctccttaccctggaaatgagagcgtttatacctggctggaaacggaagtgctgccaaaagtcgccgtcaatgaagagaggaagaacaattcccggctggctatcttgaacaccggtgggataaggttcgacatcttcaagggcccgtttaccagggactcgacttttattgtcagccctttcacctcgggactgaactacgtcaaggatgtaccatatgaggttgcccaaaagctcattaagctgctcaacaacggcggaccgattcttgcggccggacaaggtgtgccagacctgcgattcatggcctcaccagagcagtggttccgtaccgaggacgtcgtcgtcaccgactcgacatcgaccccgtctcattcattcaccgctgaggatttcgaccagaagcctttgagccatcatgataaacacaaaccggccttgattggtggctacacaaccaaggacgacatatctgatgatggcgacgatgcggtgcattcgccattgtcattctatagagtaccgaactgtgtccaggccgaggttggctttcccgtcgatgatgacggaaagaagaagaaccctgaaaaggtggacgttgtcttcatcagcttcatccagccgtgggttttgctcgccctcaagtttgcgggaggcgactatacctcggatgacgttggtgtctatcggaacggaacctttaccgagatgatggccgactggatccaggagaactggaagggagactgctga

SEQ ID NO: 68419 - protein, 618 aa, Magnaporthe grisea 70-15
MAFRTTLVGCVTAALATVGRASQPGAAKPVEAPMRDLQWAQLNFLHTTDTHGWHGGHLLESQYSADWGDYVSFAEHLRHRADQEGRDLLLVDTGDRIEGNGLYDSSDPKGRFTYDIFRRQDIDIICTGNHELYQADAADREWSQTVPNFKDKYIASNLDYIHPETGEKKPMAQRFRRFKTKNQKMDVLAMGFLFDFTGNANNTVVQPVEDTVEEEWFKNAIKEKPDIFVIIGHVGLRMQEFKHIFTEIRKQNWFTPIAFFGGHAHVRDAVKFDDGAYAIASGRYFETIGWMSVDGLYKDTTKGKTPVKFQRRYIDNNLLGLYHHTGLNQSTFPTKKGQEVTEMITAARKELKLDEKYGCAPQTYWMNRAPYPGNESVYTWLETEVLPKVAVNEERKNNSRLAILNTGGIRFDIFKGPFTRDSTFIVSPFTSGLNYVKDVPYEVAQKLIKLLNNGGPILAAGQGVPDLRFMASPEQWFRTEDVVVTDSTSTPSHSFTAEDFDQKPLSHHDKHKPALIGGYTTKDDISDDGDDAVHSPLSFYRVPNCVQAEVGFPVDDDGKKKNPEKVDVVFISFIQPWVLLALKFAGGDYTSDDVGVYRNGTFTEMMADWIQENWKGDC

SEQ ID NO: 68420 - DNA, 1869 bp, Gibberella zeae PH-1
  CDS (1)..(1869)
atgattcttcggagtaaaacacttgctgctggctcagcgctggtcgctgtagctcgcgcatcgcaacccggagctgcagcgccggtaccaggtcccatgagagaccttacttggggtcagattaactttatccacacaacggatacacatggctggattggcggccacttacaagaacctcaatattctgctgattggggtgactacatctccttcaccaagcacatgcgcgaccaagccgacaagaggggatccgacctactagtcatcgataccggcgatcgcatcgagggcaatggcttatatgacgcctcaacccccaagggcctcttccaatatgacatctacgccgaagccgatgtcgacatcatgtctaccggcaatcatgagctttacaaggcctactcggctgatatggaacacaacaccactgttcccaactacaagaacagctacctcgcatccaaccttgactacatcagtttcgagaccggcgatcgcgttccccaagccccgcgctacaagaagttcaagacaaagaaccagggtctcaacattgtggcgttcggctttctcttcgactttaccggaaatgccaacaacacggttgttcagcccgtggaggacaccatcaaggaagattggttccaggaagctatccatgagaagcctgatctcttcgtcgtgattggccatgttggtcttcgcatggaagagttcaaggttatctatactgccattcgaaaacagaactggcacattcccattgctttcttcggcggccatgcgcatgttcgcgatactgtccagtatgactccaaggctttggccatagccagtggccgctatttcgagaccattggatggatgtcaatagacggtattaagaaaggcggtgccaaggacgttgaggcagctgcttctcctacctttactcgccgatacatcgacaacaacctctatggcctacactatcacactggtctcaacgaaacgacattctccacagagaatggaaagagagtcagcaagatgattacccgtgcccgcaaggctcttcagctcgattacacgttcggctgcgctcctaagacactctggatggctcgggccaagcccactgacgaggatagcatttaccattggatctcaaatcatctcttgcctgatgtcatcactcgcaaggatcgcaaagacaagtcgagactggccatcttcaacactggtggaatccgatttgacattttcaagggcggtttcacacgagacagcacttatgctgtctgcccctttgacagtggatttaaatacatccctgacgtcccatacaaagccgctgccaaggttattgatctcctcaacagcgctggaagaatctttgctgagaacggccttgacgttaagtatatggccatgcccgagcaagctttccccgctcctgtcatgaaggctcagttcgagaggaacaagatagatgcagaagagtcccgtctggaacttcgaagtctcttcgataaacctgatttgactgccggctatactaccatagacgatatcggcgccgacggcgatgataccattcacgagccagtcaagttttatcagcagcccaactgtgtccaggctgagattaacatgcccaaggatggtgagccagagacagttgactttgtattccttgactttatccagccatggattatccctgccctgagactcgcaggagcgggccattttagtgatgctgatgtcgagcggtatattgagggttcttttacgtatcacatggccgattggattagcaagaactggcagtttcatgtgccccaggattccgaagtgagtaccaacttcagtatcacgtactga

SEQ ID NO: 68421 - protein, 622 aa, Gibberella zeae PH-1
MILRSKTLAAGSALVAVARASQPGAAAPVPGPMRDLTWGQINFIHTTDTHGWIGGHLQEPQYSADWGDYISFTKHMRDQADKRGSDLLVIDTGDRIEGNGLYDASTPKGLFQYDIYAEADVDIMSTGNHELYKAYSADMEHNTTVPNYKNSYLASNLDYISFETGDRVPQAPRYKKFKTKNQGLNIVAFGFLFDFTGNANNTVVQPVEDTIKEDWFQEAIHEKPDLFVVIGHVGLRMEEFKVIYTAIRKQNWHIPIAFFGGHAHVRDTVQYDSKALAIASGRYFETIGWMSIDGIKKGGAKDVEAAASPTFTRRYIDNNLYGLHYHTGLNETTFSTENGKRVSKMITRARKALQLDYTFGCAPKTLWMARAKPTDEDSIYHWISNHLLPDVITRKDRKDKSRLAIFNTGGIRFDIFKGGFTRDSTYAVCPFDSGFKYIPDVPYKAAAKVIDLLNSAGRIFAENGLDVKYMAMPEQAFPAPVMKAQFERNKIDAEESRLELRSLFDKPDLTAGYTTIDDIGADGDDTIHEPVKFYQQPNCVQAEINMPKDGEPETVDFVFLDFIQPWIIPALRLAGAGHFSDADVERYIEGSFTYHMADWISKNWQFHVPQDSEVSTNFSITY

SEQ ID NO: 68422 - DNA, 1758 bp, Candida glabrata CBS138
  CDS (1)..(1758)
atgctgtggttggtgtttttattgtttgtgaaggttattggtgcctttccgacagaacagttctttagtactagtgaatatgctgcatcgctagaattaagacctataaaattaggtaagattaattttctgcacacgacagacactcatggttggttagggtctcatctgctgcagagagattttaacgctgattggggcgacttcatatcatttgtggaattgtttcgcaagaacagaataaatagcaagaaccaggatctaattgtgcttgatactggagataagcgagatggcaatggtttgagcgatgccacttctttagtaggtatgaactcgtcagtcatttttaatgaaatggactttgacttattgacattggggaaccacgaattgtacactgaagaggcttcaatattagagtattatgggacagctctttctggtaagttcaaggacaaatatgtttcgagcaatgtcgaattcattgatgacaaaggtagcaaacacgcatttggtaataaatatttgtgtttcaaaactacaaataccaagaccaaaattttagcgctatcttttatttttgattttaagagatataatcgtaaaacaatagtaacaccagcaatacaagaaataaagaaaccttggttctccgatatggttaaatcatatacagaagatgacatagatatggtactagtgtttggtcatattcctgctaggggtgaggctgatgatgaacttctatcgatacataaagaactccgaaagtactacccaaatattgtcattcaatattttggcggccatacccacattagagatttcaagattatggatgataagtcaacatgtctacaaagtggaaaattctcagaaactgttggatttttatccattgataatttagatagtcaaaatgttactttctcaagaagatatttggattttagtaaaaggtcatttaagtttcatgcaggcgtgaagtctttgaccacaacgctaggtgatagcgtttcgaaggcaatttcaaaacttagaacgcatttaggactaaacgaaattattgggtatgtaccccatacgttttatatgtctgccagaccattaaactcatcagagaatatctataatttattgtcaaccaaagttctccctctattagaaacgccaaaaggtttattttcacattctaggattattatgataaactctggttcagtaagatatgacttatataaaggtccatttactaaggatactgaatatatcgtgatgcctttccctaacttttggaaatatattaggttgccacttaaagtagctattcagattgaaccagcgttaaataacgggcctgtaatcgcccatttagtaccacctgagggaagagttggtagtaaattggtagcatcctctcaaaagtgtccttttgtgactaatccgaaattaagtgagggttttactacagttgatgatgcaggttgtgatggggacgatactccacatagatcacaatattatcatgatattcctaacgtggttcaatgcattcaagtacacgatgaggaacctgatacaattgtggattttatatactatagttttatggaagacagtgtcatcactgctattaatttcatattagggcagcttgaaggagaagatcacaaaaatgttactaggggcgacactcttcattacggtggtagagcaacaaaggaacttttaaaggcatacatcaaatcaatttaa

SEQ ID NO: 68423 - protein, 585 aa, Candida glabrata CBS138
MLWLVFLLFVKVIGAFPTEQFFSTSEYAASLELRPIKLGKINFLHTTDTHGWLGSHLLQRDFNADWGDFISFVELFRKNRINSKNQDLIVLDTGDKRDGNGLSDATSLVGMNSSVIFNEMDFDLLTLGNHELYTEEASILEYYGTALSGKFKDKYVSSNVEFIDDKGSKHAFGNKYLCFKTTNTKTKILALSFIFDFKRYNRKTIVTPAIQEIKKPWFSDMVKSYTEDDIDMVLVFGHIPARGEADDELLSIHKELRKYYPNIVIQYFGGHTHIRDFKIMDDKSTCLQSGKFSETVGFLSIDNLDSQNVTFSRRYLDFSKRSFKFHAGVKSLTTTLGDSVSKAISKLRTHLGLNEIIGYVPHTFYMSARPLNSSENIYNLLSTKVLPLLETPKGLFSHSRIIMINSGSVRYDLYKGPFTKDTEYIVMPFPNFWKYIRLPLKVAIQIEPALNNGPVIAHLVPPEGRVGSKLVASSQKCPFVTNPKLSEGFTTVDDAGCDGDDTPHRSQYYHDIPNVVQCIQVHDEEPDTIVDFIYYSFMEDSVITAINFILGQLEGEDHKNVTRGDTLHYGGRATKELLKAYIKSI

SEQ ID NO: 68424 - DNA, 1914 bp, Kluyveromyces lactis NRRL Y-1140
  CDS (1)..(1914)
atgtttagcaaactcagagtaccctggacgaaaggtagctcttttatgcagtttattgccaaacaaagaaccgtgaaatttactacttctttttggaggatatacaggtgtgttcttccaccgacgatgattgaactactgagtgttgtagtattggcagtttatgcccttcccttttttctatcctgtacgttaggggccgttttacctttcactccacaacaaagtgttttatccacagtagaacgtgaaactgataaacttagagatttagacattggacaattgaattttttacacaccacggacactcacggttggttaggctctcatttaaaccaggacaattataatgccaaatggggagatctcatttcatttattgataagttcaagcgaaatgtagttcgtgacaacgatctcttgataatcgatacaggcgacaagcacgatggaaatgggttcagtgatgcgacccagccaaatggattgaactctactcagatatttaatgaactggattatgatttattgacgttgggaaaccatgaattatacgttgaggacaatactgttttggaatattacgaaacagttatgaatcccaaattcagcaataaatatgtttcgagcaatgtggaattcatcaaagaagatggatcagttgtgccatttggctctaagtatcgttactttaaaacagagaaacacggtttaagagtcttggcattatcctttctattcgacttcaagaggtataacaaaagagcccaagtaacaccggtttccaaagaaattaaaaaaccttggttcaatgaagttactggaaactactccagggaagaggttgacattttattggtttttgggcatatgcctattagtgacccagaaaatcgcgagatcaaccatctacatgcaaagttaaggcatatttatccgaacactgtcatccaatacttcggtgctcacactcatatccgcgattttgtagaattagacaacaaggcgtctgctcttcaaagtggaagattctgtgagactgtaggatttgcatcaattgacgacattacgaaggaatcccctgttgtgtcaagaaaatacattgacttcaacttagattctttcttgcatcattcaaagagcaggaacaccaaggaatttgacaccgaaaagggcgtcgaagtcaatcagcgtttagatcgtttaagagaatatttgaacttaactaccaaatatggtgatgtaccttccacttattacatgtacaataaacccctctcctcaccgcacaatatttatcatcttttaaccgaaaaagtgctacctagattagcgcctgaaaattcagatgccaacgaatcgttaacctcccgaataataatgataaatactggtgcaatcaggtacgacttatataaaggccctttcacagctgacactgagtatactatttcacccttctcaaattcatggaactatattcaattacctgcgaggttagcgatacaagtcgaatcatatttaaatggcctgggtccgattctgacgttgaacgccgtgggtaaagaacatcgccaatgtccatttgttgatgataaaacactctccaaaggatataccacatccgacgatcttggatgtgaaggcgacgacacagcacaccgcagtgaacatcaatacaggattcctaacgttgtacagtccgttgatattgttgatgaagatgaagataaagttgatttcgtgtatgttagttttatccagcccttcgttttgcaagccttgaacgacttaaatgaagatcaaaacatcgtgaaccactcattcaatgagtcggactgtagaatttatggtgttacatcaataaaggatcttcttcgtggatatatcatctcactaaaccagtcataa

SEQ ID NO: 68425 - protein, 637 aa, Kluyveromyces lactis NRRL Y-1140
MFSKLRVPWTKGSSFMQFIAKQRTVKFTTSFWRIYRCVLPPTMIELLSVVVLAVYALPFFLSCTLGAVLPFTPQQSVLSTVERETDKLRDLDIGQLNFLHTTDTHGWLGSHLNQDNYNAKWGDLISFIDKFKRNVVRDNDLLIIDTGDKHDGNGFSDATQPNGLNSTQIFNELDYDLLTLGNHELYVEDNTVLEYYETVMNPKFSNKYVSSNVEFIKEDGSVVPFGSKYRYFKTEKHGLRVLALSFLFDFKRYNKRAQVTPVSKEIKKPWFNEVTGNYSREEVDILLVFGHMPISDPENREINHLHAKLRHIYPNTVIQYFGAHTHIRDFVELDNKASALQSGRFCETVGFASIDDITKESPVVSRKYIDFNLDSFLHHSKSRNTKEFDTEKGVEVNQRLDRLREYLNLTTKYGDVPSTYYMYNKPLSSPHNIYHLLTEKVLPRLAPENSDANESLTSRIIMINTGAIRYDLYKGPFTADTEYTISPFSNSWNYIQLPARLAIQVESYLNGLGPILTLNAVGKEHRQCPFVDDKTLSKGYTTSDDLGCEGDDTAHRSEHQYRIPNVVQSVDIVDEDEDKVDFVYVSFIQPFVLQALNDLNEDQNIVNHSFNESDCRIYGVTSIKDLLRGYIISLNQS

SEQ ID NO: 68426 - DNA, 1920 bp, Debaryomyces hansenii CBS767
  CDS (1)..(1920)
atgaacatgattgaaaataagaggaagtgtcagtatggctttattgtattggcgtttattttaggtatatttttgtttccggtttcatggcttcaactaagtaaacagcacaaatcagactcatcgttgataaggaatatagagtggaatgatataaattttattcacactactgatacacacggctggtattctggacatattaaccagaaacagtacaatgctgattggggagattttatatcttttactattcatctaagggacatagctcattcaaaaaagcaagattttttgttagttgatactggtgatagacatgatgggaatggactctcagatgtaacaataccaaatggtgctaaatctttgccgatatttatgaggcaggactatgacctccttactattggaaaccacgaattatatatctgggaaaactcccaacaagaatatgatttggtccgtgatcattttaaatcgaactatattagtactaatgtggaatacaaattacaaaatggaacatatattcctatgggtcaaaggtataagtacttcacaacaccaattcaaagtattagaatattgtcatttgcattcttgtttgacttcgctaggtacaattcggagacaaaagtcgaaccaatcatgaaagttctagacgaagattggttcaaagatattttgattgatcatcctgctgatgaagtcgatttacttgtaataattggacatatcccagtgagtcataacgatgaagagttgttccaattacatctgtttttaaggaaatattaccctaagaccaaaatccaatattttggtgggcattcacatataagagatttcagcatatatgatgaatatctgactggtttgcaaagtggaagattttgtgaaactgctggctgggtaagtattaatttagagtctgccaataataatttgaatggggtagataaggttaaaaacacattctcgaggtcctacattgatttcaacttaaactcatttatgtaccatacaaatataagctcaactgaagagtttcatacgggagtaggattgaatgtttcaagacagattagtgatacccgtaaggaattgaacttagaagcgataatcggttatgttagaaacagtaattatttcatggattatgtttcaataacgaatccgaaaaatatttttaaactcttgactgataaagtattgcctacattagaaattgaaaatccagatatagcaacttcagaccagaggttaattataattaatactggttcgataaggtatgatctatacaaaggtccatatacattggattctcagtatataatttctccttttgaaaatgattgggtaaagttgacattacctaaaaatgtggctataaagatagctcccaagttgaatgagttacagtatattattcgttctgcaagcgataatacatttgacaacagacggttgttacctgagcatcaatattccagacttctcaaaaacgattatgcgagttttaataagcgtacagaagattgggggcaacatcatttcgaaaatcgtgcttccgaaaggtttcaagagataggtaaattgaagtctgcctctcgaaaaaatagattgtctaaaggttatgtcacgtatgacgatttcggtcatgacggtgatgatactttacacagaccggtagtaaaccatcctattccaaatgttgtacaatcggaagaattaaactactccgatgggggctcatccgtcgatgttgttttctacagcttcattactcctaatattttatgggcattaaaggagatcggatttgaggaagacgtgagtaatcaaatcgaattttattccaagaactatttgggtctattattaaatgaatatattagaaataatgatatatag

SEQ ID NO: 68427 - protein, 639 aa, Debaryomyces hansenii CBS767
MNMIENKRKCQYGFIVLAFILGIFLFPVSWLQLSKQHKSDSSLIRNIEWNDINFIHTTDTHGWYSGHINQKQYNADWGDFISFTIHLRDIAHSKKQDFLLVDTGDRHDGNGLSDVTIPNGAKSLPIFMRQDYDLLTIGNHELYIWENSQQEYDLVRDHFKSNYISTNVEYKLQNGTYIPMGQRYKYFTTPIQSIRILSFAFLFDFARYNSETKVEPIMKVLDEDWFKDILIDHPADEVDLLVIIGHIPVSHNDEELFQLHLFLRKYYPKTKIQYFGGHSHIRDFSIYDEYLTGLQSGRFCETAGWVSINLESANNNLNGVDKVKNTFSRSYIDFNLNSFMYHTNISSTEEFHTGVGLNVSRQISDTRKELNLEAIIGYVRNSNYFMDYVSITNPKNIFKLLTDKVLPTLEIENPDIATSDQRLIIINTGSIRYDLYKGPYTLDSQYIISPFENDWVKLTLPKNVAIKIAPKLNELQYIIRSASDNTFDNRRLLPEHQYSRLLKNDYASFNKRTEDWGQHHFENRASERFQEIGKLKSASRKNRLSKGYVTYDDFGHDGDDTLHRPVVNHPIPNVVQSEELNYSDGGSSVDVVFYSFITPNILWALKEIGFEEDVSNQIEFYSKNYLGLLLNEYIRNNDI

SEQ ID NO: 68428 - DNA, 1722 bp, Yarrowia lipolytica CLIB122
  CDS (1)..(1722)
atgaaactgaatctggcagtgctggcgctggcggtgcattccgtggcctcagcagctacgggccagcagatttttgcactcaaacgtcccgacagacgtgctctgactcccggcgagtacacctttctacagaccacagacacccacggctggtttgagcagagcggtgagacctactttggcgactggggcgatctcgccagcttccaccaacacatgaagaaaaagtacccgaatttgctgttttttgactcgggagacaagcatgatggcaacggggtttcggacgcctctaccccgagaggccactattcgcgacggctgtttcgcgaaatgccctttgacgccgtcacggtcggaaaccacgagctctacaacacagaggtggccacgttggagtacgaggaggtgtcacagcatctaggagacaagtaccttagtggtaacgtggagatttggagaggcgaatggcgtccctacggtaaccgatacaaggtgatcgagcggtcgcattacaaagacggcaaaactcgtcggatcctcacttttggcttcctctatgactttgacctgcatcccaataacattcgagtcaccaaggtcagagatgccgtcaagcagcaatggtttctggacgctctggacaacgaggagtacgacgtggtggcggtgataggccacattcccctacgatcatgggaattccctcagctgattgaggccatcagaaagcgaacaaagaagcctctggtgctgctaggtggccattctcacgtcagagacgccgtccagctgaatggagagtttgacggcccctctgacgtgtacggcatccagggaggccggttcctggaaactctgggatggctgtctcttaatgtcactggtcaggagtccacctcttcgtcccggtcatatattgatttccatattgacggtctcaagttccacgcctcacatgaccccgaccattccaagtgggacaccgctttgggcaagagccttactcggcagctgagccgcatcaagaagaagctcgatctgaaagaagtgtatggatgtgtgcccgaaaactattacaccaatggcgcaaaattccccgggccgtcttctctgctcagtctcattgctgacgaggtgctcccaactctgaatggcactgccgagggagctacgggtgaccgagtgattatcaccaacaccggcggtctgcgtttcgatctgctcaagggcccctacacacgtaataccggctttgtggtgtctcctttccccaataactgggtataccttcccaatatagacattcacacggcccatgacattttgccgtacctgaaccgaaaggcgcatattttgggaagtggtcacatggtgcctgaggagatcccccaggagtgtgacatgttccatgctgcagacaccaagggcctgttgcctggatacgtgactctggacgactacgggcatgatggagatgatactcctcattgggctcttccttactacgagcttcctaatgccattcagacagagatgcctccggacgacgtcaagtatgttgatctggtcttctacgacttcattgccccctttattcaggaggcgctgtatgctcttgaccggcctgattactttgagcggctgaccgactatggaggcaagggactgaatgagctactgaaggactacgccgaggagcactgggagtgtcggtattag

SEQ ID NO: 68429 - protein, 573 aa, Yarrowia lipolytica CLIB122
MKLNLAVLALAVHSVASAATGQQIFALKRPDRRALTPGEYTFLQTTDTHGWFEQSGETYFGDWGDLASFHQHMKKKYPNLLFFDSGDKHDGNGVSDASTPRGHYSRRLFREMPFDAVTVGNHELYNTEVATLEYEEVSQHLGDKYLSGNVEIWRGEWRPYGNRYKVIERSHYKDGKTRRILTFGFLYDFDLHPNNIRVTKVRDAVKQQWFLDALDNEEYDVVAVIGHIPLRSWEFPQLIEAIRKRTKKPLVLLGGHSHVRDAVQLNGEFDGPSDVYGIQGGRFLETLGWLSLNVTGQESTSSSRSYIDFHIDGLKFHASHDPDHSKWDTALGKSLTRQLSRIKKKLDLKEVYGCVPENYYTNGAKFPGPSSLLSLIADEVLPTLNGTAEGATGDRVIITNTGGLRFDLLKGPYTRNTGFVVSPFPNNWVYLPNIDIHTAHDILPYLNRKAHILGSGHMVPEEIPQECDMFHAADTKGLLPGYVTLDDYGHDGDDTPHWALPYYELPNAIQTEMPPDDVKYVDLVFYDFIAPFIQEALYALDRPDYFERLTDYGGKGLNELLKDYAEEHWECRY

SEQ ID NO: 68430 - DNA, 1794 bp, Cryptococcus neoformans var. neoformans JEC21
  CDS (1)..(1794)
atgaggttccccctcctcctccctttcgccgctctcgagctcccggtccccaccgcccccctcgagtggaagcaagcgaacttcctcagcatctcagacagccacggctggctcctcggacaccaacattcaacatggcctgaaccgaattactcgggaaattatgggtcgttcgcatcattcgtgatccacatgcgcaaaatagcagatgagaagggcgttgacttactcctgatcgacgcaggggatcatcatgacggctcaggcctggtctcatcctcaccggactcggcatccttggcggaggacatattctcgatgatttcatacgatgtcattaccatcggaaatcatgagctataccattatgcggacgccctcgatatctatgagaaccacgagcgatggggtggaaggtacgttacttccaatgtaaatattacggtcaagcgggaaggggaatggcaatctgtccctattggacagacgcacctaaaattcacgacgaaacagggctataatgtcactgcctttggtgtaatatttgatttcaaggcgcatgacaagggtataacggtccagaaacctagtaagcttgtgcatgaaccttggttccaggaagccattcgcgatgctccggactattttatcctcgctggtcatatgccggtacgaggagaaaccgcggagtttgcacctgtgtttgatgctatccgcgatatccatccacaagtccctattttcttatttggagggcatacacatgttcgggattgtgtccaatatgacgaacgctctatcggagttgtcccggggaagtatcttgaaacagtggctttcacatcgtcatcattaccttcttcttcgggcgatgataggcctctagacgtggctaggagctatcaatggcatacaaatcaaacatcttatacttttgatacggaacaagggctgcatatctctctcacgcttcagcatctagcctcctctttgaacatcactgatcctcttggtgtttctcctcacgactattatctcgctcgtcatccttggggtcatccacgctctgtactgacccttttctcagacaaagttttacccaaaacagttgtcgaccatgaacgagggaaaggggagcaaggcaaggagaggatcatcatcggcaatgccgggagtttgaggtttgatttgttccagggggttttcgatagaaacgacgaacttactgtttcccctttcacgtcttcatttttatatactcgtctaccggcttcactagctcgaaacatcacggatcagatgaaccgcgctggtgcatcaaaattgatgtcaaagtcacctgtgacaccttacgaggaggagcagcgtgtgaaaaggattcacgacaggtggttgtatgaacagtggcaagcttatgagctcgaaaacgcatacgaaggcgacactcaaaaggtgatggtcgacaaagggaaagacaagcctagaactttgggacatgtcaccaaggacaaatgtcctggtactggcgatgatatcgcgcacatccctgttccattttatagtgaccagccggattttatatcttcccccttcccttcagttgcggaagacgaagaaattgatgttgtttgcatggactttgcattggatgatttcctcactgccgtcaacacccttgacccaacacttaatttaaatgagagtgagatgaagccgtatgctaaagggctacgtatcaattctgtcttcgggaaatacgcccagagatactggggagctggaactcaagagtga

SEQ ID NO: 68431 - protein, 597 aa, Cryptococcus neoformans var. neoformans JEC21
MRFPLLLPFAALELPVPTAPLEWKQANFLSISDSHGWLLGHQHSTWPEPNYSGNYGSFASFVIHMRKIADEKGVDLLLIDAGDHHDGSGLVSSSPDSASLAEDIFSMISYDVITIGNHELYHYADALDIYENHERWGGRYVTSNVNITVKREGEWQSVPIGQTHLKFTTKQGYNVTAFGVIFDFKAHDKGITVQKPSKLVHEPWFQEAIRDAPDYFILAGHMPVRGETAEFAPVFDAIRDIHPQVPIFLFGGHTHVRDCVQYDERSIGVVPGKYLETVAFTSSSLPSSSGDDRPLDVARSYQWHTNQTSYTFDTEQGLHISLTLQHLASSLNITDPLGVSPHDYYLARHPWGHPRSVLTLFSDKVLPKTVVDHERGKGEQGKERIIIGNAGSLRFDLFQGVFDRNDELTVSPFTSSFLYTRLPASLARNITDQMNRAGASKLMSKSPVTPYEEEQRVKRIHDRWLYEQWQAYELENAYEGDTQKVMVDKGKDKPRTLGHVTKDKCPGTGDDIAHIPVPFYSDQPDFISSPFPSVAEDEEIDVVCMDFALDDFLTAVNTLDPTLNLNESEMKPYAKGLRINSVFGKYAQRYWGAGTQE

SEQ ID NO: 68432 - DNA, 1743 bp, Aspergillus nidulans FGSC A4
  CDS (1)..(1743)
atggcttcctatctcaaccctctcgttatcttatctttggtctcggcggttcaagctgttcagccctccgctccggattttgtcgcagctcctttacgtgaactgaaatggggtcaaatcaacttccttcatacgacagatactcatggctggctggctggccatctctcagagtatgagtatcagtcgttgcttggtgatagagtagagggcaatggcctttacgattcgtcagaccctaaaggtatatatacttccgagattatacggcaacaacaaatcgacgtgttgtctcccggaaatcatgagctctacaaaaagagcacctcagaagccgaatatagaattactgtacctaacttccgcggtcactatttgtcgtccaacgtcgatatctatgaccctgaaacaggagaactcgtggagttgggtccccgatttaggaaattcaccacgaagaaccaaggcattcgcatcactgcctttggctttcttttcgactttacaaggaactataacaacacggttgtccatccggtggaggaagttgtgaaagagccttggttcaagcacgccattcaagaccaggccgtcgatctgtttttggtgatagggcatgttccagttcggtcaaaagagtacgacgcggtcttcaatgaaatcagagctagtcatccggacacgccaattcagtttttcggtggtcacctccacattcgcgattgtcatcaattcgactcgaaagctgttgggcttgccagtggccgatttatggaaactattgggtttgcgtcaattagcggactgtctacggagcgcaacaaattggagcccagcatggtagatcctatcttcgagcgaagtcacactggtcttaatgagagtacgtttccaacggagcacggccgcaatgtgtctcgtcttatccagcaatcacgaagtgcgctgaaactagacgaaatatacggctgcgtcccggagaccttgtggatgtcacgatctccgcatacagcctcaaataacatttacgcttggttgcagagggaggtacttccaagcatgctagacgacacatctcggaaagggaaaccagctttcgttatcttcaatactggcgccattcggtttgaccttttcaaggggcaattcaatcgggactcagtctatataatttcgccatttacaagtggctttcgttacctgaaggacattgcctatgccgaagcagagcaggttttgaatgtcctaaatcagcagccacaaatcttcacaggcgccgaagggacaaccgggcttctgctacgggctcttgcgccgccagagcaagctgctcgtgactacggaattgacctcgctcgactacatcgtgcagagtcgattctcaatattcccacaagtcagcatccgatgtcagttggccacgattctgagcatgagatcatacctggatatactacgacagatgatctaggtgcagatggtgatgatacagtccattccatgattgaattctatcagataccgaactgcataggtgccttgactcttgacggtggctctgctccgccagaaactgtggaccttgtgtacatcgatttcatacagccatatgtgagcttcgcggctgaccaagttgggctcggtgtcaatgtctctcaggacagtgaggtgtatatgccctctacttcatttacggatctccttgtacagtgggttaagactcactggggctgctcggtgtga

SEQ ID NO: 68433 - protein, 580 aa, Aspergillus nidulans FGSC A4
MASYLNPLVILSLVSAVQAVQPSAPDFVAAPLRELKWGQINFLHTTDTHGWLAGHLSEYEYQSLLGDRVEGNGLYDSSDPKGIYTSEIIRQQQIDVLSPGNHELYKKSTSEAEYRITVPNFRGHYLSSNVDIYDPETGELVELGPRFRKFTTKNQGIRITAFGFLFDFTRNYNNTVVHPVEEVVKEPWFKHAIQDQAVDLFLVIGHVPVRSKEYDAVFNEIRASHPDTPIQFFGGHLHIRDCHQFDSKAVGLASGRFMETIGFASISGLSTERNKLEPSMVDPIFERSHTGLNESTFPTEHGRNVSRLIQQSRSALKLDEIYGCVPETLWMSRSPHTASNNIYAWLQREVLPSMLDDTSRKGKPAFVIFNTGAIRFDLFKGQFNRDSVYIISPFTSGFRYLKDIAYAEAEQVLNVLNQQPQIFTGAEGTTGLLLRALAPPEQAARDYGIDLARLHRAESILNIPTSQHPMSVGHDSEHEIIPGYTTTDDLGADGDDTVHSMIEFYQIPNCIGALTLDGGSAPPETVDLVYIDFIQPYVSFAADQVGLGVNVSQDSEVYMPSTSFTDLLVQWVKTHWGCSV

SEQ ID NO: 68434 - DNA, 1689 bp, Candida albicans SC5314
  CDS (1)..(1689): transl_table=12
atgttgttaattcttgctgtggttttgtttagtggctgttatgcgtcatttccacatcgtaacttgacatggaacgatataaattttgttcataccaccgatacccacggttggtactctggacacatcaaccaacctctttaccatgccaattggggagatttcatttcgtttactacacacttgcggagaattgcccatagccggaaccaagatcttttacttatagacagcggtgatcgccacgatggtaatggcctatcagatatcaccagccccaatggcctaaaatcaacccctattttcatcaaacaagactatgatttgctaactatcggaaaccacgagttgtatctttgggaaaactcaaaacaggaatacgaaactgtggttaaccattttcaggataagtatgtttgttcaaatgtggatatcagactagacaatggcctgtttgttcccttggggctgaagtacaagtattttacaacaccgattagagggattagagttttggcttttgggtttttattcgatttcaagaggtttaatagtggtactagagtgacgccaatggcagaaaccatacacgagccgtggtttcaggaggcattaaaacatgaagtcgatttgattataattgtgggtcacacacccatttcccataactggggagagttttaccaggttcaccaatacttgcgtcagtttttccctgatacgataattcagtattttggtggacacagtcatattcgagactttaccgtgtttgacagtttgtctacaggattacagagcggaagatattgtgagaccgttggctggacaagtgttaatttagataaagcggatctaaaccttcctgttagacaaagattttcgagatcgtatattgatttcaataccgactcatttaagtaccacaccaatttagataaagagtttgataccgccaaggggaaactggtttccaagttgattcgagaaacacgcaaagagctcaagttagataccttgataggctatgtcaagacaaactattatgttgattacgttcccatcgatcaccccaaaagcattttcaatttgttggctctgaaaattctcaaaacattaccgaaatccaaacatgaagagcgaattacaattatcaatactggctcaatcaggtacgacttgtacaaggggccatatactattgactccaaatttattgtctcgccctttgaaaacatatgggtcaatattacagtgccaaaatcagttgccactaaagtagcagcaaaactaaatgacgccgactatatcagtgcctctcgattgaaaccacctcatcaatacgatttgcaagtccaggacttgagtacttccccccaccaagctcactttgagatgcaggaaaaactccccaaaggttatgtcactcatgatgactttggggctgatggcgacgatacgttgcatcgtgccgtagttaatttcccagtacccaatgttattcagagtgtggaaatcaacgatgaggtagattcgcctgtcaaccttgtgttttatagttttatcacgccaaatatcatctgggcattaaaagagttgaatttctctactgaacaagtaccaacaccatattctgacatttacttaggtacattgctaaacgaatttgttgccaacaataagatctaa

SEQ ID NO: 68435 - protein, 562 aa, Candida albicans SC5314
MLLILAVVLFSGCYASFPHRNLTWNDINFVHTTDTHGWYSGHINQPLYHANWGDFISFTTHLRRIAHSRNQDLLLIDSGDRHDGNGLSDITSPNGLKSTPIFIKQDYDLLTIGNHELYLWENSKQEYETVVNHFQDKYVCSNVDIRLDNGSFVPLGSKYKYFTTPIRGIRVLAFGFLFDFKRFNSGTRVTPMAETIHEPWFQEALKHEVDLIIIVGHTPISHNWGEFYQVHQYLRQFFPDTIIQYFGGHSHIRDFTVFDSLSTGLQSGRYCETVGWTSVNLDKADLNLPVRQRFSRSYIDFNTDSFKYHTNLDKEFDTAKGKSVSKLIRETRKELKLDTLIGYVKTNYYVDYVPIDHPKSIFNLLASKILKTLPKSKHEERITIINTGSIRYDLYKGPYTIDSKFIVSPFENIWVNITVPKSVATKVAAKLNDADYISASRLKPPHQYDLQVQDLSTSPHQAHFEMQEKLPKGYVTHDDFGADGDDTLHRAVVNFPVPNVIQSVEINDEVDSPVNLVFYSFITPNIIWALKELNFSTEQVPTPYSDIYLGTLLNEFVANNKI

SEQ ID NO: 68436 - DNA, 2001 bp, Aspergillus fumigatus Af293
  CDS (1)..(2001)
atgatgcggtctcacactgcgctttccattgcagcgctgctggcacttgccagagtgccgtgcactgtgttcggcgacaacattatttatcctcaacaacaaaaagaagcattcaacgcaactgaaataccccgagctcctctcccctgggggagggtcaactttctgcacacaacggatactcatggatggcttgatgggcacgcaaatgtacccagctggggtgctgactggggcgacttcgtttcctttgtcatgcacatgaaagataaagccttacgcaagaaggtagatcttcttcttatcgagagtggagacttccatgacggtggcggcctcagcgacagtacaagccccaaaggagctgtgtcagacagtatctttgagaacattgattacgatctcgtgactattggtaaccacggcgttcgaacctgggcagaagcattaaacatccattacaacctatcgcgagtctttggtgatcggtttctcaccagtaacgtcgacgtagaagaagataaaaaacttaaatcaattggcaatcgatatcgcgcttttcagaccagaaacgggctacggatcgtggcctttggagtcactgtcaatgaccctatcctcagggatctaaaccatacagaggttcacaatgcgagctggatatttgaacaggaatggtttgcggaagccatgaagaaagaggctgacctctacgtgattgttggtcatatccctacctacgcttcctgcctggatcctacaaaggataatcctatggtgtgtctgcgcgataggatcaggaattccacagataagcccatccagctcttcgggggccacgcccatcatcgaaacttcacgtgttatgacgacagatcctcgggtattgaatctggcaagtattgcgataccgtgggatgggtggccttgaacaacgtgttgtcgcctacatggtctggtacgaaggagctgctgggtgacgatctccatccaaacaaatcctgcgccgtaggaagacaaggagatacacacgacgccccttatcttctagatcgccgatacctggactggaaccgtgtaacatttgcgtaccatacggtaaacctggaaggaaacaccgacaacccgtccgtgccagcatcctttgatatgcccctgggccgcaaggtcaccgatgatatcagcaaagcccgacagttactcaacctgacccatttcctagggtgcgcaaaagaagaatactgcttcaattgcaagaaagtgggacaggacggcaatatctatgagctcctaaaggttgccctcgctgatacggttgttaacaaggagcgggcacaccttgcacgggttgtgatttccaacgacgggacaatccgggataatatttaccaaggcccttttacgacaggggacgcctatgctgtcgtgccctttccgaatcatttcctgtatatcgcgaatatgccgtgtcatcatttcaaaaagatgacttcaagtttgcaggcaaagcaaaacgtttcctgcattgatgacgacgactatgatgaaccctacgtgattaaaaaagagggtcatagatcccagtatcaggcacacctggagctccggaacatatttgactatcatagtgatcatcaggctagggaacggaaagaatacagcccagggtacacaacgcacgatgccttaggcaacgacggagacgacacccttcactctcctgttatcgaggacgaaagatacatgaaactgttctgggcaaatgccagcttcccgaacctgcctcagtacccgccttcatttgatgtagttttcaccgactaccttgcgccgagaatcctcggcgctcttaagagaataggagctccctatacgcagaaagatgtcattgattacctgccgcggacttatactagtagggatgtccttgttgattatactgcgaggaattgggaccaggatagggacaactgtcatatccagaagccgggtgatcgttag

SEQ ID NO: 68437 - protein, 666 aa, Aspergillus fumigatus Af293
MMRSHTALSIAALLALARVPCTVFGDNIIYPQQQKEAFNATEIPRAPLPWGRVNFLHTTDTHGWLDGHANVPSWGADWGDFVSFVMHMKDKALRKKVDLLLIESGDFHDGGGLSDSTSPKGAVSDSIFENIDYDLVTIGNHGVRTWAEALNIHYNLSRVFGDRFLTSNVDVEEDKKLKSIGNRYRAFQTRNGLRIVAFGVTVNDPILRDLNHTEVHNASWIFEQEWFAEAMKKEADLYVIVGHIPTYASCLDPTKDNPMVCLRDRIRNSTDKPIQLFGGHAHHRNFTCYDDRSSGIESGKYCDTVGWVALNNVLSPTWSGTKELLGDDLHPNKSCAVGRQGDTHDAPYLLDRRYLDWNRVTFAYHTVNLEGNTDNPSVPASFDMPLGRKVTDDISKARQLLNLTHFLGCAKEEYCFNCKKVGQDGNIYELLKVALADTVVNKERAHLARVVISNDGTIRDNIYQGPFTTGDAYAVVPFPNHFLYIANMPCHHFKKMTSSLQAKQNVSCIDDDDYDEPYVIKKEGHRSQYQAHLELRNIFDYHSDHQARERKEYSPGYTTHDALGNDGDDTLHSPVIEDERYMKLFWANASFPNLPQYPPSFDVVFTDYLAPRILGALKRIGAPYTQKDVIDYLPRTYTSRDVLVDYTARNWDQDRDNCHIQKPGDR

SEQ ID NO: 68438 - DNA, 1881 bp, Aspergillus fumigatus Af293
  CDS (1)..(1881)
atggtgtggaacattgctctgaccaggatgaagtaccttgcttactgggctcttctctattcatcttcacccggcctagctattcagccgtcagctccagatgctataccggcgcccattcgcgatctccaatggggtcagctgaatttcctccacactacagacacccacggctggctggctggtcatctacaggaatcgaaaagggcttcctatggagcagactggggagattatatctctttcaccacccgcatgcgggaaaaggcactcgctcagggcaatgatctgctgataattgacactggtgacagggttgaagggaacggtctttacgacgcttcggaacccaagggcgcctacatttccgacattctgcgtcaacagcagattgatttgatgtcagccggcaatcatgaactgtacaagcagaacacctcggagactgagtttttgactactgtgcccaattttcgtgatagctacctggcgtccaacattgacatcgtccatccaatttccggagagctcgtgccgttggctccacggtttaaaaagttcacaactgagaaacaaggcatccgcatcgtcgcttttggttttctgtttgatttctccaaaaattacaacaacacaatcgtttatacagtggaggatacaattaaaacgacttggttccaagaagccattcgtgacgaagaagtcgatcttttcctggtgatcggccatgttccagttcgctcgaaggaatacaatgctgttttcgaagagatcagaaacgttaattgggatgtgccaattcaatttttcggcggccattatcatatccgcgactatgctcggtacgattctaaagcgtacgggctggcgagcggccgcttcatggagaccattgggtttttgtcaatcgacggtctgtccactagtaagaatcggctcaagcctgctcaagcaactcccagcttcaaccgacggtacattgataacaacctctactcgtttcaccatcacactggtcatgatcgggattcttttcccacagagcacggtcaaaatatatcgcatcttattcagcagtccagggatgtccttgaactggatagggtgcacggttgcgctcctcgggacctctggatgacccgagtaaagtatccctctcaggacagtatatatacgtggctcgaggagaaagtgcttcctagtcaagtgaaggatgactctcgcaaagggaagcccgcgttggtcattgtcaacactggagccatacgcttcgacatatttaagggtccgtttacacaagatacgacattcattgtctcgccctttacgagcggcttccggtatatcaaggacatcccctacgacaaagcgcaaacggtagtagacattttgaacaagcagccgcaaattttgactgcgcccaaggaccacacaaaccacacaccatggactcttgcgccacctgagcaatcaatgcatatgcacgataagattgtggaaagcgacgatgtggctgcccattatcttactgatcagagtcggcttccaatgagcacaccattcacgcctaaggttttccctggctacaccactgtagatgatgggggtatagatggtgatgacactgttcattcgccaatatcattctaccgtgttccaaattgcattcaagctctcatcaatccagggacgtctgccgatccgaacacagtggatcttgtgtatattgactttatcgagccctacgtggcgctggccgccaaatttgcgagacttgatctcgattttgcacgggatagtgacgtctatatgcccttcgagactttaactgatcttatcttggactgggtcaaacataactggaaatgcgaagatgcatga

SEQ ID NO: 68439 - protein, 626 aa, Aspergillus fumigatus Af293
MVWNIALTRMKYLAYWALLYSSSPGLAIQPSAPDAIPAPIRDLQWGQLNFLHTTDTHGWLAGHLQESKRASYGADWGDYISFTTRMREKALAQGNDLLIIDTGDRVEGNGLYDASEPKGAYISDILRQQQIDLMSAGNHELYKQNTSETEFLTTVPNFRDSYLASNIDIVHPISGELVPLAPRFKKFTTEKQGIRIVAFGFLFDFSKNYNNTIVYTVEDTIKTTWFQEAIRDEEVDLFLVIGHVPVRSKEYNAVFEEIRNVNWDVPIQFFGGHYHIRDYARYDSKAYGLASGRFMETIGFLSIDGLSTSKNRLKPAQATPSFNRRYIDNNLYSFHHHTGHDRDSFPTEHGQNISHLIQQSRDVLELDRVHGCAPRDLWMTRVKYPSQDSIYTWLEEKVLPSQVKDDSRKGKPALVIVNTGAIRFDIFKGPFTQDTTFIVSPFTSGFRYIKDIPYDKAQTVVDILNKQPQILTAPKDHTNHTPWTLAPPEQSMHMHDKIVESDDVAAHYLTDQSRLPMSTPFTPKVFPGYTTVDDGGIDGDDTVHSPISFYRVPNCIQALINPGTSADPNTVDLVYIDFIEPYVALAAKFARLDLDFARDSDVYMPFETLTDLILDWVKHNWKCEDA

SEQ ID NO: 68440 - DNA, 2385 bp, Ustilago maydis 521
  CDS (1)..(2385)
atgatggcacctcactccaacaccgccgtccagccatggccatcttccagtacccgaggctacagaggtcggccagcaagacatctgcttgtgaccttgatcgcactcgcctctctctgttcgactctggcgagctcgccagttgagccattatcgagtaaactcgctttcaaccatcgtatcgatgcagacgccgattcgctcgccaactaccgcgccgagatggaaggcttccagcgctggagtcgagaaagaggtcgcatgcccaggtccgatgacaagttgcgcgagctcgaatggggcgacctcaatcttctccattcaaccgatatacacggctggtttgctggccatcgcaaactctcgccaccagagccgtcgtattctggcgactggggtgactgggcatctttcgcgtccaagatgaggtccaaggctcgccatgagggtcgagatctcttgctcatcgacactggtgatctgcacgatggcaacggactctcggacggctttccaccttacaataaggacgaacctggcggcaaggaagccgtcgacggccatgtcagcaaccagatttttgctatggtcgactacgatttgcttacgatcggcaaccacgagctctacaattacacagtagcaaaggatgtctatcagaattttgtgccacagtggggcggaagatatatgaccagcaacgtcaagattgcgctccccagccctgatgctccttacgcaagctacgcgcctatcggatcgctcttcaacacgttggtgacgccggtgcaagggctcaagatcatgtcgtacggcatcctgttcgactttaagcttgctgccaagggaatcgccgtacaatcgccagaggacatggtggaagaagactggttccaacagagcctggatcgagctgaaaagtggggcgttgacgcctttgtcatactgggccacatgcccgtatcgggtgaccctggctgggaggctgttcgcaccaggattcgctcacgctttcccgatacacctatcgccatccttggaggacacacgcatgttcgcgactgcagaatgatggacagtcaaactatggctctcgaaagcggacgatacatggaaacaattggttttatgggcatcaaggaccttcagaagcgcaaacgtgcaggcaatcgcggcaaagtcaagtttacacggcggtacattgattcgaaccccagaaattttgcgcatcacttgaagctggagagaacacaggagctggcaaccaagaagggcagcttcattcggttcatcatggatgccatctccgaagcgtggaatctttcgcgcttgcacggcgtagtgcctcaggactactacctggaccgcgttccatacggcgacaattcgagcttgttaagtctcttggcggatcaggtgctacccaaggtcgtgcggccgtcggaaagaggtcgacaagacaagaagagtctggtgctgatcaacagcggctcacagcggtttgacgtctactcgggcccttttacacgtaatgaccaatacattgtctcgccgttcaaggatcgcttcctgtacatggccgatgtcccttggggcactgccaagcacctgcttgacggattgctcagcttcaagaaaggcgccatggttgaggtgatgcagggcggaactcagtactcggacggcgatgcggtgctgcgatacggaagtggttttgtggaggacattttcgtacgctggcaaaagtcgcaatggttcaaatttttgcaagcagagcacgctgatcgacaaaaagcagctgcagctgccgctgccgctgccgacggcggatgggtaaacgatatgaataccaccatcaagagcgtagaagagctcgaggcggaagaagatgaagagctgctcaagttcttccacaagtacgactcgctcgataagccgtctttggggtatcgcaccatcgatcaatgtgctggaccgggcgatgatacggtccattcgcccgtaccgtttaacccgcaccagccagagtacgttgcttcgaacccagatccactgccagagtctgacgaggaggtggtcgacgtcgtgtttgtcgactttatgcgcaaactcatggtggagctcctcaaccggtacgatgtggagcgcaatggaacgcggtcataccatgtggatcagcttgagcgatggggagacattaccacgcagcttttgtatccgcgattcgccgagctcgaatggcagcctggcgaaggtgcagtcaaggcgatcaacgcacatgcgaggagggcgggcaagatgggctacgcacctttggctgacgaacccgattacgatcatgaagagcaacagcagcacatctcgatccccaatgactcacgatga

SEQ ID NO: 68441 - protein, 794 aa, Ustilago maydis 521
MMAPHSNTAVQPWPSSSTRGYRGRPARHLLVTLIALASLCSTLASSPVEPLSSKLAFNHRIDADADSLANYRAEMEGFQRWSRERGRMPRSDDKLRELEWGDLNLLHSTDIHGWFAGHRKLSPPEPSYSGDWGDWASFASKMRSKARHEGRDLLLIDTGDLHDGNGLSDGFPPYNKDEPGGKEAVDGHVSNQIFAMVDYDLLTIGNHELYNYTVAKDVYQNFVPQWGGRYMTSNVKIALPSPDAPYASYAPIGSLFNTLVTPVQGLKIMSYGILFDFKLAAKGIAVQSPEDMVEEDWFQQSLDRAEKWGVDAFVILGHMPVSGDPGWEAVRTRIRSRFPDTPIAILGGHTHVRDCRMMDSQTMALESGRYMETIGFMGIKDLQKRKRAGNRGKVKFTRRYIDSNPRNFAHHLKLERTQELATKKGSFIRFIMDAISEAWNLSRLHGVVPQDYYLDRVPYGDNSSLLSLLADQVLPKVVRPSERGRQDKKSLVLINSGSQRFDVYSGPFTRNDQYIVSPFKDRFLYMADVPWGTAKHLLDGLLSFKKGAMVEVMQGGTQYSDGDAVLRYGSGFVEDIFVRWQKSQWFKFLQAEHADRQKAAAAAAAAADGGWVNDMNTTIKSVEELEAEEDEELLKFFHKYDSLDKPSLGYRTIDQCAGPGDDTVHSPVPFNPHQPEYVASNPDPLPESDEEVVDVVFVDFMRKLMVELLNRYDVERNGTRSYHVDQLERWGDITTQLLYPRFAELEWQPGEGAVKAINAHARRAGKMGYAPLADEPDYDHEEQQQHISIPNDSR

SEQ ID NO: 68442 - DNA, 1932 bp, Ustilago maydis 521
  CDS (1)..(1932)
atgttgttgagccgcttcatcaccacggccatcgcgctcgccggtgcggtttcggcttgtcccggaatcgaccatgcccaaggccttgctcctcggaaagttgatcactccattcagcccagtggaggcaacagtctgctccgtgaactgacttggggcgatctggccgtaattgcgacaactgacatccacggctggtatatgggtcacatgaagaagagttatccggagcctaactattccggcgattggggcgactttgcgtcctttgtcaagcacatgcgcaagcttgccaagaagaagggtgtcgatctgctccttgtcgactctggtgaccttcacgacggtgctggtttgagtgacggtttccctgcaggccaggtcgacggccaagtctctaaccaattccatgccaaggtcaagtacgatctcttgaccgtcggcaaccacgagctgtacaagtacaatgttgcctggaacacgctgcaagaatttgtgcctgaagctcgcagtcgttacctgggctccaacgtcaacatcagtcatgctgcgccccgcggtggcaacaacgtctcatacacctatggcgaacggtttgtcaagttcaagaccgaccatggccgaaaggtcacctcgctcggcgtcctcttcaactttaccggtgccgacagcggcattaccgtccaagaccctgctcagatggttctcgagccctggttcatcgacgccatccaggagcagcctgatgtcttcctgatcgctggccacatgcccgtccgcaaggatcaatttcccgtcgtggttaatgcgatccgcaaagtgcacccgatcacaccgatcatgatcctcggcggccactcgcacattcgcgactgcacccagtacgacaagtactctatgggtatcgagtcgggccgatacctcgagacgatcggctggatgtcgatgaactttaccaacaacggtcccaccttcagccgcacctatatcgacgccaaccgacgcaattacgccttccacgcaggtctcgctgccaagcctgaaaagttcgacacggccctgggaaggaagatcaccaagcagatgaaccaagtcgccgatgcctggaatctctctcacgtttatggtgttgctccccaggattactacctccagcgtgtccccatcaacgacagctcatctctgatcaactttatgaccaacaaggtgctgcccaccgtcatctcgacctcgaatccggaacgcaaaggggtgcccaacattgtcatcgccaacacgggctcgcagcgattcgacctgtatgcaggtcctttcaccaagaacgaccagtacattgtctcgcccttcaccgacgctttccagtatattaaggatgtgccgtacaagtacgctagccaggtcattcacaagctcaacggtgacagggtcgctcaggctaccagccgtaggcgcgatctcgaaggcgctgagagcgaacaggagctctacgctaagggacacgtctctcacatctacaaccgctggatccaggatcagcacgtttttgcttcggctcacaacgcggcagctcgtgacctggccatattggacgctcgagcagctgaagctcaagcgaaccgcacgctcggctacgtcaccaaggaccaatgtccaggggatggagacgacaccgtgcacagcgctattcccttcgcttcggttcccgactacgttcagagccctgtcaccggtcagaacgtaagcgacacggacaaggtcgacgtcatcttcctcgactttatcgccaagaacgtcgtgagaattctcaacagcgtccaaactgaaacgacgtactcgctgagcgatgtcgctgcttacaaccagtacactacgcaggacatctacccgctttacgctgaacagatctgggccaacaactctacctctgcctga

SEQ ID NO: 68443 - protein, 643 aa, Ustilago maydis 521
MLLSRFITTAIALAGAVSACPGIDHAQGLAPRKVDHSIQPSGGNSLLRELTWGDLAVIATTDIHGWYMGHMKKSYPEPNYSGDWGDFASFVKHMRKLAKKKGVDLLLVDSGDLHDGAGLSDGFPAGQVDGQVSNQFHAKVKYDLLTVGNHELYKYNVAWNTLQEFVPEARSRYLGSNVNISHAAPRGGNNVSYTYGERFVKFKTDHGRKVTSLGVLFNFTGADSGITVQDPAQMVLEPWFIDAIQEQPDVFLIAGHMPVRKDQFPVVVNAIRKVHPITPIMILGGHSHIRDCTQYDKYSMGIESGRYLETIGWMSMNFTNNGPTFSRTYIDANRRNYAFHAGLAAKPEKFDTALGRKITKQMNQVADAWNLSHVYGVAPQDYYLQRVPINDSSSLINFMTNKVLPTVISTSNPERKGVPNIVIANTGSQRFDLYAGPFTKNDQYIVSPFTDAFQYIKDVPYKYASQVIHKLNGDRVAQATSRRRDLEGAESEQELYAKGHVSHIYNRWIQDQHVFASAHNAAARDLAILDARAAEAQANRTLGYVTKDQCPGDGDDTVHSAIPFASVPDYVQSPVTGQNVSDTDKVDVIFLDFIAKNVVRILNSVQTETTYSLSDVAAYNQYTTQDIYPLYAEQIWANNSTSA

SEQ ID NO: 68444 - DNA, 1806 bp, Giardia lamblia ATCC 50803
  CDS (1)..(1806)
atggtgctggccgttctggctcttgccctgcttttcgcaagcaccgcagaggcccagaatctggcccttgacgttatctcagtctccgatacacatgggtggatttatggccacagacaccagaaggagctaggagactacggaacccttgtgtcttacatcgaacgcaccagggacgaggcagccaaggatcctgcgcgtgccgtgctggccatagatggcggcgacctcattgaaggtacgggcctcagcgacgcaacgcccattaaaggcatgtacatataccaagccgccagtgaggtaggcttcgacctcataacagtcggcaatcacgatctggggtcagaatccagtaccgcatacatccatgagaagattgatgacatgttcggggacgcctatgtctcaactaataccttcatgaacgcagacaattctccattggtgaagaaccgctacaagcacatgacactgaagaatgggctcaacgtccttatgttcgggtttctgtatcgcagtagctacgtatcatcgtacgttgagcgagccagtgatatcatcaagaccgctgagattcaggcgatcctggacaagtactttgacaagacagacgtcctcgtggtggccaatcacatgagctattcagatggtgagctggagaacatcgtgaatgcatttcgctcatactatggcggaaggggatatactattccaataattcttatcgctgcacacagccatcgcttatataacgacgcctgtgcatttgaccagaccggccagtgctttattgtggaggccgagtgctacttaaagcgcattcagcacatcaagtatagcttcacccccatacaatacatggatacgaaaactagggctacaagaacaggctatcagatggccgtcccacccactgtccttactccttcaaagaacataccaaaaacaatggcagacagatttggcttagccgtggatcaatttgacacaccaaaggcaatagccctacgggaaaagatacatggctgggttgacagcctcgaccttaaccgtgtgctcggctgcagcaactatttatactccaagtctgttgggatggagtccccgacgtctgtgttcaatatttggctcaatgctgtcgttccagcagagatttataatgatgaccgcctgtctaagtgcacgcagtttccagtgacagggagctcgtccgtcagagactccatctacaaaggagagttcgtcgtcgacgactcctataacgtgatgccctttaagaattcatttgtgtatatcgcaaatctcaccgcagaagaggtggcctgtgcattttccggttccatcctgacatacaccgaagaggaacagctacagaacatttacacttacgaggctgctcgcgccagcatcccgcgttatgttaccccgatggatccctcgtctctcccatctgacagttgctatgacttaattctcacttcgtacgatgctgacaagtttgcaggccgttttagaaagggagggagctgctatagtatggttgacccatctaaatcgtatcttgcggtggactaccctactcagccgaggccaaatgttacaacagaggagctacttccagacttcttttccaaatatatgccctgctatacatcccaatctgtcgatggggtatcaggccaagaagctgctacaaccaggagcaccatgcgcatcgtattcttctctctcagcttcatagtacttgctgcagttgttgctgcactaattggacttattctcttctgctgccgcagaaagtcatga

SEQ ID NO: 68445 - protein, 601 aa, Giardia lamblia ATCC 50803
MVLAVLALALLFASTAEAQNLALDVISVSDTHGWIYGHRHQKELGDYGTLVSYIERTRDEAAKDPARAVLAIDGGDLIEGTGLSDATPIKGMYIYQAASEVGFDLITVGNHDLGSESSTAYIHEKIDDMFGDAYVSTNTFMNADNSPLVKNRYKHMTLKNGLNVLMFGFLYRSSYVSSYVERASDIIKTAEIQAILDKYFDKTDVLVVANHMSYSDGELENIVNAFRSYYGGRGYTIPIILIAAHSHRLYNDACAFDQTGQCFIVEAECYLKRIQHIKYSFTPIQYMDTKTRATRTGYQMAVPPTVLTPSKNIPKTMADRFGLAVDQFDTPKAIALREKIHGWVDSLDLNRVLGCSNYLYSKSVGMESPTSVFNIWLNAVVPAEIYNDDRLSKCTQFPVTGSSSVRDSIYKGEFVVDDSYNVMPFKNSFVYIANLTAEEVACAFSGSILTYTEEEQLQNIYTYEAARASIPRYVTPMDPSSLPSDSCYDLILTSYDADKFAGRFRKGGSCYSMVDPSKSYLAVDYPTQPRPNVTTEELLPDFFSKYMPCYTSQSVDGVSGQEAATTRSTMRIVFFSLSFIVLAAVVAALIGLILFCCRRKS

SEQ ID NO: 68446 - DNA, 1905 bp, Giardia lamblia ATCC 50803
  CDS (1)..(1905)
atgatattggcactactgcacacgctgttattactcatcagatcagcgtatcttagtacagagtcaaaaattgtcctcgacgttatctctgtgtcagacactcacggctggatttacggccacagacatctaccagaatatggagattatggcacgcttctttcttacatagagcgcacaagacaaaaagctttggagtccgaaggtcgatctgtgttagcagtagatgcgggggatctggtagagggaacagggcttagtgatctcacaaaagttaagggagaaaagatactggaggcggcatcctatattggcttcgacctacagacgatagggaaccacgaatcatactataaggagacaacagattacatacacagcaaggttgaagccctcttcggtgacagatatataaccaccaatgtttttatgcgcgatacgaacgtgccagtcggaagcggaagatataagtatctcgttcttcctactggactccgggttctcatgcttggctttctattccacaccagcccatatgacggggtctacactatccctgcgagggaggccattgcatcccaggagatcaccggtgtccttgagaagtataagtaccaaacggatctgctagtcctcgcatgtcatataccgacatatgacctggagatatccgaaatagttacagaactgcgtgcgttttataaccaaatcaattataccattccgataataattattgccggtcactaccaccaaattaagaacacgtattgcatggacggtcaggacaagcagtgctacattgtcgagggtgggtgttatctgcgctttatgcagcacgttacctatgagttcaagcccatgacttatagccatgaagggaatacgtatacaggataccagttttcctccgtagactactctttaccctacaactttacgtccgagagtttggcaaagagattcaaccttactacggaaacgttcatgactgagaacggggccatcctctcgaataagattgccgggtgggtggcagatctaaacctgacagcctttattggctataacaagcactactacagcatgttcaagaacgctacagatcaagattctatctttaacctgtggctcaatggagcaattcctgcggtgttctatcctacaaggtctactccgtgcctcccttttccaacgatttcttctgggacggccaggtatgatttttttcctgggaacgtcactagagatgattgcattgcaatccagccctcttggcaaaccatgtcgacgattcgtgggctaacagccaacctgattgcgtgtctcttttcagtgaagaatgggcttgcagaaaccatgtatccccttccagaaggtctatttgattgggaggacccccaccttatcaattaccagacaactttggacccttttaccttaaacccaaataagtgctacgacttgctaacgaccataaaaagcgcagagagctttcttgctctgttacaggaaggaggagcttgctatgaagagggatccggtccatactctgtttctccctactatgatcagaatggacaagaggttaatgcaatcgacgttcttctcaagtacgtcgagatgtacatgccgaatttggatgtcgtctctccttatattctgacccacgatctccatcaagcagacaaagactttatgatgatgatggggacaatatccttcgcaatatatattacgctaattatggttgcattaataagcttctgcattaagccaccagtcaagactgtctctgcacacagacgctccgtggacagaactcagagtagcagcgaatccaatccttccatctcattctttgatacacaggatagtttaagtaattctgatattatcacttag

SEQ ID NO: 68447 - protein, 634 aa, Giardia lamblia ATCC 50803
MILALLHTLLLLIRSAYLSTESKIVLDVISVSDTHGWIYGHRHLPEYGDYGTLLSYIERTRQKALESEGRSVLAVDAGDLVEGTGLSDLTKVKGEKILEAASYIGFDLQTIGNHESYYKETTDYIHSKVEALFGDRYITTNVFMRDTNVPVGSGRYKYLVLPTGLRVLMLGFLFHTSPYDGVYTIPAREAIASQEITGVLEKYKYQTDLLVLACHIPTYDLEISEIVTELRAFYNQINYTIPIIIIAGHYHQIKNTYCMDGQDKQCYIVEGGCYLRFMQHVTYEFKPMTYSHEGNTYTGYQFSSVDYSLPYNFTSESLAKRFNLTTETFMTENGAILSNKIAGWVADLNLTAFIGYNKHYYSMFKNATDQDSIFNLWLNGAIPAVFYPTRSTPCLPFPTISSGTARYDFFPGNVTRDDCIAIQPSWQTMSTIRGLTANLIACLFSVKNGLAETMYPLPEGLFDWEDPHLINYQTTLDPFTLNPNKCYDLLTTIKSAESFLALLQEGGACYEEGSGPYSVSPYYDQNGQEVNAIDVLLKYVEMYMPNLDVVSPYILTHDLHQADKDFMMMMGTISFAIYITLIMVALISFCIKPPVKTVSAHRRSVDRTQSSSESNPSISFFDTQDSLSNSDIIT

SEQ ID NO: 68448 - DNA, 1806 bp, Schizosaccharomyces pombe
  CDS (1)..(1806)
atgaagttatcatctttaccttctggattgggcctagcgtctttgcttggtcttatcagttctgctactgcttattcggccaccgatttaactacgatgtatgattggaaccaaataatcaaacctttagaatggggacaattgaatttcattcatactacggatactcacggttggcttggtggtcatcttagagatgctcgttataaagccgactttggtgaattcaaatcgtttgctttgcgcatgaaggaattagctgattttaaaggtgtagacttgttgatggttgacaccggtgatttgcacgacggaaacggcctttctgatgcttctgatcctcagggtatctacacaaacaacattttcacctatcttccctacgatattcttacaattggtaatcacgaattgtaccaagccgccatttctaataacacgcatgagtattttgtgcctcattggaatggtacgtatctcgcttctaacgttcaaatttacaactcatcaaatgaattggagcaatttggtggtgaatccacttactttattacaaaacatggtgttcgaacccttgctatgggttttctcttcaacttcagtagtaatgctaataacactgtcgttacacccgttgaaacagccatcaaatctgaatggtaccaacaacaaatcaacagaaccgacgtcgaccttttcttattgattggtcatatccccgttcgtgattatgatgagtggaaatcactacatgcctctattagaaaagtacatcccaatactcccattcaaatccttggtggtcattctcacattcgtgattttgctgtttacgacgaggcttctgtatctcttgagggtggaagatattgtgaaactgtaggctggctttcaattgacggtctttcagcatccaatgcaacccgccaatatgttggtcgtcccgtcaccaatgagactcgtcaatcatatcccaatcttcctaagcctgctacgcctttgtattatacacgtcgctacattgatttcaaccgtcaaaacttccgcttccatactcaacagtcagaggactccttcgatactccagaaggtgttgaactatcgaaggttattaaacagtaccgtgacgatcttaatctttcatatgtctttggatgcatccctaaaaattattatatgactgaagtctctcctcaagccgaggacagcatcttcaaacttatggtagatcatattttgccagaggttttggtcaatgaaaaccgttcatctgtgcctcatattataattagcaacggaggtggtgttcgtggttctatgtatgaaggaacgtttggacccgacgaaatgttccaacttaacccattccttaccaattattataattacattccagacgttccttacaaatatgccaagaagctttactctatcttgaatggcggttccactcttcgcaacgttaacgattatcttgctgctctcaatcctggttacgttactagcgacgactttggagaagatggcgatgacaccgtccatacctatgtttccacatacgcagtacctaacgttcttcaagctcaagtcggctttaacactacttcagctccagaaaccgttgatgttgttttcctcaactatttccagaccaaagtattgaaggcccttaatacaatggttaacgaaactatttatactttatcaaacgtgacacaatactgggttcgtgaagacggcaaagacagctctccttatatgtttgcccagtacgttcaacaagaatggagtgattactgtgattaa

SEQ ID NO: 68449 - protein, 601 aa, Schizosaccharomyces pombe
MKLSSLPSGLGLASLLGLISSATAYSATDLTTMYDWNQIIKPLEWGQLNFIHTTDTHGWLGGHLRDARYKADFGEFKSFALRMKELADFKGVDLLMVDTGDLHDGNGLSDASDPQGIYTNNIFTYLPYDILTIGNHELYQAAISNNTHEYFVPHWNGTYLASNVQIYNSSNELEQFGGESTYFITKHGVRTLAMGFLFNFSSNANNTVVTPVETAIKSEWYQQQINRTDVDLFLLIGHIPVRDYDEWKSLHASIRKVHPNTPIQILGGHSHIRDFAVYDEASVSLEGGRYCETVGWLSIDGLSASNATRQYVGRPVTNETRQSYPNLPKPATPLYYTRRYIDFNRQNFRFHTQQSEDSFDTPEGVELSKVIKQYRDDLNLSYVFGCIPKNYYMTEVSPQAEDSIFKLMVDHILPEVLVNENRSSVPHIIISNGGGVRGSMYEGTFGPDEMFQLNPFLTNYYNYIPDVPYKYAKKLYSILNGGSTLRNVNDYLAALNPGYVTSDDFGEDGDDTVHTYVSTYAVPNVLQAQVGFNTTSAPETVDVVFLNYFQTKVLKALNTMVNETIYTLSNVTQYWVREDGKDSSPYMFAQYVQQEWSDYCD

SEQ ID NO: 68450 - DNA, 26 bp, Artificial sequence
  (1)..(26): primer
atgatactaaagcttgtacactgttt

SEQ ID NO: 68451 - DNA, 26 bp, Artificial sequence
  (1)..(26): primer
ctaaaattgagaaaagtaatcccgta

SEQ ID NO: 68452 - protein, 679 aa, Artificial sequence
  Variant (2)..(4): xaa in position 2 to 4 is any amino acid
  Variant (12)..(13): xaa in position 12 to 13 is any amino acid
  Variant (14)..(14): xaa in position 14 is any or no amino acid
  Variant (16)..(20): xaa in position 16 to 20 is any amino acid
  Variant (21)..(24): xaa in position 21 to 24 is any or no amino acid
  Variant (26)..(27): xaa in position 26 to 27 is any amino acid
  Variant (28)..(29): xaa in position 28 to 29 is any or no amino acid
  Variant (31)..(33): xaa in position 31 to 33 is any amino acid
  Variant (36)..(37): xaa in position 36 to 37 is any amino acid
  Variant (38)..(49): xaa in position 38 to 49 is any or no amino acid
  Variant (51)..(51): xaa in position 51 is any amino acid
  Variant (53)..(54): xaa in position 53 to 54 is any amino acid
  Variant (56)..(56): xaa in position 56 is any amino acid
  Variant (59)..(61): xaa in position 59 to 61 is any amino acid
  Variant (63)..(63): xaa in position 63 is any amino acid
  Variant (66)..(66): xaa in position 66 is any amino acid
  Variant (68)..(72): xaa in position 68 to 72 is any amino acid
  Variant (73)..(84): xaa in position 73 to 84 is any or no amino acid
  Variant (86)..(97): xaa in position 86 to 97 is any amino acid
  Variant (99)..(102): xaa in position 99 to 102 is any amino acid
  Variant (109)..(126): xaa in position 109 to 126 is any amino acid
  Variant (127)..(129): xaa in position 127 to 129 is any or no amino acid
  Variant (131)..(133): xaa in position 131 to 133 is any amino acid
  Variant (135)..(153): xaa in position 135 to 153 is any amino acid
  Variant (154)..(160): xaa in position 154 to 160 is any or no amino acid
  Variant (162)..(171): xaa in position 162 to 171 is any amino acid
  Variant (172)..(176): xaa in position 172 to 176 is any or no amino acid
  Variant (178)..(180): xaa in position 178 to 180 is any amino acid
  Variant (181)..(181): xaa in position 181 is any or no amino acid
  Variant (183)..(190): xaa in position 183 to 190 is any amino acid
  Variant (192)..(201): xaa in position 192 to 201 is any amino acid
  Variant (202)..(202): xaa in position 202 is any or no amino acid
  Variant (204)..(211): xaa in position 204 to 211 is any amino acid
  Variant (212)..(216): xaa in position 212 to 216 is any or no amino acid
  Variant (218)..(222): xaa in position 218 to 222 is any amino acid
  Variant (225)..(225): xaa in position 225 is any amino acid
  Variant (227)..(230): xaa in position 227 to 230 is any amino acid
  Variant (231)..(238): xaa in position 231 to 238 is any or no amino acid
  Variant (240)..(247): xaa in position 240 to 247 is any amino acid
  Variant (249)..(254): xaa in position 249 to 254 is any amino acid
  Variant (255)..(259): xaa in position 255 to 259 is any or no amino acid
  Variant (261)..(263): xaa in position 261 to 263 is any amino acid
  Variant (267)..(267): xaa in position 267 is any amino acid
  Variant (269)..(269): xaa in position 269 is any amino acid
  Variant (272)..(275): xaa in position 272 to 275 is any amino acid
  Variant (277)..(284): xaa in position 277 to 284 is any amino acid
  Variant (285)..(290): xaa in position 285 to 290 is any or no amino acid
  Variant (292)..(294): xaa in position 292 to 294 is any amino acid
  Variant (297)..(297): xaa in position 297 is any amino acid
  Variant (299)..(300): xaa in position 299 to 300 is any amino acid
  Variant (302)..(309): xaa in position 302 to 309 is any amino acid
  Variant (310)..(360): xaa in position 310 to 360 is any or no amino acid
  Variant (362)..(362): xaa in position 362 is any amino acid
  Variant (364)..(364): xaa in position 364 is any amino acid
  Variant (366)..(371): xaa in position 366 to 371 is any amino acid
  Variant (372)..(373): xaa in position 372 to 373 is any or no amino acid
  Variant (375)..(379): xaa in position 375 to 379 is any amino acid
  Variant (380)..(390): xaa in position 380 to 390 is any or no amino acid
  Variant (392)..(392): xaa in position 392 is any amino acid
  Variant (394)..(395): xaa in position 394 to 395 is any amino acid
  Variant (397)..(409): xaa in position 397 to 409 is any amino acid
  Variant (411)..(411): xaa in position 411 is any amino acid
  Variant (413)..(416): xaa in position 413 to 416 is any amino acid
  Variant (418)..(443): xaa in position 418 to 443 is any amino acid
  Variant (444)..(445): xaa in position 444 to 445 is any or no amino acid
  Variant (448)..(461): xaa in position 448 to 461 is any amino acid
  Variant (462)..(468): xaa in position 462 to 468 is any or no amino acid
  Variant (470)..(470): xaa in position 470 is any amino acid
  Variant (472)..(473): xaa in position 472 to 473 is any amino acid
  Variant (475)..(479): xaa in position 475 to 479 is any amino acid
  Variant (481)..(481): xaa in position 481 is any amino acid
  Variant (483)..(491): xaa in position 483 to 491 is any amino acid
  Variant (494)..(502): xaa in position 494 to 502 is any amino acid
  Variant (503)..(504): xaa in position 503 to 504 is any or no amino acid
  Variant (506)..(515): xaa in position 506 to 515 is any amino acid
  Variant (518)..(534): xaa in position 518 to 534 is any amino acid
  Variant (535)..(623): xaa in position 535 to 623 is any or no amino acid
  Variant (626)..(626): xaa in position 626 is any amino acid
  Variant (628)..(628): xaa in position 628 is any amino acid
  Variant (630)..(634): xaa in position 630 to 634 is any amino acid
  Variant (638)..(639): xaa in position 638 to 639 is any amino acid
  Variant (641)..(670): xaa in position 641 to 670 is any amino acid
  Variant (671)..(678): xaa in position 671 to 678 is any or no amino acid
NXXXTTDTHGWXXXHXXXXXXXXXYXXXXGXXXSFXXXXXXXXXXXXXXDXLXXDXGDXXXGXGLXDXXXXXXXXXXXXXXXXXGXXXXXXXXXXXXDXXXXGNHELYXXXXXXXXXXXXXXXXXXXXXYXXXNXXXXXXXXXXXXXXXXXXXXXXXXXXTXXXXXXXXXXXXXXXFXXXXFXXXXXXXXVXXXXXXXXXXXWXXXXXXXXXXXXXDXXXXXGHXPXXXXXXXXXXXXEXXXXXXXXRXXXXXXXXXXXIXXXGGHXHXRDXXXXDXXXXXXXXXXXXXXGXXXETXGXXSXXXXXXXXXXXXXXXXXXXXXXXXXXXXXXXXXXXXXXXXXXXXXXXXXXXXXXXXXXXRXYXDXXXXXXXXHXXXXXXXXXXXXXXXXFXTXXGXXXXXXXXXXXXXLXLXXXXGXXXXXXXXXXXXXXXXXXXXXXXXXXXXLPXXXXXXXXXXXXXXXXXXXXXNXGXXRXXXXXGXFXXXXXXXXXPFXXXXXXXXXXXPXXXXXXXXXXLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGYXTXDXXXXXGDDXXHXXXXXXXXXXXXXXXXXXXXXXXXXXXXXXXXXXXXXXF

SEQ ID NO: 68453 - protein, 11 aa, Artificial sequence
  Variant (2)..(2): xaa in position 2 is Phe, Ile or Leu
  Variant (3)..(3): xaa in position 3 is Ile, Leu or Val
  Variant (4)..(5): xaa in position 4 to 5 is any amino acid
  Variant (6)..(6): xaa in position 6 is Ser or Thr
  Variant (8)..(8): xaa in position 8 is any amino acid
NXXXXXDXHGW

SEQ ID NO: 68454 - protein, 18 aa, Artificial sequence
  Variant (2)..(2): xaa in position 2 is Phe, Leu or Val
  Variant (3)..(3): xaa in position 3 is Ile or Leu
  Variant (4)..(4): xaa in position 4 is Ile, Leu, Met or Val
  Variant (5)..(5): xaa in position 5 is Ile, Leu or Val
  Variant (6)..(6): xaa in position 6 is Asp or Glu
  Variant (7)..(7): xaa in position 7 is Ala, Ser or Thr
  Variant (10)..(11): xaa in position 10 to 11 is any amino acid
  Variant (12)..(12): xaa in position 12 is Asp, Glu or Thr
  Variant (14)..(14): xaa in position 14 is Ala, Gly, Asn, Ser or Thr
  Variant (16)..(16): xaa in position 16 is Phe or Leu
  Variant (17)..(17): xaa in position 17 is any amino acid
  Variant (18)..(18): xaa in position 18 is Asp or Ser
DXXXXXXGDXXXGXGXXX

SEQ ID NO: 68455 - protein, 11 aa, Artificial sequence
  Variant (2)..(2): xaa in position 2 is Ile, Leu or Val
  Variant (3)..(3): xaa in position 3 is Ile, Leu or Met
  Variant (4)..(4): xaa in position 4 is Cys, Ser, Thr or Val
  Variant (5)..(5): xaa in position 5 is any amino acid
DXXXXGNHELY

SEQ ID NO: 68456 - protein, 51 aa, Artificial sequence
  Variant (2)..(2): xaa in position 2 is any amino acid
  Variant (3)..(3): xaa in position 3 is Phe, Ile, Leu or Val
  Variant (4)..(4): xaa in position 4 is Ala, Ile, Leu or Val
  Variant (5)..(5): xaa in position 5 is Ile, Leu or Val
  Variant (6)..(6): xaa in position 6 is any amino acid
  Variant (9)..(23): xaa in position 9 to 23 is any amino acid
  Variant (24)..(26): xaa in position 24 to 26 is any or no amino acid
  Variant (28)..(37): xaa in position 28 to 37 is any amino acid
  Variant (38)..(38): xaa in position 38 is any or no amino acid
  Variant (40)..(40): xaa in position 40 is Ala or Gly
  Variant (42)..(42): xaa in position 42 is any amino acid
  Variant (44)..(44): xaa in position 44 is Ile or Val
  Variant (47)..(50): xaa in position 47 to 50 is any amino acid
  Variant (51)..(51): xaa in position 51 is Asp or Asn
DXXXXXGHXXXXXXXXXXXXXXXXXXRXXXXXXXXXXXGXHXHXRDXXXXX

SEQ ID NO: 68457 - protein, 26 aa, Artificial sequence
  Variant (2)..(2): xaa in position 2 is Ala, Asp, Gly, Ser or Thr
  Variant (4)..(4): xaa in position 4 is Ala, Gly, Ser or Thr
  Variant (5)..(5): xaa in position 5 is any amino acid
  Variant (7)..(7): xaa in position 7 is any amino acid
  Variant (8)..(8): xaa in position 8 is Asp, Gly, Asn or Ser
  Variant (9)..(9): xaa in position 9 is Ile, Leu, Met or Val
  Variant (10)..(11): xaa in position 10 to 11 is any amino acid
  Variant (13)..(16): xaa in position 13 to 16 is any amino acid
  Variant (17)..(17): xaa in position 17 is any or no amino acid
  Variant (19)..(23): xaa in position 19 to 23 is any amino acid
  Variant (24)..(24): xaa in position 24 is any or no amino acid
NXGXXRXXXXXGXXXXXDXXXXXXPF

SEQ ID NO: 68458 - DNA, 942 bp, Saccharomyces cerevisiae; identical to SEQ ID NO: 50322
  CDS (1)..(942)

SEQ ID NO: 68459 - protein, 313 aa, Saccharomyces cerevisiae; identical to SEQ ID NO: 50323

SEQ ID NO: 68460 - DNA, 819 bp, Arabidopsis thaliana; identical to SEQ ID NO: 50324
  CDS (1)..(819)

SEQ ID NO: 68461 - protein, 272 aa, Arabidopsis thaliana; identical to SEQ ID NO: 50325

SEQ ID NO: 68462 - DNA, 978 bp, Arabidopsis thaliana; identical to SEQ ID NO: 50326
  CDS (1)..(978)

SEQ ID NO: 68463 - protein, 325 aa, Arabidopsis thaliana; identical to SEQ ID NO: 50327

SEQ ID NO: 68464 - DNA, 771 bp, Thermoanaerobacter tengcongensis MB4; identical to SEQ ID NO: 50328
  CDS (1)..(771): transl_table=11

SEQ ID NO: 68465 - protein, 256 aa, Thermoanaerobacter tengcongensis MB4; identical to SEQ ID NO: 50329

SEQ ID NO: 68466 - DNA, 897 bp, Eremothecium gossypii; identical to SEQ ID NO: 50330
  CDS (1)..(897)

SEQ ID NO: 68467 - protein, 298 aa, Eremothecium gossypii; identical to SEQ ID NO: 50331

SEQ ID NO: 68468 - DNA, 1329 bp, Neurospora crassa; identical to SEQ ID NO: 50332
  CDS (1)..(1329)

SEQ ID NO: 68469 - protein, 442 aa, Neurospora crassa; identical to SEQ ID NO: 50333

SEQ ID NO: 68470 - DNA, 1254 bp, Magnaporthe grisea 70-15; identical to SEQ ID NO: 50334
  CDS (1)..(1254)

SEQ ID NO: 68471 - protein, 417 aa, Magnaporthe grisea 70-15; identical to SEQ ID NO: 50335

SEQ ID NO: 68472 - DNA, 1176 bp, Gibberella zeae PH-1; identical to SEQ ID NO: 50336
  CDS (1)..(1176)

SEQ ID NO: 68473 - protein, 391 aa, Gibberella zeae PH-1; identical to SEQ ID NO: 50337

SEQ ID NO: 68474 - DNA, 1425 bp, Gibberella zeae PH-1; identical to SEQ ID NO: 50338
  CDS (1)..(1425)

SEQ ID NO: 68475 - protein, 474 aa, Gibberella zeae PH-1; identical to SEQ ID NO: 50339

SEQ ID NO: 68476 - DNA, 1095 bp, Ustilago maydis 521; identical to SEQ ID NO: 50340
  CDS (1)..(1095)

SEQ ID NO: 68477 - protein, 364 aa, Ustilago maydis 521; identical to SEQ ID NO: 50341

SEQ ID NO: 68478 - DNA, 897 bp, Candida glabrata CBS138; identical to SEQ ID NO: 50342
  CDS (1)..(897)

SEQ ID NO: 68479 - protein, 298 aa, Candida glabrata CBS138; identical to SEQ ID NO: 50343

SEQ ID NO: 68480 - DNA, 975 bp, Kluyveromyces lactis NRRL Y-1140; identical to SEQ ID NO: 50344
  CDS (1)..(975)

SEQ ID NO: 68481 - protein, 324 aa, Kluyveromyces lactis NRRL Y-1140; identical to SEQ ID NO: 50345

SEQ ID NO: 68482 - DNA, 1041 bp, Debaryomyces hansenii CBS767; identical to SEQ ID NO: 50346
  CDS (1)..(1041)

SEQ ID NO: 68483 - protein, 346 aa, Debaryomyces hansenii CBS767; identical to SEQ ID NO: 50347

SEQ ID NO: 68484 - DNA, 936 bp, Oryza sativa (japonica cultivar-group); identical to SEQ ID NO: 50348
  CDS (1)..(936)

SEQ ID NO: 68485 - protein, 311 aa, Oryza sativa (japonica cultivar-group); identical to SEQ ID NO: 50349

SEQ ID NO: 68486 - DNA, 954 bp, Yarrowia lipolytica CLIB99; identical to SEQ ID NO: 50350
  CDS (1)..(954)

SEQ ID NO: 68487 - protein, 317 aa, Yarrowia lipolytica CLIB99; identical to SEQ ID NO: 50351

SEQ ID NO: 68488 - DNA, 1380 bp, Cryptococcus neoformans var. neoformans JEC21; identical to SEQ ID NO: 50352
  CDS (1)..(1380)

SEQ ID NO: 68489 - protein, 459 aa, Cryptococcus neoformans var. neoformans JEC21; identical to SEQ ID NO: 50353

SEQ ID NO: 68490 - DNA, 969 bp, Dictyostelium discoideum; identical to SEQ ID NO: 50354
  CDS (1)..(969)

SEQ ID NO: 68491 - protein, 322 aa, Dictyostelium discoideum; identical to SEQ ID NO: 50355

SEQ ID NO: 68492 - DNA, 1215 bp, Aspergillus nidulans FGSC A4; identical to SEQ ID NO: 50356
  CDS (1)..(1215)

SEQ ID NO: 68493 - protein, 404 aa, Aspergillus nidulans FGSC A4; identical to SEQ ID NO: 50357

SEQ ID NO: 68494 - DNA, 972 bp, Candida albicans SC5314; identical to SEQ ID NO: 50358
  CDS (1)..(972): transl_table=12

SEQ ID NO: 68495 - protein, 323 aa, Candida albicans SC5314; identical to SEQ ID NO: 50359

SEQ ID NO: 68496 - DNA, 1386 bp, Aspergillus fumigatus Af293; identical to SEQ ID NO: 50360
  CDS (1)..(1386)

SEQ ID NO: 68497 - protein, 461 aa, Aspergillus fumigatus Af293; identical to SEQ ID NO: 50361

SEQ ID NO: 68498 - DNA, 1380 bp, Cryptococcus neoformans var; identical to SEQ ID NO: 50362
  CDS (1)..(1380)

SEQ ID NO: 68499 - protein, 459 aa, Cryptococcus neoformans var; identical to SEQ ID NO: 50363

SEQ ID NO: 68500 - DNA, 957 bp, Arabidopsis thaliana; identical to SEQ ID NO: 50364
  CDS (1)..(957)

SEQ ID NO: 68501 - protein, 318 aa, Arabidopsis thaliana; identical to SEQ ID NO: 50365

SEQ ID NO: 68502 - DNA, 1008 bp, Schizosaccharomyces pombe; identical to SEQ ID NO: 50366
  CDS (1)..(1008)

SEQ ID NO: 68503 - protein, 335 aa, Schizosaccharomyces pombe; identical to SEQ ID NO: 50367

SEQ ID NO: 68504 - DNA, 25 bp, Artificial sequence
  (1)..(25): primer
atgaataaacttgttgatgcccact

SEQ ID NO: 68505 - DNA, 27 bp, Artificial sequence
  (1)..(27): primer
tcacttgataaatttctgaaagttttc

SEQ ID NO: 68506 - protein, 495 aa, Artificial sequence; identical to SEQ ID NO: 50370
  Variant (2)..(2): xaa in position 2 is any amino acid
  Variant (6)..(32): xaa in position 6 to 32 is any amino acid
  Variant (33)..(43): xaa in position 33 to 43 is any or no amino acid
  Variant (45)..(57): xaa in position 45 to 57 is any amino acid
  Variant (58)..(84): xaa in position 58 to 84 is any or no amino acid
  Variant (87)..(87): xaa in position 87 is any amino acid
  Variant (91)..(96): xaa in position 91 to 96 is any amino acid
  Variant (97)..(146): xaa in position 97 to 146 is any or no amino acid
  Variant (148)..(164): xaa in position 148 to 164 is any amino acid
  Variant (165)..(173): xaa in position 165 to 173 is any or no amino acid
  Variant (176)..(176): xaa in position 176 is any amino acid
  Variant (180)..(189): xaa in position 180 to 189 is any amino acid
  Variant (190)..(227): xaa in position 190 to 227 is any or no amino acid
  Variant (229)..(238): xaa in position 229 to 238 is any amino acid
  Variant (240)..(246): xaa in position 240 to 246 is any amino acid
  Variant (248)..(248): xaa in position 248 is any amino acid
  Variant (250)..(250): xaa in position 250 is any amino acid
  Variant (252)..(254): xaa in position 252 to 254 is any amino acid
  Variant (256)..(270): xaa in position 256 to 270 is any amino acid
  Variant (271)..(337): xaa in position 271 to 337 is any or no amino acid
  Variant (341)..(342): xaa in position 341 to 342 is any amino acid
  Variant (344)..(358): xaa in position 344 to 358 is any amino acid
  Variant (359)..(368): xaa in position 359 to 368 is any or no amino acid
  Variant (370)..(370): xaa in position 370 is any amino acid
  Variant (372)..(393): xaa in position 372 to 393 is any amino acid
  Variant (394)..(405): xaa in position 394 to 405 is any or no amino acid
  Variant (407)..(407): xaa in position 407 is any amino acid
  Variant (409)..(409): xaa in position 409 is any amino acid
  Variant (411)..(445): xaa in position 411 to 445 is any amino acid
  Variant (446)..(494): xaa in position 446 to 494 is any or no amino acid

SEQ ID NO: 68507 - protein, 5 aa, Artificial sequence
  Variant (2)..(2): xaa in position 2 is Ala or Ser
DXHCH

SEQ ID NO: 68508 - protein, 11 aa, Artificial sequence
  Variant (2)..(3): xaa in position 2 to 3 is any amino acid
  Variant (4)..(4): xaa in position 4 is any or no amino acid
  Variant (7)..(7): xaa in position 7 is any amino acid
  Variant (11)..(11): xaa in position 11 is Phe, Trp or Tyr
VXXXFGXHPWX

SEQ ID NO: 68509 - protein, 12 aa, Artificial sequence
  Variant (3)..(3): xaa in position 3 is Ile or Val
  Variant (5)..(5): xaa in position 5 is Ile or Leu
  Variant (7)..(9): xaa in position 7 to 9 is any amino acid
  Variant (10)..(11): xaa in position 10 to 11 is any or no amino acid
GEXGXDXXXXXR

SEQ ID NO: 68510 - protein, 37 aa, Artificial sequence; identical to SEQ ID NO: 50374
  Variant (2)..(3): xaa in position 2 to 3 is any amino acid
  Variant (4)..(4): xaa in position 4 is Ile or Val
  Variant (5)..(5): xaa in position 5 is Phe or Leu
  Variant (6)..(10): xaa in position 6 to 10 is any amino acid
  Variant (11)..(11): xaa in position 11 is Ile or Leu
  Variant (13)..(18): xaa in position 13 to 18 is any amino acid
  Variant (19)..(19): xaa in position 19 is Ala, Ile, Leu or Val
  Variant (21)..(21): xaa in position 21 is Phe, Ile, Leu or Val
  Variant (23)..(23): xaa in position 23 is Cys, Asp, Gly or Ser
  Variant (25)..(27): xaa in position 25 to 27 is any amino acid
  Variant (29)..(29): xaa in position 29 is any amino acid
  Variant (30)..(36): xaa in position 30 to 36 is any or no amino acid

SEQ ID NO: 68511 - protein, 10 aa, Artificial sequence
  Variant (2)..(2): xaa in position 2 is any amino acid
  Variant (3)..(3): xaa in position 3 is Asp, Glu, Gly, Asn, Gln or Thr
  Variant (4)..(4): xaa in position 4 is any amino acid
  Variant (5)..(5): xaa in position 5 is Ile, Leu or Val
  Variant (7)..(7): xaa in position 7 is any amino acid
  Variant (9)..(9): xaa in position 9 is Ser or Thr
PXXXXLXEXD

SEQ ID NO: 68512 - DNA, 1618 bp, Saccharomyces cerevisiae
  CDS (292)..(1113)
acacgtaatcgccttacctacgaggggagaaaacgttccctctgcatgtatatatatatatatatatataaatattaaatcttgaatattgttggattaagcatgtgcttgacaaatggtgtatgggtttgtagacgatgagagtggaagggagattaaaagtttattgcagatgcgaacatctgcacaaaagtacttgaatgtactaagcagaaaaagttctaatacatattagcaggaggcccaacagtcacacaagttcagcagaactgccaattaatcgaaaagaatatgtatgtttctaatgggaaagacacttgccagttgttggggcccgtgtctctttttgtccagacattgatgggtatgacagccgtgattgtgttattggtgaaaagaaactatgagcatccaaggagaaaaatgattgtgtggagttatgacattggaaaacaaatcatcggctctcttggaatccattttttgaatctaggcatcagcatactgaagaaaagacgaaggtcactcttcgcaatcactgcaaaaggcaatgatgatgaggatcaatgcgattggtattttcttaacttactcctggatactactgttgggattcccattctttggttgtgcttatacataattgaaaaagtgctaaaatccttacacttccaaaacattgaaagtggtaattattttccatctaaaaccgttgggagccaccccagaaaacccttattctctgccttcgtgaaacagctgcttatattcattgttgggctgggcgtgatgaagttctgcgtgtttctaatactaaactacttagaagacttggcatactggttcgccgatcttatccttggctggtcagattcatggccaaactttcaagtttttctggtcatgtttgtctttcctatcttactgaattgcttccagtacttttgtgtcgacaatgtcatcaggttacattctgagagcctaacgataaccaatgcagagaattttgaaacgaacacattcctaaatgacgaaattcctgatttatcggaagtctcaaatgaagtgcctaacaaggataacaacatttccagctatggtagcataatatagtattccaaggataaggaaagcatgcactgtttatttcctttccttgcttaattgattttttttaaagggaacaaacattttgatttcaatttccacaagcctagactcttcaacacataatctgtgggttattgtttgggaaagcattctccgctagaagaatgaaactggcgctcaggtttgattctataactacggcagtttttcctattctattttcgttttttgattttcccgccgcattggatattcaattcgcgacgctaataattggcatttcgtgttcttaagtaatttcgtgtttcaaataaccgtaaacagagaaagacccaagaatttcagatggcttagaagaggtagacattaaatcaatctgtatgtgatggagagggagtgtatttaaaagacgtaagaaaatgaattatcaagatccgttatggccatctagtctctttcttgtacactagttgtctaacacaaccaacaaattagaatatatatcgca

SEQ ID NO: 68513 - protein, 273 aa, Saccharomyces cerevisiae
MYVSNGKDTCQLLGPVSLFVQTLMGMTAVIVLLVKRNYEHPRRKMIVWSYDIGKQIIGSLGIHFLNLGISILKKRRRSLFAITAKGNDDEDQCDWYFLNLLLDTTVGIPILWLCLYIIEKVLKSLHFQNIESGNYFPSKTVGSHPRKPLFSAFVKQLLIFIVGLGVMKFCVFLILNYLEDLAYWFADLILGWSDSWPNFQVFLVMFVFPILLNCFQYFCVDNVIRLHSESLTITNAENFETNTFLNDEIPDLSEVSNEVPNKDNNISSYGSII

SEQ ID NO: 68514 - DNA, 615 bp, Xenopus tropicalis
  CDS (1)..(615)
atggggacgagcaatggcagcaagagcctgaccccggggccgtccccgcccgaccccagtcccactgctccgggctgcgggaatggggcaatgatgggctctttcgggatcttcttgcaaggcctgctggctgtgatggctttcagcatcctcatgttaaaacgccttcgagaaccaaagcatgaaagacgtccttggaaaatatggtttttggacacatccaagcaagctatagggatgctgtttatccattttgcaaacgtctacttgtcggaccttaccggggaagatccttgctctatatatctgattaatttcctgctggacgctacattgggaatgttgctcatttatatcggggttcgagtagtgagttgcatcgtggagtggaggcagtgggagtccttgcgatttggcgaatatggtgaacctatgcagtgcaaagcctgggttggtcagtgtgctctctacattgtcatcatgatgtttgagaaagcagccatcatccttgtgctgctcataccacatctcaaagaggttgccaaggtaaaacctataaaaaaaccctcagctggaacttgcaactgtcatgctgattgtcccgttctttgttaa

SEQ ID NO: 68515 - protein, 204 aa, Xenopus tropicalis
MGTSNGSKSLTPGPSPPDPSPTAPGCGNGAMMGSFGIFLQGLLAVMAFSILMLKRLREPKHERRPWKIWFLDTSKQAIGMLFIHFANVYLSDLTGEDPCSIYLINFLLDATLGMLLIYIGVRVVSCIVEWRQWESLRFGEYGEPMQCKAWVGQCALYIVIMMFEKAAIILVLLIPHLKEVAKVKPIKKPSAGTCNCHADCPVLC

SEQ ID NO: 68516 - DNA, 804 bp, Gallus gallus
  CDS (1)..(804)
atggccgcgacccgtccgactcacggctgcggcagcggagcgctactgggctgcttcggagtgctgctgcaggcattgctggcgctgtgcgtcttctgcacgctgatgttaaaacgatttaaggaaccaaaagaagagaggcgtccctggaggatatggttttacgatacctccaagcaagcaattggtgcccttttcatccactttgccaatatttttctgtctgaacgcactgagaaggacccttgctctctctaccttattaatttcatccttgatgccacgctggggatgctgctgatttggcttggtgtgaaggtggtgtcctgggctgtgcagcgtcagaagtacacatatctggtctttggagaatatggtgatcctccacaagctgctgcttggattagccagtgtatcctctacctgctgataatggttgtggagaagaccctgatcaaccttgtgctgctgatccctggttggacagagcttcagcagatcctcctgagttacatcccaaacccccagttggagcttttcctggtcatgcttgttgtgccttttattgtaaatgccgttatgttctgggttgtggacagcttgattatgagaaaatacaagcagaaagacacgttgaacatcaatggatccacagaaaccccacaagctaggaggagtgaggaatctcaggtgctgctctctccagacatggattttgaccagtctgaaagtgaccaggatatctcaggactccagggaacaaaccagaagatgaagcagcccagctaccacgtggtcatctga

SEQ ID NO: 68517 - protein, 267 aa, Gallus gallus
MAATRPTHGCGSGALLGCFGVLLQALLALCVFCTLMLKRFKEPKEERRPWRIWFYDTSKQAIGALFIHFANIFLSERTEKDPCSLYLINFILDATLGMLLIWLGVKVVSWAVQRQKYTYLVFGEYGDPPQAAAWISQCILYLLIMVVEKTLINLVLLIPGWTELQQILLSYIPNPQLELFLVMLVVPFIVNAVMFWVVDSLIMRKYKQKDTLNINGSTETPQARRSEESQVLLSPDMDFDQSESDQDISGLQGTNQKMKQPSYHVVI

SEQ ID NO: 68518 - DNA, 867 bp, Mus musculus
  CDS (1)..(867)
atgcaaggcccgggagggaacgtgagccgcggattgccgagcgggccggcctccacggtcgcgtccggggcgggccgctgtgagagcggcgcgctcatgcacagtttcggcatcttcctgcaggggctgctcggcgtcgtggccttcagcacattgatgcttaaacgcttcagagaaccaaagcatgaaagacggccgtggaggatatggtttttagacacttccaaacaagccatagggatgctcttcatccactttgcaaatgtgtacctagcagatctcactgaagaggacccttgttcactgtacctcatcaactttcttctggacgccactgtaggcatgctgctcatttatgtgggcgtacgcgccgccggtgtcttggtggagtggcagcagtgggaatccctgcgtttgggagaatatggagaccctctgcagtgcggggcctgggtaggacagtgcgccctctacatggtgatcatgatctttgaaaagtccgtggtcttcatcgtcctcctcatactccagtggaaaaaggtggccctattgaatccaattgaaaaccccgacctgaagctggccatcgtcatgctgatagtccccttctttgtcaatgctttcatgttctgggtagtggacaatttcctcatgagaaaggggaagacgaaagctaaactaaaagaaagaggagccaaccaggactcaaggaatgggagcaaggttcgctaccgaagggcagcatcccatgaggagtctgagtctgagatcctgatctcagctgacgacgagatggaggagtctgacgccgaggaggacctccggagacctgtgaaaaagaagcaccgcttcgggctgcctgtatga

SEQ ID NO: 68519 - protein, 288 aa, Mus musculus
MQGPGGNVSRGLPSGPASTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAAGVLVEWQQWESLRLGEYGDPLQCGAWVGQCALYMVIMIFEKSVVFIVLLILQWKKVALLNPIENPDLKLAIVMLIVPFFVNAFMFWVVDNFLMRKGKTKAKLKERGANQDSRNGSKVRYRRAASHEESESEILISADDEMEESDAEEDLRRPVKKKHRFGLPV

SEQ ID NO: 68520 - DNA, 885 bp, Homo sapiens
  CDS (1)..(885)
atgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccgtatga

SEQ ID NO: 68521 - protein, 294 aa, Homo sapiens
MQGPAGNASRGLPGGPPSTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVSVLVEWQQWESLRFGEYGDPLQCGAWVGQCALYIVIMIFEKSVVFIVLLILQWKKVALLNPIENPDLKLAIVMLIVPFFVNALMFWVVDNFLMRKGKTKAKLEERGANQDSRNGSKVRYRRAASHEESESEILISADDEMEESDVEEDLRRLTPLKPVKKKKHRFGLPV

SEQ ID NO: 68522 - DNA, 867 bp, Rattus norvegicus
  CDS (1)..(867)
atgcaaggcccgggagggaacgtgagccgcggattgccgggcgggccggcctccacggtcgcgtccggggcgggccgctgtgagagcggcgcgctcatgcacagtttcggcatcttcctgcaggggctgctcggcgtcgtggccttcagcacattgatgcttaaacgcttccgagaaccaaagcatgaaagacggccatggaggatatggtttttagacacttccaaacaagccatagggatgctcttcatccactttgcaaacgtgtacctagcggatctcactgaagaggacccttgctcactgtacctcatcaacttccttctggacgccactgtaggcatgctcctcatttatgtgggcgtacgtgccgtcggtgtgttggtggagtggcagcagtgggagtccctgcgttttggagaatatggagaccctctacagtgtggggcctgggtcgggcagtgtgccctttacatcgtgatcatgatctttgaaaagtccgtggtcttcatcgtccttctcatactccagtggaaaaaggtggccctgctgaatccaattgagaaccctgacctgaagctggccatcgtcatgctcatagtccccttctttgtcaatgctttcatgttctgggtagtggacaatttcctcatgagaaaggggaagacgaaagctaaactcgaagaaagaggagccaaccaggactcaaggaacgggagcaaggttcgctaccgacgggcggcatcccatgaggagtctgagtctgagatcctgatctcggctgacgacgagatggaggagtctgacgccgaggaggacctccggagacctgtgaagaagaaacatcgcttcgggctgcccgtatga

SEQ ID NO: 68523 - protein, 288 aa, Rattus norvegicus
MQGPGGNVSRGLPGGPASTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVGVLVEWQQWESLRFGEYGDPLQCGAWVGQCALYIVIMIFEKSVVFIVLLILQWKKVALLNPIENPDLKLAIVMLIVPFFVNAFMFWVVDNFLMRKGKTKAKLEERGANQDSRNGSKVRYRRAASHEESESEILISADDEMEESDAEEDLRRPVKKKHRFGLPV

SEQ ID NO: 68524 - DNA, 837 bp, Danio rerio
  CDS (1)..(837)
atgtttgtttttgtgaaagacagcattaatatgactgatttggtgagcccggagtatcagggctgcgtggacggagctctgatggacggattcagtgtttttatacaggctctgttggcggttctggctttcagcactttaatgttgaagaggtttcgtgaacctgttggaataagaagaccttggaagatctggttctttgacacttctaaacaagcggtcggggctcttttcatgcattttgccaacatattcctttccacactcaccaatgaagatccctgctctctatatttgctgaacttcttgttggatgccacattgggaatgcttgtgatctgggtgggagtgaaagttgtttccaaaatagtggaacataaacagataacactactaatgttcggagaatatggtgatcctcctcgagtcttggcatgggtggctcagtgttcagtgtatttactcatcgttgctctggggaaaagtgtggtctctctggtgctgctcattcctggatggaccaatttggaggaggtggtgctggattacatcccaaacccacagctggagctggccatcgtcatgcttatcgtgcctttcatagtcaactctataatgttctgggtggtggacagtttaacaatgcgcaaatataggaagatgacgtctctggaaggctcacgcgactctccgaaacaagtagacgctttgccagatgagagcaatgatgaagctgaggtgctgctaaagaaagatgatgaagcagcggtgtgttctgaagaggaagatcacgtcacaacagaagaagccttaatacgagtcagcatggaggtttaa

SEQ ID NO: 68525 - protein, 278 aa, Danio rerio
MFVFVKDSINMTDLVSPEYQGCVDGALMDGFSVFIQALLAVLAFSTLMLKRFREPVGIRRPWKIWFFDTSKQAVGALFMHFANIFLSTLTNEDPCSLYLLNFLLDATLGMLVIWVGVKVVSKIVEHKQITLLMFGEYGDPPRVLAWVAQCSVYLLIVALGKSVVSLVLLIPGWTNLEEVVLDYIPNPQLELAIVMLIVPFIVNSIMFWVVDSLTMRKYRKMTSLEGSRDSPKQVDALPDESNDEAEVLLKKDDEAAVCSEEEDHVTTEEALIRVSMEV

SEQ ID NO: 68526 - DNA, 897 bp, Danio rerio
  CDS (1)..(897)
atggcgggtgtcggggtcagtatgctgtcccggggtcagctgccgtctgcatcctctaactcctcgcccactgagctccaggcccagggctgctccaacggggacttcatgggctccttcggcatcttcctgcagggcctgctgggagtggtggccttcagcacccttatgttgaaacgctttagggagcccaagcatgaacggagaccctggaaaatctggtttctggacacctccaaacaggccatagggatgctgttcattcactttgccaatgtctacctgtctgacctcacaaaggaggacccatgttcactatacctgatcaacttcctgttggatgcaacgctgggcatgctggtgatctatggcggtgtgaaggctattagcgttgtggtggaatggagacagtgggattcattgcgttttggagagtatggtgagcctgttcagtgcactgcctgggcgggtcagtgtgccctgtatatcctcatcatgatctttgagaaggtcatgatcatattggttctcctcatcccacagtggaagaagctggctacactcaaccccctgaagaaccctaagctagagctagctatcgtcatgctaatcgtcccgtttttcgtgaacgctcttatgttctgggtggtagataacttcctaatgaagaaggggagaacaaaagccaaactggaggagagagtagcagaagacgatcctcgcggaaacagcaaagtgcgctacagacgggcactgtcacatgatgattcggaatcagaaatcctgttctctgcagatgatgaaatggaggattcagagggtgacgacgatgtacgaagaatcacagggctcaagcctgttaagaaaaagaaacaccgtcttggtattccagtatga

SEQ ID NO: 68527 - protein, 298 aa, Danio rerio
MAGVGVSMLSRGQLPSASSNSSPTELQAQGCSNGDFMGSFGIFLQGLLGVVAFSTLMLKRFREPKHERRPWKIWFLDTSKQAIGMLFIHFANVYLSDLTKEDPCSLYLINFLLDATLGMLVIYGGVKAISVVVEWRQWDSLRFGEYGEPVQCTAWAGQCALYILIMIFEKVMIILVLLIPQWKKLATLNPLKNPKLELAIVMLIVPFFVNALMFWVVDNFLMKKGRTKAKLEERVAEDDPRGNSKVRYRRALSHDDSESEILFSADDEMEDSEGDDDVRRITGLKPVKKKKHRLGIPV

SEQ ID NO: 68528 - DNA, 792 bp, Eremothecium gossypii
  CDS (1)..(792)
atgggtgcggaaaactcatgccggctattgggaccggtggcgctcttcatccagttcttcatggcggccgtggccgtcgggggattgctagttaagcgccagtacgagcaccccaagcgcacgtggcgggtgtggtcatacgatgtgggaaagcagatgatcgggtctgccgggatacacctgctcaatgtgctgctgagcatcatgaagagccagggcctgctcggcacgctgaaaaagacggacgaccagtgcgactggttcttcgtgaacctcttgatggacacgacggtcggcatcccgattttgtggtgctggttggtgctgatccacaaggggctgcaggcgctgggcgtgcagaacatcgagagcggcaactactaccccacgctggacaagccggagcccggcgccgcggtgccgcgcaccggcccgatgttcagcgcgttcgtcaagcagctcctcgtgttcgtgtccgggctcgccatgatgaaggtgtgcattttcctgctgctcggctgcttcgagcagctcgcgaacctcttcgccgacctcgtgctcggctggtccgacccctggcccaacctccaggtgttcctcgtcatgttcgtgttccccgtcctgttgaactgcttccagtacttctgcgtcgacaacatcatcaagttgccatccgaccgcttgacccgccagaacgtcgacaatttcgaccaggagtccatcttcgaacagaacggcgtctacgtgcccaccctgctggcagcggcgaagcaaacatacctggccgtgtga

SEQ ID NO: 68529 - protein, 263 aa, Eremothecium gossypii
MGAENSCRLLGPVALFIQFFMAAVAVGGLLVKRQYEHPKRTWRVWSYDVGKQMIGSAGIHLLNVLLSIMKSQGLLGTLKKTDDQCDWFFVNLLMDTTVGIPILWCWLVLIHKGLQALGVQNIESGNYYPTLDKPEPGAAVPRTGPMFSAFVKQLLVFVSGLAMMKVCIFLLLGCFEQLANLFADLVLGWSDPWPNLQVFLVMFVFPVLLNCFQYFCVDNIIKLPSDRLTRQNVDNFDQESIFEQNGVYVPTLLAAAKQTYLAV

SEQ ID NO: 68530 - DNA, 582 bp, Anopheles gambiae str. PEST
  CDS (1)..(582)
atgtgcagcaaggatgcgctgacggatctgttcggctggtttctgcagggcatactggccaccctcgcctttacctgccttatcgctaaacgcttctgcgaaccacagtacaatcgccgctcatgggaaacctggtggtacgatacgtccaagcagggcatcggtgctctggtgatccacatggccaacgtttatttggccccactcttccaaggcgacccctgtacctggtacattatcaacttcctgctagattctaccatcgggctgttcattatttacatcggcatcaaaacctgtcagtatttagcgcggaagaaaaaatgggatgccatcaactttggtgaatatggtgccccgaaatcctggctctaccaaacgtgtatctacgtgtgcctgatggtggtcgttaagctgataacgacgctaatcattcagttcgatgtgtgggataacgtgaaaaacttcgtcctgtcgccgttccgggatccgcggatagagctggccgtcgtgatgctggtcattccgttcttcgtcaatatcctaatcttctgggtgacggataacttcctgatgaggtag

SEQ ID NO: 68531 - protein, 193 aa, Anopheles gambiae str. PEST
MCSKDALTDLFGWFLQGILATLAFTCLIAKRFCEPQYNRRSWETWWYDTSKQGIGALVIHMANVYLAPLFQGDPCTWYIINFLLDSTIGLFIIYIGIKTCQYLARKKKWDAINFGEYGAPKSWLYQTCIYVCLMVVVKLITTLIIQFDVWDNVKNFVLSPFRDPRIELAVVMLVIPFFVNILIFWVTDNFLMR

SEQ ID NO: 68532 - DNA, 1671 bp, Neurospora crassa
  CDS (1)..(1671)
atgcgcttagtgtcatcgtcctgctccttctccaactcaacgtttcaacgtttcaaaagtggaaagctgggattcaacaaccgaacggctgaaactcgacaagcccacttgttcggaactgtgcaccgatcaaaccaacattattacaccaaaccagccccgacagtacccgcaacaccgcctttatctttgtcaggacagcgtcgcaatgttgatatccgcgaagacataccggttgtaagaatagccggcggtactctgccctctcaccatcgtctgcgcatcggcacagtcaacagcctccatcgtcgcctaggtggcgaggcagctgctggtgcggatacccgtcccgattactttgtcgacccgcaagtagacacccaactcgacgatcccgacgcccaagacacggaaccacaaccattcgaaacctttcctcacgtcgtcaacccacctgctcccaccgggaccgttatatccgtcaccatgactcccacatcgcaacctacgtcgtcaacatcaccacaaccagcctcccccatggctcatcaaacagacaacaacaccgaatgccgcctactcggccctttcgccatcctcgtccaaattgccctcggctgcttggctctattatcactcgtctacaagcgctggcgcgaacggccacaaagaccggtcaagatctggttctttgatgtgtcgaaacaagtctttgggagcgtcttggtgcacgccgccaacgtgttcatgtccatgttgacaagcggcaagtttgagatcaaagtgttggatccggtggcagtggcggtggggaccaagatggtgaagcgcgctgtggaatatgggatattgagtgcgagaggagaagacgagtacacgcccaatccgtgctcgttttatttgttgaacttggctattgatgtatcacaaaaaaaacagacaaccctcggcatcccaatcctcatcctcatcgtccgcctcctctcccgcggcctccaatacacccccctcggccaacctcccgaatccctccaatccggcaactacaccccgctccactccccacccggtactaaaccgcgctggagctggtggttcaagcaatccatcatctacttcatcggcctcttgggcatgaagttctgtgtgctcatcatcttcatggtcttcccctggatttcgcgcgtgggcgactgggccctcggctggaccgagggaaacgaacgattgcaaatcatttttgtcatgatgcttttcccgctcatcatgaacgcgttgcaatactatattattgattcgtacatcaagaaggacgagaagattcctgaggaaggggcggagagtgaaggattagtcacgggacggggagatgccgaggctgcgggtgctgaggagaggggaaggggaagaggggtttatgatatcatcagtgggagtgatgatgatgcgggtagttccggggatggtgatagtgatggacaggaagatgaggaggatgagctgcccaaggacaaagctgctgagttaatggtcggtcataaaaagagggggttcaagaccaggaccaaagcagtgagggaagaggaatatgatccggcggtggatggagataccccgaccgtcattgggagtagctctagtgcggtgtcgggtgtgtcggtgaaggattga

SEQ ID NO: 68533 - protein, 556 aa, Neurospora crassa
MRLVSSSCSFSNSTFQRFKSGKLGFNNRTAETRQAHLFGTVHRSNQHYYTKPAPTVPATPPLSLSGQRRNVDIREDIPVVRIAGGTLPSHHRLRIGTVNSLHRRLGGEAAAGADTRPDYFVDPQVDTQLDDPDAQDTEPQPFETFPHVVNPPAPTGTVISVTMTPTSQPTSSTSPQPASPMAHQTDNNTECRLLGPFAILVQIALGCLALLSLVYKRWRERPQRPVKIWFFDVSKQVFGSVLVHAANVFMSMLTSGKFEIKVLDPVAVAVGTKMVKRAVEYGILSARGEDEYTPNPCSFYLLNLAIDVSQKKQTTLGIPILILIVRLLSRGLQYTPLGQPPESLQSGNYTPLHSPPGTKPRWSWWFKQSIIYFIGLLGMKFCVLIIFMVFPWISRVGDWALGWTEGNERLQIIFVMMLFPLIMNALQYYIIDSYIKKDEKIPEEGAESEGLVTGRGDAEAAGAEERGRGRGVYDIISGSDDDAGSSGDGDSDGQEDEEDELPKDKAAELMVGHKKRGFKTRTKAVREEEYDPAVDGDTPTVIGSSSSAVSGVSVKD

SEQ ID NO: 68534 - DNA, 1536 bp, Magnaporthe grisea 70-15
  CDS (1)..(1536)
atgcctaccacatgcaccacctacgtacccagattttccccaccttgcccatcgacaactccgcccacgctatactttgccgccgtgccgatcacccacactcacattcacgttcaccagcatccttcgcctctacctctgcgtttattttcaacccgagccggtgtcttgcaaccctcgagacactcccaccgctccccgtgcgcatttttcttctcgttaccccgtttgccgacaatcaataaaacgacttttgcttgccaatccttgtcagcacgcctcttcgaacgccgcagcccacccccgtccgtgaggctcggacccagcgcgccacaggtcatgcaggatttacagggcgccataataccggcggtcgctagggctgccaaagacatgtatcctcccgatgtccaagcaactgctaaagctgccatctcgacagcgttatccgccagtctcatagcgaccacgaccccgaccccgacgatgaccgctgtgactgcaacggcgacgggcagcccacacgacgggcccgagggctcgggagaatgccggctattggggtcttttgccgtcttggtgcagctggcactcggcgccctggccctactcgtgctggtctacaagaggtggagggagcgcccgcaaagaccggtcaagatctggttctttgacgcgtcgaagcaggtcttcggctcggtcttggtgcacggcgccaacgtcttcatgtcaatgttgacgtctggtcgtctttccatcaaggtggatcctgccgcggcggcggctgctaggagatggctgatgcctcggggccatggtgctgatgcagagaaatatgtgccaaatccatgctcattttacctgctcaacttggccatcgacacgacgataggaatacccatcctgatccttctcgtgcgacttacaactattcttgtttcccgtacgccgctgggcaagccatccgagtcgatacagtcgggcttctacggcaatcctcccaagtggcaatggtggctcaagcagagcataatatacttctgcggactgtttggcatgaagatatgtgtcctcataatcttcctagtgttcccctggatcagccacgtcggagactgggcactaggctggactgagggcaacgagaagctgcagattgtgttcgtcatgatgttattcccactcatcatgaacgccatgcaatattatatcatcgacagtttcatcaaagagcgcacacaagatgaagccggagacgcggccgcaaggagacctgggcttgggtctcgagaaagttcatacgaccgcctgagcgaaagtggtgacgatgaccacgaagaagagcttgcggatagaggcagcagcctcggcgaaggcaatcgcgcaaaggggggtatcaaggcgcccccccgcgatcgagaatacgaccctgagattgacggagacgatgagcgtaccgtaataggatccgccagcacatccggaaaccaacagagccaggcactgttgtcaaagggcctcttgccacacgagtag

SEQ ID NO: 68535 - protein, 511 aa, Magnaporthe grisea 70-15
MPTTCTTYVPRFSPPCPSTTPPTLYFAAVPITHTHIHVHQHPSPLPLRLFSTRAGVLQPSRHSHRSPCAFFFSLPRLPTINKTTFACQSLSARLFERRSPPPSVRLGPSAPQVMQDLQGAIIPAVARAAKDMYPPDVQATAKAAISTALSASLIATTTPTPTMTAVTATATGSPHDGPEGSGECRLLGSFAVLVQLALGALALLVLVYKRWRERPQRPVKIWFFDASKQVFGSVLVHGANVFMSMLTSGRLSIKVDPAAAAAARRWLMPRGHGADAEKYVPNPCSFYLLNLAIDTTIGIPILILLVRLTTILVSRTPLGKPSESIQSGFYGNPPKWQWWLKQSIIYFCGLFGMKICVLIIFLVFPWISHVGDWALGWTEGNEKLQIVFVMMLFPLIMNAMQYYIIDSFIKERTQDEAGDAAARRPGLGSRESSYDRLSESGDDDHEEELADRGSSLGEGNRAKGGIKAPPRDREYDPEIDGDDERTVIGSASTSGNQQSQALLSKGLLPHE

SEQ ID NO: 68536 - DNA, 1173 bp, Gibberella zeae PH-1
  CDS (1)..(1173)
atggcttcctcagttattgctacggctacctccatgaccacctctacaaccgcgtcggctacatttgtctcgtctgccccaccaacaccttatagcgaaaatggctccggcggagagtgctcattactgggctcctttgctcttgtcgtacaaggcgcactcggcgctctggcgttgctctctctcgtgtacaaacgatggagagaacgtcctcagcgacctctaaagatctggtttttcgatgtctccaagcaggtctttggttctgtgcttgtgcacatcgccaatatcttcatgtccatgttgacaagcggtcgcttttcggttcaggtcgacccgtcagcagcagccgttactgcgcgttctgatgacgactacgctcccaacccatgctctttctacctcctcaatctcgccatcgatactaccctcggtattcccatccttatcattcttctcaaggttctgactggtctcgtccgttacacgcccgtcggccaacctcccgaatctgtccagtcaggaaactatggtagcccgcccaatgttgtatggtggttgaaacaatccgtcatctacttctgtggtctatttggcatgaaggtttgcgtcctcatcatcttcatcatgatgccctggatctccaaagccggtgactgggcgcttggctggacagaaggcaatgagaagctgcagatcgcgttcgtaatgatgatcttcccactcattatgaacgctctacagtactatattatcgactccttcatcaagctcaaggaaaccgactacgaaaatgtcaatgccgatgaatctgacgaggttcgacgcaggagatatgacgacagcgaggatgagattgcgcgcgccagactggtcgattcggagcacgagactgatagcgagtcggacgacgaggtcgataagcccgccgcgcgttctgggcatccttctcgccaacccaacaccaaaaactctggggaatacgatcctgaacgcgatggtgacgatcggacgatcataggaagcagctcgagtggccggggtccaaaggacaagctaacagcgagatctatgcttaaattgcccgtgggcatctcgccaaatagcgagaacaagaagtacatcattgggttcccaaccaaaaccgacagaggatttggacccgtatcctaa

SEQ ID NO: 68537 - protein, 390 aa, Gibberella zeae PH-1
MASSVIATATSMTTSTTASATFVSSAPPTPYSENGSGGECSLLGSFALVVQGALGALALLSLVYKRWRERPQRPLKIWFFDVSKQVFGSVLVHIANIFMSMLTSGRFSVQVDPSAAAVTARSDDDYAPNPCSFYLLNLAIDTTLGIPILIILLKVLTGLVRYTPVGQPPESVQSGNYGSPPNVVWWLKQSVIYFCGLFGMKVCVLIIFIMMPWISKAGDWALGWTEGNEKLQIAFVMMIFPLIMNALQYYIIDSFIKLKETDYENVNADESDEVRRRRYDDSEDEIARARLVDSEHETDSESDDEVDKPAARSGHPSRQPNTKNSGEYDPERDGDDRTIIGSSSSGRGPKDKLTARSMLKLPVGISPNSENKKYIIGFPTKTDRGFGPVS

SEQ ID NO: 68538 - DNA, 870 bp, Candida glabrata CBS138
  CDS (1)..(870)
atgggaccgatcaaaccaggaatggataactgccagttgttggggcctgcatctttgctagttcagtgcttaatggggatttctgcactagctttgttgctatttaagagaaatcacgagcacccgaggagaaagatggagatatggctgttcgatattggcaagcaaatcatcggtgccttgggtatacattttattaatgttggcataagtgttttaaagagacatcatgaaaaaaaagcatatttatttatcagtataatagggaatctcatagagagcgtgtcttctaccagagaagatgatggttcagatgaacagtgtgactggtatttcttaaatctattactggatactaccgtggggataccaattctctggttggcgattaattgtatcacttatattctgcaatatctcaacatcaaaaacgttgaatcagggaactattttgccgaagaggagaatgatatagaatcacaagagtcagaacagccattaataactgcatttttcaaacagctaggtatttttaccagtagtttgatagttatgaaaatctgtgtatatttagtactcaactattttgaagatttagcatactggtttgctaatttaattttatcctggtcagatagatggcccgatttacaagtcactttggttatgtttgtgttccccataatattgaattgttttcaatatttttgcgtagacaacgttataaaattacattcagatgatgtaaacaactacaattcaaagagttttgaaccagaggaagtaatacaagaagaatacacaaatttgatatcgggagctcagaaaaaagataagaataaacaatcagcttacgaaaccatttcataa

SEQ ID NO: 68539 - protein, 289 aa, Candida glabrata CBS138
MGPIKPGMDNCQLLGPASLLVQCLMGISALALLLFKRNHEHPRRKMEIWLFDIGKQIIGALGIHFINVGISVLKRHHEKKAYLFISIIGNLIESVSSTREDDGSDEQCDWYFLNLLLDTTVGIPILWLAINCITYILQYLNIKNVESGNYFAEEENDIESQESEQPLITAFFKQLGIFTSSLIVMKICVYLVLNYFEDLAYWFANLILSWSDRWPDLQVTLVMFVFPIILNCFQYFCVDNVIKLHSDDVNNYNSKSFEPEEVIQEEYTNLISGAQKKDKNKQSAYETIS

SEQ ID NO: 68540 - DNA, 831 bp, Kluyveromyces lactis NRRL Y-1140
  CDS (1)..(831)
atgcaaaatgacaacgaatgtaagctattaggtccagtttctattgccatacaactgctgatggcctttctgataatatgttcgttattattgaaaagacaatcagagcatcccaagagaacgtgggtagtttggtgctacgatgttggaaaacaaatccttggtgctttgagcatacatttcttgaatgtactgattagtgtgcttaaaggaagtaattcccttgaggatgctattattttcatttttagggccggattgaaattaatgactaaggatggtggatctgactctggggacgaatgtgactggttttttttgaacctattattagataccactgtcggaataccgattctttggtgctgtctcacattttacgagtacatactgacagctataggaattgagaatatcgaaagtggcaattacttctcagaatcagaatctcattcttctacagcgaaacgtgaaccgttgttttcagcatttttgaaacagttgacggttttcatcgttagcttagcttcaatgaaagggtgtttgtttctaatacttctatatttcgaaaatgtcgcagaatggttggccaactgggtgcttggctggtccgatccatggcctaacctgcaagtgtttttggtcatgttcgttttccccttacttctaaattgtttccagtgtttctgcgttgacactattatcaaattgccagcaacgaatattactgctcagaatgtagacaatttcgatcaagaatcgttaattgagagtgatggaatatatgtcacaagaactgtttcgaataaacggtatggaacaatagtatag

SEQ ID NO: 68541 - protein, 276 aa, Kluyveromyces lactis NRRL Y-1140
MQNDNECKLLGPVSIAIQLLMAFLIICSLLLKRQSEHPKRTWVVWCYDVGKQILGALSIHFLNVLISVLKGSNSLEDAIIFIFRAGLKLMTKDGGSDSGDECDWFFLNLLLDTTVGIPILWCCLTFYEYILTAIGIENIESGNYFSESESHSSTAKREPLFSAFLKQLTVFIVSLASMKGCLFLILLYFENVAEWLANWVLGWSDPWPNLQVFLVMFVFPLLLNCFQCFCVDTIIKLPATNITAQNVDNFDQESLIESDGIYVTRTVSNKRYGTIV

SEQ ID NO: 68542 - DNA, 957 bp, Debaryomyces hansenii CBS767
  CDS (1)..(957)
atgaaatcaatacccagcattttgctaacaacattcgtggcgatatctttacaaacaactggcaataggccaaagcaccctgatgatggtgatgatgatggcaaatgtgaactaataggtacattttcacttataacacaagcgtttttgggagtgctttgtttatcttcgttaatagttaaacgattttatgagtatccgttaagaagaacgtggccagtgtggttttttgacgtgatgaagcaattaattggtgcgtttggggttcatgtgttcaatgtatttttgtcgatattgaaatccaagaaagatccaggcgtgaagtgtgctagaaataaggatgaggacgatactggtgatattgatccatgtgattggtatttcttaaatatagtattcgattgtaccataggagttttggtcttatactttgtatttaatgccattaacaggttttgtcgaaactggcttaaaatcacgcagattgaatcaggccaatatgggccaaacctggagaagccatcggttagagcgtttttaaagcaattagctgtgtattttggatcgcttatgatcaccaagatttttttatacggaatagtcgaatgctttgaaactgaattattatggataactagtcacatactattggtgtggctagatgaatatcccgacgaatttgagatattcgtcgttatgttcgttgtaccggtagtgatgaattgtctacaattagtgttggttgataatatcattcaaaaccggattatcgggaaggtcaatggacgaatgcaccatgaatatgcgggtcaatcagaagcagacgaaggtcatatccgagatgaaatcgaagagttcaccagacacggcgaccataggcacaagcgaagccgtaggcaccactctcttcccaacaacgaaggaattaaaacgtacggtacatttaatgacgtctga

SEQ ID NO: 68543 - protein, 318 aa, Debaryomyces hansenii CBS767
MKSIPSILLTTFVAISLQTTGNRPKHPDDGDDDGKCELIGTFSLITQAFLGVLCLSSLIVKRFYEYPLRRTWPVWFFDVMKQLIGAFGVHVFNVFLSILKSKKDPGVKCARNKDEDDTGDIDPCDWYFLNIVFDCTIGVLVLYFVFNAINRFCRNWLKITQIESGQYGPNLEKPSVRAFLKQLAVYFGSLMITKIFLYGIVECFETELLWITSHILLVWLDEYPDEFEIFVVMFVVPVVMNCLQLVLVDNIIQNRIIGKVNGRMHHEYAGQSEADEGHIRDEIEEFTRHGDHRHKRSRRHHSLPNNEGIKTYGTFNDV

SEQ ID NO: 68544 - DNA, 747 bp, Yarrowia lipolytica CLIB122
  CDS (1)..(747)
atgtttggaaaacacccaaagaaccctcccgggtgcaaactgctcggtccgtttgccctgatagttcaggcatcgatgggcgtgttagcggtcctaaccctggttgtgaaacgtcaatatgaagtccctcgccgtccctggtgggtgtggttctttgacgtctcgaaacagctctgtggagcggccggcttgcattttctgaatctcttcctttcgattcttacctcttcgcgcacagacgtgcccgacacgagtgataatccgtgcgactactactttctcaacgtgctaatggacactacggtcggagtgcctgttctatggggcttcctggtgctggtgaccaacattgctgagagacagttcaaggtgacggagattgaatccggagtctacggccaccctccccaatggcgggcattctggaaacaggctgggatttatcttttggccatggttttaatgaaaattgtgcttgccacgtcgttcatcatcttcccctggctggattacatcggcgccttcctactaaagtggactgataacaatcccgatctccaggtggcgtttgtcatgctcatctttcctctcttcatgaatgctctgcaatattatctgatcgacaacattatagagagcaactcgttccgacaggactaccacagtgttcccaacattggcgaggtggatgcccccgagcgaattccccaacagctggcccagagtagttatcataccttcaagtaa

SEQ ID NO: 68545 - protein, 248 aa, Yarrowia lipolytica CLIB122
MFGKHPKNPPGCKLLGPFALIVQASMGVLAVLTLVVKRQYEVPRRPWWVWFFDVSKQLCGAAGLHFLNLFLSILTSSRTDVPDTSDNPCDYYFLNVLMDTTVGVPVLWGFLVLVTNIAERQFKVTEIESGVYGHPPQWRAFWKQAGIYLLAMVLMKIVLATSFIIFPWLDYIGAFLLKWTDNNPDLQVAFVMLIFPLFMNALQYYLIDNIIESNSFRQDYHSVPNIGEVDAPERIPQQLAQSSYHTFK

SEQ ID NO: 68546 - DNA, 1476 bp, Cryptococcus neoformans var. neoformans JEC21
  CDS (1)..(1476)
atgcttccggacaactccacaatcatagacccagtagggccgccgcacacgcccacagacacgcccgcagacccgcagagatgcaagctgctcgggacaacaggcctcgtagtgcaggcactcatgggcatcctcgtcatcgcttctttggtcgttaaaaaacggctcgaaaagaggaaacgttcatggcgtatttggttcctcgacgtcagcaagcaactcgtcgggcaggccgtcgtccatgcgctcaacttattaatatcagatctggtagcgtcagtggggaacagcaatccatgttcattatattttctaaacattctcatcgacaccactattggtgtcggaatcatctttctcagtctcaaattctttacatggctcttttcaagctacctcggttatgacggattcatcagcggtaaatatggaaaccctcctcaagccctcttttggtggaaacaactactcacctacgtattttccatcatcatcatgaaactcctcgtcctcctcccactcacgcttccacgcatctctgaccttcttctccatttgggccactacatgctcgagtacttctctccctccgtgcaggtcattttcgtcatggccatcttccccttgatcatgaacattgtccagttttgtctggtcgaccaggtcatcaaggccggcggtaaagccgacgatgaggaaggccgaatacatgatacaggggatgaagaggaagggtatagcagagtacctgactgggagaatgatttggatggacatggacgcaggagcggagaagggtcaccaagggaaatgacgaagaaggaggaggaggagacgacggcaagagcgaccggtatatccacagccttaccgccatcatcgcctcttctctcacccgctcgttatgacggttatggaagtaccacacctagtcccgtggggagcccaacgaaatctgtcgaggggcagaatatgtggacaaagatgatgagtaagagtaaggatacaggtggcggtagtagtaataatgccagtttgaaggagagacatggggtaaacagtagaaagtctagtaatacatggtgggagtatccggacgacgaagacgaagacggcggaggagggctggaagctcccatacagcgtaatactcgatctcacgccccttcgccagaatcagtatatccagcagaattacctcctccatttgtggtaaacggcagctcggcggctgcttttcgcaagaattcacggacgccgccggaatggggcgcgtcatccacacactcttctcatactgctcgacgattgacatcagaagtcgagcgggaggcaagactgacgttgagcccgccgcggtcgcctagggtagagaatagtagtagtagtggtggtggtggtggtggtggtggtggtggtggtaatgggcggtcggaaagaggggaggaagttggtttggatgtcttacggaggtga

SEQ ID NO: 68547 - protein, 491 aa, Cryptococcus neoformans var. neoformans JEC21
MLPDNSTIIDPVGPPHTPTDTPADPQRCKLLGTTGLVVQALMGILVIASLVVKKRLEKRKRSWRIWFLDVSKQLVGQAVVHALNLLISDLVASVGNSNPCSLYFLNILIDTTIGVGIIFLSLKFFTWLFSSYLGYDGFISGKYGNPPQALFWWKQLLTYVFSIIIMKLLVLLPLTLPRISDLLLHLGHYMLEYFSPSVQVIFVMAIFPLIMNIVQFCLVDQVIKAGGKADDEEGRIHDTGDEEEGYSRVPDWENDLDGHGRRSGEGSPREMTKKEEEETTARATGISTALPPSSPLLSPARYDGYGSTTPSPVGSPTKSVEGQNMWTKMMSKSKDTGGGSSNNASLKERHGVNSRKSSNTWWEYPDDEDEDGGGGLEAPIQRNTRSHAPSPESVYPAELPPPFVVNGSSAAAFRKNSRTPPEWGASSTHSSHTARRLTSEVEREARLTLSPPRSPRVENSSSSGGGGGGGGGGGNGRSERGEEVGLDVLRR

SEQ ID NO: 68548 - DNA, 1284 bp, Bos taurus
  CDS (1)..(1284)
atgtgtctccccagttttccatttctcaccacccccaaaccgaaaccagaagtgcagtggaaccatttctggagggtgaaagttcaggccaagatgttggccagcttcgtttctcctgaggcctctctccttggcttgaaggtggccgtcttctcaccgtgtcctctcacggtcacctgtcagtctactgggggctggctgtatttatttagagaagtagggcttattgattcggcaccggtttctccctcgctgcctccttcctcttcgtgcatcctcattgcagtttgggactctgccagaagtcgattcttgcctgctaccatcgtgtctatttcttcctcagtactttgtataggaaaatcccacacacatggcacttgcattgtttgttttagtagagtcattgtggaaatagtctgcctgaggcttcagcggaggacaggacacttagaacatttttgcttccgtctgtataagcggttgtgtttgcagacccgcctgaggtcaagatgtcagtctggggagccctttgtcatccatcgtggtcaggctgttgtcaaacgcttcagagaaccaaagcatgaaagacgaccatggaggatatggtttttagacacttccaaacaagccataggaatgctgttcatccattttgcaaatgtatacctagcagatctcaacgaagaggacccttgttcactgtacctcatcaacttcctcctggatgccaccgtgggcatgctcctcatctacgtgggtgtgcgcgccgtcagcgtcctggtggaatggcagcagtgggagtccctgcgttttggcgaatacggagaccctctgcagtgtggagcctgggttggacaatgtgccctttacatcgtgatcatgatttttgaaaaatctgtcgttttcatcgtcctcctaatacttcagtggaagaaggtggccctgttgaatcccattgaaaacccagacttgaagctggccatcgtcatgctgatcgtccccttctttgtcaatgctctgatgttttgggtagtggacaatttcctcatgagaaagggaaggacgaaagctaagctagaagaaagaggagccaaccaggactcaaggaacgggagcaaggtccgctaccgaagggccgcgtcccatgaggagtcagagtctgagatcctgatctcagccgatgacgagatggaggagtcggacgtggaggaggacctccggagactgacgcccctgaagcctgtgaagaaaaagaagcaccgcttcgggctgcctgtatga

SEQ ID NO: 68549 - protein, 427 aa, Bos taurus
MCLPSFPFLTTPKPKPEVQWNHFWRVKVQAKMLASFVSPEASLLGLKVAVFSPCPLTVTCQSTGGWLYLFREVGLIDSAPVSPSLPPSSSCILIAVWDSARSRFLPATIVSISSSVLCIGKSHTHGTCIVCFSRVIVEIVCLRLQRRTGHLEHFCFRLYKRLCLQTRLRSRCQSGEPFVIHRGQAVVKRFREPKHERRPWRIWFLDTSKQAIGMLFIHFANVYLADLNEEDPCSLYLINFLLDATVGMLLIYVGVRAVSVLVEWQQWESLRFGEYGDPLQCGAWVGQCALYIVIMIFEKSVVFIVLLILQWKKVALLNPIENPDLKLAIVMLIVPFFVNALMFWVVDNFLMRKGRTKAKLEERGANQDSRNGSKVRYRRAASHEESESEILISADDEMEESDVEEDLRRLTPLKPVKKKKHRFGLPV

SEQ ID NO: 68550 - DNA, 1113 bp, Aspergillus nidulans FGSC A4
  CDS (1)..(1113)
atggcttatgcatccatcccgttgttttctgcggcgatcctcgtatccgccctcgacatcggggtaaatgctctggtctctccgaccggcgtcattacaacaccatcaccatctttgtcaacaccggccgcatcgtactccccaacgagttccagttcttccggacatgacgaagacaatggagaatgccggctacttgggccgttttcgctcgtcgtgcaggccgccctgggaatgctcgcgttattgtcgcttgtctacaagcgatggagagaacgccctcaacgcccggtgaaggtctgggcgttcgatgcctcgaagcaagttttcggttcatctatgctacatctctttaaccttttgatgtccatgttctctgccggacagtttgagatcacaagcaaatacaagccaaacccatgctcgttttacttgctaaatcttggcatcgataccaccctaggtatccctatcttgatcgttatactccatgtcttgaaccgcttggcgaaatacacccccctcgcaaatcctccggaatcgatcgaatctgggaattatgacgatcccccccgtgtcagctggtggtttaagcaatccatgatctactttctgggtcttctgggaatgaaaatttgtgtcttcttcctcatccagatggtgccgcttatcgttaaggtaggcgactgggctttgcgatggactgaaggcaacaccgccatccagatcatcttcgtgatgctcatcttccccgtcataatgaatgctattcagtattatattatcgatattttcataaagaagccactctccgtgtctcacgacctcgagagtgccgataccgcaagcgacaacgacgccgacgaccggcatgcattgctggccggattggaggatgatgatacatttgaccgtgatgggtcgctaggaagtgacgaaagaacgttacatagccccgtgcagtttaaggaagctctggaccatctgaatgctgctaaaagagatccggtgggttctctggactctgcatcaacgccaacctccagtagcgcacgcgaaaacgatgacacgactttgtctacagaaatcaatgtgcaaccgaaagatatgtaa

SEQ ID NO: 68551 - protein, 370 aa, Aspergillus nidulans FGSC A4
MAYASIPLFSAAILVSALDIGVNALVSPTGVITTPSPSLSTPAASYSPTSSSSSGHDEDNGECRLLGPFSLVVQAALGMLALLSLVYKRWRERPQRPVKVWAFDASKQVFGSSMLHLFNLLMSMFSAGQFEITSKYKPNPCSFYLLNLGIDTTLGIPILIVILHVLNRLAKYTPLANPPESIESGNYDDPPRVSWWFKQSMIYFLGLLGMKICVFFLIQMVPLIVKVGDWALRWTEGNTAIQIIFVMLIFPVIMNAIQYYIIDIFIKKPLSVSHDLESADTASDNDADDRHALLAGLEDDDTFDRDGSLGSDERTLHSPVQFKEALDHLNAAKRDPVGSLDSASTPTSSSARENDDTTLSTEINVQPKDM

SEQ ID NO: 68552 - DNA, 678 bp, Danio rerio
  CDS (1)..(678)
atgtttgtttttgtgaaagacagcattaatatgactgatttggtgagcccggagtatcagggctgcgtggacggagctctgatggacggattcagtgtttttatacaggctctgttggcggttctggctttcagcactttaatgttgaagaggtttcgtgaacctgttggaataagaagaccttggaagatctggttctttgacacttctaaacaagcggtcggggctcttttcatgcattttgccaacatattcctttccacactcaccaatgaagatccctgctctctatatttgctgaacttcttgttggatgccacattgggaatgcttgtgatctgggtgggagtgaaagttgtttccaaaatagtggaacataaacagataacactgctaatgttcggagaatatggtgatcctcctcgagtcttggcatgggtggctcagtgttcagtgtatttactcatcgttgctctggagaaaagtgtggtctctctggtgctgctcattcctggatggaccaatacctggctgcccgaattgctgggtattgaaactaaacacggcactatcaaaatggattgggctcatagaacccttggtccgctcaagcccaagcgaacacgccctgtggtgatgaagctactcagacaaggccaaaacactagcagctgctaa

SEQ ID NO: 68553 - protein, 225 aa, Danio rerio
MFVFVKDSINMTDLVSPEYQGCVDGALMDGFSVFIQALLAVLAFSTLMLKRFREPVGIRRPWKIWFFDTSKQAVGALFMHFANIFLSTLTNEDPCSLYLLNFLLDATLGMLVIWVGVKVVSKIVEHKQITLLMFGEYGDPPRVLAWVAQCSVYLLIVALEKSVVSLVLLIPGWTNTWLPELLGIETKHGTIKMDWAHRTLGPLKPKRTRPVVMKLLRQGQNTSSC

SEQ ID NO: 68554 - DNA, 1023 bp, Candida albicans SC5314
  CDS (1)..(1023): transl_table=12
atgggttgtggagaactactatctgttccacttgtatttttatcattattttctcatgaaaatgtccctgttttaaacactggcacaacagatgatgatgggaaatgtgaattaattgggacattttcgttaatgactcaagccatattaggaatgttatgtctttcttcattattaattaaaagattttatgaatatcccatacgacgaacttggccagtttggatatttgatgtatcaaaacaattgattggagcattaggagttcatatatttaatgtgattttatcaatggttaaaactgcccctgagatttggtcaacccagaacaacaacaacagtagcgatcctgatgatgataacacgaaagatccttgtgattggtattttttgaatattgttcttgattgtactattggagtatatatcttatatcatgtatttaaaaccatgaataaaatatgtcgagattattggcatattacacagattgaaagtggtgaatatggaccaaatcccaataaaccatcaaccaaagcattcctcaagcaattaattgtttatttcacttctttgatgattacaaaaattatattatatggattagttgaatgttttgaaacgcaattattatggtttacatctcatgtattattaatttggttaaatgaataccctgatgaatttgaaatttttatcgtgatgtttattgtcccaataattatgaattgtttacaattaatacttattgataattttattagaaatcaaatgtggattaacattaataaacgaatgagaatagaatttcctaattttagtgatgaaacagaaagtgttcaacaacaagatattatccaagcacaaagagaagaggaagaggaagaagaacaaaggaaataccttttaatgaatgatagtactgaaggtggtaacaacaatcatagtagcagtagtagtaatgatactttactaggagaatctcacaataaaaacaattatggctcttataatgatgtatag

SEQ ID NO: 68555 - protein, 340 aa, Candida albicans SC5314
MGCGELLSVPLVFLSLFSHENVPVLNTGTTDDDGKCELIGTFSLMTQAILGMLCLSSLLIKRFYEYPIRRTWPVWIFDVSKQLIGALGVHIFNVILSMVKTAPEIWSTQNNNNSSDPDDDNTKDPCDWYFLNIVLDCTIGVYILYHVFKTMNKICRDYWHITQIESGEYGPNPNKPSTKAFLKQLIVYFTSLMITKIILYGLVECFETQLLWFTSHVLLIWLNEYPDEFEIFIVMFIVPIIMNCLQLILIDNFIRNQMWININKRMRIEFPNFSDETESVQQQDIIQAQREEEEEEEQRKYLLMNDSTEGGNNNHSSSSSNDTLLGESHNKNNYGSYNDV

SEQ ID NO: 68556 - DNA, 1023 bp, Candida albicans SC5314
  CDS (1)..(1023): transl_table=12
atgggttgtggagaactactatctgttccacttgtatttttatcattattttctcatgaaaatgtccctgttttaaacactggcacaacagatgatgatgggaaatgtgaattaattgggacattttcgttaatgactcaagccatattaggaatgttatgtctttcttcattattaattaaaagattttatgaatatcccatacgacgaacttggccagtttggatatttgatgtatcaaaacaattgattggagcattaggagttcatatatttaatgtgattttatcaatggttaaaactgccccagagatttggttaacccagaacaacaacaacagtagcgatcctgatgatgataacacgaaagatccttgtgattggtattttttgaatattgttcttgattgtactattggagtatatatcttatatcatgtatttaaaaccatgaataaaatatgtcgagattattggcatattacacagattgaaagtggtgaatatggaccaaatcccaataaaccatcaaccaaagcattcctcaagcaattaattgtttatttcacttctttgatgattacaaaaattatattatatggattagttgaatgttttgaaacgcaattattatggtttacatctcatgtattattaatttggttaaatgaataccctgatgaatttgaaatttttatcgtgatgtttattgtcccaataattatgaattgtttacaattaatacttattgataattttattagaaatcaaatgtggattaacattaataaacgaatgagaatagaatttcctaattttagtgatgaaacagaaagtgttcaacaacaagatattatccaagcacaaagagaagaggaagaggaagaagaacaaaggaaataccttttaatgaatgatagtactgaaggtggtaacaacaatcatagtagcagtagtagtaatgatactttactaggagaatctcacaataaaaacaattatggctcttataatgatgtatag

SEQ ID NO: 68557 - protein, 340 aa, Candida albicans SC5314
MGCGELLSVPLVFLSLFSHENVPVLNTGTTDDDGKCELIGTFSLMTQAILGMLCLSSLLIKRFYEYPIRRTWPVWIFDVSKQLIGALGVHIFNVILSMVKTAPEIWLTQNNNNSSDPDDDNTKDPCDWYFLNIVLDCTIGVYILYHVFKTMNKICRDYWHITQIESGEYGPNPNKPSTKAFLKQLIVYFTSLMITKIILYGLVECFETQLLWFTSHVLLIWLNEYPDEFEIFIVMFIVPIIMNCLQLILIDNFIRNQMWININKRMRIEFPNFSDETESVQQQDIIQAQREEEEEEEQRKYLLMNDSTEGGNNNHSSSSSNDTLLGESHNKNNYGSYNDV

SEQ ID NO: 68558 - DNA, 1110 bp, Aspergillus fumigatus Af293
  CDS (1)..(1110)
atgtctctcccgtctatgacttcactggcggcggcggctacagccatcgcagtaatgagcagtagcgtcccaacatcatcacccacaccttcaatacctagaccttcttccatggccggtccgcatcatgatcctgatggggaagataatggagaatgcaggctgttgggtcccttttcgattctcgtccaagcggctctcggatccctggcgctgttgtccttagtatacaaacgctggagggagagaccccagcggcctgtgaaggtgtgggcatttgatgtatcaaaacaagtctttgggtcggcaatgctacatcttgcgaatctactcatgtccatgttctcagccggccagttcgaaatcacgagcaaatacagaccgaatccatgctctttctatctattaaatttggggattgatactacactcggaatccccattctcatcttcatcctccacattctaaaccgcctagcggcatatactccccttgcgaatcccccggaatcaatagagtctggaaactatggcgcgccaccacgggccgcctggtggttcaagcaggctatgatatacttcttcgggcttttgggaatgaaaatatgcgtcttctttctcatccaactactgccattcatagtcaagataggtgactgggctctgcgctggacggaagggaacacagctctgcagatcatcttcgtcatgctgcttttcccagtgatcatgaacgcgatccagtactacatcatcgatactttcatcaaaagaccgctatctcgaactcacgagctgctccaggaagacgatgaagtagaagatgctttgttggatgacggtcggacaccgcacaatgcactgctgtctagcgctgaggatgctgatacatttgggccggatgaaggtattataggaaaggatttgggcaaaactcttgaaccgcctgcagggccgaacggttttcgtcatgtcgagtacgatccagcagttgatggagagtatttctccccggcgtcatcaacgtctgccagctccagcagcagtcatggcgaatatgatgcaatgtcatcttcgacaaagcttacacctcagaacaagagaccatga

SEQ ID NO: 68559 - protein, 369 aa, Aspergillus fumigatus Af293
MSLPSMTSLAAAATAIAVMSSSVPTSSPTPSIPRPSSMAGPHHDPDGEDNGECRLLGPFSILVQAALGSLALLSLVYKRWRERPQRPVKVWAFDVSKQVFGSAMLHLANLLMSMFSAGQFEITSKYRPNPCSFYLLNLGIDTTLGIPILIFILHILNRLAAYTPLANPPESIESGNYGAPPRAAWWFKQAMIYFFGLLGMKICVFFLIQLLPFIVKIGDWALRWTEGNTALQIIFVMLLFPVIMNAIQYYIIDTFIKRPLSRTHELLQEDDEVEDALLDDGRTPHNALLSSAEDADTFGPDEGIIGKDLGKTLEPPAGPNGFRHVEYDPAVDGEYFSPASSTSASSSSSHGEYDAMSSSTKLTPQNKRP

SEQ ID NO: 68560 - DNA, 1326 bp, Ustilago maydis 521
  CDS (1)..(1326)
atgagcgcctccgacactggcttcgtcggtatggtcggtgtcgtacgtgacatgatgccgccaactgcatccatagcggctttggcgtccgacccgaccttgacccccacgcctacgccgatcatcggcgctccggaagtggacggagacaactgcaaacttatgggtccctttgcgctgttcgtacaggccgtcatgggcatcctcgtcataggctctctcgtttacaaacgacagagagaaaagccgaaacgcaaatggaaaatctgggcgctcgacgtttctaagcagatgctcggccaactctttgttcacatcctcaatatcgtcctttcggactttgttgccagcggaggaggtgaaaacccttgctcgctctactttctcaacatcctcgtcgataccactttgggcgtattcttcatctacatcgccttgaagtacgtcacgtatttcctcaccgaacgactcggcttggagggcttcatatccggtcaatacactccaccgctacctagcattgttcctgcatcatccaccggtcccagcacatcggcgcagtccggttcttcgcgcagggcattccgcagaggcagacccaggatcgagtactggttgaagcagctggcttcgtacctttttgtgctcttcctcatgaagatggcggtgcttgttgtctttggcttctttccattcctctttgacgtgggctcatggatcttgggcttctttggtagcaacaaggacttccaagtgctgttctcgatggccttattcccgctcgctatgaacgtattgcagttctggctcatcgattccctcctccgccacaatccttacacatcggcttactccaagatcaatccggacgaccaagaatttctcaacagctctgatagtatctctcacgagtctcgccaacctgccgaggatgtcggcggtcgcacacattcaataggggaagatagcgacgacgaaacaaacgacctagataaacagcacattcaaccgtacgcttctggcccaggccgatccagacgaaggccttccccacagaggtctgtcacctcggatcagccttacgactatcctccaccgacagatttgtacggctcagtgcacaagtcgcctcctctgaggccctctagacctacggacgacatgcgacgccaagctagcctgacgctttcggatgctggctcggatacagaatcgggtagtcagagcatacaccagactctgtttaatagcaaagcctctctacaaccgtctgagacgcaccatctcaaacaggtcagcagagacggcagcagcagcagcagctga

SEQ ID NO: 68561 - protein, 441 aa, Ustilago maydis 521
MSASDTGFVGMVGVVRDMMPPTASIAALASDPTLTPTPTPIIGAPEVDGDNCKLMGPFALFVQAVMGILVIGSLVYKRQREKPKRKWKIWALDVSKQMLGQLFVHILNIVLSDFVASGGGENPCSLYFLNILVDTTLGVFFIYIALKYVTYFLTERLGLEGFISGQYTPPLPSIVPASSTGPSTSAQSGSSRRAFRRGRPRIEYWLKQLASYLFVLFLMKMAVLVVFGFFPFLFDVGSWILGFFGSNKDFQVLFSMALFPLAMNVLQFWLIDSLLRHNPYTSAYSKINPDDQEFLNSSDSISHESRQPAEDVGGRTHSIGEDSDDETNDLDKQHIQPYASGPGRSRRRPSPQRSVTSDQPYDYPPPTDLYGSVHKSPPLRPSRPTDDMRRQASLTLSDAGSDTESGSQSIHQTLFNSKASLQPSETHHLKQVSRDGSSSSS

SEQ ID NO: 68562 - DNA, 861 bp, Strongylocentrotus purpuratus
  CDS (1)..(861)
atggcaatgcccacaaatgaatcgtccactgaccactgcaaaccggaaaatttcacagatcgttttggaatgctcgagcaagggattcttgcatttcttgccttcagttttttgatacttaagagactaagagaacccaaggatgagagaaggccttggaagatttggtttttcgatacctccaaacaggctcttggtgctggcctgatccatgtcttcaacattctattgtcaatgatttccgtgagaggagatgcctgtacttggtatgtcatatacttcttactggactccaccgccgggctcttgttcatctacctacaagtgagaatcgcccagaggatctttataaggtgtgcatgcaaggcactgatgtttggagagtacggggaccctcccaaatgggatgcttggatcggacagtgtggtgtcttcatcatcatcgtcatcatagaaaagattggcatcactctacttacgtttattccattctggacaaaggtcgctgaaatcttactgagtcctatacataatcctaaagtagagttgacattggtgatgctcatcataccattcattgtgaacacaattatgttctgggtgattgataacctcttgatgggaaagaggtcaaagttgaaaggtcacgacaaggagagtcggggcttgaacgggaaagaccggaagcagagagtgcattactaccgcagcgtgccaggaaagtcgtcggacggatcagagtcagaggttctggtctcatgtgatgatgacgacaccaaggcatcgaacgggtcgctattggtcagagagccagaagaggagaggttgagtgggaagagaataaaagaaaattatttatag

SEQ ID NO: 68563 - protein, 286 aa, Strongylocentrotus purpuratus
MAMPTNESSTDHCKPENFTDRFGMLEQGILAFLAFSFLILKRLREPKDERRPWKIWFFDTSKQALGAGLIHVFNILLSMISVRGDACTWYVIYFLLDSTAGLLFIYLQVRIAQRIFIRCACKALMFGEYGDPPKWDAWIGQCGVFIIIVIIEKIGITLLTFIPFWTKVAEILLSPIHNPKVELTLVMLIIPFIVNTIMFWVIDNLLMGKRSKLKGHDKESRGLNGKDRKQRVHYYRSVPGKSSDGSESEVLVSCDDDDTKASNGSLLVREPEEERLSGKRIKENYL

SEQ ID NO: 68564 - DNA, 876 bp, Canis familiaris
  CDS (1)..(876)
atgcgaatcgcagcaacccctggagaggtggtcaccctggccatgaggctgaggagatctgacctcatgcccatactcctgctgctcaaaggcccagcccctccacctgagagctcttccaccgactcctgtgactctcccctccctttcctcaagcgcttcagagaaccaaagcatgagagacggccgtggaggatatggtttttagacacttccaaacaagccataggaatgctgttcatccactttgcaaatgtgtacctagcagatcttactgaagaggacccttgctcactgtacctcatcaacttcctcctggatgccaccgtgggcatgctgctcatctacgtgggtgtgcgtgctgtcagtgtcttggtggagtggcagcagtgggagtccctgcgctttggcgaatatggagaccctctgcagtgcggagcctgggttgggcagtgtgctctttacatcgtgatcatgatttttgaaaagtctgtcgtcttcatcgtcctccttatacttcagtggaaaaaggtggccctattgaatcccattgaaaacccagacctgaaactggccatcgtcatgctgatcgtccccttctttgtcaatgctttgatgttttgggtagtggataatttcctcatgagaaaagggaggacgaaagctaaactagaagaaaggggagccaaccaggactcgaggaatgggagcaaagtccgctatcgaagggctgcatcccacgaggagtcagagtctgagatcctgatctcagccgatgacgagatggaggagtccgatgtggaggaggacctgcgcagactgacccctctgaagcctgcgaagaaaaagaaacaccgttttgggctgcccgtatga

SEQ ID NO: 68565 - protein, 291 aa, Canis familiaris
MRIAATPGEVVTLAMRLRRSDLMPILLLLKGPAPPPESSSTDSCDSPLPFLKRFREPKHERRPWRIWFLDTSKQAIGMLFIHFANVYLADLTEEDPCSLYLINFLLDATVGMLLIYVGVRAVSVLVEWQQWESLRFGEYGDPLQCGAWVGQCALYIVIMIFEKSVVFIVLLILQWKKVALLNPIENPDLKLAIVMLIVPFFVNALMFWVVDNFLMRKGRTKAKLEERGANQDSRNGSKVRYRRAASHEESESEILISADDEMEESDVEEDLRRLTPLKPAKKKKHRFGLPV

SEQ ID NO: 68566 - DNA, 867 bp, Mus musculus
  CDS (1)..(867)
atgcaaggcccgggagggaacgtgagccgcggattgccgagcgggccggcctccacggtcgcgtccggggcgggccgctgtgagagcggcgcgctcatgcacagtttcggcatcttcctgcaggggctgctcggcgtcgtggccttcagcacattgatgcttaaacgcttcagagaaccaaagcatgaaagacggccgtggaggatatggtttttagacacttccaaacaagccatagggatgctcttcatccactttgcaaatgtgtacctagcagatctcactgaagaggacccttgttcactgtacctcatcaactttcttctggacgccactgtaggcatgctgctcatttatgtgggcgtacgcgccgtcggtgtcttggtggagtggcagcagtgggaatccctgcgttttggagaatatggagaccctctgcagtgcggggcctgggtagggcagtgcgccctctacatcgtgatcatgatctttgaaaagtccgtggtcttcatcgtcctcctcatactccagtggaaaaaggtggccctattgaatccaattgaaaaccccgacctgaagctggccatcgtcatgctgatagtccccttctttgtcaatgctttcatgttctgggtagtggacaatttcctcatgagaaaggggaagacgaaagctaaactagaaggaagaggagccaaccaggactcaaggaatgggagcaaggttcgctaccgaagggcagcatcccatgaggagtctgagtctgagatcctgatctcagctgacgacgagatggaggagtctgacgccgaggaggacctccggagacctgtgaaaaagaagcaccgcttcgggctgcctgtatga

SEQ ID NO: 68567 - protein, 288 aa, Mus musculus
MQGPGGNVSRGLPSGPASTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVGVLVEWQQWESLRFGEYGDPLQCGAWVGQCALYIVIMIFEKSVVFIVLLILQWKKVALLNPIENPDLKLAIVMLIVPFFVNAFMFWVVDNFLMRKGKTKAKLEGRGANQDSRNGSKVRYRRAASHEESESEILISADDEMEESDAEEDLRRPVKKKHRFGLPV

SEQ ID NO: 68568 - DNA, 867 bp, Mus musculus
  CDS (1)..(867)
atgcaaggcccgggagggaacgtgagccgcggattgccgagcgggccggcctccacggtggcgtccggggcgggccgctgtgagagcggcgcgctcatgcacagtttcggcatcttcctgcaggggctgctcggcgtcgtggccttcagcacattgatgcttaaacgcttcagagaaccaaagcatgaaagacggccgtggaggatatggtttttagacacttccaaacaagccatagggatgctcttcatccactttgcaaatgtgtacctagcagatctcactgaagaggacccttgttcactgtacctcatcaactttcttctggacgccactgtaggcatgctgctcatttatgtgggcgtacgcgccgtcggtgtcttggtggagtggcagcagtgggaatccctgcgttttggagaatatggagaccctctgcagtgcggggcctgggtaggacagtgcgccctctacatcgtgatcatgatctttgaaaagtccgtggtcttcatcgtcctcctcatactccagtggaaaaaggtggccctattgaatccaattgaaaaccccgacctgaagctggccatcgtcatgctgatagtccccttctttgtcaatgctttcatgttctgggtagtggacaatttcctcatgagaaaggggaagacgaaagctaaactagaagaaagaggagccaaccaggactcaaggaatgggagcaaggttcgctaccgaagggcagcatcccatgaggagtctgagtctgagatcctgatctcagctgacgacgagatggaggagtctgacgccgaggaggacctccggagacctgtgaaaaagaagcaccgcttcgggctgcctgtatga

SEQ ID NO: 68569 - protein, 288 aa, Mus musculus
MQGPGGNVSRGLPSGPASTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVGVLVEWQQWESLRFGEYGDPLQCGAWVGQCALYIVIMIFEKSVVFIVLLILQWKKVALLNPIENPDLKLAIVMLIVPFFVNAFMFWVVDNFLMRKGKTKAKLEERGANQDSRNGSKVRYRRAASHEESESEILISADDEMEESDAEEDLRRPVKKKHRFGLPV

SEQ ID NO: 68570 - DNA, 720 bp, Tetraodon nigroviridis
  CDS (1)..(720)
atggacgcgtaccgcaggctcctcgcggagacgaggctcgtgggcaggggtgttttggaggggaccaacatgtcggaggtcagcaaggccgaccctcacggctgcgataacggagctctgaccgacaggttcggggtgctgatccagggtctgctggccgtcgtcgccttcagcactctcatggtgaagaggttccgagagccggcagatatccgacgaccctggaggatctggttctttgacacgtccaaacaggccattggctccctcttcatccactttgccaacatcttcctctccacgctcaccaaagaggacccgtgctccctgtacctgatgaactttctgttggacgccaccctggggatgctggtcatctgggtggctgtgaaactggtgtccaaactggtggagcacaaacagtggagcctcctcgtgtttggggaatacggcgaccccccgcaggcggccgcctggctgggccagtgcggcgtctacctgctcatcatggtgctggagaaaggtgtgatcagcctgacgctgctggtccccggctggtccaaactgcaggaggtgttgctaagctacatcgctaaccctcagctggagctggcgctggtcatgctcatcgtgcccttcatcgtcaactccatcatgttctgggtggtcgacagtctgacgatgaggaagaacaagatgacgaagagcttggatgattag

SEQ ID NO: 68571 - protein, 239 aa, Tetraodon nigroviridis
MDAYRRLLAETRLVGRGVLEGTNMSEVSKADPHGCDNGALTDRFGVLIQGLLAVVAFSTLMVKRFREPADIRRPWRIWFFDTSKQAIGSLFIHFANIFLSTLTKEDPCSLYLMNFLLDATLGMLVIWVAVKLVSKLVEHKQWSLLVFGEYGDPPQAAAWLGQCGVYLLIMVLEKGVISLTLLVPGWSKLQEVLLSYIANPQLELALVMLIVPFIVNSIMFWVVDSLTMRKNKMTKSLDD

SEQ ID NO: 68572 - DNA, 837 bp, Brachydanio rerio
  CDS (1)..(837)
atgtttgtttttgtgaaagacagcattaatatgactgatttggtgagcccggagtatcagggctgcgtggacggagctctgatggacggattcagtgtttttatacaggctctgttggcggttctggctttcagcactttaatgttgaagaggtttcgtgaacctgttggaataagaagaccttggaagatctggttctttgacacttctaaacaagcggtcggggctcttttcatgcattttgccaacatattcctttccacactcaccaatgaagatccctgctctctatatttgctgaacttcttgttggatgccacattgggaatgcttgtgatctgggtgggagtgaaagttgtttccaaaatagtggaacataaacagataacactgctaatgttcggagaatatggtgatcctcctcgagtcttggcatgggtggctcagtgttcagtgtatttactcatcgttgctctggagaaaagtgtggtctctctggtgctgctcattcctggatggaccaatttggaggaggtggtgctggattacatcccaaacccacagctggagctggccatcgtcatgcttatcgtgcctttcatagtcaactctataatgttctgggtggtggacagtttaacaatgcgcaaatataagaagatgacgtctctggaaggctcacgcgactctccgaaacaagtagacgctttgccagatgagagcaatgatgaagctgaggtgctgctaaagaaagatgatgaagcagcggtgtgttctgaagaggaagatcacgtcacaacagaagaagccttaatacgagtcagcatggaggtttaa

SEQ ID NO: 68573 - protein, 278 aa, Brachydanio rerio
MFVFVKDSINMTDLVSPEYQGCVDGALMDGFSVFIQALLAVLAFSTLMLKRFREPVGIRRPWKIWFFDTSKQAVGALFMHFANIFLSTLTNEDPCSLYLLNFLLDATLGMLVIWVGVKVVSKIVEHKQITLLMFGEYGDPPRVLAWVAQCSVYLLIVALEKSVVSLVLLIPGWTNLEEVVLDYIPNPQLELAIVMLIVPFIVNSIMFWVVDSLTMRKYKKMTSLEGSRDSPKQVDALPDESNDEAEVLLKKDDEAAVCSEEEDHVTTEEALIRVSMEV

SEQ ID NO: 68574 - DNA, 621 bp, Xenopus laevis
  CDS (1)..(621)
atggggacgagcaatggcagcaagagcctgaccccggggccgtcccctcccgaccccagccccactgctccgggctgtggcaacggggcaatgatgggctctttcgggatcttcttgcaaggcctgctggctgtgatggctttcagcatcctcatgttaaaacgccttcgagaaccaaagcatgaaagacgtccttggaaaatctggttcttggacacatccaagcaagctatagggatgctgtttatccattttgcaaatgtctacttgtcggaccttactggggaagacccttgctctatatatcttattaactttctcctggacgctacattggggatgttgcttatctatattggtgttcgagtggtgagttgcatcgtggagtggaggcagtgggagtccctgcgattcggcgaatatggtgatcctgtgcagtgcaaagcctgggttgggcagtgtgccctctacattgtcattatgatgttcgagaaaacagccatcgtccttgtcttgctcatcccgcatctcaaagaggttgccaaggtaaaacctataaaaaatcctcaactggagcttgcaactgtcatgctgattgttccatttttgttaatgcattaa

SEQ ID NO: 68575 - protein, 206 aa, Xenopus laevis
MGTSNGSKSLTPGPSPPDPSPTAPGCGNGAMMGSFGIFLQGLLAVMAFSILMLKRLREPKHERRPWKIWFLDTSKQAIGMLFIHFANVYLSDLTGEDPCSIYLINFLLDATLGMLLIYIGVRVVSCIVEWRQWESLRFGEYGDPVQCKAWVGQCALYIVIMMFEKTAIVLVLLIPHLKEVAKVKPIKNPQLELATVMLIVPFLLMH

SEQ ID NO: 68576 - DNA, 744 bp, Xenopus laevis
  CDS (1)..(744)
atgactgatataataagatctgctccccagggctgcaataatggggcgctcatggatcactttggtgtccttatccaaggagtgttggcagtggtggcattcagcacattaatgttaaagcgttgtagggaaccaaaagaagaaagacgtccatggaaaatttggttttatgatacttccaaacaagctatcggtgctctgttcattcattttacaaacgtctttctctcagacttgactgaaaaggacccctgctcattataccttatgaattttctacttgatgctacacttggcatgttggtcatctggatttgtgtgaaaattgtgtctgtgatcgtagaaaggcgacagtccacactcctagtgtttggggaatatggggatcctccacaagctgcggcctggctggggcaatgtgtactctatctagtaataatggtcgtggagaaaaccgtaataactcttgttctgctcttcccaggatggacaaagcttcaggcgattttattgaactacattccaaacccacagctggagcttgtccttgtaatgctggtggtaccatttatagtcaatgctataatgttctgggtggttgacagtttaataatgaggaagtacaagaaaatgaaaagggacaaaagtttagaaaccacttcaagctcaaacagtcctacgtatgatgatgaatcacaggtattgcttggttctgcatctgaccattaccgctcttatgagtaa

SEQ ID NO: 68577 - protein, 247 aa, Xenopus laevis
MTDIIRSAPQGCNNGALMDHFGVLIQGVLAVVAFSTLMLKRCREPKEERRPWKIWFYDTSKQAIGALFIHFTNVFLSDLTEKDPCSLYLMNFLLDATLGMLVIWICVKIVSVIVERRQSTLLVFGEYGDPPQAAAWLGQCVLYLVIMVVEKTVITLVLLFPGWTKLQAILLNYIPNPQLELVLVMLVVPFIVNAIMFWVVDSLIMRKYKKMKRDKSLETTSSSNSPTYDDESQVLLGSASDHYRSYE

SEQ ID NO: 68578 - DNA, 867 bp, Mus musculus
  CDS (1)..(867)
atgcaaggcccgggagggaacgtgagccgcggattgccgagcgggccggcctccacggtcgcgtccggggcgggccgctgtgagagcggcgcgctcatgcacagtttcggcatcttcctgcaggggctgctcggcgtcgtggccttcagcacattgatgcttaaacgcttcagagaaccaaagcatgaaagacggccgtggaggatatggtttttagacacttccaaacaagccatagggatgctcttcatccactttgcaaatgtgtacctagcagatctcactgaagaggacccttgttcactgtacctcatcaactttcttctggacgccactgtaggcatgctgctcatttatgtgggcgtacgcgccgtcggtgtcttggtggagtggcagcagtgggaatccctgcgttttggagaatatggagaccctctgcagtgcggggcctgggtaggacagtgcgccctctacatcgtgatcatgatctttgaaaagtccgtggtcttcatcgtcctcctcatactccagtggaaaaaggtggccctattgaatccaattgaaaaccccgacctgaagctggccatcgtcatgctgatagtccccttctttgtcaatgctttcatgttctgggtagtggacaatttcctcatgagaaaggggaagacgaaagctaaactagaagaaagaggagccaaccaggactcaaggaatgggagcaaggttcgctaccgaagggcagcatcccatgaggagtctgagtctgagatcctgatctcagctgactacgagatggaggagtctgacgccgaggaggacctccggagacctgtgaaaaagaagcaccgcttcgggctgcctgtatga

SEQ ID NO: 68579 - protein, 288 aa, Mus musculus
MQGPGGNVSRGLPSGPASTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVGVLVEWQQWESLRFGEYGDPLQCGAWVGQCALYIVIMIFEKSVVFIVLLILQWKKVALLNPIENPDLKLAIVMLIVPFFVNAFMFWVVDNFLMRKGKTKAKLEERGANQDSRNGSKVRYRRAASHEESESEILISADYEMEESDAEEDLRRPVKKKHRFGLPV

SEQ ID NO: 68580 - DNA, 867 bp, Mus musculus
  CDS (1)..(867)
atgcaaggcccgggagggaacttgagccgcggattgccgagcgggccggcctccacggtcgcgtccgaggcgggccgctgtgagagcggcgcgctcatgcacagtttcggcatcttcctgcaggggctgctcggcgtcgtggccttcagcacattgatgcttaaacgcttcagagaaccaaagcatgaaagacggccgtggaggatatggtttttagacacttccaaacaagccatagggatgctcttcatccactttgcaaatgtgtacctagcagatctcactgaagaggacccttgttcactgtacctcatcaactttcttctggacgccactgtaggcatgctgctcatttatgtgggcgtacgcgccgtcggtgtcttggtggagtggcagcagtgggaatccctgcgttttggagaatatggagaccctctgcagtgcggggcctgggtaggacagtgcgccctctacatcgtgatcatgatctttgaaaagtccgtggtcttcatcgtcctcctcatactccagtggaaaaaggtggccctattgaatccaattgaaaaccccgacctgaagctggccatcgtcatgctgatagtccccttctttgtcaatgctttcatgttctgggtagtggacaatttcctcatgagaaaggggaagacgaaagctaaactagaagaaagaggagccaaccaggactcaaggaatgggagcaaggttcgctaccgaagggcagcatcccatgaggagtctgagtctgagatcctgatctcagctgacgacgagatggaggagtctgacgccgaggaggacctccggagacctgtgaaaaagaagcaccgcttcgggctgcctgtatga

SEQ ID NO: 68581 - protein, 288 aa, Mus musculus
MQGPGGNLSRGLPSGPASTVASEAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVGVLVEWQQWESLRFGEYGDPLQCGAWVGQCALYIVIMIFEKSVVFIVLLILQWKKVALLNPIENPDLKLAIVMLIVPFFVNAFMFWVVDNFLMRKGKTKAKLEERGANQDSRNGSKVRYRRAASHEESESEILISADDEMEESDAEEDLRRPVKKKHRFGLPV

SEQ ID NO: 68582 - DNA, 26 bp, Artificial sequence
  (1)..(26): primer
atgtatgtttctaatgggaaagacac

SEQ ID NO: 68583 - DNA, 25 bp, Artificial sequence
  (1)..(25): primer
ctatattatgctaccatagctggaa

SEQ ID NO: 68584 - protein, 296 aa, Artificial sequence
  Variant (2)..(4): xaa in position 2 to 4 is any amino acid
  Variant (6)..(9): xaa in position 6 to 9 is any amino acid
  Variant (11)..(20): xaa in position 11 to 20 is any amino acid
  Variant (22)..(23): xaa in position 22 to 23 is any amino acid
  Variant (24)..(52): xaa in position 24 to 52 is any or no amino acid
  Variant (55)..(56): xaa in position 55 to 56 is any amino acid
  Variant (58)..(62): xaa in position 58 to 62 is any amino acid
  Variant (63)..(64): xaa in position 63 to 64 is any or no amino acid
  Variant (66)..(67): xaa in position 66 to 67 is any amino acid
  Variant (69)..(70): xaa in position 69 to 70 is any amino acid
  Variant (72)..(72): xaa in position 72 is any amino acid
  Variant (76)..(77): xaa in position 76 to 77 is any amino acid
  Variant (79)..(82): xaa in position 79 to 82 is any amino acid
  Variant (84)..(85): xaa in position 84 to 85 is any amino acid
  Variant (87)..(96): xaa in position 87 to 96 is any amino acid
  Variant (97)..(134): xaa in position 97 to 134 is any or no amino acid
  Variant (137)..(138): xaa in position 137 to 138 is any amino acid
  Variant (140)..(141): xaa in position 140 to 141 is any amino acid
  Variant (143)..(145): xaa in position 143 to 145 is any amino acid
  Variant (147)..(147): xaa in position 147 is any amino acid
  Variant (148)..(153): xaa in position 148 to 153 is any or no amino acid
  Variant (155)..(155): xaa in position 155 is any amino acid
  Variant (157)..(181): xaa in position 157 to 181 is any amino acid
  Variant (182)..(185): xaa in position 182 to 185 is any or no amino acid
  Variant (187)..(187): xaa in position 187 is any amino acid
  Variant (190)..(198): xaa in position 190 to 198 is any amino acid
  Variant (199)..(228): xaa in position 199 to 228 is any or no amino acid
  Variant (230)..(232): xaa in position 230 to 232 is any amino acid
  Variant (234)..(240): xaa in position 234 to 240 is any amino acid
  Variant (242)..(271): xaa in position 242 to 271 is any amino acid
  Variant (272)..(278): xaa in position 272 to 278 is any or no amino acid
  Variant (281)..(283): xaa in position 281 to 283 is any amino acid
  Variant (285)..(287): xaa in position 285 to 287 is any amino acid
  Variant (289)..(295): xaa in position 289 to 295 is any amino acid
LXXXFXXXXQXXXXXXXXXXLXXXXXXXXXXXXXXXXXXXXXXXXXXXXXXXKRXXEXXXXXXXWXXWXXDXSKQXXGXXXXHXXNXXXXXXXXXXXXXXXXXXXXXXXXXXXXXXXXXXXXXXXXXXXXXXXXPCXXYXXNXXXDXXXXXXXTXGXXXXXXXXXXXXXXXXXXXXXXXXXXXXXGXYGXXXXXXXXXXXXXXXXXXXXXXXXXXXXXXXXXXXXXXXQXXXYXXXXXXXKXXXXXXXXXXXXXXXXXXXXXXXXXXXXXXXXXXXXXVMXXXPXXXNXXXXXXXD

SEQ ID NO: 68585 - protein, 25 aa, Artificial sequence
  Variant (2)..(2): xaa in position 2 is Pro, Ser or Thr
  Variant (3)..(4): xaa in position 3 to 4 is any amino acid
  Variant (5)..(5): xaa in position 5 is Ile or Val
  Variant (7)..(7): xaa in position 7 is any or no amino acid
  Variant (9)..(9): xaa in position 9 is any or no amino acid
  Variant (11)..(11): xaa in position 11 is Ala, Thr or Val
  Variant (15)..(15): xaa in position 15 is Ala, Leu or Val
  Variant (16)..(16): xaa in position 16 is any amino acid
  Variant (18)..(20): xaa in position 18 to 20 is any amino acid
  Variant (21)..(21): xaa in position 21 is Ile, Leu, Met or Val
  Variant (23)..(24): xaa in position 23 to 24 is any amino acid
RXXXXWXFXDXSKQXXGXXXXHXXN

SEQ ID NO: 68586 - protein, 43 aa, Artificial sequence
  Variant (2)..(2): xaa in position 2 is Asp or Ser
  Variant (3)..(3): xaa in position 3 is any amino acid
  Variant (5)..(5): xaa in position 5 is any or no amino acid
  Variant (7)..(7): xaa in position 7 is any or no amino acid
  Variant (9)..(9): xaa in position 9 is Phe, Ile or Leu
  Variant (10)..(10): xaa in position 10 is Ala, Gly, Ile, Leu or Val
  Variant (11)..(11): xaa in position 11 is Ile, Leu or Val
  Variant (13)..(13): xaa in position 13 is Ala, Cys or Thr
  Variant (15)..(15): xaa in position 15 is Ile, Leu or Val
  Variant (17)..(18): xaa in position 17 to 18 is any amino acid
  Variant (19)..(19): xaa in position 19 is any or no amino acid
  Variant (21)..(30): xaa in position 21 to 30 is any amino acid
  Variant (31)..(31): xaa in position 31 is Ile, Leu or Val
  Variant (32)..(42): xaa in position 32 to 42 is any amino acid
  Variant (43)..(43): xaa in position 43 is Glu, Gly or Ser
CXXYXLXNXXXDXTXGXXXIXXXXXXXXXXXXXXXXXXXXXXX

SEQ ID NO: 68587 - DNA, 1047 bp, Escherichia coli K12; identical to SEQ ID NO: 1323
  CDS (1)..(1047)

SEQ ID NO: 68588 - protein, 348 aa, Escherichia coli K12; identical to SEQ ID NO: 1324

SEQ ID NO: 68589 - DNA, 1235 bp, Salmonella typhimurium; identical to SEQ ID NO: 1325
  CDS (165)..(1235)

SEQ ID NO: 68590 - protein, 356 aa, Salmonella typhimurium; identical to SEQ ID NO: 1326

SEQ ID NO: 68591 - DNA, 1086 bp, Deinococcus radiodurans; identical to SEQ ID NO: 1327
  CDS (1)..(1086)

SEQ ID NO: 68592 - protein, 361 aa, Deinococcus radiodurans; identical to SEQ ID NO: 1328

SEQ ID NO: 68593 - DNA, 1056 bp, Neisseria meningitidis; identical to SEQ ID NO: 1329
  CDS (1)..(1056)

SEQ ID NO: 68594 - protein, 351 aa, Neisseria meningitidis; identical to SEQ ID NO: 1330

SEQ ID NO: 68595 - DNA, 1047 bp, Yersinia pestis; identical to SEQ ID NO: 1331
  CDS (1)..(1047)

SEQ ID NO: 68596 - protein, 348 aa, Yersinia pestis; identical to SEQ ID NO: 1332

SEQ ID NO: 68597 - DNA, 1071 bp, Escherichia coli; identical to SEQ ID NO: 1333
  CDS (1)..(1071)

SEQ ID NO: 68598 - protein, 356 aa, Escherichia coli; identical to SEQ ID NO: 1334

SEQ ID NO: 68599 - DNA, 1131 bp, Nostoc sp. PCC 7120; identical to SEQ ID NO: 1335
  CDS (1)..(1131)

SEQ ID NO: 68600 - protein, 376 aa, Nostoc sp. PCC 7120; identical to SEQ ID NO: 1336

SEQ ID NO: 68601 - DNA, 1053 bp, Salmonella enterica subsp. enterica serovar Typhi; identical to SEQ ID NO: 1337
  CDS (1)..(1053)

SEQ ID NO: 68602 - protein, 350 aa, Salmonella enterica subsp. enterica serovar Typhi; identical to SEQ ID NO: 1338

SEQ ID NO: 68603 - DNA, 1077 bp, Pseudomonas aeruginosa; identical to SEQ ID NO: 1339
  CDS (1)..(1077)

SEQ ID NO: 68604 - protein, 358 aa, Pseudomonas aeruginosa; identical to SEQ ID NO: 1340

SEQ ID NO: 68605 - DNA, 1047 bp, Buchnera sp; identical to SEQ ID NO: 1341
  CDS (1)..(1047)

SEQ ID NO: 68606 - protein, 348 aa, Buchnera sp; identical to SEQ ID NO: 1342

SEQ ID NO: 68607 - DNA, 1074 bp, Vibrio cholerae; identical to SEQ ID NO: 1343
  CDS (1)..(1074)

SEQ ID NO: 68608 - protein, 357 aa, Vibrio cholerae; identical to SEQ ID NO: 1344

SEQ ID NO: 68609 - DNA, 1038 bp, Lactococcus lactis subsp. lactis; identical to SEQ ID NO: 1345
  CDS (1)..(1038)

SEQ ID NO: 68610 - protein, 345 aa, Lactococcus lactis subsp. lactis; identical to SEQ ID NO: 1346

SEQ ID NO: 68611 - DNA, 1023 bp, Lactococcus lactis subsp. lactis; identical to SEQ ID NO: 1347
  CDS (1)..(1023)

SEQ ID NO: 68612 - protein, 340 aa, Lactococcus lactis subsp. lactis; identical to SEQ ID NO: 1348

SEQ ID NO: 68613 - DNA, 1032 bp, Streptococcus pneumoniae; identical to SEQ ID NO: 1349
  CDS (1)..(1032)

SEQ ID NO: 68614 - protein, 343 aa, Streptococcus pneumoniae; identical to SEQ ID NO: 1350

SEQ ID NO: 68615 - DNA, 1095 bp, Pseudomonas aeruginosa; identical to SEQ ID NO: 1351
  CDS (1)..(1095)

SEQ ID NO: 68616 - protein, 364 aa, Pseudomonas aeruginosa; identical to SEQ ID NO: 1352

SEQ ID NO: 68617 - DNA, 1110 bp, Caulobacter crescentus; identical to SEQ ID NO: 1353
  CDS (1)..(1110)

SEQ ID NO: 68618 - protein, 369 aa, Caulobacter crescentus; identical to SEQ ID NO: 1354

SEQ ID NO: 68619 - DNA, 1032 bp, Streptococcus pneumoniae; identical to SEQ ID NO: 1355
  CDS (1)..(1032)

SEQ ID NO: 68620 - protein, 343 aa, Streptococcus pneumoniae; identical to SEQ ID NO: 1356

SEQ ID NO: 68621 - DNA, 1047 bp, Buchnera aphidicola; identical to SEQ ID NO: 1357
  CDS (1)..(1047)

SEQ ID NO: 68622 - protein, 348 aa, Buchnera aphidicola; identical to SEQ ID NO: 1358

SEQ ID NO: 68623 - DNA, 1089 bp, Haemophilus influenzae; identical to SEQ ID NO: 1359
  CDS (1)..(1089)

SEQ ID NO: 68624 - protein, 362 aa, Haemophilus influenzae; identical to SEQ ID NO: 1360

SEQ ID NO: 68625 - DNA, 1502 bp, Candida albicans; identical to SEQ ID NO: 1361
  CDS (336)..(1442)

SEQ ID NO: 68626 - protein, 368 aa, Candida albicans; identical to SEQ ID NO: 1362

SEQ ID NO: 68627 - DNA, 1113 bp, Saccharomyces cerevisiae; identical to SEQ ID NO: 1363
  CDS (1)..(1113)

SEQ ID NO: 68628 - protein, 370 aa, Saccharomyces cerevisiae; identical to SEQ ID NO: 1364

SEQ ID NO: 68629 - DNA, 2048 bp, Saccharomyces cerevisiae; identical to SEQ ID NO: 1365
  CDS (619)..(1731)

SEQ ID NO: 68630 - protein, 370 aa, Saccharomyces cerevisiae; identical to SEQ ID NO: 1366

SEQ ID NO: 68631 - DNA, 1107 bp, Schizosaccharomyces pombe; identical to SEQ ID NO: 1367
  CDS (1)..(1107)

SEQ ID NO: 68632 - protein, 368 aa, Schizosaccharomyces pombe; identical to SEQ ID NO: 1368

SEQ ID NO: 68633 - DNA, 1089 bp, Amycolatopsis orientalis; identical to SEQ ID NO: 1369
  CDS (1)..(1089)

SEQ ID NO: 68634 - protein, 362 aa, Amycolatopsis orientalis; identical to SEQ ID NO: 1370

SEQ ID NO: 68635 - DNA, 1119 bp, Schizosaccharomyces pombe; identical to SEQ ID NO: 1371
  CDS (1)..(1119)

SEQ ID NO: 68636 - protein, 372 aa, Schizosaccharomyces pombe; identical to SEQ ID NO: 1372

SEQ ID NO: 68637 - DNA, 1248 bp, Corynebacterium glutamicum; identical to SEQ ID NO: 1373
  CDS (101)..(1228)

SEQ ID NO: 68638 - protein, 375 aa, Corynebacterium glutamicum; identical to SEQ ID NO: 1374

SEQ ID NO: 68639 - DNA, 1083 bp, Methylophilus methylotrophus; identical to SEQ ID NO: 1375
  CDS (1)..(1083)

SEQ ID NO: 68640 - protein, 360 aa, Methylophilus methylotrophus; identical to SEQ ID NO: 1376

SEQ ID NO: 68641 - DNA, 1107 bp, Debaryomyces hansenii; identical to SEQ ID NO: 1377
  CDS (1)..(1107)

SEQ ID NO: 68642 - protein, 368 aa, Debaryomyces hansenii; identical to SEQ ID NO: 1378

SEQ ID NO: 68643 - DNA, 1074 bp, Yarrowia lipolytica; identical to SEQ ID NO: 1379
  CDS (1)..(1074)

SEQ ID NO: 68644 - protein, 357 aa, Yarrowia lipolytica; identical to SEQ ID NO: 1380

SEQ ID NO: 68645 - DNA, 1089 bp, Yarrowia lipolytica; identical to SEQ ID NO: 1381
  CDS (1)..(1089)

SEQ ID NO: 68646 - protein, 362 aa, Yarrowia lipolytica; identical to SEQ ID NO: 1382

SEQ ID NO: 68647 - DNA, 1119 bp, Kluyveromyces lactis; identical to SEQ ID NO: 1383
  CDS (1)..(1119)

SEQ ID NO: 68648 - protein, 372 aa, Kluyveromyces lactis; identical to SEQ ID NO: 1384

SEQ ID NO: 68649 - DNA, 1095 bp, Kluyveromyces lactis; identical to SEQ ID NO: 1385
  CDS (1)..(1095)

SEQ ID NO: 68650 - protein, 364 aa, Kluyveromyces lactis; identical to SEQ ID NO: 1386

SEQ ID NO: 68651 - DNA, 1074 bp, Erwinia carotovora subsp; identical to SEQ ID NO: 1387
  CDS (1)..(1074)

SEQ ID NO: 68652 - protein, 357 aa, Erwinia carotovora subsp; identical to SEQ ID NO: 1388

SEQ ID NO: 68653 - DNA, 1047 bp, Erwinia carotovora subsp; identical to SEQ ID NO: 1389
  CDS (1)..(1047)

SEQ ID NO: 68654 - protein, 348 aa, Erwinia carotovora subsp; identical to SEQ ID NO: 1390

SEQ ID NO: 68655 - DNA, 1056 bp, Erwinia carotovora subsp; identical to SEQ ID NO: 1391
  CDS (1)..(1056)

SEQ ID NO: 68656 - protein, 351 aa, Erwinia carotovora subsp; identical to SEQ ID NO: 1392

SEQ ID NO: 68657 - DNA, 1113 bp, Acinetobacter sp; identical to SEQ ID NO: 1393
  CDS (1)..(1113)

SEQ ID NO: 68658 - protein, 370 aa, Acinetobacter sp; identical to SEQ ID NO: 1394

SEQ ID NO: 68659 - DNA, 1056 bp, Acinetobacter sp; identical to SEQ ID NO: 1395
  CDS (1)..(1056)

SEQ ID NO: 68660 - protein, 351 aa, Acinetobacter sp; identical to SEQ ID NO: 1396

SEQ ID NO: 68661 - DNA, 1119 bp, Candida glabrata; identical to SEQ ID NO: 1397
  CDS (1)..(1119)

SEQ ID NO: 68662 - protein, 372 aa, Candida glabrata; identical to SEQ ID NO: 1398

SEQ ID NO: 68663 - DNA, 1071 bp, Candida glabrata; identical to SEQ ID NO: 1399
  CDS (1)..(1071)

SEQ ID NO: 68664 - protein, 356 aa, Candida glabrata; identical to SEQ ID NO: 1400

SEQ ID NO: 68665 - DNA, 1083 bp, Photobacterium profundum; identical to SEQ ID NO: 1401
  CDS (1)..(1083)

SEQ ID NO: 68666 - protein, 360 aa, Photobacterium profundum; identical to SEQ ID NO: 1402

SEQ ID NO: 68667 - DNA, 1053 bp, Photobacterium profundum; identical to SEQ ID NO: 1403
  CDS (1)..(1053)

SEQ ID NO: 68668 - protein, 350 aa, Photobacterium profundum; identical to SEQ ID NO: 1404

SEQ ID NO: 68669 - DNA, 1113 bp, Photobacterium profundum; identical to SEQ ID NO: 1405
  CDS (1)..(1113)

SEQ ID NO: 68670 - protein, 370 aa, Photobacterium profundum; identical to SEQ ID NO: 1406

SEQ ID NO: 68671 - DNA, 1056 bp, Photobacterium profundum; identical to SEQ ID NO: 1407
  CDS (1)..(1056)

SEQ ID NO: 68672 - protein, 351 aa, Photobacterium profundum; identical to SEQ ID NO: 1408

SEQ ID NO: 68673 - DNA, 1092 bp, Parachlamydia sp; identical to SEQ ID NO: 1409
  CDS (1)..(1092)

SEQ ID NO: 68674 - protein, 363 aa, Parachlamydia sp; identical to SEQ ID NO: 1410

SEQ ID NO: 68675 - DNA, 1095 bp, Rhodopseudomonas palustris; identical to SEQ ID NO: 1411
  CDS (1)..(1095)

SEQ ID NO: 68676 - protein, 364 aa, Rhodopseudomonas palustris; identical to SEQ ID NO: 1412

SEQ ID NO: 68677 - DNA, 1100 bp, Amycolatopsis methanolica; identical to SEQ ID NO: 1413
  CDS (1)..(1086)

SEQ ID NO: 68678 - protein, 361 aa, Amycolatopsis methanolica; identical to SEQ ID NO: 1414

SEQ ID NO: 68679 - DNA, 1071 bp, Treponema denticola; identical to SEQ ID NO: 1415
  CDS (1)..(1071)

SEQ ID NO: 68680 - protein, 356 aa, Treponema denticola; identical to SEQ ID NO: 1416

SEQ ID NO: 68681 - DNA, 1068 bp, Geobacter sulfurreducens; identical to SEQ ID NO: 1417
  CDS (1)..(1068)

SEQ ID NO: 68682 - protein, 355 aa, Geobacter sulfurreducens; identical to SEQ ID NO: 1418

SEQ ID NO: 68683 - DNA, 1095 bp, Ashbya gossypii; identical to SEQ ID NO: 1419
  CDS (1)..(1095)

SEQ ID NO: 68684 - protein, 364 aa, Ashbya gossypii; identical to SEQ ID NO: 1420

SEQ ID NO: 68685 - DNA, 1122 bp, Ashbya gossypii; identical to SEQ ID NO: 1421
  CDS (1)..(1122)

SEQ ID NO: 68686 - protein, 373 aa, Ashbya gossypii; identical to SEQ ID NO: 1422

SEQ ID NO: 68687 - DNA, 1098 bp, Amycolatopsis balhimycina; identical to SEQ ID NO: 1423
  CDS (1)..(1098)

SEQ ID NO: 68688 - protein, 365 aa, Amycolatopsis balhimycina; identical to SEQ ID NO: 1424

SEQ ID NO: 68689 - DNA, 1071 bp, Vibrio vulnificus; identical to SEQ ID NO: 1425
  CDS (1)..(1071)

SEQ ID NO: 68690 - protein, 356 aa, Vibrio vulnificus; identical to SEQ ID NO: 1426

SEQ ID NO: 68691 - DNA, 1047 bp, Photorhabdus luminescens; identical to SEQ ID NO: 1427
  CDS (1)..(1047)

SEQ ID NO: 68692 - protein, 348 aa, Photorhabdus luminescens; identical to SEQ ID NO: 1428

SEQ ID NO: 68693 - DNA, 1053 bp, Photorhabdus luminescens; identical to SEQ ID NO: 1429
  CDS (1)..(1053)

SEQ ID NO: 68694 - protein, 350 aa, Photorhabdus luminescens; identical to SEQ ID NO: 1430

SEQ ID NO: 68695 - DNA, 1095 bp, Photorhabdus luminescens; identical to SEQ ID NO: 1431
  CDS (1)..(1095)

SEQ ID NO: 68696 - protein, 364 aa, Photorhabdus luminescens; identical to SEQ ID NO: 1432

SEQ ID NO: 68697 - DNA, 1119 bp, Gloeobacter violaceus; identical to SEQ ID NO: 1433
  CDS (1)..(1119)

SEQ ID NO: 68698 - protein, 372 aa, Gloeobacter violaceus; identical to SEQ ID NO: 1434

SEQ ID NO: 68699 - DNA, 1107 bp, Chromobacterium violaceum; identical to SEQ ID NO: 1435
  CDS (1)..(1107)

SEQ ID NO: 68700 - protein, 368 aa, Chromobacterium violaceum; identical to SEQ ID NO: 1436

SEQ ID NO: 68701 - DNA, 1059 bp, Chromobacterium violaceum; identical to SEQ ID NO: 1437
  CDS (1)..(1059)

SEQ ID NO: 68702 - protein, 352 aa, Chromobacterium violaceum; identical to SEQ ID NO: 1438

SEQ ID NO: 68703 - DNA, 1140 bp, Neurospora crassa; identical to SEQ ID NO: 1439
  CDS (1)..(1140)

SEQ ID NO: 68704 - protein, 379 aa, Neurospora crassa; identical to SEQ ID NO: 1440

SEQ ID NO: 68705 - DNA, 1092 bp, Neurospora crassa; identical to SEQ ID NO: 1441
  CDS (1)..(1092)

SEQ ID NO: 68706 - protein, 363 aa, Neurospora crassa; identical to SEQ ID NO: 1442

SEQ ID NO: 68707 - DNA, 1068 bp, Synechococcus sp; identical to SEQ ID NO: 1443
  CDS (1)..(1068)

SEQ ID NO: 68708 - protein, 355 aa, Synechococcus sp; identical to SEQ ID NO: 1444

SEQ ID NO: 68709 - DNA, 1053 bp, Rhodopirellula baltica; identical to SEQ ID NO: 1445
  CDS (1)..(1053)

SEQ ID NO: 68710 - protein, 350 aa, Rhodopirellula baltica; identical to SEQ ID NO: 1446

SEQ ID NO: 68711 - DNA, 1068 bp, Prochlorococcus marinus subsp; identical to SEQ ID NO: 1447
  CDS (1)..(1068)

SEQ ID NO: 68712 - protein, 355 aa, Prochlorococcus marinus subsp; identical to SEQ ID NO: 1448

SEQ ID NO: 68713 - DNA, 1083 bp, Prochlorococcus marinus; identical to SEQ ID NO: 1449
  CDS (1)..(1083)

SEQ ID NO: 68714 - protein, 360 aa, Prochlorococcus marinus; identical to SEQ ID NO: 1450

SEQ ID NO: 68715 - DNA, 1074 bp, Prochlorococcus marinus; identical to SEQ ID NO: 1451
  CDS (1)..(1074)

SEQ ID NO: 68716 - protein, 357 aa, Prochlorococcus marinus; identical to SEQ ID NO: 1452

SEQ ID NO: 68717 - DNA, 1113 bp, Haemophilus ducreyi; identical to SEQ ID NO: 1453
  CDS (1)..(1113)

SEQ ID NO: 68718 - protein, 370 aa, Haemophilus ducreyi; identical to SEQ ID NO: 1454

SEQ ID NO: 68719 - DNA, 1080 bp, Haemophilus ducreyi; identical to SEQ ID NO: 1455
  CDS (1)..(1080)

SEQ ID NO: 68720 - protein, 359 aa, Haemophilus ducreyi; identical to SEQ ID NO: 1456

SEQ ID NO: 68721 - DNA, 1086 bp, Candidatus Blochmannia floridanus; identical to SEQ ID NO: 1457
  CDS (1)..(1086)

SEQ ID NO: 68722 - protein, 361 aa, Candidatus Blochmannia floridanus; identical to SEQ ID NO: 1458

SEQ ID NO: 68723 - DNA, 1074 bp, Bordetella pertussis; identical to SEQ ID NO: 1459
  CDS (1)..(1074)

SEQ ID NO: 68724 - protein, 357 aa, Bordetella pertussis; identical to SEQ ID NO: 1460

SEQ ID NO: 68725 - DNA, 1119 bp, Bordetella bronchiseptica; identical to SEQ ID NO: 1461
  CDS (1)..(1119)

SEQ ID NO: 68726 - protein, 372 aa, Bordetella bronchiseptica; identical to SEQ ID NO: 1462

SEQ ID NO: 68727 - DNA, 1179 bp, Nitrosomonas europaea; identical to SEQ ID NO: 1463
  CDS (1)..(1179)

SEQ ID NO: 68728 - protein, 392 aa, Nitrosomonas europaea; identical to SEQ ID NO: 1464

SEQ ID NO: 68729 - DNA, 1083 bp, Coxiella burnetii; identical to SEQ ID NO: 1465
  CDS (1)..(1083)

SEQ ID NO: 68730 - protein, 360 aa, Coxiella burnetii; identical to SEQ ID NO: 1466

SEQ ID NO: 68731 - DNA, 834 bp, Vibrio anguillarum; identical to SEQ ID NO: 1467
  CDS (1)..(834)

SEQ ID NO: 68732 - protein, 277 aa, Vibrio anguillarum; identical to SEQ ID NO: 1468

SEQ ID NO: 68733 - DNA, 1143 bp, Xylella fastidiosa; identical to SEQ ID NO: 1469
  CDS (1)..(1143)

SEQ ID NO: 68734 - protein, 380 aa, Xylella fastidiosa; identical to SEQ ID NO: 1470

SEQ ID NO: 68735 - DNA, 1053 bp, Vibrio parahaemolyticus; identical to SEQ ID NO: 1471
  CDS (1)..(1053)

SEQ ID NO: 68736 - protein, 350 aa, Vibrio parahaemolyticus; identical to SEQ ID NO: 1472

SEQ ID NO: 68737 - DNA, 1053 bp, Vibrio parahaemolyticus; identical to SEQ ID NO: 1473
  CDS (1)..(1053)

SEQ ID NO: 68738 - protein, 350 aa, Vibrio parahaemolyticus; identical to SEQ ID NO: 1474

SEQ ID NO: 68739 - DNA, 1074 bp, Vibrio parahaemolyticus; identical to SEQ ID NO: 1475
  CDS (1)..(1074)

SEQ ID NO: 68740 - protein, 357 aa, Vibrio parahaemolyticus; identical to SEQ ID NO: 1476

SEQ ID NO: 68741 - DNA, 1083 bp, Pseudomonas syringae; identical to SEQ ID NO: 1477
  CDS (1)..(1083)

SEQ ID NO: 68742 - protein, 360 aa, Pseudomonas syringae; identical to SEQ ID NO: 1478

SEQ ID NO: 68743 - DNA, 1077 bp, Pseudomonas syringae; identical to SEQ ID NO: 1479
  CDS (1)..(1077)

SEQ ID NO: 68744 - protein, 358 aa, Pseudomonas syringae; identical to SEQ ID NO: 1480

SEQ ID NO: 68745 - DNA, 1062 bp, Pseudomonas putida; identical to SEQ ID NO: 1481
  CDS (1)..(1062)

SEQ ID NO: 68746 - protein, 353 aa, Pseudomonas putida; identical to SEQ ID NO: 1482

SEQ ID NO: 68747 - DNA, 1113 bp, Pseudomonas putida; identical to SEQ ID NO: 1483
  CDS (1)..(1113)

SEQ ID NO: 68748 - protein, 370 aa, Pseudomonas putida; identical to SEQ ID NO: 1484

SEQ ID NO: 68749 - DNA, 1086 bp, Bradyrhizobium japonicum; identical to SEQ ID NO: 1485
  CDS (1)..(1086)

SEQ ID NO: 68750 - protein, 361 aa, Bradyrhizobium japonicum; identical to SEQ ID NO: 1486

SEQ ID NO: 68751 - DNA, 1053 bp, Yersinia pestis; identical to SEQ ID NO: 1487
  CDS (1)..(1053)

SEQ ID NO: 68752 - protein, 350 aa, Yersinia pestis; identical to SEQ ID NO: 1488

SEQ ID NO: 68753 - DNA, 1077 bp, Yersinia pestis; identical to SEQ ID NO: 1489
  CDS (1)..(1077)

SEQ ID NO: 68754 - protein, 358 aa, Yersinia pestis; identical to SEQ ID NO: 1490

SEQ ID NO: 68755 - DNA, 1038 bp, Wigglesworthia glossinidia brevipalpis; identical to SEQ ID NO: 1491
  CDS (1)..(1038)

SEQ ID NO: 68756 - protein, 345 aa, Wigglesworthia glossinidia brevipalpis; identical to SEQ ID NO: 1492

SEQ ID NO: 68757 - DNA, 1053 bp, Vibrio vulnificus; identical to SEQ ID NO: 1493
  CDS (1)..(1053)

SEQ ID NO: 68758 - protein, 350 aa, Vibrio vulnificus; identical to SEQ ID NO: 1494

SEQ ID NO: 68759 - DNA, 1053 bp, Vibrio vulnificus; identical to SEQ ID NO: 1495
  CDS (1)..(1053)

SEQ ID NO: 68760 - protein, 350 aa, Vibrio vulnificus; identical to SEQ ID NO: 1496

SEQ ID NO: 68761 - DNA, 1071 bp, Vibrio vulnificus; identical to SEQ ID NO: 1497
  CDS (1)..(1071)

SEQ ID NO: 68762 - protein, 356 aa, Vibrio vulnificus; identical to SEQ ID NO: 1498

SEQ ID NO: 68763 - DNA, 1062 bp, Synechococcus elongatus; identical to SEQ ID NO: 1499
  CDS (1)..(1062)

SEQ ID NO: 68764 - protein, 353 aa, Synechococcus elongatus; identical to SEQ ID NO: 1500

SEQ ID NO: 68765 - DNA, 1032 bp, Streptococcus mutans; identical to SEQ ID NO: 1501
  CDS (1)..(1032)

SEQ ID NO: 68766 - protein, 343 aa, Streptococcus mutans; identical to SEQ ID NO: 1502

SEQ ID NO: 68767 - DNA, 1035 bp, Streptococcus mutans; identical to SEQ ID NO: 1503
  CDS (1)..(1035)

SEQ ID NO: 68768 - protein, 344 aa, Streptococcus mutans; identical to SEQ ID NO: 1504

SEQ ID NO: 68769 - DNA, 1008 bp, Streptococcus agalactiae; identical to SEQ ID NO: 1505
  CDS (1)..(1008)

SEQ ID NO: 68770 - protein, 335 aa, Streptococcus agalactiae; identical to SEQ ID NO: 1506

SEQ ID NO: 68771 - DNA, 1065 bp, Shewanella oneidensis; identical to SEQ ID NO: 1507
  CDS (1)..(1065)

SEQ ID NO: 68772 - protein, 354 aa, Shewanella oneidensis; identical to SEQ ID NO: 1508

SEQ ID NO: 68773 - DNA, 1092 bp, Shewanella oneidensis; identical to SEQ ID NO: 1509
  CDS (1)..(1092)

SEQ ID NO: 68774 - protein, 363 aa, Shewanella oneidensis; identical to SEQ ID NO: 1510

SEQ ID NO: 68775 - DNA, 1059 bp, Shewanella oneidensis; identical to SEQ ID NO: 1511
  CDS (1)..(1059)

SEQ ID NO: 68776 - protein, 352 aa, Shewanella oneidensis; identical to SEQ ID NO: 1512

SEQ ID NO: 68777 - DNA, 1053 bp, Escherichia coli O6; identical to SEQ ID NO: 1513
  CDS (1)..(1053)

SEQ ID NO: 68778 - protein, 350 aa, Escherichia coli O6; identical to SEQ ID NO: 1514

SEQ ID NO: 68779 - DNA, 1170 bp, Corynebacterium efficiens; identical to SEQ ID NO: 1515
  CDS (1)..(1170)

SEQ ID NO: 68780 - protein, 389 aa, Corynebacterium efficiens; identical to SEQ ID NO: 1516

SEQ ID NO: 68781 - DNA, 1134 bp, Bifidobacterium longum; identical to SEQ ID NO: 1517
  CDS (1)..(1134)

SEQ ID NO: 68782 - protein, 377 aa, Bifidobacterium longum; identical to SEQ ID NO: 1518

SEQ ID NO: 68783 - DNA, 1233 bp, Bifidobacterium longum; identical to SEQ ID NO: 1519
  CDS (1)..(1233)

SEQ ID NO: 68784 - protein, 410 aa, Bifidobacterium longum; identical to SEQ ID NO: 1520

SEQ ID NO: 68785 - DNA, 1221 bp, Phytophthora infestans; identical to SEQ ID NO: 1521
  CDS (20)..(1153)

SEQ ID NO: 68786 - protein, 377 aa, Phytophthora infestans; identical to SEQ ID NO: 1522

SEQ ID NO: 68787 - DNA, 1062 bp, Chlorobium tepidum; identical to SEQ ID NO: 1523
  CDS (1)..(1062)

SEQ ID NO: 68788 - protein, 353 aa, Chlorobium tepidum; identical to SEQ ID NO: 1524

SEQ ID NO: 68789 - DNA, 1074 bp, Xanthomonas campestris; identical to SEQ ID NO: 1525
  CDS (1)..(1074)

SEQ ID NO: 68790 - protein, 357 aa, Xanthomonas campestris; identical to SEQ ID NO: 1526

SEQ ID NO: 68791 - DNA, 1074 bp, Xanthomonas axonopodis; identical to SEQ ID NO: 1527
  CDS (1)..(1074)

SEQ ID NO: 68792 - protein, 357 aa, Xanthomonas axonopodis; identical to SEQ ID NO: 1528

SEQ ID NO: 68793 - DNA, 1080 bp, Ralstonia solanacearum; identical to SEQ ID NO: 1529
  CDS (1)..(1080)

SEQ ID NO: 68794 - protein, 359 aa, Ralstonia solanacearum; identical to SEQ ID NO: 1530

SEQ ID NO: 68795 - DNA, 1179 bp, Ralstonia solanacearum; identical to SEQ ID NO: 1531
  CDS (1)..(1179)

SEQ ID NO: 68796 - protein, 392 aa, Ralstonia solanacearum; identical to SEQ ID NO: 1532

SEQ ID NO: 68797 - DNA, 1065 bp, Synechococcus sp; identical to SEQ ID NO: 1533
  CDS (1)..(1065)

SEQ ID NO: 68798 - protein, 354 aa, Synechococcus sp; identical to SEQ ID NO: 1534

SEQ ID NO: 68799 - DNA, 1035 bp, Escherichia coli; identical to SEQ ID NO: 1535
  CDS (1)..(1035)

SEQ ID NO: 68800 - protein, 344 aa, Escherichia coli; identical to SEQ ID NO: 1536

SEQ ID NO: 68801 - DNA, 1200 bp, Stigmatella aurantiaca; identical to SEQ ID NO: 1537
  CDS (62)..(1147)

SEQ ID NO: 68802 - protein, 361 aa, Stigmatella aurantiaca; identical to SEQ ID NO: 1538

SEQ ID NO: 68803 - DNA, 1092 bp, Rhizobium loti; identical to SEQ ID NO: 1539
  CDS (1)..(1092)

SEQ ID NO: 68804 - protein, 363 aa, Rhizobium loti; identical to SEQ ID NO: 1540

SEQ ID NO: 68805 - DNA, 1083 bp, Amycolatopsis mediterranei; identical to SEQ ID NO: 1541
  CDS (1)..(1083)

SEQ ID NO: 68806 - protein, 360 aa, Amycolatopsis mediterranei; identical to SEQ ID NO: 1542

SEQ ID NO: 68807 - DNA, 1053 bp, Pasteurella multocida; identical to SEQ ID NO: 1543
  CDS (1)..(1053)

SEQ ID NO: 68808 - protein, 350 aa, Pasteurella multocida; identical to SEQ ID NO: 1544

SEQ ID NO: 68809 - DNA, 1086 bp, Pasteurella multocida; identical to SEQ ID NO: 1545
  CDS (1)..(1086)

SEQ ID NO: 68810 - protein, 361 aa, Pasteurella multocida; identical to SEQ ID NO: 1546

SEQ ID NO: 68811 - DNA, 1125 bp, Emericella nidulans; identical to SEQ ID NO: 1547
  CDS (1)..(1125)

SEQ ID NO: 68812 - protein, 374 aa, Emericella nidulans; identical to SEQ ID NO: 1548

SEQ ID NO: 68813 - DNA, 1089 bp, Emericella nidulans; identical to SEQ ID NO: 1549
  CDS (1)..(1089)

SEQ ID NO: 68814 - protein, 362 aa, Emericella nidulans; identical to SEQ ID NO: 1550

SEQ ID NO: 68815 - DNA, 1239 bp, Vibrio cholerae; identical to SEQ ID NO: 1551
  CDS (114)..(1175)

SEQ ID NO: 68816 - protein, 353 aa, Vibrio cholerae; identical to SEQ ID NO: 1552

SEQ ID NO: 68817 - DNA, 2184 bp, Candida albicans; identical to SEQ ID NO: 1553
  CDS (461)..(1573)

SEQ ID NO: 68818 - protein, 370 aa, Candida albicans; identical to SEQ ID NO: 1554

SEQ ID NO: 68819 - DNA, 1047 bp, Buchnera aphidicola; identical to SEQ ID NO: 1555
  CDS (1)..(1047)

SEQ ID NO: 68820 - protein, 348 aa, Buchnera aphidicola; identical to SEQ ID NO: 1556

SEQ ID NO: 68821 - DNA, 1047 bp, Buchnera aphidicola; identical to SEQ ID NO: 1557
  CDS (1)..(1047)

SEQ ID NO: 68822 - protein, 348 aa, Buchnera aphidicola; identical to SEQ ID NO: 1558

SEQ ID NO: 68823 - DNA, 1047 bp, Erwinia herbicola; identical to SEQ ID NO: 1559
  CDS (1)..(1047)

SEQ ID NO: 68824 - protein, 348 aa, Erwinia herbicola; identical to SEQ ID NO: 1560

SEQ ID NO: 68825 - DNA, 1047 bp, Salmonella typhimurium; identical to SEQ ID NO: 1561
  CDS (1)..(1047)

SEQ ID NO: 68826 - protein, 348 aa, Salmonella typhimurium; identical to SEQ ID NO: 1562

SEQ ID NO: 68827 - DNA, 23 bp, Artificial sequence
  (1)..(23): primer
atgaacagaactgacgaactccg

SEQ ID NO: 68828 - DNA, 24 bp, Artificial sequence
  (1)..(24): primer
ttagaagcgggtatctaccgcaga

SEQ ID NO: 68829 - protein, 352 aa, Artificial sequence; identical to SEQ ID NO: 19007
  Variant (2)..(3): xaa in position 2 to 3 is any amino acid
  Variant (5)..(11): xaa in position 5 to 11 is any amino acid
  Variant (13)..(24): xaa in position 13 to 24 is any amino acid
  Variant (26)..(30): xaa in position 26 to 30 is any amino acid
  Variant (32)..(33): xaa in position 32 to 33 is any amino acid
  Variant (35)..(35): xaa in position 35 is any amino acid
  Variant (37)..(40): xaa in position 37 to 40 is any amino acid
  Variant (42)..(43): xaa in position 42 to 43 is any amino acid
  Variant (45)..(46): xaa in position 45 to 46 is any amino acid
  Variant (51)..(51): xaa in position 51 is any amino acid
  Variant (54)..(55): xaa in position 54 to 55 is any amino acid
  Variant (58)..(59): xaa in position 58 to 59 is any amino acid
  Variant (62)..(63): xaa in position 62 to 63 is any amino acid
  Variant (65)..(76): xaa in position 65 to 76 is any amino acid
  Variant (78)..(80): xaa in position 78 to 80 is any amino acid
  Variant (83)..(83): xaa in position 83 is any amino acid
  Variant (85)..(85): xaa in position 85 is any amino acid
  Variant (91)..(93): xaa in position 91 to 93 is any amino acid
  Variant (100)..(100): xaa in position 100 is any amino acid
  Variant (103)..(112): xaa in position 103 to 112 is any amino acid
  Variant (115)..(117): xaa in position 115 to 117 is any amino acid
  Variant (119)..(119): xaa in position 119 is any amino acid
  Variant (121)..(128): xaa in position 121 to 128 is any amino acid
  Variant (130)..(130): xaa in position 130 is any amino acid
  Variant (132)..(132): xaa in position 132 is any amino acid
  Variant (134)..(134): xaa in position 134 is any amino acid
  Variant (136)..(136): xaa in position 136 is any amino acid
  Variant (139)..(142): xaa in position 139 to 142 is any amino acid
  Variant (144)..(146): xaa in position 144 to 146 is any amino acid
  Variant (148)..(152): xaa in position 148 to 152 is any amino acid
  Variant (163)..(163): xaa in position 163 is any amino acid
  Variant (166)..(167): xaa in position 166 to 167 is any amino acid
  Variant (170)..(170): xaa in position 170 is any amino acid
  Variant (173)..(173): xaa in position 173 is any amino acid
  Variant (175)..(175): xaa in position 175 is any amino acid
  Variant (180)..(180): xaa in position 180 is any amino acid
  Variant (182)..(182): xaa in position 182 is any amino acid
  Variant (184)..(187): xaa in position 184 to 187 is any amino acid
  Variant (189)..(190): xaa in position 189 to 190 is any amino acid
  Variant (192)..(194): xaa in position 192 to 194 is any amino acid
  Variant (196)..(198): xaa in position 196 to 198 is any amino acid
  Variant (200)..(200): xaa in position 200 is any amino acid
  Variant (202)..(207): xaa in position 202 to 207 is any amino acid
  Variant (209)..(214): xaa in position 209 to 214 is any amino acid
  Variant (216)..(216): xaa in position 216 is any amino acid
  Variant (219)..(221): xaa in position 219 to 221 is any amino acid
  Variant (223)..(224): xaa in position 223 to 224 is any amino acid
  Variant (229)..(237): xaa in position 229 to 237 is any amino acid
  Variant (240)..(268): xaa in position 240 to 268 is any amino acid
  Variant (270)..(270): xaa in position 270 is any amino acid
  Variant (273)..(273): xaa in position 273 is any amino acid
  Variant (276)..(276): xaa in position 276 is any amino acid
  Variant (278)..(281): xaa in position 278 to 281 is any amino acid
  Variant (283)..(284): xaa in position 283 to 284 is any amino acid
  Variant (286)..(291): xaa in position 286 to 291 is any amino acid
  Variant (293)..(295): xaa in position 293 to 295 is any amino acid
  Variant (297)..(304): xaa in position 297 to 304 is any amino acid
  Variant (306)..(306): xaa in position 306 is any amino acid
  Variant (308)..(308): xaa in position 308 is any amino acid
  Variant (311)..(314): xaa in position 311 to 314 is any amino acid
  Variant (316)..(316): xaa in position 316 is any amino acid
  Variant (318)..(333): xaa in position 318 to 333 is any amino acid
  Variant (336)..(336): xaa in position 336 is any amino acid
  Variant (338)..(338): xaa in position 338 is any amino acid
  Variant (341)..(341): xaa in position 341 is any amino acid
  Variant (343)..(344): xaa in position 343 to 344 is any amino acid
  Variant (346)..(347): xaa in position 346 to 347 is any amino acid
  Variant (349)..(351): xaa in position 349 to 351 is any amino acid

SEQ ID NO: 68830 - protein, 24 aa, Artificial sequence
  Variant (2)..(2): xaa in position 2 is any amino acid
  Variant (3)..(3): xaa in position 3 is Leu, Val, Phe, Ile, Ala or Met
  Variant (4)..(4): xaa in position 4 is Val, Ile, Leu or Ala
  Variant (5)..(5): xaa in position 5 is Val or Ile
  Variant (6)..(6): xaa in position 6 is Val, Ile, Cys or Thr
  Variant (11)..(11): xaa in position 11 is Ile, Val, Ser or Leu
  Variant (12)..(12): xaa in position 12 is His or Asp
  Variant (13)..(13): xaa in position 13 is Asp or Asn
  Variant (14)..(15): xaa in position 14 to 15 is any amino acid
  Variant (16)..(16): xaa in position 16 is Ala, Ser, Gln or Thr
  Variant (17)..(17): xaa in position 17 is Ala, Val or Gly
  Variant (18)..(18): xaa in position 18 is any amino acid
  Variant (19)..(19): xaa in position 19 is Glu, Asp, Ala or Gln
  Variant (21)..(21): xaa in position 21 is Ala, Gly, Cys or Ser
  Variant (22)..(22): xaa in position 22 is any amino acid
  Variant (23)..(23): xaa in position 23 is Arg, Lys, Gln, His or Leu
  Variant (24)..(24): xaa in position 24 is Leu, Ile or Phe
RXXXXXGPCSXXXXXXXXXYXXXX

SEQ ID NO: 68831 - protein, 42 aa, Artificial sequence; identical to SEQ ID NO: 2884
  Variant (1)..(1): xaa in position 1 is Leu, Ile, Phe or Met
  Variant (2)..(2): xaa in position 2 is any amino acid
  Variant (3)..(3): xaa in position 3 is Ile, Val, Leu or Met
  Variant (4)..(4): xaa in position 4 is Val, Ile or Leu
  Variant (7)..(7): xaa in position 7 is Val, Ala or Thr
  Variant (9)..(9): xaa in position 9 is Phe, Leu, Thr or Val
  Variant (10)..(10): xaa in position 10 is Glu or Ala
  Variant (15)..(16): xaa in position 15 to 16 is any amino acid
  Variant (17)..(17): xaa in position 17 is any or no amino acid
  Variant (19)..(19): xaa in position 19 is Trp or Tyr
  Variant (20)..(20): xaa in position 20 is Lys or Arg
  Variant (22)..(22): xaa in position 22 is Leu, Phe, Met or Tyr
  Variant (23)..(23): xaa in position 23 is Ile, Val, Ala or Leu
  Variant (24)..(24): xaa in position 24 is any amino acid
  Variant (25)..(25): xaa in position 25 is Asp, Glu or Gln
  Variant (27)..(27): xaa in position 27 is any amino acid
  Variant (28)..(28): xaa in position 28 is Leu, Met, Ile, Val, Ala or Thr
  Variant (29)..(29): xaa in position 29 is Asp, Asn or Ser
  Variant (30)..(33): xaa in position 30 to 33 is any amino acid
  Variant (34)..(34): xaa in position 34 is Ile, Val, Leu or Met
  Variant (35)..(36): xaa in position 35 to 36 is any amino acid
  Variant (38)..(38): xaa in position 38 is Leu, Ile, Met or Val
  Variant (39)..(40): xaa in position 39 to 40 is any amino acid
  Variant (41)..(41): xaa in position 41 is Ala, Ser, Gly, Val or Thr

SEQ ID NO: 68832 - protein, 65 aa, Artificial sequence; identical to SEQ ID NO: 2885
  Variant (2)..(2): xaa in position 2 is any amino acid
  Variant (4)..(4): xaa in position 4 is Asp, Tyr, Gln, Asn or Glu
  Variant (5)..(9): xaa in position 5 to 9 is any amino acid
  Variant (10)..(10): xaa in position 10 is Tyr, Phe or Leu
  Variant (11)..(12): xaa in position 11 to 12 is any amino acid
  Variant (13)..(13): xaa in position 13 is Asp or Glu
  Variant (14)..(15): xaa in position 14 to 15 is any amino acid
  Variant (16)..(16): xaa in position 16 is Ser, Ala, Thr or Cys
  Variant (17)..(17): xaa in position 17 is Trp, Phe, Tyr, Leu or Val
  Variant (18)..(18): xaa in position 18 is any amino acid
  Variant (19)..(19): xaa in position 19 is Ala or Ser
  Variant (20)..(20): xaa in position 20 is Ile or Val
  Variant (24)..(24): xaa in position 24 is Thr, Ser or Asn
  Variant (25)..(25): xaa in position 25 is Thr, Val, Ala, Ser or Ile
  Variant (26)..(26): xaa in position 26 is Glu or Ala
  Variant (27)..(27): xaa in position 27 is Ser, Asp or Asn
  Variant (29)..(29): xaa in position 29 is any amino acid
  Variant (32)..(32): xaa in position 32 is Glu, Gln, Phe or Met
  Variant (33)..(33): xaa in position 33 is Leu, Met, Val, Ile or Phe
  Variant (34)..(34): xaa in position 34 is Ala, Ser, Thr, Cys or Val
  Variant (36)..(36): xaa in position 36 is Gly, Ala or Asn
  Variant (37)..(39): xaa in position 37 to 39 is any amino acid
  Variant (40)..(40): xaa in position 40 is Pro or Ala
  Variant (41)..(41): xaa in position 41 is Val, Ile, Thr or Leu
  Variant (43)..(43): xaa in position 43 is Phe, Met, Tyr or Ile
  Variant (46)..(46): xaa in position 46 is any amino acid
  Variant (47)..(47): xaa in position 47 is Thr, Ser or Arg
  Variant (48)..(48): xaa in position 48 is any amino acid
  Variant (50)..(53): xaa in position 50 to 53 is any amino acid
  Variant (54)..(54): xaa in position 54 is Ala or Met
  Variant (55)..(55): xaa in position 55 is any amino acid
  Variant (56)..(56): xaa in position 56 is Asp, Asn or Glu
  Variant (57)..(57): xaa in position 57 is Ala or Gly
  Variant (58)..(59): xaa in position 58 to 59 is any amino acid
  Variant (60)..(60): xaa in position 60 is Ala or Ser
  Variant (61)..(61): xaa in position 61 is Ala, Ser, Val or Thr
  Variant (62)..(64): xaa in position 62 to 64 is any amino acid
  Variant (65)..(65): xaa in position 65 is His or Gln

SEQ ID NO: 68833 - protein, 71 aa, Artificial sequence; identical to SEQ ID NO: 2886
  Variant (1)..(1): xaa in position 1 is Thr or Ser
  Variant (2)..(2): xaa in position 2 is any amino acid
  Variant (5)..(7): xaa in position 5 to 7 is any amino acid
  Variant (8)..(8): xaa in position 8 is His or Phe
  Variant (9)..(9): xaa in position 9 is Val, Ile, Leu or Ala
  Variant (10)..(10): xaa in position 10 is Ile or Val
  Variant (11)..(11): xaa in position 11 is Leu or Met
  Variant (14)..(14): xaa in position 14 is Gly, Ser or Ala
  Variant (15)..(16): xaa in position 15 to 16 is any amino acid
  Variant (17)..(22): xaa in position 17 to 22 is any or no amino acid
  Variant (23)..(23): xaa in position 23 is Pro, Thr or Ser
  Variant (25)..(25): xaa in position 25 is Tyr, Phe or His
  Variant (26)..(29): xaa in position 26 to 29 is any amino acid
  Variant (30)..(30): xaa in position 30 is Val, Ile or Leu
  Variant (31)..(36): xaa in position 31 to 36 is any amino acid
  Variant (37)..(37): xaa in position 37 is Leu, Met, Ile, Tyr or His
  Variant (38)..(40): xaa in position 38 to 40 is any amino acid
  Variant (41)..(51): xaa in position 41 to 51 is any or no amino acid
  Variant (52)..(52): xaa in position 52 is Leu, Ile or Val
  Variant (53)..(53): xaa in position 53 is Met, Val, Ile or Leu
  Variant (54)..(54): xaa in position 54 is Ile or Val
  Variant (56)..(56): xaa in position 56 is Cys, Phe, Ala, Thr, Tyr or Val
  Variant (57)..(57): xaa in position 57 is Ser, Asn or Ala
  Variant (59)..(59): xaa in position 59 is Gly, Ala or Asp
  Variant (61)..(61): xaa in position 61 is Ser or Cys
  Variant (62)..(62): xaa in position 62 is any amino acid
  Variant (64)..(66): xaa in position 64 to 66 is any amino acid
  Variant (67)..(67): xaa in position 67 is Arg, Asn, Lys, Leu or Glu
  Variant (69)..(70): xaa in position 69 to 70 is any amino acid
  Variant (71)..(71): xaa in position 71 is Val or Ile

SEQ ID NO: 68834 - protein, 41 aa, Artificial sequence; identical to SEQ ID NO: 2887
  Variant (2)..(2): xaa in position 2 is any amino acid
  Variant (4)..(4): xaa in position 4 is Ile, Leu, Val, Ala or Met
  Variant (7)..(7): xaa in position 7 is His, Asn, Phe or Tyr
  Variant (8)..(8): xaa in position 8 is Leu or Ile
  Variant (9)..(10): xaa in position 9 to 10 is any amino acid
  Variant (12)..(12): xaa in position 12 is any amino acid
  Variant (14)..(19): xaa in position 14 to 19 is any amino acid
  Variant (20)..(30): xaa in position 20 to 30 is any or no amino acid
  Variant (32)..(32): xaa in position 32 is any amino acid
  Variant (34)..(34): xaa in position 34 is Ile or Val
  Variant (37)..(37): xaa in position 37 is Ala, Pro, Gly, Lys, Ser or Glu
  Variant (39)..(39): xaa in position 39 is Ile, Leu or Val
  Variant (40)..(40): xaa in position 40 is any amino acid
  Variant (41)..(41): xaa in position 41 is Trp, Ile, Leu or Phe

SEQ ID NO: 68835 - DNA, 900 bp, Escherichia coli; identical to SEQ ID NO: 49564
  CDS (1)..(900)

SEQ ID NO: 68836 - protein, 299 aa, Escherichia coli; identical to SEQ ID NO: 49565

SEQ ID NO: 68837 - DNA, 1005 bp, Xenopus tropicalis; identical to SEQ ID NO: 49566
  CDS (1)..(1005)

SEQ ID NO: 68838 - protein, 334 aa, Xenopus tropicalis; identical to SEQ ID NO: 49567

SEQ ID NO: 68839 - DNA, 858 bp, Archaeoglobus fulgidus DSM 4304; identical to SEQ ID NO: 49568
  CDS (1)..(858): transl_table=11

SEQ ID NO: 68840 - protein, 285 aa, Archaeoglobus fulgidus DSM 4304; identical to SEQ ID NO: 49569

SEQ ID NO: 68841 - DNA, 879 bp, Mesorhizobium loti MAFF303099; identical to SEQ ID NO: 49570
  CDS (1)..(879): transl_table=11

SEQ ID NO: 68842 - protein, 292 aa, Mesorhizobium loti MAFF303099; identical to SEQ ID NO: 49571

SEQ ID NO: 68843 - DNA, 843 bp, Thermoplasma volcanium GSS1; identical to SEQ ID NO: 49572
  CDS (1)..(843): transl_table=11

SEQ ID NO: 68844 - protein, 280 aa, Thermoplasma volcanium GSS1; identical to SEQ ID NO: 49573

SEQ ID NO: 68845 - DNA, 852 bp, Pyrococcus abyssi GE5; identical to SEQ ID NO: 49574
  CDS (1)..(852): transl_table=11

SEQ ID NO: 68846 - protein, 283 aa, Pyrococcus abyssi GE5; identical to SEQ ID NO: 49575

SEQ ID NO: 68847 - DNA, 873 bp, Pyrococcus horikoshii OT3; identical to SEQ ID NO: 49576
  CDS (1)..(873): transl_table=11

SEQ ID NO: 68848 - protein, 290 aa, Pyrococcus horikoshii OT3; identical to SEQ ID NO: 49577

SEQ ID NO: 68849 - DNA, 918 bp, Aeropyrum pernix K1; identical to SEQ ID NO: 49578
  CDS (1)..(918): transl_table=11

SEQ ID NO: 68850 - protein, 305 aa, Aeropyrum pernix K1; identical to SEQ ID NO: 49579

SEQ ID NO: 68851 - DNA, 720 bp, Clostridium acetobutylicum ATCC 824; identical to SEQ ID NO: 49580
  CDS (1)..(720): transl_table=11

SEQ ID NO: 68852 - protein, 239 aa, Clostridium acetobutylicum ATCC 824; identical to SEQ ID NO: 49581

SEQ ID NO: 68853 - DNA, 852 bp, Bacillus halodurans C-125; identical to SEQ ID NO: 49582
  CDS (1)..(852): transl_table=11

SEQ ID NO: 68854 - protein, 283 aa, Bacillus halodurans C-125; identical to SEQ ID NO: 49583

SEQ ID NO: 68855 - DNA, 909 bp, Pseudomonas aeruginosa PAO1; identical to SEQ ID NO: 49584
  CDS (1)..(909): transl_table=11

SEQ ID NO: 68856 - protein, 302 aa, Pseudomonas aeruginosa PAO1; identical to SEQ ID NO: 49585

SEQ ID NO: 68857 - DNA, 900 bp, Lactococcus lactis subsp. lactis Il1403; identical to SEQ ID NO: 49586
  CDS (1)..(900): transl_table=11

SEQ ID NO: 68858 - protein, 299 aa, Lactococcus lactis subsp. lactis Il1403; identical to SEQ ID NO: 49587

SEQ ID NO: 68859 - DNA, 921 bp, Neisseria meningitidis MC58; identical to SEQ ID NO: 49588
  CDS (1)..(921): transl_table=11

SEQ ID NO: 68860 - protein, 306 aa, Neisseria meningitidis MC58; identical to SEQ ID NO: 49589

SEQ ID NO: 68861 - DNA, 843 bp, Methanothermobacter thermautotrophicus str. Delta H; identical to SEQ ID NO: 49590
  CDS (1)..(843)

SEQ ID NO: 68862 - protein, 280 aa, Methanothermobacter thermautotrophicus str. Delta H; identical to SEQ ID NO: 49591

SEQ ID NO: 68863 - DNA, 864 bp, Neisseria meningitidis Z2491; identical to SEQ ID NO: 49592
  CDS (1)..(864): transl_table=11

SEQ ID NO: 68864 - protein, 287 aa, Neisseria meningitidis Z2491; identical to SEQ ID NO: 49593

SEQ ID NO: 68865 - DNA, 909 bp, Xylella fastidiosa 9a5c; identical to SEQ ID NO: 49594
  CDS (1)..(909): transl_table=11

SEQ ID NO: 68866 - protein, 302 aa, Xylella fastidiosa 9a5c; identical to SEQ ID NO: 49595

SEQ ID NO: 68867 - DNA, 915 bp, Mycobacterium tuberculosis CDC1551; identical to SEQ ID NO: 49596
  CDS (1)..(915): transl_table=11

SEQ ID NO: 68868 - protein, 304 aa, Mycobacterium tuberculosis CDC1551; identical to SEQ ID NO: 49597

SEQ ID NO: 68869 - DNA, 681 bp, Sulfolobus solfataricus P2; identical to SEQ ID NO: 49598
  CDS (1)..(681): transl_table=11

SEQ ID NO: 68870 - protein, 226 aa, Sulfolobus solfataricus P2; identical to SEQ ID NO: 49599

SEQ ID NO: 68871 - DNA, 843 bp, Clostridium acetobutylicum ATCC 824; identical to SEQ ID NO: 49600
  CDS (1)..(843): transl_table=11

SEQ ID NO: 68872 - protein, 280 aa, Clostridium acetobutylicum ATCC 824; identical to SEQ ID NO: 49601

SEQ ID NO: 68873 - DNA, 822 bp, Sulfolobus tokodaii str. 7; identical to SEQ ID NO: 49602
  CDS (1)..(822): transl_table=11

SEQ ID NO: 68874 - protein, 273 aa, Sulfolobus tokodaii str. 7; identical to SEQ ID NO: 49603

SEQ ID NO: 68875 - DNA, 903 bp, Caulobacter crescentus CB15; identical to SEQ ID NO: 49604
  CDS (1)..(903): transl_table=11

SEQ ID NO: 68876 - protein, 300 aa, Caulobacter crescentus CB15; identical to SEQ ID NO: 49605

SEQ ID NO: 68877 - DNA, 882 bp, Caulobacter crescentus CB15; identical to SEQ ID NO: 49606
  CDS (1)..(882): transl_table=11

SEQ ID NO: 68878 - protein, 293 aa, Caulobacter crescentus CB15; identical to SEQ ID NO: 49607

SEQ ID NO: 68879 - DNA, 903 bp, Sinorhizobium meliloti 1021; identical to SEQ ID NO: 49608
  CDS (1)..(903): transl_table=11

SEQ ID NO: 68880 - protein, 300 aa, Sinorhizobium meliloti 1021; identical to SEQ ID NO: 49609

SEQ ID NO: 68881 - DNA, 843 bp, Synechocystis sp. PCC 6803; identical to SEQ ID NO: 49610
  CDS (1)..(843): transl_table=11

SEQ ID NO: 68882 - protein, 280 aa, Synechocystis sp. PCC 6803; identical to SEQ ID NO: 49611

SEQ ID NO: 68883 - DNA, 831 bp, Listeria monocytogenes EGD-e; identical to SEQ ID NO: 49612
  CDS (1)..(831): transl_table=11

SEQ ID NO: 68884 - protein, 276 aa, Listeria monocytogenes EGD-e; identical to SEQ ID NO: 49613

SEQ ID NO: 68885 - DNA, 885 bp, Nostoc sp. PCC 7120; identical to SEQ ID NO: 49614
  CDS (1)..(885): transl_table=11

SEQ ID NO: 68886 - protein, 294 aa, Nostoc sp. PCC 7120; identical to SEQ ID NO: 49615

SEQ ID NO: 68887 - DNA, 918 bp, Ralstonia solanacearum GMI1000; identical to SEQ ID NO: 49616
  CDS (1)..(918): transl_table=11

SEQ ID NO: 68888 - protein, 305 aa, Ralstonia solanacearum GMI1000; identical to SEQ ID NO: 49617

SEQ ID NO: 68889 - DNA, 894 bp, Agrobacterium tumefaciens str. C58; identical to SEQ ID NO: 49618
  CDS (1)..(894): transl_table=11

SEQ ID NO: 68890 - protein, 297 aa, Agrobacterium tumefaciens str. C58; identical to SEQ ID NO: 49619

SEQ ID NO: 68891 - DNA, 885 bp, Clostridium perfringens str. 13; identical to SEQ ID NO: 49620
  CDS (1)..(885): transl_table=11

SEQ ID NO: 68892 - protein, 294 aa, Clostridium perfringens str. 13; identical to SEQ ID NO: 49621

SEQ ID NO: 68893 - DNA, 1362 bp, Corynebacterium glutamicum ATCC 13032; identical to SEQ ID NO: 49622
  CDS (1)..(1362): transl_table=11

SEQ ID NO: 68894 - protein, 453 aa, Corynebacterium glutamicum ATCC 13032; identical to SEQ ID NO: 49623

SEQ ID NO: 68895 - DNA, 855 bp, Streptococcus pyogenes MGAS8232; identical to SEQ ID NO: 49624
  CDS (1)..(855): transl_table=11

SEQ ID NO: 68896 - protein, 284 aa, Streptococcus pyogenes MGAS8232; identical to SEQ ID NO: 49625

SEQ ID NO: 68897 - DNA, 810 bp, Methanosarcina mazei Go1; identical to SEQ ID NO: 49626
  CDS (1)..(810): transl_table=11

SEQ ID NO: 68898 - protein, 269 aa, Methanosarcina mazei Go1; identical to SEQ ID NO: 49627

SEQ ID NO: 68899 - DNA, 909 bp, Xanthomonas campestris pv. campestris str. ATCC 33913; identical to SEQ ID NO: 49628
  CDS (1)..(909): transl_table=11

SEQ ID NO: 68900 - protein, 302 aa, Xanthomonas campestris pv. campestris str. ATCC 33913; identical to SEQ ID NO: 49629

SEQ ID NO: 68901 - DNA, 900 bp, Xanthomonas axonopodis pv. citri str. 306; identical to SEQ ID NO: 49630
  CDS (1)..(900): transl_table=11

SEQ ID NO: 68902 - protein, 299 aa, Xanthomonas axonopodis pv. citri str. 306; identical to SEQ ID NO: 49631

SEQ ID NO: 68903 - DNA, 879 bp, Chlorobium tepidum TLS; identical to SEQ ID NO: 49632
  CDS (1)..(879): transl_table=11

SEQ ID NO: 68904 - protein, 292 aa, Chlorobium tepidum TLS; identical to SEQ ID NO: 49633

SEQ ID NO: 68905 - DNA, 915 bp, Thermosynechococcus elongatus BP-1; identical to SEQ ID NO: 49634
  CDS (1)..(915): transl_table=11

SEQ ID NO: 68906 - protein, 304 aa, Thermosynechococcus elongatus BP-1; identical to SEQ ID NO: 49635

SEQ ID NO: 68907 - DNA, 855 bp, Streptococcus agalactiae 2603V/R; identical to SEQ ID NO: 49636
  CDS (1)..(855): transl_table=11

SEQ ID NO: 68908 - protein, 284 aa, Streptococcus agalactiae 2603V/R; identical to SEQ ID NO: 49637

SEQ ID NO: 68909 - DNA, 849 bp, Oceanobacillus iheyensis HTE831; identical to SEQ ID NO: 49638
  CDS (1)..(849): transl_table=11

SEQ ID NO: 68910 - protein, 282 aa, Oceanobacillus iheyensis HTE831; identical to SEQ ID NO: 49639

SEQ ID NO: 68911 - DNA, 1443 bp, Bifidobacterium longum NCC2705; identical to SEQ ID NO: 49640
  CDS (1)..(1443): transl_table=11

SEQ ID NO: 68912 - protein, 480 aa, Bifidobacterium longum NCC2705; identical to SEQ ID NO: 49641

SEQ ID NO: 68913 - DNA, 921 bp, Leptospira interrogans serovar Lai str. 56601; identical to SEQ ID NO: 49642
  CDS (1)..(921): transl_table=11

SEQ ID NO: 68914 - protein, 306 aa, Leptospira interrogans serovar Lai str. 56601; identical to SEQ ID NO: 49643

SEQ ID NO: 68915 - DNA, 987 bp, Shewanella oneidensis MR-1; identical to SEQ ID NO: 49644
  CDS (1)..(987): transl_table=11

SEQ ID NO: 68916 - protein, 328 aa, Shewanella oneidensis MR-1; identical to SEQ ID NO: 49645

SEQ ID NO: 68917 - DNA, 921 bp, Shewanella oneidensis MR-1; identical to SEQ ID NO: 49646
  CDS (1)..(921): transl_table=11

SEQ ID NO: 68918 - protein, 306 aa, Shewanella oneidensis MR-1; identical to SEQ ID NO: 49647

SEQ ID NO: 68919 - DNA, 855 bp, Streptococcus mutans UA159; identical to SEQ ID NO: 49648
  CDS (1)..(855): transl_table=11

SEQ ID NO: 68920 - protein, 284 aa, Streptococcus mutans UA159; identical to SEQ ID NO: 49649

SEQ ID NO: 68921 - DNA, 855 bp, Streptococcus agalactiae NEM316; identical to SEQ ID NO: 49650
  CDS (1)..(855): transl_table=11

SEQ ID NO: 68922 - protein, 284 aa, Streptococcus agalactiae NEM316; identical to SEQ ID NO: 49651

SEQ ID NO: 68923 - DNA, 1380 bp, Corynebacterium efficiens YS-314; identical to SEQ ID NO: 49652
  CDS (1)..(1380): transl_table=11

SEQ ID NO: 68924 - protein, 459 aa, Corynebacterium efficiens YS-314; identical to SEQ ID NO: 49653

SEQ ID NO: 68925 - DNA, 903 bp, Pseudomonas putida KT2440; identical to SEQ ID NO: 49654
  CDS (1)..(903): transl_table=11

SEQ ID NO: 68926 - protein, 300 aa, Pseudomonas putida KT2440; identical to SEQ ID NO: 49655

SEQ ID NO: 68927 - DNA, 909 bp, Xylella fastidiosa Temecula1; identical to SEQ ID NO: 49656
  CDS (1)..(909): transl_table=11

SEQ ID NO: 68928 - protein, 302 aa, Xylella fastidiosa Temecula1; identical to SEQ ID NO: 49657

SEQ ID NO: 68929 - DNA, 843 bp, Lactobacillus plantarum WCFS1; identical to SEQ ID NO: 49658
  CDS (1)..(843): transl_table=11

SEQ ID NO: 68930 - protein, 280 aa, Lactobacillus plantarum WCFS1; identical to SEQ ID NO: 49659

SEQ ID NO: 68931 - DNA, 864 bp, Tropheryma whipplei str. Twist; identical to SEQ ID NO: 49660
  CDS (1)..(864): transl_table=11

SEQ ID NO: 68932 - protein, 287 aa, Tropheryma whipplei str. Twist; identical to SEQ ID NO: 49661

SEQ ID NO: 68933 - DNA, 906 bp, Pseudomonas syringae pv. tomato str. DC3000; identical to SEQ ID NO: 49662
  CDS (1)..(906): transl_table=11

SEQ ID NO: 68934 - protein, 301 aa, Pseudomonas syringae pv. tomato str. DC3000; identical to SEQ ID NO: 49663

SEQ ID NO: 68935 - DNA, 855 bp, Streptococcus pyogenes SSI-1; identical to SEQ ID NO: 49664
  CDS (1)..(855): transl_table=11

SEQ ID NO: 68936 - protein, 284 aa, Streptococcus pyogenes SSI-1; identical to SEQ ID NO: 49665

SEQ ID NO: 68937 - DNA, 855 bp, Bacteroides thetaiotaomicron VPI-5482; identical to SEQ ID NO: 49666
  CDS (1)..(855): transl_table=11

SEQ ID NO: 68938 - protein, 284 aa, Bacteroides thetaiotaomicron VPI-5482; identical to SEQ ID NO: 49667

SEQ ID NO: 68939 - DNA, 909 bp, Bacteroides thetaiotaomicron VPI-5482; identical to SEQ ID NO: 49668
  CDS (1)..(909): transl_table=11

SEQ ID NO: 68940 - protein, 302 aa, Bacteroides thetaiotaomicron VPI-5482; identical to SEQ ID NO: 49669

SEQ ID NO: 68941 - DNA, 849 bp, Bacteroides thetaiotaomicron VPI-5482; identical to SEQ ID NO: 49670
  CDS (1)..(849): transl_table=11

SEQ ID NO: 68942 - protein, 282 aa, Bacteroides thetaiotaomicron VPI-5482; identical to SEQ ID NO: 49671

SEQ ID NO: 68943 - DNA, 900 bp, Enterococcus faecalis V583; identical to SEQ ID NO: 49672
  CDS (1)..(900): transl_table=11

SEQ ID NO: 68944 - protein, 299 aa, Enterococcus faecalis V583; identical to SEQ ID NO: 49673

SEQ ID NO: 68945 - DNA, 855 bp, Bacillus cereus ATCC 14579; identical to SEQ ID NO: 49674
  CDS (1)..(855): transl_table=11

SEQ ID NO: 68946 - protein, 284 aa, Bacillus cereus ATCC 14579; identical to SEQ ID NO: 49675

SEQ ID NO: 68947 - DNA, 915 bp, Nitrosomonas europaea ATCC 19718; identical to SEQ ID NO: 49676
  CDS (1)..(915): transl_table=11

SEQ ID NO: 68948 - protein, 304 aa, Nitrosomonas europaea ATCC 19718; identical to SEQ ID NO: 49677

SEQ ID NO: 68949 - DNA, 855 bp, Bacillus anthracis str. Ames; identical to SEQ ID NO: 49678
  CDS (1)..(855): transl_table=11

SEQ ID NO: 68950 - protein, 284 aa, Bacillus anthracis str. Ames; identical to SEQ ID NO: 49679

SEQ ID NO: 68951 - DNA, 849 bp, Ruegeria sp. PR1b; identical to SEQ ID NO: 49680
  CDS (1)..(849): transl_table=11

SEQ ID NO: 68952 - protein, 282 aa, Ruegeria sp. PR1b; identical to SEQ ID NO: 49681

SEQ ID NO: 68953 - DNA, 897 bp, Bordetella pertussis Tohama I; identical to SEQ ID NO: 49682
  CDS (1)..(897): transl_table=11

SEQ ID NO: 68954 - protein, 298 aa, Bordetella pertussis Tohama I; identical to SEQ ID NO: 49683

SEQ ID NO: 68955 - DNA, 906 bp, Prochlorococcus marinus str. MIT 9313; identical to SEQ ID NO: 49684
  CDS (1)..(906): transl_table=11

SEQ ID NO: 68956 - protein, 301 aa, Prochlorococcus marinus str. MIT 9313; identical to SEQ ID NO: 49685

SEQ ID NO: 68957 - DNA, 909 bp, Synechococcus sp. WH 8102; identical to SEQ ID NO: 49686
  CDS (1)..(909): transl_table=11

SEQ ID NO: 68958 - protein, 302 aa, Synechococcus sp. WH 8102; identical to SEQ ID NO: 49687

SEQ ID NO: 68959 - DNA, 933 bp, Chromobacterium violaceum ATCC 12472; identical to SEQ ID NO: 49688
  CDS (1)..(933): transl_table=11

SEQ ID NO: 68960 - protein, 310 aa, Chromobacterium violaceum ATCC 12472; identical to SEQ ID NO: 49689

SEQ ID NO: 68961 - DNA, 858 bp, Porphyromonas gingivalis W83; identical to SEQ ID NO: 49690
  CDS (1)..(858): transl_table=11

SEQ ID NO: 68962 - protein, 285 aa, Porphyromonas gingivalis W83; identical to SEQ ID NO: 49691

SEQ ID NO: 68963 - DNA, 903 bp, Gloeobacter violaceus PCC 7421; identical to SEQ ID NO: 49692
  CDS (1)..(903): transl_table=11

SEQ ID NO: 68964 - protein, 300 aa, Gloeobacter violaceus PCC 7421; identical to SEQ ID NO: 49693

SEQ ID NO: 68965 - DNA, 882 bp, Vibrio vulnificus YJ016; identical to SEQ ID NO: 49694
  CDS (1)..(882): transl_table=11

SEQ ID NO: 68966 - protein, 293 aa, Vibrio vulnificus YJ016; identical to SEQ ID NO: 49695

SEQ ID NO: 68967 - DNA, 1347 bp, Corynebacterium diphtheriae NCTC 13129; identical to SEQ ID NO: 49696
  CDS (1)..(1347): transl_table=11

SEQ ID NO: 68968 - protein, 448 aa, Corynebacterium diphtheriae NCTC 13129; identical to SEQ ID NO: 49697

SEQ ID NO: 68969 - DNA, 894 bp, Rhodopseudomonas palustris CGA009; identical to SEQ ID NO: 49698
  CDS (1)..(894): transl_table=11

SEQ ID NO: 68970 - protein, 297 aa, Rhodopseudomonas palustris CGA009; identical to SEQ ID NO: 49699

SEQ ID NO: 68971 - DNA, 843 bp, Geobacter sulfurreducens PCA; identical to SEQ ID NO: 49700
  CDS (1)..(843): transl_table=11

SEQ ID NO: 68972 - protein, 280 aa, Geobacter sulfurreducens PCA; identical to SEQ ID NO: 49701

SEQ ID NO: 68973 - DNA, 924 bp, Mycobacterium avium subsp. paratuberculosis K-10; identical to SEQ ID NO: 49702
  CDS (1)..(924): transl_table=11

SEQ ID NO: 68974 - protein, 307 aa, Mycobacterium avium subsp. paratuberculosis K-10; identical to SEQ ID NO: 49703

SEQ ID NO: 68975 - DNA, 987 bp, Lactobacillus johnsonii NCC 533; identical to SEQ ID NO: 49704
  CDS (1)..(987): transl_table=11

SEQ ID NO: 68976 - protein, 328 aa, Lactobacillus johnsonii NCC 533; identical to SEQ ID NO: 49705

SEQ ID NO: 68977 - DNA, 921 bp, Leptospira interrogans serovar Copenhageni str. Fiocruz L1-130; identical to SEQ ID NO: 49706
  CDS (1)..(921): transl_table=11

SEQ ID NO: 68978 - protein, 306 aa, Leptospira interrogans serovar Copenhageni str. Fiocruz L1-130; identical to SEQ ID NO: 49707

SEQ ID NO: 68979 - DNA, 885 bp, Parachlamydia sp. UWE25; identical to SEQ ID NO: 49708
  CDS (1)..(885): transl_table=11

SEQ ID NO: 68980 - protein, 294 aa, Parachlamydia sp. UWE25; identical to SEQ ID NO: 49709

SEQ ID NO: 68981 - DNA, 876 bp, Desulfovibrio vulgaris subsp. vulgaris str. Hildenborough; identical to SEQ ID NO: 49710
  CDS (1)..(876): transl_table=11

SEQ ID NO: 68982 - protein, 291 aa, Desulfovibrio vulgaris subsp. vulgaris str. Hildenborough; identical to SEQ ID NO: 49711

SEQ ID NO: 68983 - DNA, 810 bp, Picrophilus torridus DSM 9790; identical to SEQ ID NO: 49712
  CDS (1)..(810): transl_table=11

SEQ ID NO: 68984 - protein, 269 aa, Picrophilus torridus DSM 9790; identical to SEQ ID NO: 49713

SEQ ID NO: 68985 - DNA, 909 bp, Acinetobacter sp. ADP1; identical to SEQ ID NO: 49714
  CDS (1)..(909): transl_table=11

SEQ ID NO: 68986 - protein, 302 aa, Acinetobacter sp. ADP1; identical to SEQ ID NO: 49715

SEQ ID NO: 68987 - DNA, 852 bp, Erwinia carotovora subsp. atroseptica SCRI1043; identical to SEQ ID NO: 49716
  CDS (1)..(852): transl_table=11

SEQ ID NO: 68988 - protein, 283 aa, Erwinia carotovora subsp. atroseptica SCRI1043; identical to SEQ ID NO: 49717

SEQ ID NO: 68989 - DNA, 855 bp, Streptococcus pyogenes MGAS10394; identical to SEQ ID NO: 49718
  CDS (1)..(855): transl_table=11

SEQ ID NO: 68990 - protein, 284 aa, Streptococcus pyogenes MGAS10394; identical to SEQ ID NO: 49719

SEQ ID NO: 68991 - DNA, 888 bp, Leifsonia xyli subsp. xyli str. CTCB07; identical to SEQ ID NO: 49720
  CDS (1)..(888): transl_table=11

SEQ ID NO: 68992 - protein, 295 aa, Leifsonia xyli subsp. xyli str. CTCB07; identical to SEQ ID NO: 49721

SEQ ID NO: 68993 - DNA, 855 bp, Bacillus cereus E33L; identical to SEQ ID NO: 49722
  CDS (1)..(855): transl_table=11

SEQ ID NO: 68994 - protein, 284 aa, Bacillus cereus E33L; identical to SEQ ID NO: 49723

SEQ ID NO: 68995 - DNA, 885 bp, Legionella pneumophila subsp. pneumophila str. Philadelphia 1; identical to SEQ ID NO: 49724
  CDS (1)..(885): transl_table=11

SEQ ID NO: 68996 - protein, 294 aa, Legionella pneumophila subsp. pneumophila str. Philadelphia 1; identical to SEQ ID NO: 49725

SEQ ID NO: 68997 - DNA, 891 bp, Bacteroides fragilis YCH46; identical to SEQ ID NO: 49726
  CDS (1)..(891): transl_table=11

SEQ ID NO: 68998 - protein, 296 aa, Bacteroides fragilis YCH46; identical to SEQ ID NO: 49727

SEQ ID NO: 68999 - DNA, 897 bp, Burkholderia mallei ATCC 23344; identical to SEQ ID NO: 49728
  CDS (1)..(897): transl_table=11

SEQ ID NO: 69000 - protein, 298 aa, Burkholderia mallei ATCC 23344; identical to SEQ ID NO: 49729

SEQ ID NO: 69001 - DNA, 906 bp, Methylococcus capsulatus str. Bath; identical to SEQ ID NO: 49730
  CDS (1)..(906): transl_table=11

SEQ ID NO: 69002 - protein, 301 aa, Methylococcus capsulatus str. Bath; identical to SEQ ID NO: 49731

SEQ ID NO: 69003 - DNA, 858 bp, Nocardia farcinica IFM 10152; identical to SEQ ID NO: 49732
  CDS (1)..(858): transl_table=11

SEQ ID NO: 69004 - protein, 285 aa, Nocardia farcinica IFM 10152; identical to SEQ ID NO: 49733

SEQ ID NO: 69005 - DNA, 885 bp, Legionella pneumophila str. Lens; identical to SEQ ID NO: 49734
  CDS (1)..(885): transl_table=11

SEQ ID NO: 69006 - protein, 294 aa, Legionella pneumophila str. Lens; identical to SEQ ID NO: 49735

SEQ ID NO: 69007 - DNA, 873 bp, Streptococcus thermophilus LMG 18311; identical to SEQ ID NO: 49736
  CDS (1)..(873): transl_table=11

SEQ ID NO: 69008 - protein, 290 aa, Streptococcus thermophilus LMG 18311; identical to SEQ ID NO: 49737

SEQ ID NO: 69009 - DNA, 897 bp, Azoarcus sp. EbN1; identical to SEQ ID NO: 49738
  CDS (1)..(897): transl_table=11

SEQ ID NO: 69010 - protein, 298 aa, Azoarcus sp. EbN1; identical to SEQ ID NO: 49739

SEQ ID NO: 69011 - DNA, 870 bp, Synechococcus elongatus PCC 6301; identical to SEQ ID NO: 49740
  CDS (1)..(870): transl_table=11

SEQ ID NO: 69012 - protein, 289 aa, Synechococcus elongatus PCC 6301; identical to SEQ ID NO: 49741

SEQ ID NO: 69013 - DNA, 894 bp, Gluconobacter oxydans 621H; identical to SEQ ID NO: 49742
  CDS (1)..(894): transl_table=11

SEQ ID NO: 69014 - protein, 297 aa, Gluconobacter oxydans 621H; identical to SEQ ID NO: 49743

SEQ ID NO: 69015 - DNA, 909 bp, Xanthomonas oryzae pv. oryzae KACC10331; identical to SEQ ID NO: 49744
  CDS (1)..(909): transl_table=11

SEQ ID NO: 69016 - protein, 302 aa, Xanthomonas oryzae pv. oryzae KACC10331; identical to SEQ ID NO: 49745

SEQ ID NO: 69017 - DNA, 864 bp, Neisseria gonorrhoeae FA 1090; identical to SEQ ID NO: 49746
  CDS (1)..(864): transl_table=11

SEQ ID NO: 69018 - protein, 287 aa, Neisseria gonorrhoeae FA 1090; identical to SEQ ID NO: 49747

SEQ ID NO: 69019 - DNA, 864 bp, Bacteroides fragilis NCTC 9343; identical to SEQ ID NO: 49748
  CDS (1)..(864): transl_table=11

SEQ ID NO: 69020 - protein, 287 aa, Bacteroides fragilis NCTC 9343; identical to SEQ ID NO: 49749

SEQ ID NO: 69021 - DNA, 891 bp, Bacteroides fragilis NCTC 9343; identical to SEQ ID NO: 49750
  CDS (1)..(891): transl_table=11

SEQ ID NO: 69022 - protein, 296 aa, Bacteroides fragilis NCTC 9343; identical to SEQ ID NO: 49751

SEQ ID NO: 69023 - DNA, 849 bp, Sulfolobus acidocaldarius DSM 639; identical to SEQ ID NO: 49752
  CDS (1)..(849): transl_table=11

SEQ ID NO: 69024 - protein, 282 aa, Sulfolobus acidocaldarius DSM 639; identical to SEQ ID NO: 49753

SEQ ID NO: 69025 - DNA, 852 bp, Rhodobacter sphaeroides 2.4.1; identical to SEQ ID NO: 49754
  CDS (1)..(852)

SEQ ID NO: 69026 - protein, 283 aa, Rhodobacter sphaeroides 2.4.1; identical to SEQ ID NO: 49755

SEQ ID NO: 69027 - DNA, 891 bp, Nostoc punctiforme PCC 73102; identical to SEQ ID NO: 49756
  CDS (1)..(891)

SEQ ID NO: 69028 - protein, 296 aa, Nostoc punctiforme PCC 73102; identical to SEQ ID NO: 49757

SEQ ID NO: 69029 - DNA, 1452 bp, Bifidobacterium longum DJO10A; identical to SEQ ID NO: 49758
  CDS (1)..(1452)

SEQ ID NO: 69030 - protein, 483 aa, Bifidobacterium longum DJO10A; identical to SEQ ID NO: 49759

SEQ ID NO: 69031 - DNA, 909 bp, Pseudomonas aeruginosa UCBPP-PA14; identical to SEQ ID NO: 49760
  CDS (1)..(909)

SEQ ID NO: 69032 - protein, 302 aa, Pseudomonas aeruginosa UCBPP-PA14; identical to SEQ ID NO: 49761

SEQ ID NO: 69033 - DNA, 894 bp, Fusobacterium nucleatum subsp. vincentii ATCC 49256; identical to SEQ ID NO: 49762
  CDS (1)..(894): transl_table=11

SEQ ID NO: 69034 - protein, 297 aa, Fusobacterium nucleatum subsp. vincentii ATCC 49256; identical to SEQ ID NO: 49763

SEQ ID NO: 69035 - DNA, 891 bp, Anabaena variabilis ATCC 29413; identical to SEQ ID NO: 49764
  CDS (1)..(891)

SEQ ID NO: 69036 - protein, 296 aa, Anabaena variabilis ATCC 29413; identical to SEQ ID NO: 49765

SEQ ID NO: 69037 - DNA, 915 bp, Ralstonia eutropha JMP134; identical to SEQ ID NO: 49766
  CDS (1)..(915)

SEQ ID NO: 69038 - protein, 304 aa, Ralstonia eutropha JMP134; identical to SEQ ID NO: 49767

SEQ ID NO: 69039 - DNA, 897 bp, Rubrivivax gelatinosus PM1; identical to SEQ ID NO: 49768
  CDS (1)..(897)

SEQ ID NO: 69040 - protein, 298 aa, Rubrivivax gelatinosus PM1; identical to SEQ ID NO: 49769

SEQ ID NO: 69041 - DNA, 837 bp, Burkholderia fungorum LB400; identical to SEQ ID NO: 49770
  CDS (1)..(837)

SEQ ID NO: 69042 - protein, 278 aa, Burkholderia fungorum LB400; identical to SEQ ID NO: 49771

SEQ ID NO: 69043 - DNA, 906 bp, Psychrobacter sp. 273-4; identical to SEQ ID NO: 49772
  CDS (1)..(906)

SEQ ID NO: 69044 - protein, 301 aa, Psychrobacter sp. 273-4; identical to SEQ ID NO: 49773

SEQ ID NO: 69045 - DNA, 900 bp, Azotobacter vinelandii AvOP; identical to SEQ ID NO: 49774
  CDS (1)..(900): transl_table=11

SEQ ID NO: 69046 - protein, 299 aa, Azotobacter vinelandii AvOP; identical to SEQ ID NO: 49775

SEQ ID NO: 69047 - DNA, 885 bp, Burkholderia vietnamiensis G4; identical to SEQ ID NO: 49776
  CDS (1)..(885): transl_table=11

SEQ ID NO: 69048 - protein, 294 aa, Burkholderia vietnamiensis G4; identical to SEQ ID NO: 49777

SEQ ID NO: 69049 - DNA, 900 bp, Burkholderia cenocepacia AU 1054; identical to SEQ ID NO: 49778
  CDS (1)..(900): transl_table=11

SEQ ID NO: 69050 - protein, 299 aa, Burkholderia cenocepacia AU 1054; identical to SEQ ID NO: 49779

SEQ ID NO: 69051 - DNA, 975 bp, Polaromonas sp. JS666; identical to SEQ ID NO: 49780
  CDS (1)..(975): transl_table=11

SEQ ID NO: 69052 - protein, 324 aa, Polaromonas sp. JS666; identical to SEQ ID NO: 49781

SEQ ID NO: 69053 - DNA, 897 bp, Frankia sp. CcI3; identical to SEQ ID NO: 49782
  CDS (1)..(897): transl_table=11

SEQ ID NO: 69054 - protein, 298 aa, Frankia sp. CcI3; identical to SEQ ID NO: 49783

SEQ ID NO: 69055 - DNA, 810 bp, Methanococcoides burtonii DSM 6242; identical to SEQ ID NO: 49784
  CDS (1)..(810): transl_table=11

SEQ ID NO: 69056 - protein, 269 aa, Methanococcoides burtonii DSM 6242; identical to SEQ ID NO: 49785

SEQ ID NO: 69057 - DNA, 876 bp, Shewanella baltica OS155; identical to SEQ ID NO: 49786
  CDS (1)..(876): transl_table=11

SEQ ID NO: 69058 - protein, 291 aa, Shewanella baltica OS155; identical to SEQ ID NO: 49787

SEQ ID NO: 69059 - DNA, 906 bp, Shewanella amazonensis SB2B; identical to SEQ ID NO: 49788
  CDS (1)..(906): transl_table=11

SEQ ID NO: 69060 - protein, 301 aa, Shewanella amazonensis SB2B; identical to SEQ ID NO: 49789

SEQ ID NO: 69061 - DNA, 879 bp, Pelodictyon phaeoclathratiforme BU-1; identical to SEQ ID NO: 49790
  CDS (1)..(879): transl_table=11

SEQ ID NO: 69062 - protein, 292 aa, Pelodictyon phaeoclathratiforme BU-1; identical to SEQ ID NO: 49791

SEQ ID NO: 69063 - DNA, 921 bp, Ralstonia metallidurans CH34; identical to SEQ ID NO: 49792
  CDS (1)..(921): transl_table=11

SEQ ID NO: 69064 - protein, 306 aa, Ralstonia metallidurans CH34; identical to SEQ ID NO: 49793

SEQ ID NO: 69065 - DNA, 888 bp, Mesorhizobium sp. BNC1; identical to SEQ ID NO: 49794
  CDS (1)..(888): transl_table=11

SEQ ID NO: 69066 - protein, 295 aa, Mesorhizobium sp. BNC1; identical to SEQ ID NO: 49795

SEQ ID NO: 69067 - DNA, 915 bp, Nitrobacter hamburgensis X14; identical to SEQ ID NO: 49796
  CDS (1)..(915): transl_table=11

SEQ ID NO: 69068 - protein, 304 aa, Nitrobacter hamburgensis X14; identical to SEQ ID NO: 49797

SEQ ID NO: 69069 - DNA, 855 bp, Streptococcus mutans; identical to SEQ ID NO: 49798
  CDS (1)..(855): transl_table=11

SEQ ID NO: 69070 - protein, 284 aa, Streptococcus mutans; identical to SEQ ID NO: 49799

SEQ ID NO: 69071 - DNA, 867 bp, Serratia marcescens; identical to SEQ ID NO: 49800
  CDS (1)..(867): transl_table=11

SEQ ID NO: 69072 - protein, 288 aa, Serratia marcescens; identical to SEQ ID NO: 49801

SEQ ID NO: 69073 - DNA, 885 bp, Actinobacillus actinomycetemcomitans; identical to SEQ ID NO: 49802
  CDS (1)..(885): transl_table=11

SEQ ID NO: 69074 - protein, 294 aa, Actinobacillus actinomycetemcomitans; identical to SEQ ID NO: 49803

SEQ ID NO: 69075 - DNA, 918 bp, Streptomyces glaucescens; identical to SEQ ID NO: 49804
  CDS (1)..(918): transl_table=11

SEQ ID NO: 69076 - protein, 305 aa, Streptomyces glaucescens; identical to SEQ ID NO: 49805

SEQ ID NO: 69077 - DNA, 900 bp, Enterococcus faecalis; identical to SEQ ID NO: 49806
  CDS (1)..(900): transl_table=11

SEQ ID NO: 69078 - protein, 299 aa, Enterococcus faecalis; identical to SEQ ID NO: 49807

SEQ ID NO: 69079 - DNA, 867 bp, Sphingomonas sp; identical to SEQ ID NO: 49808
  CDS (1)..(867): transl_table=11

SEQ ID NO: 69080 - protein, 288 aa, Sphingomonas sp; identical to SEQ ID NO: 49809

SEQ ID NO: 69081 - DNA, 828 bp, Rhizobium meliloti; identical to SEQ ID NO: 49810
  CDS (1)..(828): transl_table=11

SEQ ID NO: 69082 - protein, 275 aa, Rhizobium meliloti; identical to SEQ ID NO: 49811

SEQ ID NO: 69083 - DNA, 891 bp, Azorhizobium caulinodans; identical to SEQ ID NO: 49812
  CDS (1)..(891): transl_table=11

SEQ ID NO: 69084 - protein, 296 aa, Azorhizobium caulinodans; identical to SEQ ID NO: 49813

SEQ ID NO: 69085 - DNA, 852 bp, Streptococcus pneumoniae; identical to SEQ ID NO: 49814
  CDS (1)..(852): transl_table=11

SEQ ID NO: 69086 - protein, 283 aa, Streptococcus pneumoniae; identical to SEQ ID NO: 49815

SEQ ID NO: 69087 - DNA, 852 bp, Streptococcus pneumoniae; identical to SEQ ID NO: 49816
  CDS (1)..(852): transl_table=11

SEQ ID NO: 69088 - protein, 283 aa, Streptococcus pneumoniae; identical to SEQ ID NO: 49817

SEQ ID NO: 69089 - DNA, 882 bp, Pseudomonas fluorescens; identical to SEQ ID NO: 49818
  CDS (1)..(882): transl_table=11

SEQ ID NO: 69090 - protein, 293 aa, Pseudomonas fluorescens; identical to SEQ ID NO: 49819

SEQ ID NO: 69091 - DNA, 1005 bp, Xenopus laevis; identical to SEQ ID NO: 49820
  CDS (1)..(1005)

SEQ ID NO: 69092 - protein, 334 aa, Xenopus laevis; identical to SEQ ID NO: 49821

SEQ ID NO: 69093 - DNA, 900 bp, Shigella boydii; identical to SEQ ID NO: 49822
  CDS (1)..(900): transl_table=11

SEQ ID NO: 69094 - protein, 299 aa, Shigella boydii; identical to SEQ ID NO: 49823

SEQ ID NO: 69095 - DNA, 915 bp, Streptomyces griseus subsp; identical to SEQ ID NO: 49824
  CDS (1)..(915): transl_table=11

SEQ ID NO: 69096 - protein, 304 aa, Streptomyces griseus subsp; identical to SEQ ID NO: 49825

SEQ ID NO: 69097 - DNA, 924 bp, Saccharopolyspora erythraea; identical to SEQ ID NO: 49826
  CDS (1)..(924): transl_table=11

SEQ ID NO: 69098 - protein, 307 aa, Saccharopolyspora erythraea; identical to SEQ ID NO: 49827

SEQ ID NO: 69099 - DNA, 909 bp, Xanthomonas campestris pv; identical to SEQ ID NO: 49828
  CDS (1)..(909): transl_table=11

SEQ ID NO: 69100 - protein, 302 aa, Xanthomonas campestris pv; identical to SEQ ID NO: 49829

SEQ ID NO: 69101 - DNA, 870 bp, Yersinia enterocolitica; identical to SEQ ID NO: 49830
  CDS (1)..(870): transl_table=11

SEQ ID NO: 69102 - protein, 289 aa, Yersinia enterocolitica; identical to SEQ ID NO: 49831

SEQ ID NO: 69103 - DNA, 843 bp, Lactobacillus rhamnosus; identical to SEQ ID NO: 49832
  CDS (1)..(843): transl_table=11

SEQ ID NO: 69104 - protein, 280 aa, Lactobacillus rhamnosus; identical to SEQ ID NO: 49833

SEQ ID NO: 69105 - DNA, 843 bp, Lactobacillus rhamnosus; identical to SEQ ID NO: 49834
  CDS (1)..(843): transl_table=11

SEQ ID NO: 69106 - protein, 280 aa, Lactobacillus rhamnosus; identical to SEQ ID NO: 49835

SEQ ID NO: 69107 - DNA, 843 bp, Lactobacillus rhamnosus; identical to SEQ ID NO: 49836
  CDS (1)..(843): transl_table=11

SEQ ID NO: 69108 - protein, 280 aa, Lactobacillus rhamnosus; identical to SEQ ID NO: 49837

SEQ ID NO: 69109 - DNA, 912 bp, Acetobacter tropicalis; identical to SEQ ID NO: 49838
  CDS (1)..(912): transl_table=11

SEQ ID NO: 69110 - protein, 303 aa, Acetobacter tropicalis; identical to SEQ ID NO: 49839

SEQ ID NO: 69111 - DNA, 900 bp, Escherichia coli; identical to SEQ ID NO: 49840
  CDS (1)..(900): transl_table=11

SEQ ID NO: 69112 - protein, 299 aa, Escherichia coli; identical to SEQ ID NO: 49841

SEQ ID NO: 69113 - DNA, 900 bp, Shigella dysenteriae; identical to SEQ ID NO: 49842
  CDS (1)..(900): transl_table=11

SEQ ID NO: 69114 - protein, 299 aa, Shigella dysenteriae; identical to SEQ ID NO: 49843

SEQ ID NO: 69115 - DNA, 963 bp, Mus musculus; identical to SEQ ID NO: 49844
  CDS (1)..(963)

SEQ ID NO: 69116 - protein, 320 aa, Mus musculus; identical to SEQ ID NO: 49845

SEQ ID NO: 69117 - DNA, 879 bp, Yersinia enterocolitica; identical to SEQ ID NO: 49846
  CDS (1)..(879): transl_table=11

SEQ ID NO: 69118 - protein, 292 aa, Yersinia enterocolitica; identical to SEQ ID NO: 49847

SEQ ID NO: 69119 - DNA, 855 bp, Streptococcus oralis; identical to SEQ ID NO: 49848
  CDS (1)..(855): transl_table=11

SEQ ID NO: 69120 - protein, 284 aa, Streptococcus oralis; identical to SEQ ID NO: 49849

SEQ ID NO: 69121 - DNA, 900 bp, Shigella boydii; identical to SEQ ID NO: 49850
  CDS (1)..(900): transl_table=11

SEQ ID NO: 69122 - protein, 299 aa, Shigella boydii; identical to SEQ ID NO: 49851

SEQ ID NO: 69123 - DNA, 885 bp, Clostridium thermosaccharolyticum; identical to SEQ ID NO: 49852
  CDS (1)..(885): transl_table=11

SEQ ID NO: 69124 - protein, 294 aa, Clostridium thermosaccharolyticum; identical to SEQ ID NO: 49853

SEQ ID NO: 69125 - DNA, 891 bp, Klebsiella terrigena; identical to SEQ ID NO: 49854
  CDS (1)..(891): transl_table=11

SEQ ID NO: 69126 - protein, 296 aa, Klebsiella terrigena; identical to SEQ ID NO: 49855

SEQ ID NO: 69127 - DNA, 861 bp, Bacillus stearothermophilus; identical to SEQ ID NO: 49856
  CDS (1)..(861): transl_table=11

SEQ ID NO: 69128 - protein, 286 aa, Bacillus stearothermophilus; identical to SEQ ID NO: 49857

SEQ ID NO: 69129 - DNA, 846 bp, Bacillus stearothermophilus; identical to SEQ ID NO: 49858
  CDS (1)..(846): transl_table=11

SEQ ID NO: 69130 - protein, 281 aa, Bacillus stearothermophilus; identical to SEQ ID NO: 49859

SEQ ID NO: 69131 - DNA, 849 bp, Bacillus stearothermophilus; identical to SEQ ID NO: 49860
  CDS (1)..(849): transl_table=11

SEQ ID NO: 69132 - protein, 282 aa, Bacillus stearothermophilus; identical to SEQ ID NO: 49861

SEQ ID NO: 69133 - DNA, 864 bp, Bacteroides coprosuis; identical to SEQ ID NO: 49862
  CDS (1)..(864): transl_table=11

SEQ ID NO: 69134 - protein, 287 aa, Bacteroides coprosuis; identical to SEQ ID NO: 49863

SEQ ID NO: 69135 - DNA, 852 bp, Thermotoga sp; identical to SEQ ID NO: 49864
  CDS (1)..(852): transl_table=11

SEQ ID NO: 69136 - protein, 283 aa, Thermotoga sp; identical to SEQ ID NO: 49865

SEQ ID NO: 69137 - DNA, 867 bp, Sphingomonas elodea; identical to SEQ ID NO: 49866
  CDS (1)..(867): transl_table=11

SEQ ID NO: 69138 - protein, 288 aa, Sphingomonas elodea; identical to SEQ ID NO: 49867

SEQ ID NO: 69139 - DNA, 852 bp, Streptococcus gordonii; identical to SEQ ID NO: 49868
  CDS (1)..(852): n means a or g or c or t/u, s means g or c

SEQ ID NO: 69140 - protein, 283 aa, Streptococcus gordonii; identical to SEQ ID NO: 49869
  Xaa in position 200 is unknown

SEQ ID NO: 69141 - DNA, 888 bp, Vibrio cholerae; identical to SEQ ID NO: 49870
  CDS (1)..(888): transl_table=11

SEQ ID NO: 69142 - protein, 295 aa, Vibrio cholerae; identical to SEQ ID NO: 49871

SEQ ID NO: 69143 - DNA, 855 bp, Vibrio cholerae; identical to SEQ ID NO: 49872
  CDS (1)..(855): transl_table=11

SEQ ID NO: 69144 - protein, 284 aa, Vibrio cholerae; identical to SEQ ID NO: 49873

SEQ ID NO: 69145 - DNA, 891 bp, Vibrio cholerae; identical to SEQ ID NO: 49874
  CDS (1)..(891): transl_table=11

SEQ ID NO: 69146 - protein, 296 aa, Vibrio cholerae; identical to SEQ ID NO: 49875

SEQ ID NO: 69147 - DNA, 891 bp, Vibrio cholerae; identical to SEQ ID NO: 49876
  CDS (1)..(891): transl_table=11

SEQ ID NO: 69148 - protein, 296 aa, Vibrio cholerae; identical to SEQ ID NO: 49877

SEQ ID NO: 69149 - DNA, 891 bp, Vibrio cholerae; identical to SEQ ID NO: 49878
  CDS (1)..(891): transl_table=11

SEQ ID NO: 69150 - protein, 296 aa, Vibrio cholerae; identical to SEQ ID NO: 49879

SEQ ID NO: 69151 - DNA, 891 bp, Vibrio cholerae; identical to SEQ ID NO: 49880
  CDS (1)..(891): transl_table=11

SEQ ID NO: 69152 - protein, 296 aa, Vibrio cholerae; identical to SEQ ID NO: 49881

SEQ ID NO: 69153 - DNA, 873 bp, Vibrio vulnificus; identical to SEQ ID NO: 49882
  CDS (1)..(873): transl_table=11

SEQ ID NO: 69154 - protein, 290 aa, Vibrio vulnificus; identical to SEQ ID NO: 49883

SEQ ID NO: 69155 - DNA, 900 bp, Lactococcus lactis subsp; identical to SEQ ID NO: 49884
  CDS (1)..(900): transl_table=11

SEQ ID NO: 69156 - protein, 299 aa, Lactococcus lactis subsp; identical to SEQ ID NO: 49885

SEQ ID NO: 69157 - DNA, 867 bp, Streptomyces roseochromogenes subsp; identical to SEQ ID NO: 49886
  CDS (1)..(867): transl_table=11

SEQ ID NO: 69158 - protein, 288 aa, Streptomyces roseochromogenes subsp; identical to SEQ ID NO: 49887

SEQ ID NO: 69159 - DNA, 837 bp, Streptococcus suis; identical to SEQ ID NO: 49888
  CDS (1)..(837): transl_table=11

SEQ ID NO: 69160 - protein, 278 aa, Streptococcus suis; identical to SEQ ID NO: 49889

SEQ ID NO: 69161 - DNA, 903 bp, Aeromonas hydrophila; identical to SEQ ID NO: 49890
  CDS (1)..(903): transl_table=11

SEQ ID NO: 69162 - protein, 300 aa, Aeromonas hydrophila; identical to SEQ ID NO: 49891

SEQ ID NO: 69163 - DNA, 903 bp, Aeromonas hydrophila; identical to SEQ ID NO: 49892
  CDS (1)..(903): transl_table=11

SEQ ID NO: 69164 - protein, 300 aa, Aeromonas hydrophila; identical to SEQ ID NO: 49893

SEQ ID NO: 69165 - DNA, 1002 bp, Lactobacillus gasseri; identical to SEQ ID NO: 49894
  CDS (1)..(1002): transl_table=11

SEQ ID NO: 69166 - protein, 333 aa, Lactobacillus gasseri; identical to SEQ ID NO: 49895

SEQ ID NO: 69167 - DNA, 921 bp, Leptospira interrogans; identical to SEQ ID NO: 49896
  CDS (1)..(921): transl_table=11

SEQ ID NO: 69168 - protein, 306 aa, Leptospira interrogans; identical to SEQ ID NO: 49897

SEQ ID NO: 69169 - DNA, 900 bp, Shigella boydii; identical to SEQ ID NO: 49898
  CDS (1)..(900): transl_table=11

SEQ ID NO: 69170 - protein, 299 aa, Shigella boydii; identical to SEQ ID NO: 49899

SEQ ID NO: 69171 - DNA, 900 bp, Shigella boydii; identical to SEQ ID NO: 49900
  CDS (1)..(900): transl_table=11

SEQ ID NO: 69172 - protein, 299 aa, Shigella boydii; identical to SEQ ID NO: 49901

SEQ ID NO: 69173 - DNA, 918 bp, Saccharopolyspora spinosa; identical to SEQ ID NO: 49902
  CDS (1)..(918): transl_table=11

SEQ ID NO: 69174 - protein, 305 aa, Saccharopolyspora spinosa; identical to SEQ ID NO: 49903

SEQ ID NO: 69175 - DNA, 849 bp, Aneurinibacillus thermoaerophilus; identical to SEQ ID NO: 49904
  CDS (1)..(849): transl_table=11

SEQ ID NO: 69176 - protein, 282 aa, Aneurinibacillus thermoaerophilus; identical to SEQ ID NO: 49905

SEQ ID NO: 69177 - DNA, 894 bp, Acinetobacter calcoaceticus; identical to SEQ ID NO: 49906
  CDS (1)..(894): transl_table=11

SEQ ID NO: 69178 - protein, 297 aa, Acinetobacter calcoaceticus; identical to SEQ ID NO: 49907

SEQ ID NO: 69179 - DNA, 897 bp, Burkholderia mallei; identical to SEQ ID NO: 49908
  CDS (1)..(897): transl_table=11

SEQ ID NO: 69180 - protein, 298 aa, Burkholderia mallei; identical to SEQ ID NO: 49909

SEQ ID NO: 69181 - DNA, 930 bp, Azospirillum brasilense; identical to SEQ ID NO: 49910
  CDS (1)..(930): transl_table=11

SEQ ID NO: 69182 - protein, 309 aa, Azospirillum brasilense; identical to SEQ ID NO: 49911

SEQ ID NO: 69183 - DNA, 879 bp, Actinobacillus actinomycetemcomitans; identical to SEQ ID NO: 49912
  CDS (1)..(879): transl_table=11

SEQ ID NO: 69184 - protein, 292 aa, Actinobacillus actinomycetemcomitans; identical to SEQ ID NO: 49913

SEQ ID NO: 69185 - DNA, 888 bp, Acetobacter xylinus; identical to SEQ ID NO: 49914
  CDS (1)..(888): transl_table=11

SEQ ID NO: 69186 - protein, 295 aa, Acetobacter xylinus; identical to SEQ ID NO: 49915

SEQ ID NO: 69187 - DNA, 900 bp, Salmonella enterica; identical to SEQ ID NO: 49916
  CDS (1)..(900): transl_table=11

SEQ ID NO: 69188 - protein, 299 aa, Salmonella enterica; identical to SEQ ID NO: 49917

SEQ ID NO: 69189 - DNA, 900 bp, Salmonella enterica; identical to SEQ ID NO: 49918
  CDS (1)..(900): transl_table=11

SEQ ID NO: 69190 - protein, 299 aa, Salmonella enterica; identical to SEQ ID NO: 49919

SEQ ID NO: 69191 - DNA, 867 bp, Streptomyces rishiriensis; identical to SEQ ID NO: 49920
  CDS (1)..(867): transl_table=11

SEQ ID NO: 69192 - protein, 288 aa, Streptomyces rishiriensis; identical to SEQ ID NO: 49921

SEQ ID NO: 69193 - DNA, 879 bp, Actinobacillus actinomycetemcomitans; identical to SEQ ID NO: 49922
  CDS (1)..(879): transl_table=11

SEQ ID NO: 69194 - protein, 292 aa, Actinobacillus actinomycetemcomitans; identical to SEQ ID NO: 49923

SEQ ID NO: 69195 - DNA, 885 bp, Streptomyces antibioticus; identical to SEQ ID NO: 49924
  CDS (1)..(885): transl_table=11

SEQ ID NO: 69196 - protein, 294 aa, Streptomyces antibioticus; identical to SEQ ID NO: 49925

SEQ ID NO: 69197 - DNA, 876 bp, Streptomyces nogalater; identical to SEQ ID NO: 49926
  CDS (1)..(876): transl_table=11

SEQ ID NO: 69198 - protein, 291 aa, Streptomyces nogalater; identical to SEQ ID NO: 49927

SEQ ID NO: 69199 - DNA, 921 bp, Leptospira interrogans; identical to SEQ ID NO: 49928
  CDS (1)..(921): transl_table=11

SEQ ID NO: 69200 - protein, 306 aa, Leptospira interrogans; identical to SEQ ID NO: 49929

SEQ ID NO: 69201 - DNA, 879 bp, Actinobacillus actinomycetemcomitans; identical to SEQ ID NO: 49930
  CDS (1)..(879): transl_table=11

SEQ ID NO: 69202 - protein, 292 aa, Actinobacillus actinomycetemcomitans; identical to SEQ ID NO: 49931

SEQ ID NO: 69203 - DNA, 855 bp, Streptococcus pneumoniae; identical to SEQ ID NO: 49932
  CDS (1)..(855): transl_table=11

SEQ ID NO: 69204 - protein, 284 aa, Streptococcus pneumoniae; identical to SEQ ID NO: 49933

SEQ ID NO: 69205 - DNA, 891 bp, Klebsiella pneumoniae; identical to SEQ ID NO: 49934
  CDS (1)..(891): transl_table=11

SEQ ID NO: 69206 - protein, 296 aa, Klebsiella pneumoniae; identical to SEQ ID NO: 49935

SEQ ID NO: 69207 - DNA, 921 bp, Leptospira borgpetersenii; identical to SEQ ID NO: 49936
  CDS (1)..(921): transl_table=11

SEQ ID NO: 69208 - protein, 306 aa, Leptospira borgpetersenii; identical to SEQ ID NO: 49937

SEQ ID NO: 69209 - DNA, 906 bp, Escherichia coli; identical to SEQ ID NO: 49938
  CDS (1)..(906): transl_table=11

SEQ ID NO: 69210 - protein, 301 aa, Escherichia coli; identical to SEQ ID NO: 49939

SEQ ID NO: 69211 - DNA, 891 bp, Rhizobium sp; identical to SEQ ID NO: 49940
  CDS (1)..(891): transl_table=11

SEQ ID NO: 69212 - protein, 296 aa, Rhizobium sp; identical to SEQ ID NO: 49941

SEQ ID NO: 69213 - DNA, 900 bp, Salmonella typhimurium; identical to SEQ ID NO: 49942
  CDS (1)..(900): transl_table=11

SEQ ID NO: 69214 - protein, 299 aa, Salmonella typhimurium; identical to SEQ ID NO: 49943

SEQ ID NO: 69215 - DNA, 915 bp, Streptomyces griseus; identical to SEQ ID NO: 49944
  CDS (1)..(915): transl_table=11

SEQ ID NO: 69216 - protein, 304 aa, Streptomyces griseus; identical to SEQ ID NO: 49945

SEQ ID NO: 69217 - DNA, 26 bp, Artificial sequence
  (1)..(26): primer
atgaatatcctcctttttggcaaaac

SEQ ID NO: 69218 - DNA, 27 bp, Artificial sequence
  (1)..(27): primer
ttaaattgctgtagtcgtaaataattc

SEQ ID NO: 69219 - protein, 351 aa, Artificial sequence; identical to SEQ ID NO: 49948
  Variant (2)..(3): xaa in position 2 to 3 is any amino acid
  Variant (6)..(6): xaa in position 6 is any amino acid
  Variant (8)..(9): xaa in position 8 to 9 is any amino acid
  Variant (11)..(19): xaa in position 11 to 19 is any amino acid
  Variant (20)..(63): xaa in position 20 to 63 is any or no amino acid
  Variant (65)..(69): xaa in position 65 to 69 is any amino acid
  Variant (70)..(70): xaa in position 70 is any or no amino acid
  Variant (73)..(73): xaa in position 73 is any amino acid
  Variant (75)..(75): xaa in position 75 is any amino acid
  Variant (78)..(78): xaa in position 78 is any amino acid
  Variant (81)..(89): xaa in position 81 to 89 is any amino acid
  Variant (90)..(91): xaa in position 90 to 91 is any or no amino acid
  Variant (93)..(99): xaa in position 93 to 99 is any amino acid
  Variant (101)..(113): xaa in position 101 to 113 is any amino acid
  Variant (120)..(120): xaa in position 120 is any amino acid
  Variant (122)..(133): xaa in position 122 to 133 is any amino acid
  Variant (134)..(141): xaa in position 134 to 141 is any or no amino acid
  Variant (143)..(145): xaa in position 143 to 145 is any amino acid
  Variant (148)..(149): xaa in position 148 to 149 is any amino acid
  Variant (151)..(152): xaa in position 151 to 152 is any amino acid
  Variant (155)..(165): xaa in position 155 to 165 is any amino acid
  Variant (166)..(173): xaa in position 166 to 173 is any or no amino acid
  Variant (176)..(176): xaa in position 176 is any amino acid
  Variant (178)..(182): xaa in position 178 to 182 is any amino acid
  Variant (184)..(184): xaa in position 184 is any amino acid
  Variant (185)..(189): xaa in position 185 to 189 is any or no amino acid
  Variant (192)..(193): xaa in position 192 to 193 is any amino acid
  Variant (195)..(205): xaa in position 195 to 205 is any amino acid
  Variant (206)..(213): xaa in position 206 to 213 is any or no amino acid
  Variant (215)..(216): xaa in position 215 to 216 is any amino acid
  Variant (219)..(219): xaa in position 219 is any amino acid
  Variant (221)..(221): xaa in position 221 is any amino acid
  Variant (224)..(228): xaa in position 224 to 228 is any amino acid
  Variant (230)..(239): xaa in position 230 to 239 is any amino acid
  Variant (240)..(257): xaa in position 240 to 257 is any or no amino acid
  Variant (259)..(260): xaa in position 259 to 260 is any amino acid
  Variant (262)..(268): xaa in position 262 to 268 is any amino acid
  Variant (269)..(273): xaa in position 269 to 273 is any or no amino acid
  Variant (275)..(277): xaa in position 275 to 277 is any amino acid
  Variant (279)..(296): xaa in position 279 to 296 is any amino acid
  Variant (297)..(316): xaa in position 297 to 316 is any or no amino acid
  Variant (318)..(318): xaa in position 318 is any amino acid
  Variant (321)..(322): xaa in position 321 to 322 is any amino acid
  Variant (324)..(324): xaa in position 324 is any amino acid
  Variant (326)..(335): xaa in position 326 to 335 is any amino acid
  Variant (336)..(350): xaa in position 336 to 350 is any or no amino acid

SEQ ID NO: 69220 - protein, 10 aa, Artificial sequence
  Variant (2)..(3): xaa in position 2 to 3 is any or no amino acid
  Variant (6)..(6): xaa in position 6 is Leu or Val
  Variant (7)..(7): xaa in position 7 is Ala, Gly, Ser or Val
  Variant (8)..(9): xaa in position 8 to 9 is any amino acid
  Variant (10)..(10): xaa in position 10 is Phe, Ile, Leu, Met or Val
GXXGQXXXXX

SEQ ID NO: 69221 - protein, 11 aa, Artificial sequence
  Variant (2)..(2): xaa in position 2 is any or no amino acid
  Variant (4)..(4): xaa in position 4 is His, Trp or Tyr
  Variant (6)..(6): xaa in position 6 is any amino acid
  Variant (9)..(9): xaa in position 9 is any amino acid
  Variant (10)..(10): xaa in position 10 is Ala, Cys or Ser
AXAXTXVDXXE

SEQ ID NO: 69222 - protein, 8 aa, Artificial sequence
  Variant (7)..(7): xaa in position 7 is any amino acid
STDYVFXG

SEQ ID NO: 69223 - protein, 13 aa, Artificial sequence
  Variant (2)..(2): xaa in position 2 is any amino acid
  Variant (3)..(3): xaa in position 3 is Gly, Asn, Ser or Thr
  Variant (4)..(4): xaa in position 4 is any amino acid
  Variant (7)..(7): xaa in position 7 is any amino acid
  Variant (8)..(8): xaa in position 8 is Ser or Thr
  Variant (10)..(11): xaa in position 10 to 11 is any amino acid
PXXXYGXXKXXGE

SEQ ID NO: 69224 - protein, 10 aa, Artificial sequence
  Variant (2)..(2): xaa in position 2 is any amino acid
  Variant (3)..(3): xaa in position 3 is Ala, Cys, Gly or Ser
  Variant (5)..(5): xaa in position 5 is Leu or Val
  Variant (6)..(6): xaa in position 6 is any amino acid
  Variant (7)..(7): xaa in position 7 is Ala, Cys, Gly or Ser
  Variant (8)..(9): xaa in position 8 to 9 is any amino acid
RXXWXXXXXG

SEQ ID NO: 69225 - protein, 17 aa, Artificial sequence
  Variant (2)..(2): xaa in position 2 is any amino acid
  Variant (3)..(3): xaa in position 3 is any or no amino acid
  Variant (5)..(5): xaa in position 5 is any or no amino acid
  Variant (7)..(7): xaa in position 7 is any amino acid
  Variant (9)..(9): xaa in position 9 is any amino acid
  Variant (11)..(11): xaa in position 11 is Ser or Thr
  Variant (12)..(12): xaa in position 12 is any amino acid
  Variant (13)..(13): xaa in position 13 is Ala, Ser, Thr or Val
  Variant (14)..(15): xaa in position 14 to 15 is any amino acid
  Variant (16)..(16): xaa in position 16 is Ile or Leu
  Variant (17)..(17): xaa in position 17 is Ala, Asn or Val
VXXDXQXGXPXXXXXXX

SEQ ID NO: 69226 - protein, 9 aa, Artificial sequence
  Variant (2)..(2): xaa in position 2 is any amino acid
  Variant (5)..(6): xaa in position 5 to 6 is any amino acid
  Variant (8)..(8): xaa in position 8 is any amino acid
  Variant (9)..(9): xaa in position 9 is Leu or Met
AXRPXXSXX

SEQ ID NO: 69227 - DNA, 195 bp, Escherichia coli
  CDS (1)..(195)
atgtacgtttgtctttgtaatggtatcagcgataaaaaaattcgtcaggctgtgcgccagttttcccctcactcgttccagcaattaaaaaaatttattccggtcggcaatcagtgcggtaaatgtgtccgggccgcgcgtgaagtgatggaggatgaattaatgcagctgccggagtttaaggagtccgcataa

SEQ ID NO: 69228 - protein, 64 aa, Escherichia coli
MYVCLCNGISDKKIRQAVRQFSPHSFQQLKKFIPVGNQCGKCVRAAREVMEDELMQLPEFKESA

SEQ ID NO: 69229 - DNA, 189 bp, Vibrio cholerae O1 biovar eltor str. N16961
  CDS (1)..(189): transl_table=11
atgtacgtttgtttgtgtcatggtgtctcagacaaaaagattaggagattggttgccgaacagggtattacggatatcaagggcatcaagcgctgtacagcactgggttctcagtgtggtaagtgtgtacgccaagctaaagagatcatcgaagaatcgctgattgctcagtttaaactggcaagttaa

SEQ ID NO: 69230 - protein, 62 aa, Vibrio cholerae O1 biovar eltor str. N16961
MYVCLCHGVSDKKIRRLVAEQGITDIKGIKRCTALGSQCGKCVRQAKEIIEESLIAQFKLAS

SEQ ID NO: 69231 - DNA, 222 bp, Pseudomonas aeruginosa PAO1
  CDS (1)..(222): transl_table=11
atgtacgtctgcctctgccaaggtgttaccgacaaccagatccgcgatgccatctacgaaggctgctgcagctatcgtgaggttcgcgaagccaccggcgtcggtacccagtgcggcaagtgcgcatgcctggccaagcaggtggtacgcgaaaccctcaacgacctgcagagtgcccagccggtaccggcgttcgggactacggcgttcgtcgctgcctga

SEQ ID NO: 69232 - protein, 73 aa, Pseudomonas aeruginosa PAO1
MYVCLCQGVTDNQIRDAIYEGCCSYREVREATGVGTQCGKCACLAKQVVRETLNDLQSAQPVPAFGTTAFVAA

SEQ ID NO: 69233 - DNA, 195 bp, Yersinia pestis CO92
  CDS (1)..(195): transl_table=11
atgtacgtttgtctatgtaatgcggtttctgacaaagtcattcgcaaagctgtgcgccagcatcagccccatacagttaagcaactgcgacagcttgtgccgattggtagtgactgtgggaagtgcatccgacaagccagagagatcttgattgaggaactcgctaatattccagaaatgaatgatgttgcctaa

SEQ ID NO: 69234 - protein, 64 aa, Yersinia pestis CO92
MYVCLCNAVSDKVIRKAVRQHQPHTVKQLRQLVPIGSDCGKCIRQAREILIEELANIPEMNDVA

SEQ ID NO: 69235 - DNA, 177 bp, Synechocystis sp. PCC 6803
  CDS (1)..(177): transl_table=11
atgtatatctgcgtttgccggggtattagcgataagcaaattgaagcggctgcccagcagggcataacctccctagaagagttgtccgagtccatgggagtaggggctgactgcggtgtctgccaaggccatgcttgccaggtgctagaggcgatcgccagaaggaaattaacctag

SEQ ID NO: 69236 - protein, 58 aa, Synechocystis sp. PCC 6803
MYICVCRGISDKQIEAAAQQGITSLEELSESMGVGADCGVCQGHACQVLEAIARRKLT

SEQ ID NO: 69237 - DNA, 192 bp, Shewanella oneidensis MR-1
  CDS (1)..(192): transl_table=11
atgtatgtttgcctttgtcacgccatcacagatacgcaaatcaaaaacgcggtaagccaaggcgacacgagtcttgctgacgttaaaaagcgtttaggcgttgccgatcaatgcggtaaatgcgcgagaatggctgtacaaatcatccagaatcaactggaaattgaacctaaatactacgaagtcgcttaa

SEQ ID NO: 69238 - protein, 63 aa, Shewanella oneidensis MR-1
MYVCLCHAITDTQIKNAVSQGDTSLADVKKRLGVADQCGKCARMAVQIIQNQLEIEPKYYEVA

SEQ ID NO: 69239 - DNA, 219 bp, Pseudomonas putida KT2440
  CDS (1)..(219): transl_table=11
atgtatgtgtgtctttgtgtcggcgttaccgacggacagatccgcgatgcgatctatgaaggatgctgcagttacaaggaagtgcgagccgccaccaatgtcgccagccagtgtgggaaatgcgcctgcgtggccaagcaggtggtccgcgagaccctgaccgagcttcaggtcagccaggcggccttgccctaccccgtcgaatttaccgctgcctga

SEQ ID NO: 69240 - protein, 72 aa, Pseudomonas putida KT2440
MYVCLCVGVTDGQIRDAIYEGCCSYKEVRAATNVASQCGKCACVAKQVVRETLTELQVSQAALPYPVEFTAA

SEQ ID NO: 69241 - DNA, 189 bp, Vibrio vulnificus CMCP6
  CDS (1)..(189): transl_table=11
atgtacgtttgtttgtgtcatggtgtttcagacaagaaaattcgcaagcttgttattgagcaaggtgttgcggatattcgcggaatcaaaaagtgcactgcattgggaagtcaatgtggcaaatgcatacgtatggcgaaagagattatcaacgagactgctccggcactattcaagcaagccagttaa

SEQ ID NO: 69242 - protein, 62 aa, Vibrio vulnificus CMCP6
MYVCLCHGVSDKKIRKLVIEQGVADIRGIKKCTALGSQCGKCIRMAKEIINETAPALFKQAS

SEQ ID NO: 69243 - DNA, 219 bp, Pseudomonas syringae pv. tomato str. DC3000
  CDS (1)..(219): transl_table=11
atgtatgtttgtctttgccaaggtgtaacagacggtcaaatccgggaagcgattctcgagggctgctgcagttatcgtgaggtccgcgaaacgctgggcgttgcgagtaaatgtggaaagtgcgcctgtctggccaaggaagtggtacgcgacacgctgaccgaactgcaaagcagtcatgcggcgctggcttattcaacagaattttcagccgcttaa

SEQ ID NO: 69244 - protein, 72 aa, Pseudomonas syringae pv. tomato str. DC3000
MYVCLCQGVTDGQIREAILEGCCSYREVRETLGVASKCGKCACLAKEVVRDTLTELQSSHAALAYSTEFSAA

SEQ ID NO: 69245 - DNA, 189 bp, Vibrio parahaemolyticus RIMD 2210633
  CDS (1)..(189): transl_table=11
atgtacgtttgtctttgccatggcgtctccgacaaaaaaattaggaagttggcgatagatgaaggtgtcactgatattcgaggtattaagagatgcactgctttggggagtcagtgtggtaagtgcattaagcaggcaaaagaaatcctagcagaaacacattacacagaattaagacaagccagttaa

SEQ ID NO: 69246 - protein, 62 aa, Vibrio parahaemolyticus RIMD 2210633
MYVCLCHGVSDKKIRKLAIDEGVTDIRGIKRCTALGSQCGKCIKQAKEILAETHYTELRQAS

SEQ ID NO: 69247 - DNA, 195 bp, Photorhabdus luminescens subsp. laumondii TTO1
  CDS (1)..(195): transl_table=11
atgtatgtctgcctatgtaatgcggtgagtgacaaaacaatacgtaatgcggtgcgtcaacatcatattcactctattaaagaactaaaatgtattgtgcctgtaggccgtgattgtggcaaatgcatacgccaagctagagagctaattaatgaggagattgcacagttacccaagatagataacgttgcttga

SEQ ID NO: 69248 - protein, 64 aa, Photorhabdus luminescens subsp. laumondii TTO1
MYVCLCNAVSDKTIRNAVRQHHIHSIKELKCIVPVGRDCGKCIRQARELINEEIAQLPKIDNVA

SEQ ID NO: 69249 - DNA, 201 bp, Vibrio vulnificus YJ016
  CDS (1)..(201): transl_table=11
ttgagttgtaatatgtacgtttgtttgtgtcatggtgtttcagacaagaaaattcgcaagcttgttattgagcaaggtgttgcggatattcgcggaatcaaaaagtgcactgcattgggaagtcaatgtggcaaatgtatacgtatggcgaaagagattatcaacgagactgctccggcactattcaagcaagccagttaa

SEQ ID NO: 69250 - protein, 66 aa, Vibrio vulnificus YJ016
MSCNMYVCLCHGVSDKKIRKLVIEQGVADIRGIKKCTALGSQCGKCIRMAKEIINETAPALFKQAS

SEQ ID NO: 69251 - DNA, 195 bp, Escherichia coli O157:H7
  CDS (1)..(195): transl_table=11
atgtacgtttgtttgtgtaatggtgtaagtgacaaaaaaattcgccaggcagtccgtcagtttcatccgcaatctttccaacaattgcgtaagtttattcctgtgggaaatcaatgtggtaagtgcattcgcgccgcgcgcgaagtgatgcaggacgagttgatgcagatgccagaatttaaagagattgcctga

SEQ ID NO: 69252 - protein, 64 aa, Escherichia coli O157:H7
MYVCLCNGVSDKKIRQAVRQFHPQSFQQLRKFIPVGNQCGKCIRAAREVMQDELMQMPEFKEIA

SEQ ID NO: 69253 - DNA, 210 bp, Acinetobacter sp. ADP1
  CDS (1)..(210): transl_table=11
atgcgaatgactctgatgtacgtttgtttgtgtcgtggtattacagatcaagatattaaagatgccgttgcaagcggtgctgaaagttaccgcgaagttcgtgagcgcttagatcttggtacgtgctgtggacgctgtgcaccagaagccaaaagtatcattaatgaagaacttgcagaaattgcagctcgcatctctgttgctgcatag

SEQ ID NO: 69254 - protein, 69 aa, Acinetobacter sp. ADP1
MRMTLMYVCLCRGITDQDIKDAVASGAESYREVRERLDLGTCCGRCAPEAKSIINEELAEIAARISVAA

SEQ ID NO: 69255 - DNA, 195 bp, Erwinia carotovora subsp. atroseptica SCRI1043
  CDS (1)..(195): transl_table=11
atgtatgtttgtttatgcaacgcaatttctgacaaagccattcgtaatgctgttcgtcagcaccagcctcaatctatgcaacaattacgcaaactcgttcctatcgggacagattgcggtaagtgcattcgtcaggcgcgtgttatttttgaggaagagcaggctaaaattcctgacatgtataaagtagcataa

SEQ ID NO: 69256 - protein, 64 aa, Erwinia carotovora subsp. atroseptica SCRI1043
MYVCLCNAISDKAIRNAVRQHQPQSMQQLRKLVPIGTDCGKCIRQARVIFEEEQAKIPDMYKVA

SEQ ID NO: 69257 - DNA, 207 bp, Yersinia pseudotuberculosis IP 32953
  CDS (1)..(207): transl_table=11
atgagtctttttatgtacgtttgtctatgtaatgcggtttctgacaaagtcattcgcaaagctgtgcgccagcatcagccccatacagttaagcaactgcgacagcttgtgccgattggtagtgactgtgggaagtgcatccgacaagccagagagatcttgattgaggaactcgctaatattccagaaatgaatgatgttgcctaa

SEQ ID NO: 69258 - protein, 68 aa, Yersinia pseudotuberculosis IP 32953
MSLFMYVCLCNAVSDKVIRKAVRQHQPHTVKQLRQLVPIGSDCGKCIRQAREILIEELANIPEMNDVA

SEQ ID NO: 69259 - DNA, 240 bp, Burkholderia pseudomallei K96243
  CDS (1)..(240): transl_table=11
atgatcgtctgcgtgtgcaagtccgtttccgatcggaagattcgcgcatccctcgcggaaggcgtgaacacgttcgaagaactccagttcgaactcggggtcgccacctgctgcggcaagtgcgaggaaaccgtgcgcgagatcatggcggaacagggcgtttgtgcgagccgttgcggtgccgagcgccctgcggccgtaccggtcgccgtcacgttctacgaacgcaaggcggcctga

SEQ ID NO: 69260 - protein, 79 aa, Burkholderia pseudomallei K96243
MIVCVCKSVSDRKIRASLAEGVNTFEELQFELGVATCCGKCEETVREIMAEQGVCASRCGAERPAAVPVAVTFYERKAA

SEQ ID NO: 69261 - DNA, 204 bp, Methylococcus capsulatus str. Bath
  CDS (1)..(204): transl_table=11
atgtatgtctgcatctgtaggagcgtcactgaccgccaggttcgggaagtcgtcactcgccacggcgcgtacaatctgcgcaccttgcggacgcgcctggacgcctgcagccagtgcgggaaatgcgcgctggaagtcaagacgctgatccaggaaaccctggcggagaacgccgtattggaacagcagaacatggccgcctga

SEQ ID NO: 69262 - protein, 67 aa, Methylococcus capsulatus str. Bath
MYVCICRSVTDRQVREVVTRHGAYNLRTLRTRLDACSQCGKCALEVKTLIQETLAENAVLEQQNMAA

SEQ ID NO: 69263 - DNA, 189 bp, Photobacterium profundum SS9
  CDS (1)..(189): transl_table=11
atgtacgtttgtttatgctttggtatttccgataaaaaaatcataagattaacccagcagaacaaagtcagtgatatacgaagcattcgagaaattacatcattaggctctcaatgtggtaaatgtattcgacaagcgaaaaatattatcgaagaaacaatagcgataagctttgaaaaagccagttag

SEQ ID NO: 69264 - protein, 62 aa, Photobacterium profundum SS9
MYVCLCFGISDKKIIRLTQQNKVSDIRSIREITSLGSQCGKCIRQAKNIIEETIAISFEKAS

SEQ ID NO: 69265 - DNA, 225 bp, Idiomarina loihiensis L2TR
  CDS (1)..(225): transl_table=11
atgtatgtttgtctttgtaaaggtattaacgataaagtcatccatcaggccgtagtttctggtgaggtgaactcaatgcgagacttacgccagcaatacggtgtagcctcacagtgcgggtgttgtaaaagctgcgccaaagatgttcttcacgaagccctcgagcaacgttctaatcaagcaggtaaagagactcaacttccggtttccgtatgctacacttaa

SEQ ID NO: 69266 - protein, 74 aa, Idiomarina loihiensis L2TR
MYVCLCKGINDKVIHQAVVSGEVNSMRDLRQQYGVASQCGCCKSCAKDVLHEALEQRSNQAGKETQLPVSVCYT

SEQ ID NO: 69267 - DNA, 231 bp, Azoarcus sp. EbN1
  CDS (1)..(231): transl_table=11
atgtacgtctgcgtctgcaacgcggtaacggatcgccatatcgaacaggcagtcagcgaaggggcatcgaccttgcgcgagctgcgcacgaaactcggcgtggcgagcgagtgcggtcgctgcgcgacatgcgctcgtgattgcctgcgttccgcgctggcagaacagatcgcgactccggcccccgccggcgtcgcgtcctcgttctcgtttgccgcggaggccttatga

SEQ ID NO: 69268 - protein, 76 aa, Azoarcus sp. EbN1
MYVCVCNAVTDRHIEQAVSEGASTLRELRTKLGVASECGRCATCARDCLRSALAEQIATPAPAGVASSFSFAAEAL

SEQ ID NO: 69269 - DNA, 219 bp, Pseudomonas syringae pv. syringae B728a
  CDS (1)..(219): transl_table=11
atgtatgtttgcctctgccaaggtgtcaccgacggtcaaatccgggatgcaattctggaaggctgctgcagttatcgtgaagtccgtgaaacactgggtgttgcgagtaaatgtggaaaatgcgcctgcctggcaaaggaagtggtgcgtgatacgctgaccgagctgcaaaccagccatgccttgctggcctatccggcaaaattttcagctgcctga

SEQ ID NO: 69270 - protein, 72 aa, Pseudomonas syringae pv. syringae B728a
MYVCLCQGVTDGQIRDAILEGCCSYREVRETLGVASKCGKCACLAKEVVRDTLTELQTSHALLAYPAKFSAA

SEQ ID NO: 69271 - DNA, 219 bp, Pseudomonas fluorescens Pf-5
  CDS (1)..(219): transl_table=11
atgtatgtctgcctctgcaccggtgtcaccgacggacaaattcgcgaagcgatctacgaaggttgctgcagctaccgcgaagtacgccaggccaccggcgtcgccagccagtgcggcaaatgtgcctgcctggccaagcaagtggttcgcgaaaccctgaccgaattgcagagcagccaagcggcaatcccctaccctgtggaatttaatgtcgcctga

SEQ ID NO: 69272 - protein, 72 aa, Pseudomonas fluorescens Pf-5
MYVCLCTGVTDGQIREAIYEGCCSYREVRQATGVASQCGKCACLAKQVVRETLTELQSSQAAIPYPVEFNVA

SEQ ID NO: 69273 - DNA, 195 bp, Colwellia psychrerythraea 34H
  CDS (1)..(195): transl_table=11
atgtacgtttgtatttgccatggtgttaccgatacccagatagaatccgctattgataatggcgtagaaactatgaaagggttaacccaagagcttaatgtaggatcgcaatgtggtaaatgttgtcaatgtactaaacgcgtactcaacagaaagttaatacaaattgctgaggcacagccacaggtcgcttaa

SEQ ID NO: 69274 - protein, 64 aa, Colwellia psychrerythraea 34H
MYVCICHGVTDTQIESAIDNGVETMKGLTQELNVGSQCGKCCQCTKRVLNRKLIQIAEAQPQVA

SEQ ID NO: 69275 - DNA, 219 bp, Pseudomonas syringae pv. phaseolicola 1448A
  CDS (1)..(219): transl_table=11
atgtatgtttgtctttgccaaggtgtcacagacggtcaaatccgggatgcaattctggaaggctgctgcagttatcgtgaagtccgtgaaacgctgggtgttgcgagtaaatgcggaaaatgcgcctgccttgcgaaggaagtggtgcgtgacacgctgacagaactgcaaaccactcaggcatcgctggcctatccagcagaattttcagctgcctga

SEQ ID NO: 69276 - protein, 72 aa, Pseudomonas syringae pv. phaseolicola 1448A
MYVCLCQGVTDGQIRDAILEGCCSYREVRETLGVASKCGKCACLAKEVVRDTLTELQTTQASLAYPAEFSAA

SEQ ID NO: 69277 - DNA, 213 bp, Thiobacillus denitrificans ATCC 25259
  CDS (1)..(213): transl_table=11
atgtacgtctgcctgtgccacggcgtcaccgacaccgacattcgccgcctcgtgcgcaccgaaggtgtgtgcacgatgcgtgaactgagccaggaactcggcgttgcgacccagtgcggcaagtgcggtcgctgcgccaaggaagtgctgtgccaggccgtggccgacgtccgccaggaaaacgcctgctgcggcgccttgatggcggcctga

SEQ ID NO: 69278 - protein, 70 aa, Thiobacillus denitrificans ATCC 25259
MYVCLCHGVTDTDIRRLVRTEGVCTMRELSQELGVATQCGKCGRCAKEVLCQAVADVRQENACCGALMAA

SEQ ID NO: 69279 - DNA, 240 bp, Burkholderia pseudomallei 1710b
  CDS (1)..(240): transl_table=11
atgatcgtctgcgtgtgcaagtccgtttccgatcggaagattcgcgcatccctcgcggaaggcgtgaacacgttcgaagaactccagttcgaactcggggtcgccacctgctgcggcaagtgcgaggaaaccgtgcgcgagatcatggcggaacagggcgtttgtgcgagccgttgcggtgtcgagcgccccgcggccgtaccggtcgccgtcacgttctacgaacgcaaggcggcctga

SEQ ID NO: 69280 - protein, 79 aa, Burkholderia pseudomallei 1710b
MIVCVCKSVSDRKIRASLAEGVNTFEELQFELGVATCCGKCEETVREIMAEQGVCASRCGVERPAAVPVAVTFYERKAA

SEQ ID NO: 69281 - DNA, 195 bp, Pseudoalteromonas haloplanktis TAC125
  CDS (1)..(195): transl_table=11
atgtatatttgtctatgtcacggtgtgaccgataaaaaaattgaacaaacaattgacgatggtgcaacaaccatgcgtgagttaactaaagagcttaaagtgggcagccaatgcggtaagtgttgtggttgtactaaaaagatccttaatcgtaagcttattcaaattgccgatataacggatcaagtggcttaa

SEQ ID NO: 69282 - protein, 64 aa, Pseudoalteromonas haloplanktis TAC125
MYICLCHGVTDKKIEQTIDDGATTMRELTKELKVGSQCGKCCGCTKKILNRKLIQIADITDQVA

SEQ ID NO: 69283 - DNA, 195 bp, Nitrosococcus oceani ATCC 19707
  CDS (1)..(195): transl_table=11
atgtatgtatgtatatgtcatgccgtaactgataagcagttgcaagaagcgatttcgcaaggtaccaatagcctccgtgatctgagacgtcagctgggggtagtaagtagctgtggtaaatgtggttgttgtgtgcgagatattttacgacagtctcggcaggctagcgctactgaggttagtaatgtggcgtag

SEQ ID NO: 69284 - protein, 64 aa, Nitrosococcus oceani ATCC 19707
MYVCICHAVTDKQLQEAISQGTNSLRDLRRQLGVVSSCGKCGCCVRDILRQSRQASATEVSNVA

SEQ ID NO: 69285 - DNA, 219 bp, Pseudomonas fluorescens PfO-1
  CDS (1)..(219): transl_table=11
atgtatgtttgcctctgcactggcgtcaccgacggacagatccgcgaagcgatctatgaaggttgctgcagctataaagaagtccgtcaggccaccggcgtcgccagccaatgcggcaaatgtgcgtgcctggcgaaggaagtggtccgcgaaaccctgaccaagctgcaaaccgcccaggctgcgatcccctacccggcagaatttaccgccgcgtaa

SEQ ID NO: 69286 - protein, 72 aa, Pseudomonas fluorescens PfO-1
MYVCLCTGVTDGQIREAIYEGCCSYKEVRQATGVASQCGKCACLAKEVVRETLTKLQTAQAAIPYPAEFTAA

SEQ ID NO: 69287 - DNA, 207 bp, Microbulbifer degradans 2-40
  CDS (1)..(207)
atgtatgtttgtctttgcaagggcataaccgattcgcaaatccgcactgcggttaacaatggcgcagaaagcatgcgcgctgtacgcgatcaactaggcgtggcatctcaatgcggcaaatgctcttctttttgcagagaaatcgttcgcgaaaccttagagaacaccgccgatcttggcgcaggaagcttctatcaggtagcttaa

SEQ ID NO: 69288 - protein, 68 aa, Microbulbifer degradans 2-40
MYVCLCKGITDSQIRTAVNNGAESMRAVRDQLGVASQCGKCSSFCREIVRETLENTADLGAGSFYQVA

SEQ ID NO: 69289 - DNA, 408 bp, Chromohalobacter salexigens DSM 3043
  CDS (1)..(408): transl_table=11
gtgttgttgaggcgacaaaagcctcccaatcccttccacccccacccacccggcaattctccgtttagccccacctttcagccacttaccggcacgttagccgaaagtcgagcgcccgccgagcgaaaagatagtgattgggggttgaaagtctttatgcgaatcatttacattcactatcatagcgatcagcgaggtgatggaatgtacgtgtgcatatgccgaggcgtgaccgacaatgccattcgcgaggccgttgaagacggcgcgcgtagctggcgtgaagtgcgcgagcgcaccgagtgtgcgactcagtgtggccgctgcgcctgcacggccaaggccatcacgcgtgatgccatcacccaggaaatgatgccgagcgaggatctcgcctacgccgtctag

SEQ ID NO: 69290 - protein, 135 aa, Chromohalobacter salexigens DSM 3043
MLLRRQKPPNPFHPHPPGNSPFSPTFQPLTGTLAESRAPAERKDSDWGLKVFMRIIYIHYHSDQRGDGMYVCICRGVTDNAIREAVEDGARSWREVRERTECATQCGRCACTAKAITRDAITQEMMPSEDLAYAV

SEQ ID NO: 69291 - DNA, 192 bp, Shewanella baltica OS155
  CDS (1)..(192): transl_table=11
atgtacgtttgtctttgccatgcgatcaccgatacgcaaattaaaaatgccgtaagccagggcgatagctcgcttgctgacgtgaaaaagcgcttaggtgttgccgatcaatgtggcaagtgtgcaagaatggcggtacagatcatccagaatcaattagagcgtgagcctaattattacgaagtcgcgtaa

SEQ ID NO: 69292 - protein, 63 aa, Shewanella baltica OS155
MYVCLCHAITDTQIKNAVSQGDSSLADVKKRLGVADQCGKCARMAVQIIQNQLEREPNYYEVA

SEQ ID NO: 69293 - DNA, 252 bp, Shewanella amazonensis SB2B
  CDS (1)..(252): transl_table=11
atgatgagaacggtttttatttataatccacatcattcaaccgccggagcatttttcaccatgtatgtctgtgtttgttatgccgtgacagatacccaaatccaggaagccgttcatcagggcgatattaccttggccgcggtgaaaaaacgcctgggtgttggcagccagtgtggtaaatgcattcaaacgaccctcgaagtgattcagcgccagctggacgtcgagcccaattactacgaagtcgcctga

SEQ ID NO: 69294 - protein, 83 aa, Shewanella amazonensis SB2B
MMRTVFIYNPHHSTAGAFFTMYVCVCYAVTDTQIQEAVHQGDITLAAVKKRLGVGSQCGKCIQTTLEVIQRQLDVEPNYYEVA

SEQ ID NO: 69295 - DNA, 192 bp, Shewanella denitrificans OS-217
  CDS (1)..(192): transl_table=11
atgttcgtttgcctttgccatgcgataaccgatactcagatcaaacaagccgttggtcagggtgacagttcattggccgatgtaaaaaagcgtctaggtgtagccgatcaatgcggaaagtgcgcccgtatggcgacgcaaatcatccaaaaccaagttgcaatcgagcctaatttctacgaagtcgcttaa

SEQ ID NO: 69296 - protein, 63 aa, Shewanella denitrificans OS-217
MFVCLCHAITDTQIKQAVGQGDSSLADVKKRLGVADQCGKCARMATQIIQNQVAIEPNFYEVA

SEQ ID NO: 69297 - DNA, 192 bp, Shewanella frigidimarina NCIMB 400
  CDS (1)..(192): transl_table=11
atgttcgtttgtctttgtcatgctattaccgacactcaaattaaagctgctgttagcttaggtgacagttcgttagctgatgtaaagaaacgtcttggcgttgcagaccaatgcggcaaatgtgcccgcatggctagtcaaatcattcaaacacagcttgagtacgaacctaatttctatgaagttgcctag

SEQ ID NO: 69298 - protein, 63 aa, Shewanella frigidimarina NCIMB 400
MFVCLCHAITDTQIKAAVSLGDSSLADVKKRLGVADQCGKCARMASQIIQTQLEYEPNFYEVA

SEQ ID NO: 69299 - DNA, 195 bp, Pseudoalteromonas atlantica T6c
  CDS (1)..(195): transl_table=11
atgtacgtttgtttgtgtcacggcattaccgacaaagctattaaacaggccgttcgcgaagacggtgtgggcaatatgcgccagttacgtgaagcgcttggcgtgggtgatcagtgcggcaaatgtgtgcgtatggcgcaaagcatcgttgacaacacgattattgatgaatctctatttaaagaagtgtgttaa

SEQ ID NO: 69300 - protein, 64 aa, Pseudoalteromonas atlantica T6c
MYVCLCHGITDKAIKQAVREDGVGNMRQLREALGVGDQCGKCVRMAQSIVDNTIIDESLFKEVC

SEQ ID NO: 69301 - DNA, 192 bp, Shewanella putrefaciens CN-32
  CDS (1)..(192): transl_table=11
atgtacgtttgtctttgccatgccatcacagatacgcagattaaaaacgcggtaagccagggcgatagttcccttgccgatgtgaaaaagcgtttaggtgttgcagatcaatgtggcaaatgtgcaagaatggccgtacagataatccaaaatcaattggagctagaacctaaatattatgaagtggcgtaa

SEQ ID NO: 69302 - protein, 63 aa, Shewanella putrefaciens CN-32
MYVCLCHAITDTQIKNAVSQGDSSLADVKKRLGVADQCGKCARMAVQIIQNQLELEPKYYEVA

SEQ ID NO: 69303 - DNA, 207 bp, Marinobacter aquaeolei VT8
  CDS (1)..(207): transl_table=11
atgtacgtttgcctgtgttacggggtaacagacagagaaatccgcgaagccgctgaaagcggtgtcagttccatgcgccagctcggcaaggaacttggcgtcggtcgccagtgcggtcgttgcgcctgcactgcccgggaaattctgaaagagtcccggtcaccggattatatggcgctcgccaatatgctggcgcaacccgcctga

SEQ ID NO: 69304 - protein, 68 aa, Marinobacter aquaeolei VT8
MYVCLCYGVTDREIREAAESGVSSMRQLGKELGVGRQCGRCACTAREILKESRSPDYMALANMLAQPA

SEQ ID NO: 69305 - DNA, 195 bp, Yersinia mollaretii ATCC 43969
  CDS (1)..(195)
atgtacgtttgtctgtgtaatgccgtatctgacaaagttatccgtaaagctgttcgtcagcaccatccacatactattcagcagttgcgtcaactagtacccatcggtacagactgcggaaagtgcattcgacaggccagagaaatcttgatcgaggaacgcgctaatattccagaaatgaatgatgttgcttag

SEQ ID NO: 69306 - protein, 64 aa, Yersinia mollaretii ATCC 43969
MYVCLCNAVSDKVIRKAVRQHHPHTIQQLRQLVPIGTDCGKCIRQAREILIEERANIPEMNDVA

SEQ ID NO: 69307 - DNA, 195 bp, Yersinia intermedia ATCC 29909
  CDS (1)..(195)
atgtacgtttgcctgtgtaatgcggtatctgacaaagttatccgtaaagctgtacgtcagcaccatccacataccattaaacaactgcgtcaattggtacccattggtacagactgcggtaagtgcatccgacaggccagagagatactgattgaggagcgcgcgaacattccagaaatgaatgatgttgcctaa

SEQ ID NO: 69308 - protein, 64 aa, Yersinia intermedia ATCC 29909
MYVCLCNAVSDKVIRKAVRQHHPHTIKQLRQLVPIGTDCGKCIRQAREILIEERANIPEMNDVA

SEQ ID NO: 69309 - DNA, 192 bp, Shewanella sp. PV-4
  CDS (1)..(192): transl_table=11
atgtatgtttgcctttgccacgccattaccgacaagcaaataaaagaagctgtcgatcaaggagatatgtctcttgccgacgttaagcgtcgtctgggtgttggcaatcaatgtggtaaatgtagcaagatggccaccgagatcatccaggcccgcctcgatgtaacccccaacttctacgaagtggcttag

SEQ ID NO: 69310 - protein, 63 aa, Shewanella sp. PV-4
MYVCLCHAITDKQIKEAVDQGDMSLADVKRRLGVGNQCGKCSKMATEIIQARLDVTPNFYEVA

SEQ ID NO: 69311 - DNA, 192 bp, Shewanella sp. ANA-3
  CDS (1)..(192): transl_table=11
atgtacgtttgtctctgccatgccatcacagatacgcaaatcaaaaacgcggtaagtcagggcgactctagccttgctgacgttaaaaagcgtttaggcgttgccgatcaatgcggtaagtgcgccagaatggccgtacaaattattcagaaccaattagaaattgaacctaattactacgaagtggcttaa

SEQ ID NO: 69312 - protein, 63 aa, Shewanella sp. ANA-3
MYVCLCHAITDTQIKNAVSQGDSSLADVKKRLGVADQCGKCARMAVQIIQNQLEIEPNYYEVA

SEQ ID NO: 69313 - DNA, 192 bp, Shewanella sp. MR-7
  CDS (1)..(192): transl_table=11
atgtacgtttgtctctgccatgccatcacagataggcaaatcaaaaacgccgtaagtcagggcgatactagccttgctgacgttaaaaagcgtttaggcgttgccgatcaatgcggtaagtgcgcgagaatggccgtacaaatcatccaaaaccaactggaaattgaacctaaatactacgaagtcgcttaa

SEQ ID NO: 69314 - protein, 63 aa, Shewanella sp. MR-7
MYVCLCHAITDRQIKNAVSQGDTSLADVKKRLGVADQCGKCARMAVQIIQNQLEIEPKYYEVA

SEQ ID NO: 69315 - DNA, 222 bp, Azotobacter vinelandii
  CDS (1)..(222): transl_table=11
atgtacgtatgtctttgccaaggtattaccgatggtcaaatccgtagcgcaattcagggcggctgctgcacttatcgtgatgtgcggattgccttgggcgttggcacacagtgcggcaaatgcgcctgcgtcgccaaacagatcgcgcgagaaacccttggcgaaggggcacaaaacacccaggatgcaaccttctgcccggcggcactggctgcctcttga

SEQ ID NO: 69316 - protein, 73 aa, Azotobacter vinelandii
MYVCLCQGITDGQIRSAIQGGCCTYRDVRIALGVGTQCGKCACVAKQIARETLGEGAQNTQDATFCPAALAAS

SEQ ID NO: 69317 - DNA, 195 bp, Salmonella typhi
  CDS (1)..(195): transl_table=11
atgtacgtttgtttgtgtaatggtataagcgataaaaaaatccgccaggctgtacgacaatttcatccacagtcatttcaacagttgcgtaaatttattcctgtgggaaatcaatgtggtaagtgtattcgcgccgcgcgagaagtgatgcaggatgagttaacgcaaatgccggaatttaaagagatcgcctga

SEQ ID NO: 69318 - protein, 64 aa, Salmonella typhi
MYVCLCNGISDKKIRQAVRQFHPQSFQQLRKFIPVGNQCGKCIRAAREVMQDELTQMPEFKEIA

SEQ ID NO: 69319 - DNA, 195 bp, Serratia marcescens
  CDS (1)..(195): transl_table=11
atgtatgtatgtctgtgtaatgcggtgactgacaaagcgatccgtaatgcggtgcgtcagcacaacccccataccatgaagcaactgcgtgaacttgtgccgattggtaccgattgtggaaagtgcattcgtcaggcaagacagattatggtggaggaatgcggaactatcatcccaatgcatgaagttgcctaa

SEQ ID NO: 69320 - protein, 64 aa, Serratia marcescens
MYVCLCNAVTDKAIRNAVRQHNPHTMKQLRELVPIGTDCGKCIRQARQIMVEECGTIIPMHEVA

SEQ ID NO: 69321 - DNA, 26 bp, Artificial sequence
  (1)..(26): primer
atgtacgtttgtctttgtaatggtat

SEQ ID NO: 69322 - DNA, 23 bp, Artificial sequence
  (1)..(23): primer
ttatgcggactccttaaactccg

SEQ ID NO: 69323 - protein, 46 aa, Artificial sequence
  Variant (7)..(10): xaa in position 7 to 10 is any amino acid
  Variant (12)..(13): xaa in position 12 to 13 is any amino acid
  Variant (15)..(37): xaa in position 15 to 37 is any amino acid
  Variant (38)..(38): xaa in position 38 is any or no amino acid
  Variant (43)..(45): xaa in position 43 to 45 is any amino acid
MYVCLCXXXXDXXIXXXXXXXXXXXXXXXXXXXXXXXXCGKCXXXA

SEQ ID NO: 69324 - protein, 14 aa, Artificial sequence
  Variant (5)..(5): xaa in position 5 is Ile, Leu or Val
  Variant (7)..(7): xaa in position 7 is any amino acid
  Variant (8)..(8): xaa in position 8 is Ala or Gly
  Variant (9)..(9): xaa in position 9 is Ile or Val
  Variant (10)..(10): xaa in position 10 is Ser or Thr
  Variant (12)..(13): xaa in position 12 to 13 is any amino acid
MYVCXCXXXXDXXI

SEQ ID NO: 69325 - protein, 8 aa, Artificial sequence
  Variant (5)..(7): xaa in position 5 to 7 is any amino acid
  Variant (8)..(8): xaa in position 8 is Ala, Thr or Val
CGKCXXXX

SEQ ID NO: 69326 - DNA, 1026 bp, Escherichia coli K12; identical to SEQ ID NO: 32742
  CDS (1)..(1026): transl_table=11

SEQ ID NO: 69327 - protein, 341 aa, Escherichia coli K12; identical to SEQ ID NO: 32743

SEQ ID NO: 69328 - DNA, 1113 bp, Deinococcus radiodurans R1; identical to SEQ ID NO: 32744
  CDS (1)..(1113): transl_table=11

SEQ ID NO: 69329 - protein, 370 aa, Deinococcus radiodurans R1; identical to SEQ ID NO: 32745

SEQ ID NO: 69330 - DNA, 1062 bp, Bacillus subtilis subsp. subtilis str. 168; identical to SEQ ID NO: 32746
  CDS (1)..(1062): transl_table=11

SEQ ID NO: 69331 - protein, 353 aa, Bacillus subtilis subsp. subtilis str. 168; identical to SEQ ID NO: 32747

SEQ ID NO: 69332 - DNA, 1044 bp, Caenorhabditis elegans; identical to SEQ ID NO: 32748
  CDS (1)..(1044)

SEQ ID NO: 69333 - protein, 347 aa, Caenorhabditis elegans; identical to SEQ ID NO: 32749

SEQ ID NO: 69334 - DNA, 1047 bp, Pseudomonas putida; identical to SEQ ID NO: 32750
  CDS (1)..(1047): transl_table=11

SEQ ID NO: 69335 - protein, 348 aa, Pseudomonas putida; identical to SEQ ID NO: 32751

SEQ ID NO: 69336 - DNA, 1053 bp, Thermoanaerobacter tengcongensis MB4; identical to SEQ ID NO: 32752
  CDS (1)..(1053): transl_table=11

SEQ ID NO: 69337 - protein, 350 aa, Thermoanaerobacter tengcongensis MB4; identical to SEQ ID NO: 32753

SEQ ID NO: 69338 - DNA, 1035 bp, Oceanobacillus iheyensis HTE831; identical to SEQ ID NO: 32754
  CDS (1)..(1035): transl_table=11

SEQ ID NO: 69339 - protein, 344 aa, Oceanobacillus iheyensis HTE831; identical to SEQ ID NO: 32755

SEQ ID NO: 69340 - DNA, 1056 bp, Oceanobacillus iheyensis HTE831; identical to SEQ ID NO: 32756
  CDS (1)..(1056): transl_table=11

SEQ ID NO: 69341 - protein, 351 aa, Oceanobacillus iheyensis HTE831; identical to SEQ ID NO: 32757

SEQ ID NO: 69342 - DNA, 1041 bp, Rhodopirellula baltica SH 1; identical to SEQ ID NO: 32758
  CDS (1)..(1041): transl_table=11

SEQ ID NO: 69343 - protein, 346 aa, Rhodopirellula baltica SH 1; identical to SEQ ID NO: 32759

SEQ ID NO: 69344 - DNA, 1029 bp, Legionella pneumophila subsp. pneumophila str. Philadelphia 1; identical to SEQ ID NO: 32760
  CDS (1)..(1029): transl_table=11

SEQ ID NO: 69345 - protein, 342 aa, Legionella pneumophila subsp. pneumophila str. Philadelphia 1; identical to SEQ ID NO: 32761

SEQ ID NO: 69346 - DNA, 984 bp, Photobacterium profundum SS9; identical to SEQ ID NO: 32762
  CDS (1)..(984): transl_table=11

SEQ ID NO: 69347 - protein, 327 aa, Photobacterium profundum SS9; identical to SEQ ID NO: 32763

SEQ ID NO: 69348 - DNA, 1044 bp, Silicibacter pomeroyi DSS-3; identical to SEQ ID NO: 32764
  CDS (1)..(1044): transl_table=11

SEQ ID NO: 69349 - protein, 347 aa, Silicibacter pomeroyi DSS-3; identical to SEQ ID NO: 32765

SEQ ID NO: 69350 - DNA, 1074 bp, Staphylococcus haemolyticus JCSC1435; identical to SEQ ID NO: 32766
  CDS (1)..(1074): transl_table=11

SEQ ID NO: 69351 - protein, 357 aa, Staphylococcus haemolyticus JCSC1435; identical to SEQ ID NO: 32767

SEQ ID NO: 69352 - DNA, 1026 bp, Colwellia psychrerythraea 34H; identical to SEQ ID NO: 32768
  CDS (1)..(1026): transl_table=11

SEQ ID NO: 69353 - protein, 341 aa, Colwellia psychrerythraea 34H; identical to SEQ ID NO: 32769

SEQ ID NO: 69354 - DNA, 1071 bp, Staphylococcus saprophyticus subsp. saprophyticus ATCC 15305; identical to SEQ ID NO: 32770
  CDS (1)..(1071): transl_table=11

SEQ ID NO: 69355 - protein, 356 aa, Staphylococcus saprophyticus subsp. saprophyticus ATCC 15305; identical to SEQ ID NO: 32771

SEQ ID NO: 69356 - DNA, 1029 bp, Burkholderia vietnamiensis G4; identical to SEQ ID NO: 32772
  CDS (1)..(1029): transl_table=11

SEQ ID NO: 69357 - protein, 342 aa, Burkholderia vietnamiensis G4; identical to SEQ ID NO: 32773

SEQ ID NO: 69358 - DNA, 1026 bp, Shewanella amazonensis SB2B; identical to SEQ ID NO: 32774
  CDS (1)..(1026): transl_table=11

SEQ ID NO: 69359 - protein, 341 aa, Shewanella amazonensis SB2B; identical to SEQ ID NO: 32775

SEQ ID NO: 69360 - DNA, 1047 bp, Pseudomonas putida; identical to SEQ ID NO: 32776
  CDS (1)..(1047): transl_table=11

SEQ ID NO: 69361 - protein, 348 aa, Pseudomonas putida; identical to SEQ ID NO: 32777

SEQ ID NO: 69362 - DNA, 1047 bp, Pseudomonas sp; identical to SEQ ID NO: 32778
  CDS (1)..(1047): transl_table=11

SEQ ID NO: 69363 - protein, 348 aa, Pseudomonas sp; identical to SEQ ID NO: 32779

SEQ ID NO: 69364 - DNA, 1047 bp, Pseudomonas putida; identical to SEQ ID NO: 32780
  CDS (1)..(1047): transl_table=11

SEQ ID NO: 69365 - protein, 348 aa, Pseudomonas putida; identical to SEQ ID NO: 32781

SEQ ID NO: 69366 - DNA, 1077 bp, Aspergillus niger; identical to SEQ ID NO: 32782
  CDS (1)..(1077)

SEQ ID NO: 69367 - protein, 358 aa, Aspergillus niger; identical to SEQ ID NO: 32783

SEQ ID NO: 69368 - DNA, 1044 bp, Caenorhabditis briggsae; identical to SEQ ID NO: 32784
  CDS (1)..(1044)

SEQ ID NO: 69369 - protein, 347 aa, Caenorhabditis briggsae; identical to SEQ ID NO: 32785

SEQ ID NO: 69370 - DNA, 1107 bp, Malus domestica; identical to SEQ ID NO: 32786
  CDS (1)..(1107)

SEQ ID NO: 69371 - protein, 368 aa, Malus domestica; identical to SEQ ID NO: 32787

SEQ ID NO: 69372 - DNA, 1032 bp, Bacillus halodurans; identical to SEQ ID NO: 32788
  CDS (1)..(1032): transl_table=11

SEQ ID NO: 69373 - protein, 343 aa, Bacillus halodurans; identical to SEQ ID NO: 32789

SEQ ID NO: 69374 - DNA, 1062 bp, Bacillus subtilis; identical to SEQ ID NO: 32746
  CDS (1)..(1062)

SEQ ID NO: 69375 - protein, 353 aa, Bacillus subtilis; identical to SEQ ID NO: 32747

SEQ ID NO: 69376 - DNA, 1044 bp, Bacillus subtilis; identical to SEQ ID NO: 32792
  CDS (1)..(1044): transl_table=11

SEQ ID NO: 69377 - protein, 347 aa, Bacillus subtilis; identical to SEQ ID NO: 32793

SEQ ID NO: 69378 - DNA, 1032 bp, Burkholderia mallei; identical to SEQ ID NO: 32794
  CDS (1)..(1032): transl_table=11

SEQ ID NO: 69379 - protein, 343 aa, Burkholderia mallei; identical to SEQ ID NO: 32795

SEQ ID NO: 69380 - DNA, 1026 bp, Chromobacterium violaceum; identical to SEQ ID NO: 32796
  CDS (1)..(1026): transl_table=11

SEQ ID NO: 69381 - protein, 341 aa, Chromobacterium violaceum; identical to SEQ ID NO: 32797

SEQ ID NO: 69382 - DNA, 1029 bp, Coxiella burnetii; identical to SEQ ID NO: 32798
  CDS (1)..(1029): transl_table=11

SEQ ID NO: 69383 - protein, 342 aa, Coxiella burnetii; identical to SEQ ID NO: 32799

SEQ ID NO: 69384 - DNA, 1047 bp, Deinococcus radiodurans; identical to SEQ ID NO: 32800
  CDS (1)..(1047)

SEQ ID NO: 69385 - protein, 348 aa, Deinococcus radiodurans; identical to SEQ ID NO: 32801

SEQ ID NO: 69386 - DNA, 1086 bp, Erwinia carotovora subsp; identical to SEQ ID NO: 32802
  CDS (1)..(1086): transl_table=11

SEQ ID NO: 69387 - protein, 361 aa, Erwinia carotovora subsp; identical to SEQ ID NO: 32803

SEQ ID NO: 69388 - DNA, 1056 bp, Francisella tularensis subsp; identical to SEQ ID NO: 32804
  CDS (1)..(1056): transl_table=11

SEQ ID NO: 69389 - protein, 351 aa, Francisella tularensis subsp; identical to SEQ ID NO: 32805

SEQ ID NO: 69390 - DNA, 1026 bp, Idiomarina loihiensis; identical to SEQ ID NO: 32806
  CDS (1)..(1026): transl_table=11

SEQ ID NO: 69391 - protein, 341 aa, Idiomarina loihiensis; identical to SEQ ID NO: 32807

SEQ ID NO: 69392 - DNA, 1023 bp, Legionella pneumophila; identical to SEQ ID NO: 32808
  CDS (1)..(1023): transl_table=11

SEQ ID NO: 69393 - protein, 340 aa, Legionella pneumophila; identical to SEQ ID NO: 32809

SEQ ID NO: 69394 - DNA, 1023 bp, Legionella pneumophila subsp; identical to SEQ ID NO: 32810
  CDS (1)..(1023)

SEQ ID NO: 69395 - protein, 340 aa, Legionella pneumophila subsp; identical to SEQ ID NO: 32811

SEQ ID NO: 69396 - DNA, 1029 bp, Parachlamydia sp; identical to SEQ ID NO: 32812
  CDS (1)..(1029): transl_table=11

SEQ ID NO: 69397 - protein, 342 aa, Parachlamydia sp; identical to SEQ ID NO: 32813

SEQ ID NO: 69398 - DNA, 1026 bp, Photorhabdus luminescens subsp; identical to SEQ ID NO: 32814
  CDS (1)..(1026): transl_table=11

SEQ ID NO: 69399 - protein, 341 aa, Photorhabdus luminescens subsp; identical to SEQ ID NO: 32815

SEQ ID NO: 69400 - DNA, 1032 bp, Photobacterium profundum; identical to SEQ ID NO: 32816
  CDS (1)..(1032)

SEQ ID NO: 69401 - protein, 343 aa, Photobacterium profundum; identical to SEQ ID NO: 32817

SEQ ID NO: 69402 - DNA, 1038 bp, Propionibacterium acnes; identical to SEQ ID NO: 32818
  CDS (1)..(1038): transl_table=11

SEQ ID NO: 69403 - protein, 345 aa, Propionibacterium acnes; identical to SEQ ID NO: 32819

SEQ ID NO: 69404 - DNA, 1047 bp, Pyrococcus abyssi; identical to SEQ ID NO: 32820
  CDS (1)..(1047): transl_table=11

SEQ ID NO: 69405 - protein, 348 aa, Pyrococcus abyssi; identical to SEQ ID NO: 32821

SEQ ID NO: 69406 - DNA, 1047 bp, Pyrococcus furiosus; identical to SEQ ID NO: 32822
  CDS (1)..(1047): transl_table=11

SEQ ID NO: 69407 - protein, 348 aa, Pyrococcus furiosus; identical to SEQ ID NO: 32823

SEQ ID NO: 69408 - DNA, 1047 bp, Pyrococcus horikoshii; identical to SEQ ID NO: 32824
  CDS (1)..(1047): transl_table=11

SEQ ID NO: 69409 - protein, 348 aa, Pyrococcus horikoshii; identical to SEQ ID NO: 32825

SEQ ID NO: 69410 - DNA, 1053 bp, Pyrococcus kodakaraensis; identical to SEQ ID NO: 32826
  CDS (1)..(1053): transl_table=11

SEQ ID NO: 69411 - protein, 350 aa, Pyrococcus kodakaraensis; identical to SEQ ID NO: 32827

SEQ ID NO: 69412 - DNA, 1035 bp, Rhizobium loti; identical to SEQ ID NO: 32828
  CDS (1)..(1035): transl_table=11

SEQ ID NO: 69413 - protein, 344 aa, Rhizobium loti; identical to SEQ ID NO: 32829

SEQ ID NO: 69414 - DNA, 1035 bp, Rhizobium meliloti; identical to SEQ ID NO: 32830
  CDS (1)..(1035): transl_table=11

SEQ ID NO: 69415 - protein, 344 aa, Rhizobium meliloti; identical to SEQ ID NO: 32831

SEQ ID NO: 69416 - DNA, 1026 bp, Shewanella oneidensis; identical to SEQ ID NO: 32832
  CDS (1)..(1026): transl_table=11

SEQ ID NO: 69417 - protein, 341 aa, Shewanella oneidensis; identical to SEQ ID NO: 32833

SEQ ID NO: 69418 - DNA, 1029 bp, Silicibacter pomeroyi; identical to SEQ ID NO: 32834
  CDS (1)..(1029)

SEQ ID NO: 69419 - protein, 342 aa, Silicibacter pomeroyi; identical to SEQ ID NO: 32835

SEQ ID NO: 69420 - DNA, 1029 bp, Streptomyces avermitilis; identical to SEQ ID NO: 32836
  CDS (1)..(1029): transl_table=11

SEQ ID NO: 69421 - protein, 342 aa, Streptomyces avermitilis; identical to SEQ ID NO: 32837

SEQ ID NO: 69422 - DNA, 1029 bp, Streptomyces coelicolor; identical to SEQ ID NO: 32838
  CDS (1)..(1029): transl_table=11

SEQ ID NO: 69423 - protein, 342 aa, Streptomyces coelicolor; identical to SEQ ID NO: 32839

SEQ ID NO: 69424 - DNA, 1056 bp, Symbiobacterium thermophilum; identical to SEQ ID NO: 32840
  CDS (1)..(1056): transl_table=11

SEQ ID NO: 69425 - protein, 351 aa, Symbiobacterium thermophilum; identical to SEQ ID NO: 32841

SEQ ID NO: 69426 - DNA, 1032 bp, Thermus thermophilus; identical to SEQ ID NO: 32842
  CDS (1)..(1032): transl_table=11

SEQ ID NO: 69427 - protein, 343 aa, Thermus thermophilus; identical to SEQ ID NO: 32843

SEQ ID NO: 69428 - DNA, 1032 bp, Thermus thermophilus; identical to SEQ ID NO: 32844
  CDS (1)..(1032): transl_table=11

SEQ ID NO: 69429 - protein, 343 aa, Thermus thermophilus; identical to SEQ ID NO: 32845

SEQ ID NO: 69430 - DNA, 1044 bp, Thermoanaerobacter tengcongensis; identical to SEQ ID NO: 32846
  CDS (1)..(1044)

SEQ ID NO: 69431 - protein, 347 aa, Thermoanaerobacter tengcongensis; identical to SEQ ID NO: 32847

SEQ ID NO: 69432 - DNA, 1032 bp, Vibrio cholerae; identical to SEQ ID NO: 32848
  CDS (1)..(1032): transl_table=11

SEQ ID NO: 69433 - protein, 343 aa, Vibrio cholerae; identical to SEQ ID NO: 32849

SEQ ID NO: 69434 - DNA, 1032 bp, Vibrio fischeri; identical to SEQ ID NO: 32850
  CDS (1)..(1032): transl_table=11

SEQ ID NO: 69435 - protein, 343 aa, Vibrio fischeri; identical to SEQ ID NO: 32851

SEQ ID NO: 69436 - DNA, 1032 bp, Vibrio parahaemolyticus; identical to SEQ ID NO: 32852
  CDS (1)..(1032): transl_table=11

SEQ ID NO: 69437 - protein, 343 aa, Vibrio parahaemolyticus; identical to SEQ ID NO: 32853

SEQ ID NO: 69438 - DNA, 1032 bp, Vibrio vulnificus; identical to SEQ ID NO: 32854
  CDS (1)..(1032): transl_table=11

SEQ ID NO: 69439 - protein, 343 aa, Vibrio vulnificus; identical to SEQ ID NO: 32855

SEQ ID NO: 69440 - DNA, 1032 bp, Vibrio vulnificus; identical to SEQ ID NO: 32856
  CDS (1)..(1032): transl_table=11

SEQ ID NO: 69441 - protein, 343 aa, Vibrio vulnificus; identical to SEQ ID NO: 32857

SEQ ID NO: 69442 - DNA, 1023 bp, Xanthomonas campestris pv; identical to SEQ ID NO: 32858
  CDS (1)..(1023): transl_table=11

SEQ ID NO: 69443 - protein, 340 aa, Xanthomonas campestris pv; identical to SEQ ID NO: 32859

SEQ ID NO: 69444 - DNA, 1026 bp, Yersinia pestis; identical to SEQ ID NO: 32860
  CDS (1)..(1026): transl_table=11

SEQ ID NO: 69445 - protein, 341 aa, Yersinia pestis; identical to SEQ ID NO: 32861

SEQ ID NO: 69446 - DNA, 1026 bp, Yersinia pseudotuberculosis; identical to SEQ ID NO: 32862
  CDS (1)..(1026): transl_table=11

SEQ ID NO: 69447 - protein, 341 aa, Yersinia pseudotuberculosis; identical to SEQ ID NO: 32863

SEQ ID NO: 69448 - DNA, 25 bp, Artificial sequence
  (1)..(25): primer
atgaaagcgttatccaaactgaaag

SEQ ID NO: 69449 - DNA, 24 bp, Artificial sequence
  (1)..(24): primer
ttaatcccagctcagaataacttt

SEQ ID NO: 69450 - protein, 375 aa, Artificial sequence; identical to SEQ ID NO: 32866
  Variant (2)..(3): xaa in position 2 to 3 is any amino acid
  Variant (5)..(5): xaa in position 5 is any amino acid
  Variant (7)..(11): xaa in position 7 to 11 is any amino acid
  Variant (13)..(20): xaa in position 13 to 20 is any amino acid
  Variant (21)..(21): xaa in position 21 is any or no amino acid
  Variant (23)..(24): xaa in position 23 to 24 is any amino acid
  Variant (26)..(27): xaa in position 26 to 27 is any amino acid
  Variant (28)..(28): xaa in position 28 is any or no amino acid
  Variant (35)..(38): xaa in position 35 to 38 is any amino acid
  Variant (48)..(48): xaa in position 48 is any amino acid
  Variant (50)..(51): xaa in position 50 to 51 is any amino acid
  Variant (54)..(55): xaa in position 54 to 55 is any amino acid
  Variant (56)..(64): xaa in position 56 to 64 is any or no amino acid
  Variant (66)..(67): xaa in position 66 to 67 is any or no amino acid
  Variant (69)..(70): xaa in position 69 to 70 is any amino acid
  Variant (75)..(76): xaa in position 75 to 76 is any amino acid
  Variant (78)..(78): xaa in position 78 is any amino acid
  Variant (80)..(81): xaa in position 80 to 81 is any amino acid
  Variant (84)..(85): xaa in position 84 to 85 is any amino acid
  Variant (87)..(90): xaa in position 87 to 90 is any amino acid
  Variant (93)..(93): xaa in position 93 is any amino acid
  Variant (97)..(97): xaa in position 97 is any amino acid
  Variant (99)..(99): xaa in position 99 is any amino acid
  Variant (100)..(100): xaa in position 100 is any or no amino acid
  Variant (103)..(103): xaa in position 103 is any amino acid
  Variant (106)..(106): xaa in position 106 is any amino acid
  Variant (108)..(109): xaa in position 108 to 109 is any amino acid
  Variant (112)..(112): xaa in position 112 is any amino acid
  Variant (114)..(115): xaa in position 114 to 115 is any amino acid
  Variant (119)..(123): xaa in position 119 to 123 is any amino acid
  Variant (127)..(129): xaa in position 127 to 129 is any amino acid
  Variant (130)..(134): xaa in position 130 to 134 is any or no amino acid
  Variant (136)..(136): xaa in position 136 is any amino acid
  Variant (139)..(139): xaa in position 139 is any amino acid
  Variant (142)..(142): xaa in position 142 is any amino acid
  Variant (145)..(148): xaa in position 145 to 148 is any amino acid
  Variant (150)..(151): xaa in position 150 to 151 is any amino acid
  Variant (153)..(154): xaa in position 153 to 154 is any amino acid
  Variant (155)..(155): xaa in position 155 is any or no amino acid
  Variant (157)..(158): xaa in position 157 to 158 is any amino acid
  Variant (160)..(160): xaa in position 160 is any amino acid
  Variant (164)..(164): xaa in position 164 is any amino acid
  Variant (167)..(167): xaa in position 167 is any amino acid
  Variant (169)..(169): xaa in position 169 is any amino acid
  Variant (173)..(180): xaa in position 173 to 180 is any amino acid
  Variant (181)..(181): xaa in position 181 is any or no amino acid
  Variant (183)..(184): xaa in position 183 to 184 is any amino acid
  Variant (188)..(188): xaa in position 188 is any amino acid
  Variant (190)..(190): xaa in position 190 is any amino acid
  Variant (198)..(201): xaa in position 198 to 201 is any amino acid
  Variant (203)..(204): xaa in position 203 to 204 is any amino acid
  Variant (207)..(208): xaa in position 207 to 208 is any amino acid
  Variant (211)..(211): xaa in position 211 is any amino acid
  Variant (215)..(217): xaa in position 215 to 217 is any amino acid
  Variant (218)..(218): xaa in position 218 is any or no amino acid
  Variant (221)..(222): xaa in position 221 to 222 is any amino acid
  Variant (224)..(225): xaa in position 224 to 225 is any amino acid
  Variant (228)..(231): xaa in position 228 to 231 is any amino acid
  Variant (232)..(232): xaa in position 232 is any or no amino acid
  Variant (235)..(237): xaa in position 235 to 237 is any amino acid
  Variant (238)..(247): xaa in position 238 to 247 is any or no amino acid
  Variant (249)..(254): xaa in position 249 to 254 is any amino acid
  Variant (255)..(262): xaa in position 255 to 262 is any or no amino acid
  Variant (264)..(264): xaa in position 264 is any amino acid
  Variant (267)..(267): xaa in position 267 is any amino acid
  Variant (270)..(270): xaa in position 270 is any amino acid
  Variant (273)..(275): xaa in position 273 to 275 is any amino acid
  Variant (277)..(280): xaa in position 277 to 280 is any amino acid
  Variant (282)..(283): xaa in position 282 to 283 is any amino acid
  Variant (285)..(286): xaa in position 285 to 286 is any amino acid
  Variant (289)..(289): xaa in position 289 is any amino acid
  Variant (291)..(291): xaa in position 291 is any amino acid
  Variant (296)..(306): xaa in position 296 to 306 is any amino acid
  Variant (307)..(307): xaa in position 307 is any or no amino acid
  Variant (310)..(310): xaa in position 310 is any amino acid
  Variant (312)..(312): xaa in position 312 is any amino acid
  Variant (314)..(314): xaa in position 314 is any amino acid
  Variant (316)..(316): xaa in position 316 is any amino acid
  Variant (319)..(319): xaa in position 319 is any amino acid
  Variant (322)..(322): xaa in position 322 is any or no amino acid
  Variant (325)..(325): xaa in position 325 is any amino acid
  Variant (328)..(332): xaa in position 328 to 332 is any amino acid
  Variant (335)..(335): xaa in position 335 is any amino acid
  Variant (338)..(339): xaa in position 338 to 339 is any amino acid
  Variant (340)..(341): xaa in position 340 to 341 is any or no amino acid
  Variant (343)..(344): xaa in position 343 to 344 is any amino acid
  Variant (349)..(357): xaa in position 349 to 357 is any amino acid
  Variant (358)..(358): xaa in position 358 is any or no amino acid
  Variant (361)..(362): xaa in position 361 to 362 is any amino acid
  Variant (364)..(365): xaa in position 364 to 365 is any amino acid
  Variant (367)..(369): xaa in position 367 to 369 is any amino acid
  Variant (370)..(371): xaa in position 370 to 371 is any or no amino acid

SEQ ID NO: 69451 - protein, 11 aa, Artificial sequence
  Variant (6)..(7): xaa in position 6 to 7 is any amino acid
  Variant (9)..(10): xaa in position 9 to 10 is any amino acid
ICGTDXXIXXW

SEQ ID NO: 69452 - protein, 21 aa, Artificial sequence
  Variant (4)..(4): xaa in position 4 is any amino acid
  Variant (5)..(5): xaa in position 5 is Ala, Ser or Val
  Variant (7)..(7): xaa in position 7 is any amino acid
  Variant (8)..(8): xaa in position 8 is Ile or Val
  Variant (9)..(9): xaa in position 9 is any amino acid
  Variant (10)..(10): xaa in position 10 is Ala, Asp, Glu, Gly or Gln
  Variant (11)..(11): xaa in position 11 is Phe, Ile, Leu, Met or Val
  Variant (13)..(13): xaa in position 13 is any amino acid
  Variant (14)..(14): xaa in position 14 is Ala, Asp, Glu, Gly, Asn or Ser
  Variant (16)..(19): xaa in position 16 to 19 is any amino acid
  Variant (20)..(20): xaa in position 20 is Ile, Leu, Pro or Val
GHEXXGXXXXXGXXVXXXXXG

SEQ ID NO: 69453 - protein, 36 aa, Artificial sequence; identical to SEQ ID NO: 32869
  Variant (2)..(2): xaa in position 2 is any amino acid
  Variant (5)..(5): xaa in position 5 is Ile or Val
  Variant (7)..(8): xaa in position 7 to 8 is any amino acid
  Variant (9)..(9): xaa in position 9 is Ala, Cys, Gly, Asn or Ser
  Variant (10)..(12): xaa in position 10 to 12 is any amino acid
  Variant (13)..(13): xaa in position 13 is Ala, Cys or Val
  Variant (14)..(16): xaa in position 14 to 16 is any amino acid
  Variant (19)..(20): xaa in position 19 to 20 is any amino acid
  Variant (21)..(22): xaa in position 21 to 22 is any or no amino acid
  Variant (24)..(24): xaa in position 24 is any amino acid
  Variant (25)..(26): xaa in position 25 to 26 is any or no amino acid
  Variant (28)..(31): xaa in position 28 to 31 is any amino acid
  Variant (34)..(35): xaa in position 34 to 35 is any amino acid

SEQ ID NO: 69454 - DNA, 609 bp, Escherichia coli; identical to SEQ ID NO: 48336
  CDS (1)..(609)

SEQ ID NO: 69455 - protein, 202 aa, Escherichia coli; identical to SEQ ID NO: 48337

SEQ ID NO: 69456 - DNA, 552 bp, Vibrio cholerae O1 biovar eltor str. N16961; identical to SEQ ID NO: 48338
  CDS (1)..(552): transl_table=11

SEQ ID NO: 69457 - protein, 183 aa, Vibrio cholerae O1 biovar eltor str. N16961; identical to SEQ ID NO: 48339

SEQ ID NO: 69458 - DNA, 513 bp, Pasteurella multocida subsp. multocida str. Pm70; identical to SEQ ID NO: 48340
  CDS (1)..(513): transl_table=11

SEQ ID NO: 69459 - protein, 170 aa, Pasteurella multocida subsp. multocida str. Pm70; identical to SEQ ID NO: 48341

SEQ ID NO: 69460 - DNA, 537 bp, Pseudomonas aeruginosa PAO1; identical to SEQ ID NO: 48342
  CDS (1)..(537): transl_table=11

SEQ ID NO: 69461 - protein, 178 aa, Pseudomonas aeruginosa PAO1; identical to SEQ ID NO: 48343

SEQ ID NO: 69462 - DNA, 498 bp, Escherichia coli O157:H7; identical to SEQ ID NO: 48344
  CDS (1)..(498): transl_table=11

SEQ ID NO: 69463 - protein, 165 aa, Escherichia coli O157:H7; identical to SEQ ID NO: 48345

SEQ ID NO: 69464 - DNA, 525 bp, Yersinia pestis CO92; identical to SEQ ID NO: 48346
  CDS (1)..(525): transl_table=11

SEQ ID NO: 69465 - protein, 174 aa, Yersinia pestis CO92; identical to SEQ ID NO: 48347

SEQ ID NO: 69466 - DNA, 498 bp, Salmonella typhimurium LT2; identical to SEQ ID NO: 48348
  CDS (1)..(498): transl_table=11

SEQ ID NO: 69467 - protein, 165 aa, Salmonella typhimurium LT2; identical to SEQ ID NO: 48349

SEQ ID NO: 69468 - DNA, 531 bp, Ralstonia solanacearum GMI1000; identical to SEQ ID NO: 48350
  CDS (1)..(531): transl_table=11

SEQ ID NO: 69469 - protein, 176 aa, Ralstonia solanacearum GMI1000; identical to SEQ ID NO: 48351

SEQ ID NO: 69470 - DNA, 567 bp, Yersinia pestis KIM; identical to SEQ ID NO: 48352
  CDS (1)..(567): transl_table=11

SEQ ID NO: 69471 - protein, 188 aa, Yersinia pestis KIM; identical to SEQ ID NO: 48353

SEQ ID NO: 69472 - DNA, 498 bp, Shigella flexneri 2a str. 301; identical to SEQ ID NO: 48354
  CDS (1)..(498): transl_table=11

SEQ ID NO: 69473 - protein, 165 aa, Shigella flexneri 2a str. 301; identical to SEQ ID NO: 48355

SEQ ID NO: 69474 - DNA, 570 bp, Shewanella oneidensis MR-1; identical to SEQ ID NO: 48356
  CDS (1)..(570): transl_table=11

SEQ ID NO: 69475 - protein, 189 aa, Shewanella oneidensis MR-1; identical to SEQ ID NO: 48357

SEQ ID NO: 69476 - DNA, 558 bp, Pseudomonas putida KT2440; identical to SEQ ID NO: 48358
  CDS (1)..(558): transl_table=11

SEQ ID NO: 69477 - protein, 185 aa, Pseudomonas putida KT2440; identical to SEQ ID NO: 48359

SEQ ID NO: 69478 - DNA, 498 bp, Escherichia coli CFT073; identical to SEQ ID NO: 48360
  CDS (1)..(498): transl_table=11

SEQ ID NO: 69479 - protein, 165 aa, Escherichia coli CFT073; identical to SEQ ID NO: 48361

SEQ ID NO: 69480 - DNA, 540 bp, Vibrio vulnificus CMCP6; identical to SEQ ID NO: 48362
  CDS (1)..(540): transl_table=11

SEQ ID NO: 69481 - protein, 179 aa, Vibrio vulnificus CMCP6; identical to SEQ ID NO: 48363

SEQ ID NO: 69482 - DNA, 561 bp, Pseudomonas syringae pv. tomato str. DC3000; identical to SEQ ID NO: 48364
  CDS (1)..(561): transl_table=11

SEQ ID NO: 69483 - protein, 186 aa, Pseudomonas syringae pv. tomato str. DC3000; identical to SEQ ID NO: 48365

SEQ ID NO: 69484 - DNA, 552 bp, Vibrio parahaemolyticus RIMD 2210633; identical to SEQ ID NO: 48366
  CDS (1)..(552): transl_table=11

SEQ ID NO: 69485 - protein, 183 aa, Vibrio parahaemolyticus RIMD 2210633; identical to SEQ ID NO: 48367

SEQ ID NO: 69486 - DNA, 498 bp, Salmonella enterica subsp. enterica serovar Typhi Ty2; identical to SEQ ID NO: 48368
  CDS (1)..(498): transl_table=11

SEQ ID NO: 69487 - protein, 165 aa, Salmonella enterica subsp. enterica serovar Typhi Ty2; identical to SEQ ID NO: 48369

SEQ ID NO: 69488 - DNA, 558 bp, Coxiella burnetii RSA 493; identical to SEQ ID NO: 48370
  CDS (1)..(558): transl_table=11

SEQ ID NO: 69489 - protein, 185 aa, Coxiella burnetii RSA 493; identical to SEQ ID NO: 48371

SEQ ID NO: 69490 - DNA, 537 bp, Nitrosomonas europaea ATCC 19718; identical to SEQ ID NO: 48372
  CDS (1)..(537): transl_table=11

SEQ ID NO: 69491 - protein, 178 aa, Nitrosomonas europaea ATCC 19718; identical to SEQ ID NO: 48373

SEQ ID NO: 69492 - DNA, 573 bp, Bordetella bronchiseptica RB50; identical to SEQ ID NO: 48374
  CDS (1)..(573): transl_table=11

SEQ ID NO: 69493 - protein, 190 aa, Bordetella bronchiseptica RB50; identical to SEQ ID NO: 48375

SEQ ID NO: 69494 - DNA, 519 bp, Photorhabdus luminescens subsp. laumondii TTO1; identical to SEQ ID NO: 48376
  CDS (1)..(519): transl_table=11

SEQ ID NO: 69495 - protein, 172 aa, Photorhabdus luminescens subsp. laumondii TTO1; identical to SEQ ID NO: 48377

SEQ ID NO: 69496 - DNA, 552 bp, Vibrio vulnificus YJ016; identical to SEQ ID NO: 48378
  CDS (1)..(552): transl_table=11

SEQ ID NO: 69497 - protein, 183 aa, Vibrio vulnificus YJ016; identical to SEQ ID NO: 48379

SEQ ID NO: 69498 - DNA, 519 bp, Bartonella quintana str. Toulouse; identical to SEQ ID NO: 48380
  CDS (1)..(519): transl_table=11

SEQ ID NO: 69499 - protein, 172 aa, Bartonella quintana str. Toulouse; identical to SEQ ID NO: 48381

SEQ ID NO: 69500 - DNA, 516 bp, Bartonella henselae str. Houston-1; identical to SEQ ID NO: 48382
  CDS (1)..(516): transl_table=11

SEQ ID NO: 69501 - protein, 171 aa, Bartonella henselae str. Houston-1; identical to SEQ ID NO: 48383

SEQ ID NO: 69502 - DNA, 504 bp, Acinetobacter sp. ADP1; identical to SEQ ID NO: 48384
  CDS (1)..(504): transl_table=11

SEQ ID NO: 69503 - protein, 167 aa, Acinetobacter sp. ADP1; identical to SEQ ID NO: 48385

SEQ ID NO: 69504 - DNA, 534 bp, Erwinia carotovora subsp. atroseptica SCRI1043; identical to SEQ ID NO: 48386
  CDS (1)..(534): transl_table=11

SEQ ID NO: 69505 - protein, 177 aa, Erwinia carotovora subsp. atroseptica SCRI1043; identical to SEQ ID NO: 48387

SEQ ID NO: 69506 - DNA, 594 bp, Burkholderia mallei ATCC 23344; identical to SEQ ID NO: 48388
  CDS (1)..(594): transl_table=11

SEQ ID NO: 69507 - protein, 197 aa, Burkholderia mallei ATCC 23344; identical to SEQ ID NO: 48389

SEQ ID NO: 69508 - DNA, 489 bp, Methylococcus capsulatus str. Bath; identical to SEQ ID NO: 48390
  CDS (1)..(489): transl_table=11

SEQ ID NO: 69509 - protein, 162 aa, Methylococcus capsulatus str. Bath; identical to SEQ ID NO: 48391

SEQ ID NO: 69510 - DNA, 543 bp, Photobacterium profundum SS9; identical to SEQ ID NO: 48392
  CDS (1)..(543): transl_table=11

SEQ ID NO: 69511 - protein, 180 aa, Photobacterium profundum SS9; identical to SEQ ID NO: 48393

SEQ ID NO: 69512 - DNA, 582 bp, Idiomarina loihiensis L2TR; identical to SEQ ID NO: 48394
  CDS (1)..(582): transl_table=11

SEQ ID NO: 69513 - protein, 193 aa, Idiomarina loihiensis L2TR; identical to SEQ ID NO: 48395

SEQ ID NO: 69514 - DNA, 558 bp, Azoarcus sp. EbN1; identical to SEQ ID NO: 48396
  CDS (1)..(558): transl_table=11

SEQ ID NO: 69515 - protein, 185 aa, Azoarcus sp. EbN1; identical to SEQ ID NO: 48397

SEQ ID NO: 69516 - DNA, 543 bp, Vibrio fischeri ES114; identical to SEQ ID NO: 48398
  CDS (1)..(543): transl_table=11

SEQ ID NO: 69517 - protein, 180 aa, Vibrio fischeri ES114; identical to SEQ ID NO: 48399

SEQ ID NO: 69518 - DNA, 498 bp, Salmonella enterica subsp. enterica serovar Choleraesuis str; identical to SEQ ID NO: 48400
  CDS (1)..(498): transl_table=11

SEQ ID NO: 69519 - protein, 165 aa, Salmonella enterica subsp. enterica serovar Choleraesuis str; identical to SEQ ID NO: 48401

SEQ ID NO: 69520 - DNA, 561 bp, Pseudomonas syringae pv. syringae B728a; identical to SEQ ID NO: 48402
  CDS (1)..(561): transl_table=11

SEQ ID NO: 69521 - protein, 186 aa, Pseudomonas syringae pv. syringae B728a; identical to SEQ ID NO: 48403

SEQ ID NO: 69522 - DNA, 504 bp, Haemophilus somnus 129PT; identical to SEQ ID NO: 48404
  CDS (1)..(504)

SEQ ID NO: 69523 - protein, 167 aa, Haemophilus somnus 129PT; identical to SEQ ID NO: 48405

SEQ ID NO: 69524 - DNA, 507 bp, Pseudomonas syringae pv. syringae B728a; identical to SEQ ID NO: 48406
  CDS (1)..(507)

SEQ ID NO: 69525 - protein, 168 aa, Pseudomonas syringae pv. syringae B728a; identical to SEQ ID NO: 48407

SEQ ID NO: 69526 - DNA, 483 bp, Actinobacillus pleuropneumoniae serovar 1 str. 4074; identical to SEQ ID NO: 48408
  CDS (1)..(483)

SEQ ID NO: 69527 - protein, 160 aa, Actinobacillus pleuropneumoniae serovar 1 str. 4074; identical to SEQ ID NO: 48409

SEQ ID NO: 69528 - DNA, 537 bp, Pseudomonas aeruginosa UCBPP-PA14; identical to SEQ ID NO: 48410
  CDS (1)..(537)

SEQ ID NO: 69529 - protein, 178 aa, Pseudomonas aeruginosa UCBPP-PA14; identical to SEQ ID NO: 48411

SEQ ID NO: 69530 - DNA, 507 bp, Psychrobacter sp. 273-4; identical to SEQ ID NO: 48412
  CDS (1)..(507)

SEQ ID NO: 69531 - protein, 168 aa, Psychrobacter sp. 273-4; identical to SEQ ID NO: 48413

SEQ ID NO: 69532 - DNA, 597 bp, Burkholderia cepacia R18194; identical to SEQ ID NO: 48414
  CDS (1)..(597)

SEQ ID NO: 69533 - protein, 198 aa, Burkholderia cepacia R18194; identical to SEQ ID NO: 48415

SEQ ID NO: 69534 - DNA, 552 bp, Pseudomonas fluorescens PfO-1; identical to SEQ ID NO: 48416
  CDS (1)..(552)

SEQ ID NO: 69535 - protein, 183 aa, Pseudomonas fluorescens PfO-1; identical to SEQ ID NO: 48417

SEQ ID NO: 69536 - DNA, 558 bp, Pseudomonas fluorescens PfO-1; identical to SEQ ID NO: 48418
  CDS (1)..(558)

SEQ ID NO: 69537 - protein, 185 aa, Pseudomonas fluorescens PfO-1; identical to SEQ ID NO: 48419

SEQ ID NO: 69538 - DNA, 684 bp, Burkholderia fungorum LB400; identical to SEQ ID NO: 48420
  CDS (1)..(684)

SEQ ID NO: 69539 - protein, 227 aa, Burkholderia fungorum LB400; identical to SEQ ID NO: 48421

SEQ ID NO: 69540 - DNA, 564 bp, Thiobacillus denitrificans ATCC 25259; identical to SEQ ID NO: 48422
  CDS (1)..(564)

SEQ ID NO: 69541 - protein, 187 aa, Thiobacillus denitrificans ATCC 25259; identical to SEQ ID NO: 48423

SEQ ID NO: 69542 - DNA, 531 bp, Dechloromonas aromatica RCB; identical to SEQ ID NO: 48424
  CDS (1)..(531)

SEQ ID NO: 69543 - protein, 176 aa, Dechloromonas aromatica RCB; identical to SEQ ID NO: 48425

SEQ ID NO: 69544 - DNA, 552 bp, Azotobacter vinelandii AvOP; identical to SEQ ID NO: 48426
  CDS (1)..(552): transl_table=11

SEQ ID NO: 69545 - protein, 183 aa, Azotobacter vinelandii AvOP; identical to SEQ ID NO: 48427

SEQ ID NO: 69546 - DNA, 597 bp, Burkholderia vietnamiensis G4; identical to SEQ ID NO: 48428
  CDS (1)..(597): transl_table=11

SEQ ID NO: 69547 - protein, 198 aa, Burkholderia vietnamiensis G4; identical to SEQ ID NO: 48429

SEQ ID NO: 69548 - DNA, 603 bp, Burkholderia mallei 10229; identical to SEQ ID NO: 48430
  CDS (1)..(603)

SEQ ID NO: 69549 - protein, 200 aa, Burkholderia mallei 10229; identical to SEQ ID NO: 48431

SEQ ID NO: 69550 - DNA, 597 bp, Burkholderia cenocepacia AU 1054; identical to SEQ ID NO: 48432
  CDS (1)..(597): transl_table=11

SEQ ID NO: 69551 - protein, 198 aa, Burkholderia cenocepacia AU 1054; identical to SEQ ID NO: 48433

SEQ ID NO: 69552 - DNA, 603 bp, Burkholderia pseudomallei 1655; identical to SEQ ID NO: 48434
  CDS (1)..(603)

SEQ ID NO: 69553 - protein, 200 aa, Burkholderia pseudomallei 1655; identical to SEQ ID NO: 48435

SEQ ID NO: 69554 - DNA, 552 bp, Chromohalobacter salexigens DSM 3043; identical to SEQ ID NO: 48436
  CDS (1)..(552): transl_table=11

SEQ ID NO: 69555 - protein, 183 aa, Chromohalobacter salexigens DSM 3043; identical to SEQ ID NO: 48437

SEQ ID NO: 69556 - DNA, 537 bp, Methylobacillus flagellatus KT; identical to SEQ ID NO: 48438
  CDS (1)..(537): transl_table=11

SEQ ID NO: 69557 - protein, 178 aa, Methylobacillus flagellatus KT; identical to SEQ ID NO: 48439

SEQ ID NO: 69558 - DNA, 564 bp, Shewanella baltica OS155; identical to SEQ ID NO: 48440
  CDS (1)..(564): transl_table=11

SEQ ID NO: 69559 - protein, 187 aa, Shewanella baltica OS155; identical to SEQ ID NO: 48441

SEQ ID NO: 69560 - DNA, 564 bp, Shewanella amazonensis SB2B; identical to SEQ ID NO: 48442
  CDS (1)..(564): transl_table=11

SEQ ID NO: 69561 - protein, 187 aa, Shewanella amazonensis SB2B; identical to SEQ ID NO: 48443

SEQ ID NO: 69562 - DNA, 615 bp, Shewanella frigidimarina NCIMB 400; identical to SEQ ID NO: 48444
  CDS (1)..(615): transl_table=11

SEQ ID NO: 69563 - protein, 204 aa, Shewanella frigidimarina NCIMB 400; identical to SEQ ID NO: 48445

SEQ ID NO: 69564 - DNA, 564 bp, Pseudomonas fluorescens; identical to SEQ ID NO: 48446
  CDS (1)..(564): transl_table=11

SEQ ID NO: 69565 - protein, 187 aa, Pseudomonas fluorescens; identical to SEQ ID NO: 48447

SEQ ID NO: 69566 - DNA, 609 bp, Xanthomonas albilineans; identical to SEQ ID NO: 48448
  CDS (1)..(609): transl_table=11

SEQ ID NO: 69567 - protein, 202 aa, Xanthomonas albilineans; identical to SEQ ID NO: 48449

SEQ ID NO: 69568 - DNA, 549 bp, Pseudomonas putida; identical to SEQ ID NO: 48450
  CDS (1)..(549): transl_table=11

SEQ ID NO: 69569 - protein, 182 aa, Pseudomonas putida; identical to SEQ ID NO: 48451

SEQ ID NO: 69570 - DNA, 549 bp, Pseudomonas sp; identical to SEQ ID NO: 48452
  CDS (1)..(549): transl_table=11

SEQ ID NO: 69571 - protein, 182 aa, Pseudomonas sp; identical to SEQ ID NO: 48453

SEQ ID NO: 69572 - DNA, 23 bp, Artificial sequence
  (1)..(23): primer
atgcgattgttgcgtttttgttg

SEQ ID NO: 69573 - DNA, 22 bp, Artificial sequence
  (1)..(22): primer
ttagtacaacggtgacgccggt

SEQ ID NO: 69574 - protein, 177 aa, Artificial sequence; identical to SEQ ID NO: 48456
  Variant (3)..(6): xaa in position 3 to 6 is any amino acid
  Variant (10)..(19): xaa in position 10 to 19 is any amino acid
  Variant (20)..(21): xaa in position 20 to 21 is any or no amino acid
  Variant (23)..(41): xaa in position 23 to 41 is any amino acid
  Variant (42)..(54): xaa in position 42 to 54 is any or no amino acid
  Variant (59)..(59): xaa in position 59 is any amino acid
  Variant (61)..(66): xaa in position 61 to 66 is any amino acid
  Variant (67)..(67): xaa in position 67 is any or no amino acid
  Variant (70)..(70): xaa in position 70 is any amino acid
  Variant (72)..(72): xaa in position 72 is any amino acid
  Variant (75)..(84): xaa in position 75 to 84 is any amino acid
  Variant (85)..(101): xaa in position 85 to 101 is any or no amino acid
  Variant (103)..(103): xaa in position 103 is any amino acid
  Variant (104)..(104): xaa in position 104 is any or no amino acid
  Variant (107)..(109): xaa in position 107 to 109 is any amino acid
  Variant (112)..(113): xaa in position 112 to 113 is any amino acid
  Variant (116)..(121): xaa in position 116 to 121 is any amino acid
  Variant (123)..(124): xaa in position 123 to 124 is any amino acid
  Variant (126)..(131): xaa in position 126 to 131 is any amino acid
  Variant (132)..(154): xaa in position 132 to 154 is any or no amino acid
  Variant (156)..(156): xaa in position 156 is any amino acid
  Variant (161)..(168): xaa in position 161 to 168 is any amino acid
  Variant (172)..(172): xaa in position 172 is any amino acid
  Variant (174)..(174): xaa in position 174 is any amino acid

SEQ ID NO: 69575 - protein, 9 aa, Artificial sequence
  Variant (2)..(2): xaa in position 2 is Leu or Val
  Variant (3)..(5): xaa in position 3 to 5 is any amino acid
  Variant (6)..(6): xaa in position 6 is Asp, Gly, Ser or Thr
  Variant (8)..(8): xaa in position 8 is Leu, Met or Val
WXXXXXSXT

SEQ ID NO: 69576 - protein, 17 aa, Artificial sequence
  Variant (3)..(3): xaa in position 3 is Ile or Val
  Variant (4)..(4): xaa in position 4 is any amino acid
  Variant (6)..(8): xaa in position 6 to 8 is any amino acid
  Variant (9)..(9): xaa in position 9 is Asp, Glu, Gly, Asn or Gln
  Variant (10)..(14): xaa in position 10 to 14 is any amino acid
  Variant (15)..(15): xaa in position 15 is Ala, Gly or Gln
  Variant (16)..(16): xaa in position 16 is any amino acid
  Variant (17)..(17): xaa in position 17 is Gln, Ser or Thr
REXXLXXXXXXXXXXXX

SEQ ID NO: 69577 - protein, 10 aa, Artificial sequence
  Variant (2)..(3): xaa in position 2 to 3 is any amino acid
  Variant (4)..(4): xaa in position 4 is Ala, Pro or Ser
  Variant (5)..(5): xaa in position 5 is Ile or Leu
  Variant (7)..(8): xaa in position 7 to 8 is any amino acid
  Variant (9)..(9): xaa in position 9 is Leu or Val
GXXXXGXXXF

SEQ ID NO: 69578 - protein, 23 aa, Artificial sequence
  Variant (2)..(3): xaa in position 2 to 3 is any or no amino acid
  Variant (5)..(5): xaa in position 5 is any or no amino acid
  Variant (7)..(14): xaa in position 7 to 14 is any amino acid
  Variant (15)..(15): xaa in position 15 is Ile, Leu, Met or Val
  Variant (16)..(16): xaa in position 16 is Leu or Met
  Variant (17)..(17): xaa in position 17 is Ile, Leu or Val
  Variant (18)..(18): xaa in position 18 is any amino acid
  Variant (20)..(21): xaa in position 20 to 21 is any amino acid
  Variant (23)..(23): xaa in position 23 is Ala, Pro or Ser
RXXRXSXXXXXXXXXXXXEXXLX

SEQ ID NO: 69579 - DNA, 1123 bp, Saccharomyces cerevisiae; identical to SEQ ID NO: 59015
  CDS (263)..(955)

SEQ ID NO: 69580 - protein, 230 aa, Saccharomyces cerevisiae; identical to SEQ ID NO: 59016

SEQ ID NO: 69581 - DNA, 642 bp, Eremothecium gossypii; identical to SEQ ID NO: 59017
  CDS (1)..(642)

SEQ ID NO: 69582 - protein, 213 aa, Eremothecium gossypii; identical to SEQ ID NO: 59018

SEQ ID NO: 69583 - DNA, 636 bp, Candida glabrata CBS138; identical to SEQ ID NO: 59019
  CDS (1)..(636)

SEQ ID NO: 69584 - protein, 211 aa, Candida glabrata CBS138; identical to SEQ ID NO: 59020

SEQ ID NO: 69585 - DNA, 567 bp, Kluyveromyces lactis NRRL Y-1140; identical to SEQ ID NO: 59021
  CDS (1)..(567)

SEQ ID NO: 69586 - protein, 188 aa, Kluyveromyces lactis NRRL Y-1140; identical to SEQ ID NO: 59022

SEQ ID NO: 69587 - DNA, 642 bp, Debaryomyces hansenii CBS767; identical to SEQ ID NO: 59023
  CDS (1)..(642)

SEQ ID NO: 69588 - protein, 213 aa, Debaryomyces hansenii CBS767; identical to SEQ ID NO: 59024

SEQ ID NO: 69589 - DNA, 25 bp, Artificial sequence
  (1)..(25): primer
atgcgtaagccttctattacgataa

SEQ ID NO: 69590 - DNA, 26 bp, Artificial sequence
  (1)..(26): primer
ttataaccttgtacctaatgtctcat

SEQ ID NO: 69591 - protein, 232 aa, Artificial sequence; identical to SEQ ID NO: 59027
  Variant (2)..(2): xaa in position 2 is any amino acid
  Variant (4)..(4): xaa in position 4 is any amino acid
  Variant (10)..(13): xaa in position 10 to 13 is any amino acid
  Variant (16)..(20): xaa in position 16 to 20 is any amino acid
  Variant (22)..(22): xaa in position 22 is any amino acid
  Variant (24)..(33): xaa in position 24 to 33 is any amino acid
  Variant (34)..(40): xaa in position 34 to 40 is any or no amino acid
  Variant (42)..(44): xaa in position 42 to 44 is any amino acid
  Variant (49)..(49): xaa in position 49 is any amino acid
  Variant (53)..(54): xaa in position 53 to 54 is any amino acid
  Variant (57)..(57): xaa in position 57 is any amino acid
  Variant (59)..(59): xaa in position 59 is any amino acid
  Variant (66)..(67): xaa in position 66 to 67 is any amino acid
  Variant (71)..(71): xaa in position 71 is any amino acid
  Variant (74)..(75): xaa in position 74 to 75 is any amino acid
  Variant (77)..(77): xaa in position 77 is any amino acid
  Variant (79)..(80): xaa in position 79 to 80 is any amino acid
  Variant (83)..(84): xaa in position 83 to 84 is any amino acid
  Variant (86)..(91): xaa in position 86 to 91 is any amino acid
  Variant (92)..(108): xaa in position 92 to 108 is any or no amino acid
  Variant (110)..(114): xaa in position 110 to 114 is any amino acid
  Variant (116)..(117): xaa in position 116 to 117 is any amino acid
  Variant (120)..(120): xaa in position 120 is any amino acid
  Variant (123)..(123): xaa in position 123 is any amino acid
  Variant (126)..(126): xaa in position 126 is any amino acid
  Variant (128)..(128): xaa in position 128 is any or no amino acid
  Variant (130)..(136): xaa in position 130 to 136 is any amino acid
  Variant (137)..(142): xaa in position 137 to 142 is any or no amino acid
  Variant (145)..(146): xaa in position 145 to 146 is any amino acid
  Variant (149)..(150): xaa in position 149 to 150 is any amino acid
  Variant (153)..(153): xaa in position 153 is any amino acid
  Variant (162)..(162): xaa in position 162 is any amino acid
  Variant (164)..(164): xaa in position 164 is any amino acid
  Variant (166)..(196): xaa in position 166 to 196 is any amino acid
  Variant (197)..(216): xaa in position 197 to 216 is any or no amino acid
  Variant (219)..(220): xaa in position 219 to 220 is any amino acid
  Variant (223)..(223): xaa in position 223 is any amino acid
  Variant (227)..(227): xaa in position 227 is any amino acid
  Variant (229)..(230): xaa in position 229 to 230 is any amino acid

SEQ ID NO: 69592 - protein, 29 aa, Artificial sequence
  Variant (5)..(5): xaa in position 5 is Phe, Ile, Leu or Met
  Variant (7)..(7): xaa in position 7 is Leu or Met
  Variant (8)..(8): xaa in position 8 is Lys or Arg
  Variant (9)..(9): xaa in position 9 is Pro or Gln
  Variant (10)..(10): xaa in position 10 is Phe or Leu
  Variant (11)..(11): xaa in position 11 is Ile or Val
  Variant (12)..(12): xaa in position 12 is Ala or Ser
  Variant (13)..(15): xaa in position 13 to 15 is any amino acid
  Variant (17)..(17): xaa in position 17 is Ile or Val
  Variant (19)..(19): xaa in position 19 is Asp or Glu
  Variant (20)..(20): xaa in position 20 is Ser or Thr
  Variant (22)..(22): xaa in position 22 is any amino acid
  Variant (23)..(23): xaa in position 23 is Asp, Asn or Thr
  Variant (25)..(25): xaa in position 25 is Ile, Leu or Val
  Variant (27)..(27): xaa in position 27 is any amino acid
  Variant (29)..(29): xaa in position 29 is Phe or Tyr
YRRFXRXXXXXXXXXMXKXXYXXYXRXKX

SEQ ID NO: 69593 - protein, 9 aa, Artificial sequence
  Variant (2)..(2): xaa in position 2 is any amino acid
  Variant (4)..(4): xaa in position 4 is Ile, Leu or Val
  Variant (5)..(5): xaa in position 5 is Ala, Ile or Leu
  Variant (7)..(7): xaa in position 7 is Ala or Ser
  Variant (8)..(8): xaa in position 8 is any amino acid
LXFXXKXXS

SEQ ID NO: 69594 - protein, 17 aa, Artificial sequence
  Variant (2)..(2): xaa in position 2 is Asn or Ser
  Variant (3)..(4): xaa in position 3 to 4 is any amino acid
  Variant (6)..(6): xaa in position 6 is Lys or Arg
  Variant (7)..(7): xaa in position 7 is any amino acid
  Variant (9)..(9): xaa in position 9 is Ile or Leu
  Variant (12)..(12): xaa in position 12 is Leu or Val
  Variant (15)..(15): xaa in position 15 is Ile, Leu, Met or Val
  Variant (16)..(16): xaa in position 16 is any amino acid
DXXXCXXIXKNXLTXXY

SEQ ID NO: 69595 - protein, 8 aa, Artificial sequence
  Variant (2)..(2): xaa in position 2 is Glu or Asn
  Variant (3)..(3): xaa in position 3 is any amino acid
  Variant (5)..(5): xaa in position 5 is Gly or Asn
  Variant (6)..(6): xaa in position 6 is any amino acid
NXXLXXRL

SEQ ID NO: 69596 - DNA, 1203 bp, Escherichia coli; identical to SEQ ID NO: 13945
  CDS (1)..(1203)

SEQ ID NO: 69597 - protein, 400 aa, Escherichia coli; identical to SEQ ID NO: 13946

SEQ ID NO: 69598 - DNA, 1281 bp, Aquifex aeolicus VF5; identical to SEQ ID NO: 13947
  CDS (1)..(1281): transl_table=11

SEQ ID NO: 69599 - protein, 426 aa, Aquifex aeolicus VF5; identical to SEQ ID NO: 13948

SEQ ID NO: 69600 - DNA, 1260 bp, Neisseria meningitidis Z2491; identical to SEQ ID NO: 13949
  CDS (1)..(1260): transl_table=11

SEQ ID NO: 69601 - protein, 419 aa, Neisseria meningitidis Z2491; identical to SEQ ID NO: 13950

SEQ ID NO: 69602 - DNA, 1425 bp, Deinococcus radiodurans R1; identical to SEQ ID NO: 13951
  CDS (1)..(1425): transl_table=11

SEQ ID NO: 69603 - protein, 474 aa, Deinococcus radiodurans R1; identical to SEQ ID NO: 13952

SEQ ID NO: 69604 - DNA, 1392 bp, Mycobacterium tuberculosis CDC1551; identical to SEQ ID NO: 13953
  CDS (1)..(1392): transl_table=11

SEQ ID NO: 69605 - protein, 463 aa, Mycobacterium tuberculosis CDC1551; identical to SEQ ID NO: 13954

SEQ ID NO: 69606 - DNA, 1203 bp, Salmonella typhimurium LT2; identical to SEQ ID NO: 13955
  CDS (1)..(1203): transl_table=11

SEQ ID NO: 69607 - protein, 400 aa, Salmonella typhimurium LT2; identical to SEQ ID NO: 13956

SEQ ID NO: 69608 - DNA, 1320 bp, Agrobacterium tumefaciens str. C58; identical to SEQ ID NO: 13957
  CDS (1)..(1320): transl_table=11

SEQ ID NO: 69609 - protein, 439 aa, Agrobacterium tumefaciens str. C58; identical to SEQ ID NO: 13958

SEQ ID NO: 69610 - DNA, 1251 bp, Yersinia pestis KIM; identical to SEQ ID NO: 13959
  CDS (1)..(1251): transl_table=11

SEQ ID NO: 69611 - protein, 416 aa, Yersinia pestis KIM; identical to SEQ ID NO: 13960

SEQ ID NO: 69612 - DNA, 1314 bp, Thermosynechococcus elongatus BP-1; identical to SEQ ID NO: 13961
  CDS (1)..(1314): transl_table=11

SEQ ID NO: 69613 - protein, 437 aa, Thermosynechococcus elongatus BP-1; identical to SEQ ID NO: 13962

SEQ ID NO: 69614 - DNA, 1464 bp, Oceanobacillus iheyensis HTE831; identical to SEQ ID NO: 13963
  CDS (1)..(1464): transl_table=11

SEQ ID NO: 69615 - protein, 487 aa, Oceanobacillus iheyensis HTE831; identical to SEQ ID NO: 13964

SEQ ID NO: 69616 - DNA, 1209 bp, Pseudomonas putida KT2440; identical to SEQ ID NO: 13965
  CDS (1)..(1209): transl_table=11

SEQ ID NO: 69617 - protein, 402 aa, Pseudomonas putida KT2440; identical to SEQ ID NO: 13966

SEQ ID NO: 69618 - DNA, 1305 bp, Bradyrhizobium japonicum USDA 110; identical to SEQ ID NO: 13967
  CDS (1)..(1305)

SEQ ID NO: 69619 - protein, 434 aa, Bradyrhizobium japonicum USDA 110; identical to SEQ ID NO: 13968

SEQ ID NO: 69620 - DNA, 1434 bp, Lactobacillus plantarum WCFS1; identical to SEQ ID NO: 13969
  CDS (1)..(1434): transl_table=11

SEQ ID NO: 69621 - protein, 477 aa, Lactobacillus plantarum WCFS1; identical to SEQ ID NO: 13970

SEQ ID NO: 69622 - DNA, 1203 bp, Salmonella enterica subsp. enterica serovar Typhi Ty2; identical to SEQ ID NO: 13971
  CDS (1)..(1203): transl_table=11

SEQ ID NO: 69623 - protein, 400 aa, Salmonella enterica subsp. enterica serovar Typhi Ty2; identical to SEQ ID NO: 13972

SEQ ID NO: 69624 - DNA, 1170 bp, Bacteroides thetaiotaomicron VPI-5482; identical to SEQ ID NO: 13973
  CDS (1)..(1170): transl_table=11

SEQ ID NO: 69625 - protein, 389 aa, Bacteroides thetaiotaomicron VPI-5482; identical to SEQ ID NO: 13974

SEQ ID NO: 69626 - DNA, 1407 bp, Coxiella burnetii RSA 493; identical to SEQ ID NO: 13975
  CDS (1)..(1407): transl_table=11

SEQ ID NO: 69627 - protein, 468 aa, Coxiella burnetii RSA 493; identical to SEQ ID NO: 13976

SEQ ID NO: 69628 - DNA, 1185 bp, Porphyromonas gingivalis W83; identical to SEQ ID NO: 13977
  CDS (1)..(1185): transl_table=11

SEQ ID NO: 69629 - protein, 394 aa, Porphyromonas gingivalis W83; identical to SEQ ID NO: 13978

SEQ ID NO: 69630 - DNA, 1608 bp, Oryza sativa (japonica cultivar-group); identical to SEQ ID NO: 13979
  CDS (1)..(1608)

SEQ ID NO: 69631 - protein, 535 aa, Oryza sativa (japonica cultivar-group); identical to SEQ ID NO: 13980

SEQ ID NO: 69632 - DNA, 1446 bp, Geobacter sulfurreducens PCA; identical to SEQ ID NO: 13981
  CDS (1)..(1446): transl_table=11

SEQ ID NO: 69633 - protein, 481 aa, Geobacter sulfurreducens PCA; identical to SEQ ID NO: 13982

SEQ ID NO: 69634 - DNA, 1437 bp, Treponema denticola ATCC 35405; identical to SEQ ID NO: 13983
  CDS (1)..(1437): transl_table=11

SEQ ID NO: 69635 - protein, 478 aa, Treponema denticola ATCC 35405; identical to SEQ ID NO: 13984

SEQ ID NO: 69636 - DNA, 1293 bp, Eremothecium gossypii; identical to SEQ ID NO: 13985
  CDS (1)..(1293)

SEQ ID NO: 69637 - protein, 430 aa, Eremothecium gossypii; identical to SEQ ID NO: 13986

SEQ ID NO: 69638 - DNA, 1434 bp, Neurospora crassa; identical to SEQ ID NO: 13987
  CDS (1)..(1434)

SEQ ID NO: 69639 - protein, 477 aa, Neurospora crassa; identical to SEQ ID NO: 13988

SEQ ID NO: 69640 - DNA, 5916 bp, Magnaporthe grisea 70-15; identical to SEQ ID NO: 13989
  CDS (1)..(5916)

SEQ ID NO: 69641 - protein, 1971 aa, Magnaporthe grisea 70-15; identical to SEQ ID NO: 13990

SEQ ID NO: 69642 - DNA, 1380 bp, Gibberella zeae PH-1; identical to SEQ ID NO: 13991
  CDS (1)..(1380)

SEQ ID NO: 69643 - protein, 459 aa, Gibberella zeae PH-1; identical to SEQ ID NO: 13992

SEQ ID NO: 69644 - DNA, 1839 bp, Ustilago maydis 521; identical to SEQ ID NO: 13993
  CDS (1)..(1839)

SEQ ID NO: 69645 - protein, 612 aa, Ustilago maydis 521; identical to SEQ ID NO: 13994

SEQ ID NO: 69646 - DNA, 1464 bp, Aspergillus nidulans FGSC A4; identical to SEQ ID NO: 13995
  CDS (1)..(1464)

SEQ ID NO: 69647 - protein, 487 aa, Aspergillus nidulans FGSC A4; identical to SEQ ID NO: 13996

SEQ ID NO: 69648 - DNA, 1296 bp, Candida glabrata CBS138; identical to SEQ ID NO: 13997
  CDS (1)..(1296)

SEQ ID NO: 69649 - protein, 431 aa, Candida glabrata CBS138; identical to SEQ ID NO: 13998

SEQ ID NO: 69650 - DNA, 1284 bp, Kluyveromyces lactis NRRL Y-1140; identical to SEQ ID NO: 13999
  CDS (1)..(1284)

SEQ ID NO: 69651 - protein, 427 aa, Kluyveromyces lactis NRRL Y-1140; identical to SEQ ID NO: 14000

SEQ ID NO: 69652 - DNA, 1269 bp, Debaryomyces hansenii CBS767; identical to SEQ ID NO: 14001
  CDS (1)..(1269)

SEQ ID NO: 69653 - protein, 422 aa, Debaryomyces hansenii CBS767; identical to SEQ ID NO: 14002

SEQ ID NO: 69654 - DNA, 1245 bp, Yarrowia lipolytica CLIB99; identical to SEQ ID NO: 14003
  CDS (1)..(1245)

SEQ ID NO: 69655 - protein, 414 aa, Yarrowia lipolytica CLIB99; identical to SEQ ID NO: 14004

SEQ ID NO: 69656 - DNA, 1362 bp, Cryptococcus neoformans var. neoformans JEC21; identical to SEQ ID NO: 14005
  CDS (1)..(1362)

SEQ ID NO: 69657 - protein, 453 aa, Cryptococcus neoformans var. neoformans JEC21; identical to SEQ ID NO: 14006

SEQ ID NO: 69658 - DNA, 1173 bp, Entamoeba histolytica HM-1:IMSS; identical to SEQ ID NO: 14007
  CDS (1)..(1173)

SEQ ID NO: 69659 - protein, 390 aa, Entamoeba histolytica HM-1:IMSS; identical to SEQ ID NO: 14008

SEQ ID NO: 69660 - DNA, 1266 bp, Candida albicans SC5314; identical to SEQ ID NO: 14009
  CDS (1)..(1266): transl_table=12

SEQ ID NO: 69661 - protein, 421 aa, Candida albicans SC5314; identical to SEQ ID NO: 14010

SEQ ID NO: 69662 - DNA, 1305 bp, Bartonella quintana str. Toulouse; identical to SEQ ID NO: 14011
  CDS (1)..(1305): transl_table=11

SEQ ID NO: 69663 - protein, 434 aa, Bartonella quintana str. Toulouse; identical to SEQ ID NO: 14012

SEQ ID NO: 69664 - DNA, 1305 bp, Bartonella henselae str. Houston-1; identical to SEQ ID NO: 14013
  CDS (1)..(1305): transl_table=11

SEQ ID NO: 69665 - protein, 434 aa, Bartonella henselae str. Houston-1; identical to SEQ ID NO: 14014

SEQ ID NO: 69666 - DNA, 1470 bp, Bacillus licheniformis ATCC 14580; identical to SEQ ID NO: 14015
  CDS (1)..(1470): transl_table=11

SEQ ID NO: 69667 - protein, 489 aa, Bacillus licheniformis ATCC 14580; identical to SEQ ID NO: 14016

SEQ ID NO: 69668 - DNA, 1167 bp, Bacteroides fragilis YCH46; identical to SEQ ID NO: 14017
  CDS (1)..(1167): transl_table=11

SEQ ID NO: 69669 - protein, 388 aa, Bacteroides fragilis YCH46; identical to SEQ ID NO: 14018

SEQ ID NO: 69670 - DNA, 1350 bp, Methylococcus capsulatus str. Bath; identical to SEQ ID NO: 14019
  CDS (1)..(1350): transl_table=11

SEQ ID NO: 69671 - protein, 449 aa, Methylococcus capsulatus str. Bath; identical to SEQ ID NO: 14020

SEQ ID NO: 69672 - DNA, 1317 bp, Nocardia farcinica IFM 10152; identical to SEQ ID NO: 14021
  CDS (1)..(1317): transl_table=11

SEQ ID NO: 69673 - protein, 438 aa, Nocardia farcinica IFM 10152; identical to SEQ ID NO: 14022

SEQ ID NO: 69674 - DNA, 1404 bp, Legionella pneumophila str. Paris; identical to SEQ ID NO: 14023
  CDS (1)..(1404): transl_table=11

SEQ ID NO: 69675 - protein, 467 aa, Legionella pneumophila str. Paris; identical to SEQ ID NO: 14024

SEQ ID NO: 69676 - DNA, 1404 bp, Legionella pneumophila str. Lens; identical to SEQ ID NO: 14025
  CDS (1)..(1404): transl_table=11

SEQ ID NO: 69677 - protein, 467 aa, Legionella pneumophila str. Lens; identical to SEQ ID NO: 14026

SEQ ID NO: 69678 - DNA, 1473 bp, Geobacillus kaustophilus HTA426; identical to SEQ ID NO: 14027
  CDS (1)..(1473): transl_table=11

SEQ ID NO: 69679 - protein, 490 aa, Geobacillus kaustophilus HTA426; identical to SEQ ID NO: 14028

SEQ ID NO: 69680 - DNA, 1347 bp, Idiomarina loihiensis L2TR; identical to SEQ ID NO: 14029
  CDS (1)..(1347): transl_table=11

SEQ ID NO: 69681 - protein, 448 aa, Idiomarina loihiensis L2TR; identical to SEQ ID NO: 14030

SEQ ID NO: 69682 - DNA, 1344 bp, Silicibacter pomeroyi DSS-3; identical to SEQ ID NO: 14031
  CDS (1)..(1344): transl_table=11

SEQ ID NO: 69683 - protein, 447 aa, Silicibacter pomeroyi DSS-3; identical to SEQ ID NO: 14032

SEQ ID NO: 69684 - DNA, 1260 bp, Neisseria gonorrhoeae FA 1090; identical to SEQ ID NO: 14033
  CDS (1)..(1260): transl_table=11

SEQ ID NO: 69685 - protein, 419 aa, Neisseria gonorrhoeae FA 1090; identical to SEQ ID NO: 14034

SEQ ID NO: 69686 - DNA, 1167 bp, Bacteroides fragilis NCTC 9343; identical to SEQ ID NO: 14035
  CDS (1)..(1167): transl_table=11

SEQ ID NO: 69687 - protein, 388 aa, Bacteroides fragilis NCTC 9343; identical to SEQ ID NO: 14036

SEQ ID NO: 69688 - DNA, 1251 bp, Salmonella enterica subsp. enterica serovar Choleraesuis str; identical to SEQ ID NO: 14037
  CDS (1)..(1251): transl_table=11

SEQ ID NO: 69689 - protein, 416 aa, Salmonella enterica subsp. enterica serovar Choleraesuis str; identical to SEQ ID NO: 14038

SEQ ID NO: 69690 - DNA, 1224 bp, Pseudomonas syringae pv. syringae B728a; identical to SEQ ID NO: 14039
  CDS (1)..(1224)

SEQ ID NO: 69691 - protein, 407 aa, Pseudomonas syringae pv. syringae B728a; identical to SEQ ID NO: 14040

SEQ ID NO: 69692 - DNA, 1326 bp, Corynebacterium jeikeium K411; identical to SEQ ID NO: 14041
  CDS (1)..(1326): transl_table=11

SEQ ID NO: 69693 - protein, 441 aa, Corynebacterium jeikeium K411; identical to SEQ ID NO: 14042

SEQ ID NO: 69694 - DNA, 1293 bp, Rhodobacter sphaeroides 2.4.1; identical to SEQ ID NO: 14043
  CDS (1)..(1293)

SEQ ID NO: 69695 - protein, 430 aa, Rhodobacter sphaeroides 2.4.1; identical to SEQ ID NO: 14044

SEQ ID NO: 69696 - DNA, 1134 bp, Xylella fastidiosa Ann-1; identical to SEQ ID NO: 14045
  CDS (1)..(1134)

SEQ ID NO: 69697 - protein, 377 aa, Xylella fastidiosa Ann-1; identical to SEQ ID NO: 14046

SEQ ID NO: 69698 - DNA, 1464 bp, Leuconostoc mesenteroides subsp. mesenteroides ATCC 8293; identical to SEQ ID NO: 14047
  CDS (1)..(1464)

SEQ ID NO: 69699 - protein, 487 aa, Leuconostoc mesenteroides subsp. mesenteroides ATCC 8293; identical to SEQ ID NO: 14048

SEQ ID NO: 69700 - DNA, 1242 bp, Psychrobacter sp. 273-4; identical to SEQ ID NO: 14049
  CDS (1)..(1242)

SEQ ID NO: 69701 - protein, 413 aa, Psychrobacter sp. 273-4; identical to SEQ ID NO: 14050

SEQ ID NO: 69702 - DNA, 1179 bp, Ralstonia eutropha JMP134; identical to SEQ ID NO: 14051
  CDS (1)..(1179)

SEQ ID NO: 69703 - protein, 392 aa, Ralstonia eutropha JMP134; identical to SEQ ID NO: 14052

SEQ ID NO: 69704 - DNA, 1200 bp, Burkholderia cepacia R18194; identical to SEQ ID NO: 14053
  CDS (1)..(1200)

SEQ ID NO: 69705 - protein, 399 aa, Burkholderia cepacia R18194; identical to SEQ ID NO: 14054

SEQ ID NO: 69706 - DNA, 1224 bp, Pseudomonas fluorescens PfO-1; identical to SEQ ID NO: 14055
  CDS (1)..(1224)

SEQ ID NO: 69707 - protein, 407 aa, Pseudomonas fluorescens PfO-1; identical to SEQ ID NO: 14056

SEQ ID NO: 69708 - DNA, 1197 bp, Burkholderia fungorum LB400; identical to SEQ ID NO: 14057
  CDS (1)..(1197)

SEQ ID NO: 69709 - protein, 398 aa, Burkholderia fungorum LB400; identical to SEQ ID NO: 14058

SEQ ID NO: 69710 - DNA, 1428 bp, Oenococcus oeni PSU-1; identical to SEQ ID NO: 14059
  CDS (1)..(1428)

SEQ ID NO: 69711 - protein, 475 aa, Oenococcus oeni PSU-1; identical to SEQ ID NO: 14060

SEQ ID NO: 69712 - DNA, 1380 bp, Trichodesmium erythraeum IMS101; identical to SEQ ID NO: 14061
  CDS (1)..(1380)

SEQ ID NO: 69713 - protein, 459 aa, Trichodesmium erythraeum IMS101; identical to SEQ ID NO: 14062

SEQ ID NO: 69714 - DNA, 1434 bp, Campylobacter upsaliensis RM3195; identical to SEQ ID NO: 14063
  CDS (1)..(1434): transl_table=11

SEQ ID NO: 69715 - protein, 477 aa, Campylobacter upsaliensis RM3195; identical to SEQ ID NO: 14064

SEQ ID NO: 69716 - DNA, 1488 bp, Lactococcus lactis subsp. cremoris SK11; identical to SEQ ID NO: 14065
  CDS (1)..(1488)

SEQ ID NO: 69717 - protein, 495 aa, Lactococcus lactis subsp. cremoris SK11; identical to SEQ ID NO: 14066

SEQ ID NO: 69718 - DNA, 1461 bp, Deinococcus geothermalis DSM 11300; identical to SEQ ID NO: 14067
  CDS (1)..(1461): transl_table=11

SEQ ID NO: 69719 - protein, 486 aa, Deinococcus geothermalis DSM 11300; identical to SEQ ID NO: 14068

SEQ ID NO: 69720 - DNA, 1359 bp, Azotobacter vinelandii AvOP; identical to SEQ ID NO: 14069
  CDS (1)..(1359): transl_table=11

SEQ ID NO: 69721 - protein, 452 aa, Azotobacter vinelandii AvOP; identical to SEQ ID NO: 14070

SEQ ID NO: 69722 - DNA, 1356 bp, Burkholderia vietnamiensis G4; identical to SEQ ID NO: 14071
  CDS (1)..(1356): transl_table=11

SEQ ID NO: 69723 - protein, 451 aa, Burkholderia vietnamiensis G4; identical to SEQ ID NO: 14072

SEQ ID NO: 69724 - DNA, 1200 bp, Burkholderia mallei 10229; identical to SEQ ID NO: 14073
  CDS (1)..(1200)

SEQ ID NO: 69725 - protein, 399 aa, Burkholderia mallei 10229; identical to SEQ ID NO: 14074

SEQ ID NO: 69726 - DNA, 1200 bp, Burkholderia cenocepacia AU 1054; identical to SEQ ID NO: 14075
  CDS (1)..(1200): transl_table=11

SEQ ID NO: 69727 - protein, 399 aa, Burkholderia cenocepacia AU 1054; identical to SEQ ID NO: 14076

SEQ ID NO: 69728 - DNA, 1356 bp, Burkholderia pseudomallei 1655; identical to SEQ ID NO: 14077
  CDS (1)..(1356)

SEQ ID NO: 69729 - protein, 451 aa, Burkholderia pseudomallei 1655; identical to SEQ ID NO: 14078

SEQ ID NO: 69730 - DNA, 1173 bp, Chromohalobacter salexigens DSM 3043; identical to SEQ ID NO: 14079
  CDS (1)..(1173): transl_table=11

SEQ ID NO: 69731 - protein, 390 aa, Chromohalobacter salexigens DSM 3043; identical to SEQ ID NO: 14080

SEQ ID NO: 69732 - DNA, 1356 bp, Burkholderia pseudomallei 668; identical to SEQ ID NO: 14081
  CDS (1)..(1356)

SEQ ID NO: 69733 - protein, 451 aa, Burkholderia pseudomallei 668; identical to SEQ ID NO: 14082

SEQ ID NO: 69734 - DNA, 1269 bp, Polaromonas sp. JS666; identical to SEQ ID NO: 14083
  CDS (1)..(1269): transl_table=11

SEQ ID NO: 69735 - protein, 422 aa, Polaromonas sp. JS666; identical to SEQ ID NO: 14084

SEQ ID NO: 69736 - DNA, 1341 bp, Crocosphaera watsonii WH 8501; identical to SEQ ID NO: 14085
  CDS (1)..(1341): transl_table=11

SEQ ID NO: 69737 - protein, 446 aa, Crocosphaera watsonii WH 8501; identical to SEQ ID NO: 14086

SEQ ID NO: 69738 - DNA, 1431 bp, Geobacter metallireducens GS-15; identical to SEQ ID NO: 14087
  CDS (1)..(1431): transl_table=11

SEQ ID NO: 69739 - protein, 476 aa, Geobacter metallireducens GS-15; identical to SEQ ID NO: 14088

SEQ ID NO: 69740 - DNA, 1206 bp, Methanosarcina barkeri str. fusaro; identical to SEQ ID NO: 14089
  CDS (1)..(1206): transl_table=11

SEQ ID NO: 69741 - protein, 401 aa, Methanosarcina barkeri str. fusaro; identical to SEQ ID NO: 14090

SEQ ID NO: 69742 - DNA, 1206 bp, Desulfuromonas acetoxidans DSM 684; identical to SEQ ID NO: 14091
  CDS (1)..(1206): transl_table=11

SEQ ID NO: 69743 - protein, 401 aa, Desulfuromonas acetoxidans DSM 684; identical to SEQ ID NO: 14092

SEQ ID NO: 69744 - DNA, 1293 bp, Jannaschia sp. CCS1; identical to SEQ ID NO: 14093
  CDS (1)..(1293): transl_table=11

SEQ ID NO: 69745 - protein, 430 aa, Jannaschia sp. CCS1; identical to SEQ ID NO: 14094

SEQ ID NO: 69746 - DNA, 1458 bp, Desulfitobacterium hafniense DCB-2; identical to SEQ ID NO: 14095
  CDS (1)..(1458): transl_table=11

SEQ ID NO: 69747 - protein, 485 aa, Desulfitobacterium hafniense DCB-2; identical to SEQ ID NO: 14096

SEQ ID NO: 69748 - DNA, 1218 bp, Methanococcoides burtonii DSM 6242; identical to SEQ ID NO: 14097
  CDS (1)..(1218): transl_table=11

SEQ ID NO: 69749 - protein, 405 aa, Methanococcoides burtonii DSM 6242; identical to SEQ ID NO: 14098

SEQ ID NO: 69750 - DNA, 1575 bp, Frankia sp. EAN1pec; identical to SEQ ID NO: 14099
  CDS (1)..(1575): transl_table=11

SEQ ID NO: 69751 - protein, 524 aa, Frankia sp. EAN1pec; identical to SEQ ID NO: 14100

SEQ ID NO: 69752 - DNA, 1200 bp, Ralstonia metallidurans CH34; identical to SEQ ID NO: 14101
  CDS (1)..(1200): transl_table=11

SEQ ID NO: 69753 - protein, 399 aa, Ralstonia metallidurans CH34; identical to SEQ ID NO: 14102

SEQ ID NO: 69754 - DNA, 1341 bp, Magnetococcus sp. MC-1; identical to SEQ ID NO: 14103
  CDS (1)..(1341): transl_table=11

SEQ ID NO: 69755 - protein, 446 aa, Magnetococcus sp. MC-1; identical to SEQ ID NO: 14104

SEQ ID NO: 69756 - DNA, 1305 bp, Mesorhizobium sp. BNC1; identical to SEQ ID NO: 14105
  CDS (1)..(1305): transl_table=11

SEQ ID NO: 69757 - protein, 434 aa, Mesorhizobium sp. BNC1; identical to SEQ ID NO: 14106

SEQ ID NO: 69758 - DNA, 1290 bp, Silicibacter sp. TM1040; identical to SEQ ID NO: 14107
  CDS (1)..(1290): transl_table=11

SEQ ID NO: 69759 - protein, 429 aa, Silicibacter sp. TM1040; identical to SEQ ID NO: 14108

SEQ ID NO: 69760 - DNA, 1305 bp, Nitrobacter hamburgensis X14; identical to SEQ ID NO: 14109
  CDS (1)..(1305): transl_table=11
